United States Patent 11,882,838 (BACTERIAL INOCULANTS) - sequence listing, part 6

SEQ ID NO: 2600 - DNA, 54188 bp, Unknown
  Kingdom: Bacteria, Phylum: Firmicutes, Class: Bacilli, Order: Bacillales, Family: Paenibacillaceae, Genus: Paenibacillus
cttgacaggggtatgaccatcccttgtgtctttctttctatagttaactgtcgcgttcgtatcttaggtctgatccactaggatgttttttcgaaaacgggatcaacgctcggtagtggaagttgtggaacgtctgttgttgtagaagaagtctgctggtgtgtatagctgaatgaaggggtctcgtattgcaatcccgccttttcataggtaaaccaatagctgacagccttcccgatatcgaggtctgtaacccgctgctcccaaacaccgccgttgtttgtcatccggtaattgagctgttgtccacccgttaaagtataatgcacgtcaacataggctgaggctgtttttttgggtgtaaattgaagcaatgcttcacgatcgctgacaaagcgagctcctactttataatcctccgtttctccgccaccctcattaccaccagatgctggctctgtcgttacctctacggaattgcttgctgcagataggttgcccgctgcatcgcgagccttaacggtaaagctgtaagtggaagctgcactcagccctgtaattgaagcggaagtaccgcttatctctgctgcctgagccccgtccttataaacgatataacccgtaacgccaacattgtctgtagctgcatcccactccagcgtgactaccgaagccgttttggtcgtagctcgaacattcgccgggatggatggagcctccgtatcaggttgcggattgccaccgccgcttccatttccggtattaaagctattcggctgcacagtaatactgtgcccatctgagaaggttaccgttttgacctggtttgtaaagttgtaggccacataagtttttacaccgtttttatgaaatacagcataaataggtgaattagcggtgatgctgcggtcgatgttgcctaaagcatccaaattgtagatccagtggtaggcattcgccttggaattccctgcttccggtgtcatggccgctgcgcgtgcactgaatttggccttggcatcggacgggtccgagatcgctctgtacatatacacaatatcttcccacggactgaagttcccaccgctttttcgcagcagatcgttatagttcttagccgcatactccgaatattgcgtcagatacaaggaggccgaggtaatcgggagccagttgataccatgcacctctgtggcattatcggtccaccatgttgcattccctaccgttttaccgccccagatcatgcttgccgtcgcgctttgcatccctgcaggggtgtttgtgccatgcacatcaaaccagtattcgttaatcgcattcatttccgttgtgtatagatagatgccgagatcacgagtttgagtatttcccgtcgcctcgccccataaaataagaccggcccaagcattcatcgcctccgaggaggattcattgttgttgccgtcgccaaatttggcatggccggaagcccaagtgtgcccggcatagggatcaaaattacgcaaatacggaaattttgaatcagacctgtcggtattggcgatatcgcgaatgagcaactgcaccatttgtccccattgggaatcggatgcccagttcttgtccacacgtgcaatttcggctgcggccttgataaagtagccataatggaaatgatggtcatttaattctaccgcactaccaaagctgtcgggataaccgatcaatgtcccccaatggttgttatacacaaatagactggagcttttcagattccccgagctgtcactggccttaaaccagtcctgcagccggcttttgatctcattgcggaactgggtcgctgctgcggtattgccagcctggtcggcaatcggcgccagcgctgctagcttgcccagacgttttccagtccagtacgtatctctatcgccggagtagacttctgctttcgcttcgtttatataattgttgagcgtatttttatcgtaggaccccaagtcgggcagggaaggcagtactcctgtaaatttcattttcgtttgaaaagacgcaccctctgctgttttcatcagaccgcgtacagaattgtacgtatagcctagcaggggttgtgatgaatttttccactgatgcgggtataaggcaaaaatagtgccgctttgtgtgccttccttcgctgtggttgcaacgttaaaggtggtcgttacctcggaagaggcttcgttatagctgtactgtgctttggagtttgtaacgaaagaataagcgtattgctgaaacttgtccaatgtcgcttttgttttgtcaggcaaagccgccactgtaaaatagtttttcccgttcaattgattgatcagagtactcgttccgaggccagaccaggtagtgccggaaggaccaaacagaccatagtgtgagccattaaccgtaattccaagcacaggagaactagctgacccagaccatacctctggcaccccattaaatgaaagcttgggattgccaccgccaaactcaaaaaaaacatagggggagccgtgtccataggtagcactcattttattgctgccgctttgaaataatgatttgacaaaccagtcgctgaaaccgtccaccttggcatcggaaaatgaagcgcttacagaatggccgacggtaaaatcgttcacatcatccatccagcctgcgatgtatccaggatttactgtaattttcccactcgggttaaagatgcgtaaaccgttttgctgatttttcaaggcaaggggatgcggatattgagcctcggagtagggtacccaggccagactgctccaccagtcattggtaggcattgggctggttacattcgctgttttgtaaatctcgttttgcggtgttgctgctccggcaggtagtgtggttgaatatgagccagcgccttgtgtgacctcacccgaaaaggctttagtagaaattggtgcagctaaaaatatcagactggcacttaacaagcataatatcgtttttttcacaacctacatcctcctttgaattctataatccctttcactgcaaggcttttcccttctctcttccaagttgaattcaacttcattgtgcttgatctcaatttccaggtcaatccttttatttctatattctaactaaacgaggcgaaagtctctaaaaatacataagaaaccagtacgaaaaacccaagcatgcgtaattatgttatctcgacttcaccccataagacattcaccctatgagttattcatcccattaaccattcaccctaataaacgtttagcatataaaaaaagaatcctccaggccttttaacccttcagattctctgttttgaatttataagtttttgagtatttagtttctcatgcccttcccatgctccgtaccatttcgaaaaacgagtgactttgcggtgggcagcagcggagcgagggggttgaatctggagaagcggtagcgttcgcctttgcagtgggattcttaccttttaaatatcttaatacaatccgaagaatcccactgcaacagcgatcggaagatcaaccccttcgcggagcctccttcactcgaaacaactcactcatttttcccgctcaaaatacccttctattttccagtctacgcccacctgcgttacgttcaaatcctgcaatgccaccgcatcgctcatcgcagacacgccctctcccccgagaaagcccggggctgcgcgccctccaaccagcttcggtgcaatatacagcaccagcttgtctgccagcccttgctgcacgaacgaagcgttcacctcggctccgccttccacgaacaccgatgacacctccgctgtacccagaatatccagcatttgcggcaggttaacccgatcgctgttttcatcctgtgtcggatataccctcacacctagctgttccagctggctacgcttgccttcatcataaacgcgtcctgtgaatatccaggtaggtgcctccccatctgtaatgacacgggcatccaatggaattcgaagcttgctatccaaaataatacgaatcggattccgtccttctggtagacgagtcgtaagctgaggattatcgtgaatcaccgtctgtacaccgaccaggattcccacatgctcgttacgaagacgatgcacatcctcccgtgcagcctcagatgtaatccacttgctttccgaggtccgggtcgcaattttaccgtccagcgttactgccgatttgatcgtaataaaaggacgcttgctcacgatatattgattgaacacttcattcatgcggatggattcctgctcacatactccgataatgacctcaatgcccgcatctttcaaaatctgtacccctctgccggaaaccagcgggttcgggtccagcgctgcaatcaccactcgacgaatgccagccttcacaatcgcttccgcgcacgggcctgtccggccgtgatgggaacacggctccagcgttacgtaaatcgtcgctccctgagcgtgttcacccgccatacgcaacgcatgaatctcggcatgtggctcgccgggcttcagatgagcgccgatcccaacgatacgaccgttgttgacaatgactgatccgacgagtggattcggttctgtttgccctttagcacttctggcattttccagtgccaggcgcatatatttttcgtgagtggtcatagaacctccctgagatcggaatcccgcaaatggccggatcgttccacttttgtattcaaataccgttcattatattgcgacacatcaccccagagcggcatgcgacccgccacattcatacccgacttcttcaaagcatccatttttttaggattatttgtaatcaaagttaccggtttttgtctcaggtgacggagcacactaatggcatccgcatagttgcgtgtatcatcttcaaaacccaattgatgattggcttcgacagtatccatgccttcttcctgcagaatataagccattgctttactaaacaaaccgattccgcggccttcatggttagccagatagaacaacgcacccgctccgtgttccacaatcattttcatggactggtggagttgaaatccgcaatcacaacgcttgctaccaaaaatatctccagtatggcaaatactatgcatgcgaactaatgcattttccgactgttcaagatcgccatacaccaaaacgcttgactgttgtccctctgccaaatccagtgtggacaatcgcttcacaatcgtctcagcggtggcattcagtaagtcctgacgatcttcctcatcccgtacaggcaaccagcagtaccactgaaaaacaaccgtttctccttccaaattaactggcagcttgatcggtcctaccaaaatcgtcgaagattgctctccacgaacggtttgaattttatcgttaagtagcgtagctacatctttttggttcatctctctgcaccatcctttatatgagctctatatagaaaatgcctaattcttcaaaggctaatcgttattgtcagggtataaatcattgaactatgtgtaagaaatgttcatgaaacgtggattccatcgtcagctgccgttcctgaagctcggtgacagcctgtcgtcgtccgtcttcgaacgcctttaagtcttctgcggtataactcttctgtcgtaaacgaagaagctcactggctagcacttcggcatccttcaaagctgcattcaagccaaaagctccggtaggtgtcatggtatgcgccgcatctccaataaggaccagtccgttctgcgtccaagtgtcactgcggctgctgaaaatatccaacggtacaaagtccttccatgaacgaatgtgatcatgcacactatgcttcaaatctggaaaagcctcggtaaacagttgtataaatggtgcaaaggattgcttaaacagggttgaaaagctaccttcctccacattccagccaatttgaatatagccctcagcctgcgagaataaagccaactgccctccgttgactcgtgccagacgagtgacgggctcccacccagcaggtgctgtgattttcgcccatagcagatcatagccgtgtcgaatgttcgtcacaggcatctgagccagcttgcgcacagtcgaatagcgaccgtctgcccctacaatcaacgaactgtcaatcgtgatctcatgaccgttcttatcgcgagcgctcaagcccgtgtacccctgctcactattaccttccaacgcagtcaccgttgtacccgccaggtaacggaaggactcgtaggttgacgcctgcttgagcagagcctccaaaaatcgaggttgtggaatgtgcactcccacattaccatggtttgaagctggctcgaccgttttgacctgctgccgatgctgccaatactcgattcttgtggaggcgagaatataatcctcatgaatttgttcgagcagcttatgcttttgcatcacttcctgaccctcattatttaaaatttcaccgcggaaagcctttccgggcacgctctgccgctcaaccaatatcgttgaaacaccctgctccgccagtaggcaggataacaaagtccctgcgggtccccctccaactacgcacacttcacattccagcttcatctgacttccccctacgcccaaaccatgacctcaacgattagtccgcacctggccatttaattacattattaataatatcaaaataagttcaaattttaagtattcatatatggatatccgtatcagagctaataagttactttatgtaacaaagtatatttatatcattccgtttcgtcaagtaataaatttatgtaaagtaaaatcatttacttttaacagtgaatcgttaataataagagcatgaggtgatcacatgaacattccgcagatgtgcccacggtttgaaaaagctatggagctactaagcaaacgttggacggtgttgatcgtatttcaactaaccaatggtccgcaacgtttcgtcgctattgagaattcaattcctaatttaagcggaaaggtcctttccgaccgtttgaaagagctggaggaagaagggatcatacaacgtatggtttatcctgagaagcctgtacggattgaatactctcttacagataagggacgcgatttagctcctttgtttgaccatatcggtacttgggctacacgctggattgaggttctaccagcactagaaaagcaatgatctatatggactacagctatttttcctaaactaacatgataaacacacacagaatgctaacatgccaaagaacgcctttgctctaagtgcaatttgtactcctagtgcaaggcgttctatttttcatatgaaggaactttaaacgtccccctcaccgctgcgttgcatttcctcacgaatggattgcacccgttttttcccccagtcatacatcatctccacaatcggtaaaatcgtcattcccagctcagtcattgaatattccacttttggaggcacttcgggatacacttcccggtgcacaataccgtcctccatcaactcccgcaactgattggtcagcactttatgcgacagcttcggaaacagcctttgcaggtcactgaaacggtgcgctccttccacacccagatgccataaaatgacgaccttccattttccgcttaacactgacaaggttagttccttttcgcagttatagtctccgttaacgatcttttcccgtatttcttctctcagcgtatcagtcatatatcaactaactccttctaaaccatcatggtcctgcactctaatagtaacctgcaggtaacctccgtacttgaaagtgcattcttcacagcctgacgaagccaccctacaatagtagataacgttacacattcaaggaggaataaagtatgagtaaaaaagctctttttattatacccccagagcgctttaatgaggatgaattgtttaaacccaaggaagcactggagcaagcaggtgttactgtgacgctagctagtacaaaaacaggcgaaatcacgggtgactacaacggtaaagcgacagctgatcttgtttttacagacgctgtgctggctgattatgatgtagtatctgtgatcggcggatcaggtacgaatgaccatctgtggaataacgcggatctccaagctctgctaaaacaaactcatgagcaaaagactttattggctggcatctgcgcaggctctgtagctgtggctcaaaccggactactctctggtagaacggctacatgctatccagtggatgtacaaaaagatcagctccaatcgcatcaagccgaatatgtggcgcagcatgtcgttgcgcatagcgacattattacggccgacggtccagatggcgcacaggcatttggcgaggcgctcgttcaagccctgcgataagcaccctttaaagtcccgtgtggggactaaaaacgagcatccccaaagaagccgcatcacgtcctttctattgtatgggacctgatgtggcttctttgtgtcattttcatgcttaagtgattaatttaattgtatggtcctggattttcgtgttagctttaaacaatcgacgtttagcataggaggcttatatgccgtgtttatgaaaggtaaaatccatttacatcaggtaacgtccgaatcgttgcgactgggcgccttactatcattagtagggggctttttggacacatatacctttgttggaagaggcggtgttttcgccaacgcacagacaggcaatatcgtgctgctggctgtcaaagtcattcaggggcactggattcaggcgttatcctatatcccacccctaatcgccttttcactgggcgtttttgttgctgaagggattaaacgaaaatcaacccaccgtctaactccggactggacccgtgcaattattttattggaaattgcaatttttttcatcgtgggactgattccgcaaggagttcccaatacggtagtggtggtgatcgtctcgttcgtcgcttccgtgcaaatgacttccttccgcaagctcattgatgtgccgtacacctccacggtcagcaccggtaacctccgatcagctatcgaggctgtgtatgtcgccataacgaccaaggacacgaacgctgccattcgagcgatgcgttatggtgttatcctggcagccttcttggtaggagccttgctggggggatttctaactttgacaattggggataaagccgtttggggcgctgttgttgtacttattttttcttttattttatttacagaaaaggaaaagtggaagcttcccctacgccactaatcctccattacatcagccctgaatgaactgccgctgggccgtttcaaagaaattcaaaaggtcttcgcgggacgagaatgctgcctgagcagattggttgctaccgccccccttaccgtgaaacgcgcccagattttcctttaaaaacgctccgcagctaatggattgggtaccgttgtgtgccagaatgattttgttttctgctgttgtggcaaataaaacaagcagatcatgctcagctgtcagcttggtagccaattgctgcatgtcctgaagggatttttgttcgaatacatgagcaagaacatgcccctgcacagcagatagcaactctttcgcctggtacgaagcattttcctcttgtaggagctccacttgcgccttaagctgcttatactcctgctcccatttttcgaatcgggtcaaaatatcttttcgcccggtattgaacttcgtagataacacgtccaatatctgaacactatcgttaaaatcctggagtgcgcgaacgccacatttgaaatggattcttgccatccccttctgcttctcccattttaagcatttaatgaacccaatttccccggtctgagctacatgtgtgccgccgcaagcattatattcaatgccctcgatctcgacaatccgaatattttctgtcactttgggcgttttcaccaacggaatatccttcaattgctcactggttacaaaaaaactttttatgctgcgattactatagatttgctgatttacttcctgctcgattgccgatagctgcgcaggcgttacatccgaacagttcacatcaatcgtggcatattcttgtcccagatgaaagctttcagtacgcgcacccaacaactctagacaaaccgctgacagcaagtgctgcccgctatgctgctgcatatgatcaaatctgcgctcccaatccaattggcaggctactttcctatcctccggcaaacgctctacctgatgccaaatatccccatcctcaagaaaaacatctaatacacggatgccctgaattgttcctgtatcacaaggctgacctccaccttgcggataaaatgccgtttcctccagcataaccaaatattttccgtctctttccatgctctgtgtaatatgagtgtcccactccgtaagatttggagcagtgtagtataattttgtcgtcattccaggttcctcacttttgagtttttggtctcgtacgatatccacttattatcaaacacttcattgtaaatatcaatgtagggaaaagcttgaaccattgcacgaacaacctccatatggtgaaaaatcgcatgacgattaacaaaatttagcttgaaattcatttttgaatagattaagattagtcggctaactaatttgtcgattggaacatactgtaagaagaaaggagaaccttatggattttgatttacgggacttgcccactcgtgaggcgctacaagaattttctaagcgtatccccgagattgatgtaagagcgacggaagctatgttattttttatgcgagtatcttccagtgtttttaaagtcagctttgagggctttgagaagttcggtatatctcatggtaaattttcgatattaattcttctgtatcgcaacatccatacagggttgctggctacagagcttgcggaaaaagtaggggttagcaagccaaccgttaccggtctcgttgaccgtctggagcgcgatgggcttattattcgatctgttcatccttccgaccgccgtatgagcattgttaaactgaccgatcaaggaacagaaatgatggaaagactgctgcctatacattttacaagcacttccacactgatgagccacctgtccaccgatgaaaaagagctgctcctgacgttactgcaaaaaatagaaagcggcatccctcaagcaaaagagatatataaagcagcaaaatcagaataagttttaatttttcgttttagttagccgactaatttttaaattattaaataaaagaataaataaaatgtacatatcaggatatttatttattcgagtctctgtttaactcattttatgaatttaaggagcgtattactcatgaatcgcacacaagtcaccagcctcatcatccctctcatttctattgcctgtcttatcggcgggggattcctgctccagaccaacggacaagatcaagtcaatgcttctcgatccgttaaaggcacaacactaaatgcggatagcattcatgtatcgtttgaacaagtaggaggcaaaatcctgaacatcccggtaacagaagaaactaaggtaaaaaaaggaactgtccttatgactttggattccacagatgtggatctgcaaattgagcagctgcggacacaaatcgcccagttcaatacgcaaatcagccaacaacaacaatccatcgatttagggtatacacgagcagcaactcaggaaaaacaggcacagctagatatcgcgcaagctcaagtgactgagcgtaaaagtcaggcggcattgcagcgggcacaagcggctgagcgtcaagccattgctgcggaacaacaggtcaataacggggctcgggctgaagatgttcagcagcaacgaattgccgtagcctccgctaccaaaaacgttcagacggcgcaaaccaactataagcgtaataaagcactctatgatgcaggaagtgcatccaaagcagcgttggatgatgccgaatcctctttgactttagcgacaaatcagttgagccagcaaaaagagtctcttcaaaaactacttcatggtgccacttccgaagaacgtatgcaggccagtgaacagacgacacaagcagccgtttcggtaaaacaagccgaggaagaaattcgcggtgcccaattgtccgtcgatcgttccaagacccagctggaaactattcagcagagtcgtcaacagttggcagatcagaagctggctattgacctcttaaagcaacaaaaagacacacaggaagttcagcttaaaacgttgctgctcaaaaaagaacgcttggtgttaaaagcaccacaggatggcaaggttacttcgattagtaccaaagtcggcgaaaatgtggcgcaaggggctcctgtgattaccctggaaaccaatgatttatattacgatctttatgtgaatgaagaacaagcggggaaattcaaggccaaccaagaaattaaaactcatatctctggtctcaataaggacctgaaaggtacggtacgctatgtaactgctgcaccacaattcgctaatgtgaagatgtcccgtgaaaaaggagaagcagataccgctacattccaggtacgtgtatatgtaacaagagaagcagctttgctaccaggcatgacagttgaggtgaatacaaatgaaatctcttcgtgatgaatggtcgtatctggttcactccaagtatccgatcatagctattatcttcccgttgattgccgtactggggtattcactgttgctcccaagcagccaaattaacgacgctaacgtggtagtagtggatcaagataacacagcttacagccgtgagttcattcagaaaatagatgcttccccgtatatgaacgtagctgagattgtttcgtatacggacaaccctgaacagtatttttatcacgagcaatatttggctgttatttccttgccgcatggtttagaggataatcacaatcgctccctttccagccgcgtgggtctcattctcgataataccaatgttcaatctatcacttcgattcgtacagctatgcaggaaattagcgtttccgagaatatggaattgtctgttccagctatgttgaaaaccgggatgaacgcagaacaggctcaaggggccctcaatggtatcgccttggaagtgcgttccctgtttaatccaaccaatgactatcagaatacgacaatacttgcattcacttgtatgttctcttttatgatactgaatataaatagcttacctctggtcgctagactccgggtttccaagaggctggctgctgagctgcaaaatccgttcaacatcctgctgcgtatgcttccttatacgctgttttcaacggctggcttaatcttctctctcgggatgctcaaagtgtttgggggaggccgtttcgaggccaatccgattctctttatgattccggttgtcctgtatgtattcggtaccgtttgtatcaatgtcctggttgcatggggcgctgcacatccgggaatagccattggccgaatggtgatgatactcatgcctgcttttgttctatcgggggctgttctttccagatcactgtttccacctttagcgattcaaatcggtgatttcttccccttcgtatggatgtataaattcctgcgcaccatgggtctgcgtggtgcacctttgcaggagatgcttcccgaactcggttctctgttactatatgtgggtgtgctctccatgctggtgatcgccagagccctatgggaaaaacagaagctggccaagcaaactgcgggttctgcttctgaaaagggttcaccacatcccgttgttccagcaagcacaactggcggcgggttatctatgcaaggggcaccgtcagcacctatgcacgagcctataaaaggatagagtctcgtctataaaataaaaaagggttaagtgccgtctaacgagccttaaccctttttcaataatattaacttcccattgttatcagaataaaactcacttatatgcccgacctaattgataagcgtgctccagtaaacctgcaatgtattctttcgactcggacaaagtatcatagaagaactccaccttggactctcttactcttgcgtaaccagcaatggctttattcaaataattagtaaccaaatcgtgatattcatacttgatcagatgttctttcgtccctcctgccaagcacatccacaaaacctgcttcgtcgtaaattcctgaagtaaacctttgttccagactttatccaggtacccttttagcatggaaggcacactgtaccaccatagtggaaacacaaagaccagagcatccgcagctgcaattctatccatttctttccgcgtttcaggagcatattgtttatgggtcgtattccaatccagctcatctgcagcgctgtacaccggattgtatccatcccgatccaagtccaaaatatctacctcgtgcttattctctttcaatccctctacaaaaagattcatgaccgcaagggtaagtgaatcctctctaggatgcgtcacgaccaatagaactttcatgttatccgtaaccttctttctcctcataattgttgaaccctgtctacagatgctattatggttgatatatatgaaagtgtgaagtacgcacttcaatgtactgtaggtacttttaggttccttagtgccttttgtactacagatcggagagggggaaagtctatggaacacaaagccaaaacctatatgctcgggatcgaggcaactttggaggtcatcagtggaaagtggaaaggcatcatcctgcatcatttaaccagcggcagaaaacgtacatacgaacttcgtcaactcattccgaaaatcacccaaaaagtgcttacccaacagcttagagagcttgaaaaggatggaatcatccaccgcatcatttataaccagattccacccaaagtggagtacgagcttagtgaatatggatgggattttaaagatctgcttgatcgtttttgcttatggggagaagatcatttggataggatctatggagataaaacaaaggtgctagaagagtattctgtgaaggagaaaaacgccaaacaagcaccacctctttaaggaggcgtgcttgtttgaaatactatagctgtgcagcttgtttatttaccagtctccgcaaatttccgaatacgagcctcgacttcatcccgtacacgctggaacacgctccatttctcttcttctgttccttttgctttagccggatcatcaaatccccaatgttcacgacgaacgtgcggaggtgtgataggacatttatcagcagcatctccgcacaaggtcacaaccaaatccgcgctgttcagcaaagcaggatctataatatctgaagtttgtccggagatatcgatccctatttcattcatcgcttgcaccgctttagggttaaggccgtgtgcctcaatgcccgcactgtatacattccaacggtctcccaagtatttttgggcccagccttctgccatttgactgcgacaagaattaccagtgcataaaaagtaaattgtcttcttttccatcattaccgtctccttcaatgttcaattatgaaatgattaaccatagatataagcccagtagggtcataaaaagtgtaggaatggttaagacaatgcctgtcttaaaataagttccccaagaaattttcacgtttttcgaacgaagcacatgcagccacaacaacgtggctaatgaaccgatcggagttattttcggccccagatcagaaccaatgacgttagcataaatcaacgcctctttgaccataccggttgtatgggtggcatcaatggcaagcgcattaatcatgaccgtaggcatgttattcatgaccgacgagataatcgccgcaataaaacccatgcccatggtggccacaaacataccttgatcggcagccgcttgaatcacatgggccagcagatccgtcaaaccggcattacgtagaccatacaccacaacatacattccgatagagaaaaatacgatggcccatggagcgcccttgatgacttctttcatcggcactgcagggcttctacgcgctatcaataagaaaaagatagcaataataccggccaccaccgaaacgggaatgttaaaaaattcgcatgcaaagtagccaacgaacaaaaccgcgagaacgatcctagacatacggaacatttttggatctttaatcgcttccgcaggcgtgattaattgtgccgcatcaaacgttttcggaatacttttgcgaaaaaaaagatacagtacccctatactggctgctaaagaaaataaattaggtataatcatgcgactcgcatattccataaaggtaatcccaaagaaatcggctgacacaatgttgaccaagttgctgaccacaagcggaagcgacgtcgtgtctgaaataaaaccgctcgctatgataaaaggaaaaatcattttctcatccaatttaagtgctcgaaccatcgccagtacaatcggtgtcagtattaaggccgcaccgtcattcgcaaaaaaagcagcaacaacggcgccaagaagggtcacataaacaaacatccgggttccgcttcctcgcgcagctcgtgccatgtggagcgccgcccattcgaaaaagccgattttatcaagcaccaacgaaatcagaataatggctacaaaagccagtgtcgcattccagacaatatgagtaacttcccaaacatcatgcaaatcgacgacacccaccagcaaggcgagtatggcacctccacaagcagaccagccgatagacagatttctaggctgccagatcaccagcactaaagtggctaaaaatataatgcatgccaacaaaatcaatgttttaaacctccatcacattaccttataaacatataattatgttaaaaacaccgtctatcccccaaggagataaacggaacagcctttaggatgagcagcaagccgatgaatccggtgcacaagatgctatcggctcctctttattcagccattttaaaatctgcttggagtctggcatacgctcaagaacggcttgaatatgcggcttgtcgtctacatttaaggaatagtatacccactgacttcgtcgttcttcttttacaattccttgcgactttaattttctcaaatgttggctaattgctggctgcgacatatcaaagatatctacaaattcgcaaacacaccattctctttctcttagcagggaaagcatagccaagcgggttttatcccccagtagctttaaatgatcggctacataaccaagttgctccaatgtgtaacctcctttcatttatataactgtatgcttatatactaatggagtacgtttttaatatcaagaacgataatacttatccattcaccaattgcataatccagtcttttatatcaacgattcgcagtgttttggggcgtgtattcgttccggaaataattaatgggacaagggaatctttttcatgcagcgaaccatgagcacctccaccgatatgggtgggagaactttcaccgacgagttcatatccgggttgtaccgtaacgacaatatatctacctccatgtgaatacattgccccgtgcaacctcgccaaaacgtctggatattttccatatttgatccggttgttatttatcgtaatatccacaaggtcttcttcgcccgacaatgtccacgattgtccatattcatcgatgtattttccaccaggatgataagaaaacagcttaccctttttcccccttgtaacatgaatattgtttttaccatctttcatagcgataatgtcgagcttgtcctcattttgtaaaaacttcaccacattggataattccacatcatcgtttatggcatagatataagccatccgttcattagcagaaatcacgatttggtcatcgtttcttactggttgatttaattttgcaatgcggtaatgattcaaaagcgactttaaatcaaccgttgctacctgtcgatcattataaatagcgctttgcgcactgtcacccatgacaatccatgtcgcattgtttacagcctgttcccacgaaccatatgcattcaacacagtttgcagtgcttgatccgctttttcgattccctccagttgagtcgggccctttctatgcgccaaattatcattctctggaaagtatgtgatggttacgtctggaagtttcttctgacttattagaaaagcggtatcttttgcggaaaattcgtcgttcatcccaaattttttccacaaaggagtattccagctatttttcggattcaattgtgccagagctgcataagataaccatttaggtcctgttactatcattttttctggcaccctgttgctattcgctatgaagtcaggcacctttaaggcatgtttcgttttccctctgaagacaacagcattgatggacgcggattctttacctttgtcagccaattcctcatgtatggttttcgtttttttgttcaaatgaacttggtttaattggtaaattgcgtctaagaatacttgcatttgatctatcttcaaggcttctttggcaccattgccgtagagaatcatgcgtttcttttggtcgctgtaccaaacgagtccaggcacatgatgttggtctgcatacgttcccgttaataatgtactgtcgattgtcacagacatcgtgggaaatgaactcactacctgcgggaaatattgcccttgtttcaggagatattgcattgccggtgcgcggcctgcttgaatcgcatcttgcaaaggcttatccattaacgaatcaatcaagatcataatgacaggttttttgcccatttgatttactgtaataggtggcttcacactctgttgttttagctgttgactggagtccgctctacagcccaagaccaacaacaataaacttagcactactgcaatggtaactttatttttcatgcccatgtatgtgtccctttcttagaaaaacttgatcttcttatttttttcttgtacttaaaatattattcctgcattggatcatcgggacaaaggtatctcatacaagcaattaaagttacacctccatgaattttttgaatctaataagccaaatttaagatcaaaaccattcagggagagagcataaccatgactacgacaaacataaatgaacattccatgcactatatagattctggtgaaggaatggccatcctattcattcaccctccagtactcacaagcttaaatttcacataccaaatccaaggactctcgccccattttcgaactatagcttttgatattagaggacacggtaaaagtcagccttcccagcaaacggttacttaccctctcatcgccctggatattaaacatttgatggaccggatgagccttgataaagtatttctgtgtggatattctaccgggggctcgatagtacttgaattcctcttgacttacccagatcgggcatggggaggcattgttatcagtggaatgtcggaagtaaacgaatggcgactaagaaataaaatttctttgggcattgctctttccaaaatcggtacaatcggtacgattgccctttctaatgcttggtcacaaacgaaacagctatctttattccgtaagttattcaacgatgcgaagcagggaaatcccaggaatgtcgaacaatattatcgatacagcttgaagtacaactgcacctcacggctcgaggaaatccatcttcctgtcctgctcgtttatggtgaaaaagataagcactttcatccctatgccaaaatattgcatcaacaattaccaaatagtgagctggttttccttaagaaagctgatcatcgccttcctacgaaggccgccggattattgaatgaactgatcaagcagttcgtagatcggttcagcctttaaagcaaatcctacaggataattccacatacatagctacattccactcctgttacgttaagcgtcaaatagccccccacctgttcaacatccgctggccatgacatgcggcggatgggcattcctttccggaccccggccgaaaggcaggaatcagcacattacatgccgttttctgcgccatcgtcgcgcaaccttacaagagtgttaggcaattgtcatctagatcaatggtatcaacctagctgctcctctatactaatccattgataggattatttttaagggggagttggcgtgaggttttttgaaatgctgctattcttttcaagtgcttgtttgttggcactcctgttcattatcaatcaacgtatccgaagaccagctttgctcctgacaagcggagcaggctccatttttttagtgatacatttgcttgtcgaaggatacagggttcagcttttatttttatacggatttacgatcctgatgcttatgctctcgcttatagacgttttcataacgctgaaagtcgttcggactgcctcgcgaatccgtagggtgctgggccgcctttttatcgtgattgggctaatcgcaacggcgtgcttcctctatgtgtttcccgtattcgactttccggcgccaaccggcgagttgaaggtaggcacgaaagtctttcatttcatcgatccaagccgggaggagacatttggcaaaaccgcgacaggcaaaagggaattgatggttcaggtatggtatccggctcaagctggcaccgacaagtacgctccctttattcccgatacccagattttacgttatatggccgcggactatggccttcccgggtttacttttcaacatctgaagtacgtatccagtcatgcttattcgggggccgaagtctcttcggcacagacttcatacccgctgatccttgcgaatcccggcaatggctcttccaggttcctccacacgtcgcaagccgaaaatctcgcgagtcatggatatatcgtggcagtgatcgaccacacctacaatacatttgcaaccgagtttccggacgggcgaatcacgaccagcacaaccaacgacttattctcgcccgcccatgattaccagacgagtagaggaaatcgcgacaagttgggacaagttttaaccggtgatgtggcgtttacgctggaccaattcgagctcatccaatcggggcagtttccaagtcatctaaaagggaggattgatctcggtcatgtcggggtgttcggtcattccatcggcggagcgacgacctatgacgcttcttacgatccgcgaatcgcggttggaatagaccttgatggagggctttatcgactgcgtgacagagagggtctgcgaaagccgtttttgttcatcaactcggaaagctatttcgaaaaattaaaaatggtgatggataaccgggtctacacggatgcagagcttaaccgtatgggctcaacaagagagtgggaggatcaagtaacggaagataaaaagttggagcttgaacggatgcgcgaagcggtcgacgaagggggacaagtcctctatatcgaaaatacggagcatttgaattttgccgacgtacagttcatttctccgattttcgaaatgctgggcattacaggaaagattgcgcccgaaagagcgaactccgttatcaatgcctatatgctggatttcttcgataggtatctgaaaaatcaaggcggaaacttaatgaaaggaccggatagccgctttccggaggtgaagttcgtaacctcgctattataaattacggaacaggctaccgattttgatatgctccccttcaagtaggcaggtttaataaataaaccgctacttgaaggggagttttcctttgtctaagaagaacgcatacaatgcgattgagaaactagccatcatacaggagttaaaagcaggacagagcagccgtgtggaagtagcaaaaaaaacataacatcagcgttaccaccttagtgaaatggcgacatcgctatgagttgtacggaatgggaaagcgaaagctatgagcaaggggcggtctaccaatcatcaggaacgaatagacagtatctttgcctgtatattgtcctgctcatcaaagtgaaaaatattatataatattttacactatgtaaatatacaaattatgctaaagtcatatatagtttggttgggataggtatgtattcggaaggagtgtaaaaatgaaatgctaaagcgtattcagaatctttttgttatccctaactacccattgttcatgatctgcatgttattgcaaggcatggctatatccatcagcgcaccttttttagctgtatattttacaagtacacttggggtatctatgggaacctttggtgtgtttacagcggtaactttgatttgtggcatatggataagctctctgattgccaaacgttctgataccggattagatcgtaaacaaattttggtgatttgtacgttatttaatgccatagcctttgcaggatatcttgtaatccaaaatttttatgtactttttgtttatatgacgatcttcacggccattggtgctcctgggatgccgcagttatttgccagtgcacgtgaagcagtagatcgcagtaaatctgcggatcacgcctttgctaattcaacacttcggtctatgttttctcttggatttattaccgggccgctttttggttcctttttgattgcacatacgggctttaaaggtatctttatggggacgacctctatttttgttcttattgctgttcttttattcttttttatccagcagcctcccgctcagcttaaacataagaatcaactttcacttcataacattacattacataaaaatattgagattctgatccctttctcagttcttactctgctctatacgtctcactggatgaacaatttaaatatttccttgttcatcatttacaatttaaaaggtgacacaagtgacgttgctctagtatccagtatttgcgccattttagaaatacccttgatgctcatgctaggcgtactagcagctaaatactccaaccgtttgcttgtatttttaggggcattaacaggagttgtctattatatccttgtccttatgtctacggagatgtggcagctattcgtggggcaacttcttctagccttctttgttgcagtgatttctgccattggcattagttacatgcaggatttgttgccctctcttccagggtacgcatcgacgctatattccaatgcgacaactatcggaagactggtggggagcttgatgggcggattaaccgctcaatggatgggttaccgaaacacctattgggtatgtttggccctaatcatctgctccctgggtctcctggcaatttcgaagaaattagagtttgaaaaatctgctgctttaaaagaaaggaatcacagtatatagactgcgcttatttttctatggtggagaaatgactcataattgtatctgccgcatgtctgtacccaccagcctgacgtaatgattcgccgatcacatgagcctgttctttataggtcggatgactcaatacctctaataaggcagctctcaaactagcgggtgtaagcttatttttatccacaacaacacccgctcccagttcctgcacccgactagctacgatcggctgatccgatgttaaaggaatcatgacctgcggtacattgtaatataaggcttcacttgtactgttcatccccgcatgtgtaacaaaaggtcggattaacatgaccttcagctggcgtgatcactactaacacacgtgccatatcctacacctccaaatcaataataaatttcaatttgagataaatgcacttttaacatagcaaacatttaccatataaacaagttttttcaataccgaaaattaagtatgtatcctctactcaaactatagaaataagcgaggctgaacgctagaagcgcttgccccgcttaaccactgaacatcaaatttaaagacgccaatcccaatgatctgtcccgctcagaacagcttcaacggtgtactgacttgcttcatcagcggtaagctgtttggcccaaggtacacgcccgctacttcctgcacctggtccaaagttgtcaaactctccaaatcttgcggtttgctcattggattccttgccccaattgttccagccgcccggcttgatatggtcatccatataggtcttcaaaaaagtaacatgagcataagggcgccatggccgtccaagatccaccttgcctgtcaagccattttctgttgtcagacgacattgaataaatacaaagcccggcttgttctcttctgttgaagctgctgtcacatatccagcacgcaggctgtgtatgatcgaattatcaaacacggcaggtgcattgccaaatataaaatctacactaccactgatgtagctgtccttaaaatactgtctgccacggttcacaagcaacgtatcctgtaagccggtaattttgacattgtgatacttaccacgatcaccttcggcatataacgctacagcctgcacctgcccggttccttctgtattggcaaccgtgacattctccaacacaaaatcgggactttgcacacgcattgtatagctgttgcttgttcctaattcttttccgtccaccaccgttttggccgtatcatcaaaagcaatgatcgttttgtcgcggtcttctccgataatactcagattttttttggaggaatgcacctttattttttcacgatacgtaccgtttttgagatggataactgtccttgtgtttctgtcgtcagggactgcgtcaatcgctgcctggagagatgtaaagtcagcagggccataggtcgctaccaccacactagtgggatgagttcctcctgagtctgtcaggttgcggagggtgacattgctgaattccgacgtattgtaattccatacatcgttttgttgtttggatgcatcggtggccaacccgaacaatagcggctgattatccggcacatctataacagtttcaccaaccttctcccagttcgtcacaccatctgcggatacccagcctgtaaccttttgtccttgtcgtaccagacgaaccgaatatggcgttgcaataaacgtctccattgatgcacgtttcgtcttggcatccgtttgatcacgactaataagaataccctgtttgccatatttaacaaatgctaaagacataaaggccatttttgatccaggcttcagcgactcacgaatcattacacccgcttcggcattatcatccaccggagtaatttgttccacacgggctgtaatttcagtgttaccttcccatttttgataagcataatggaaaatatctgccttaccgtcaacgtctcccgctgacttcagtcttatactgctgccgcttgcatcttcttttaagacctgagtatgcccttttatataaccatcgttgccctcagagccaatctcttcgctgagccaacttcccgatggcgcagtcgtattgacgtgaatggtaacaggattggaaaatgcagcagaccccttgcgatcggtcacccgtacaataatataatgggcaccgtctgttacatgattccaatcgagatgataaggcgcggtctctactttaccagcaagtttgccgtcaatgataaattcaacatgagcaataccatctttgtccttggctgttgctgttatggtcgcatcacggcctgcttccaaaatatcgttatgctttagtgaacgtccgtttgcatccgacacctgaacgacggcctctggattatccacctcatttccattcgacagcttctcaataagatcatttaaatagacctccagattggtataacccttggcaaaatgagcatacgtccctgtgccggcaagcaattgaccgttacgatcatctgcattattggggtccagcccatgggcacgttcccattcatccggcattccatcatggtcactgtcagaaagctccgtcgtcgttacgttagaatcgtcgtaaatccaccctgcttcacgcggagagttaataaacgcacccgttccattcttcacatcattcataattcgggcgtccaccgcatctcttcttggcagcgtggctcctgagccggcaagcacctccgtatatgcggtttgtgcatccgtcgcttgatatggaccatacgcatccggtgaaattccgttgtcgtattcccctctgacttcaatcggctccgccaaacgggtggaaggatcaataattgacccaatggatgtgccaagctgccagttgtctttcgtaaccgagtcattgccgtacatgtagttaccaccaataaagatgcgtgttttatattttttactacccacgtctacaaaaatttgaccgcgaacgtcctcatatgtgttggggccatacttataatagttattcagcacattatacaatccttcaccgccaccgtatgaagagaaaaatccccagttataaatgacattattggtcatttccacagcgtcgatttgttttttatcggttggaaaacgcggattacgacttgcattgtgagccaacaaattatgatgataggtggaatttcgtccgccccatatgccgccatagccgtggcgacctttctgatgcgtggtcattagcatactttcggacgcaatggaccattgtaccgttgtattgacgttgtcatacaggctcagtacctcatccaccgaccagctaaaggaacagtgatcaatcattatgtttttatggtatctggctcctaacgcgtcatcctcactggggtaacggtcggtcaatcggaaacgtaggtaacggagaatgacgttatctgcatcaatccctgtcgtgtaatcgcttacagttataccatcgccaggagctgtctggcccgcaaccgtcaggttgtttcccaagattttaagtggctccttgagatgaatcgttccacccacccggaatacgaccatccgattatcggagctgactgctgcacgaagagatccgggtattatctgttcccctttgccgtagtctgccagcgtggtgacctcatacacttcacctccgcgtccaccggtaacatatttaccgccaccctcagcccccggaaacgccggaatatccgtcgccacttttgacacctttgcgttctctgttcctaccgcagtctccgcttggattagtggtgggcacaaggtcaacaacaatgaacccacaaccacattacatagcacctttttccatgtacgctgcttgctcatattctgtttcctccctaagattttcttccacatcagcgcatatttttataaaaacacgatccgagacgttcagaagcgccttcacctcctttcatcaatcttttctgcttttatcattggcaggttgtcatatatactggtggtatatgaatgcgcttacttatcttaatttgtaaaggaagaagcacatgaatgaaatgaaagaagataaatatgtccttggcgaacaacaattctccattcatcacatctatcgtaccggtttcacggttatgccccggcctcatgtccacgagaactatgagctgtatctcttactgcgaggagaacgcatctattttatgaatggcaaggtatacaccgctcgcaagggggatctgatattcatccttcctcatgacttgcactctactgccagtacgcaattgcaggaaacagagcgcattttgattcatttttctccgacgtttctcccacagcaggatcatgacattcttgacctgccaccgtatcagcaatccgcgttgcttcgcttacctgcgagagagcaagtggaggttgaacgtttattcctacagatgaataccgaatgcaggaataagcagcctctgcatgaccgttgcgtacagcatttactgctggaaatgcttattctggtgcaccgatcggaagcgatcgagcgtagtgaacctgttccctctcatcccatgcatcagaaaatcacggaaatttcttcttttattcaggatcattacaatgaaccgttaactctcgaacaagtggccgcctgcttcttcatcagtccagcttacctaagtcgtatctttctaaagttgactggttttcatttcagcgaatacatccgcgtagtgagggtcagagcggcccaaacaagacttcgaaccaccaaagacaaaatccagcatattgcagaggaagttgggttcggtcatgcttcccactttaataaaatcttcaaaaaaataactgggctctcccctcttcagtaccgcaagcaggttcggtagatattcagtgtaaagaattagacgccgactttatacatccgctcttgtcttgtttttccatttttatatccatttgctctttcatggaactaaagacaagccgctttggagcaagtaaaatgcacaaaaaaaccatacttcgctgcaatgcatgcaacgaagtatggctattccatagtcattctacatctttaaaattataaattacactttctatgacctttatcgcaatgctttaatatcctgaatcagcattgcaacattttctttctttgtagcccaactagtacagaatcgaacagcactatgtgcatcatcaaccttttcccaaaaggagtaagtatatttttcactcaatgcctttagtatgcgatctggcaaaatcggaaactgctgattagttgtagaacggtattgaaaagaaaaaccttgctcagataatccgttttgaagcagcattgccatatctatagcgtgtttggaaatttcaacgtataaaccgtcttcaaacaaagtttcgaattgaatgcccaacattcttcccttagccagcagtcctcctttttgcttgatcatatatcgaaaatcttttttcaatgtatcatttagaaggactactgcttctcccatcaaggctccaattttggtcccgccaatataaaatacatcgcatagcttcgctatatctgctaaagatacgtcgctatcttcggccaccaagccatagcctaatcgggctccatctataaacagtggtaaaccacactcttgacagactctacttaatgcttccagctctgatttgctataaatcgttccattttcagtaggttgggaaatataaaccatcccgggctgtacactatgctcaggagcggcatcattccagtgagcgtcatatagctcctttacctgctcggcccgaattttcccatcatcacttggcaaagtaagtactttatgcccaatagcttcaatcgctccggtctcatgtacggcaatatgtccagaaactgcagcaacgacgccttgatgcggacgcagaatagaagaaatgacggtggtattggtctgtgtacctccaaccaaaaagtgtacatccgcatttggggagtcacatgcttctttaatatatgctctggctttttcacaatgatcgtcgagaccataacctggagtttgttcatcattagtctccagtagtcgctttaatatgcgctcatgagcaccttcggtatagtcgcattcaaatcgtatcattctgtatcctctccaaattatccaatttcttctgaattaacaacatagaagcatgtaattccttaatctcttcttctgaaagtccttgaactaattttagaatttgttcatcagacctttcattcagttggttgtagaatgcttttcctttaggagtcaaccgaatcagatttgttctattatccaacgttgaattttccttaacaagaaagccctctttgcaaaatttagcaatgatcctactcatatagctgcgatcaattttaagagattcgactagagtattcgcaatacatggctcgatcaacccgatctctataatgacacgggcctcagtaaaggaatatccgctatccagcacatgtctatctaaaacacctagtatattcgtatagaaccgattaaaacgcctcatatccgctatcatattagcatctatattgatcataactcccccaatttagtggacttttgcaacaattatagtaatgatttttgtggactctgtcaatgaaataataatcaatatcgacaaaagaaaaaatcgtacattaagacactcgtctaatgcacgatttcatatatttacctacaaggtcattgagctatcgctatttatagccttttccttcttatgcttccgtttcagcttcagatgagctacgaccatgtacagcgtcggaactacaaacaatgttaaaatagttgaaaaaattagtccgaaaataatggtcgttgccaacggtttgaacaagatctcgcctattgtggcaatagggatcatacccacaatcgcagttagcgaagtaagcaagatcggacggaaacgggcagagcatgccattagaatggcgtctgttaaatcagcgccttcacgccgcgcatcttcaataaactctatcagcacgataccgttacgcacgacgataccagcaagtgaaatgatacccataatactcatgaatccaattggcatccccgaaataaaacttccaaggattccccctgccgctgccagataaacagtggtcataataatgagcggtgtggaaaccgagtaaaactgcatggtaattaagaggagaataagaaaaataacaatcacagctaatttgcccaaatccttaaacatatcagactgcgcagatgtttcccctcccatctcccaggtgtagtctggttcaaactgggtatttgtaagtttgctacggatatcattagtgagttctgtagccgtacgcccatttccattggctgagatcgttaccgtccgttccagatcatagcggtggatttgttggatggaaaagtccggtttcatcgtggctaattgggataaggggatttgctcccttgccgcattgttcacacttaattgttggaataatacctcaggatcatggtttggtttgttcatgtatatattgacatcaagcaattccttacccgtatcaaaatccgttacattcaccccgtcacccattaatagcaaagtacgcgttaaatcggaatagctaacctgatatttatccaaggcttgctgattaatttggaaattcagattatagctttgcatacccatattatcggtcacatctacagctccgggggttcccgcaacaatttctttgactttagttgtcatgttttgcagcttatcaatgtcttctccttttatacggatagacaccgcactgccgaccggaatacctaattggggaacacgaatgctgattaatgcagatggatatttagcttgtagcgtatgggtccagttatccactgtttttttgagatcaaatagcccctcttttccaacgacagcaatttggccatttaccgcccccccagagccgtgaccacctgcaacatcgctgtacaactgaggcgctcctccacctgccgttgccgccaaccgctccgtttctggctgttttttgacccacatgccaatctcgttaataacctgattggttgcctgcaacgatgttccttctggcatcgttatactgatcgtggcatccgcttgatcggaatccggaaataactcaataggaacaacagctagtagtccataagctgctgtacccatcataagaccaataagcgctgttaaaagtgggcgtcgcagtattcttggcatccagtttttagagtacacattggatagagactggatttgattccccagaagtccaggtggcttaactgtcctactactctcttttcctttacgacgttgatcataccattgacggaaaataggaatgatcgttaatgacataatcatggacgccagcatcgttaacgaaataacggtaggtatcggtttaataaagtcaccaatggtgcccggcaggaataaaagcggggcaaatgctgcaaccgtagctagtgtagctgtaatgattgataaggatacctctttcgttcctttaatggctgcctccgtagcatcttccccaaattcagtgcgtcggcgttcaatattgtcattgaccacgacggcatcatcaaccaatatccctagcacgatgattaatccgatgactgaaatttgattcagcgtgattcctgttgtgggcaagaaaataaagccgatggcgatggaaacaggaatggccaaggccacaaatgcagaagtcagcaaatttaaacctaatgtacatataacaatgaccgatataatagcgatgatcatctctttggtcaggtttccaaacatttcatctactcgatcattttgcgcaaaaagcagctcaaaatgtacattcttcggcaaactgctaacaagttcattgattttggctgtagtcgctttagatactgttggcacgtctgtgcctgtatctccactcacactgattgaaatagcaggcttgttattcacatacgtataactagctgcttttttaaaaacaagtgaggctgtccctacatctttcagagatatcgggaatccatcgtcattacttgaaatctggacgttatttagaatggatggatcggtagaggcatttaccgtcaactgataagtacgctcattgaaatccatactacctgtaggaactctttcattctcatttttgattgcttgaacaacctgctcccaggagatgttatattgttgcatcttttgtgtgtctaaactgattcgtacttcttgatctggtattccttgaatattaacttgcgaaacacccgagaccgtttttaattgatctttccatttgttcatcaattcattcaacgagtataaattctcaattttatcagaagtaatcgcatatgaaccaataaaggagcttgtcatgctatcattgataaccggctgcatcgcatcatctggaagctcggactgtgcatcctgtacctttgtacgaagatcagcccatacctttgtcgggtctgcatcttcaaaagcttctacagttatactagattggcctttagatgaagtggaagaaaccgttttgacaccttgtacggctttaattttctgttccatgaccttagtaatggtttgctcgattctttcgggtgaggcgcccggatagatggttgtaacactggctgacaagggaataacatcgggctgctcttgtttaggtaacgatgtaaaattatagagccctagcacaatgcacatgccaaagaaaatgagtgtaattttttgttttttaacgatatatttaatcattcggacgactcctccgatttctcaagtacgtcattcccaattaaatcaccattaaataaggttcctgctccttgtgtaacgatttgatcgcctgcctgtaatccagagaccacttcgagctgattattagtcactttccccagtttaatcggtgttttgacggcttttccgtttacagctttaaagacataaggatcatttcccgtactaattacggcctctacgggcactaaaagcgcttcgttttgattcatgcttttagatgcgcttatgacttgaccaggtttccaattcagttcgggattgggaatgctaacttctacattgatgcttcccgttttggagttagtcgatggatagatctgagtaacggtccctgttctaatttcatcgtagagagagatatttactttttggtttttcttccacgataagatttcactgtccggtacggggaggagtacttttaaagtcttgatatttccgacaacaaatgcctcactcccgctggagcccagttgaccatcagatatctttttttcaatcacaacacccgtgatcggggaagttaaagttgcttttttcagtgacaaggctgactgttcataagcagccaatgcatcttcataggtagcctgcgcctgagctttactggctagtccttgttgtatagtagccctagccgattccagccctgccctggcctgatctacgccggccgaagcttgggcacgctcttcctgggatgcccctgcaagcaaaagagacaatttctcttgcgcatcacttaagcttttttgtgcgtttgctaattccagctgcgcattctcattttccgttaatgatactgcacctgcctggaatagactttgggaccgtgcggcatccgctttcttcttgttataattattagttgctacagtaaccgcattttgagactgtgcaatctcctgctttttggcgccattgttcaattcctgcaatttggattgggccgcgttgacctgggattgtgaactatgaatgcccgcctgggccgattggacagtagcctccgcttggcttacaccagcctttgccttttccatggttgcctttgcccgatccagctgtaactggtaagcagatgtatctaacttcgcaaggacacttcctttttctactgaatccccaacttcaaccatggtgttcaatatacgtccatccgcttcaaaggaaacattggcctcattacttgcctgcaatgttcccgccaaattaaaatcattggccaaaggtttcattgcaagtttctcaattttcaccgggtgactggcttctgttacagagttctccgatgcactggagcaaccggaagctactaaggctaatgcaacccctgcaatcattatcctgatttcttttctcttcaactaatgtcatcctctctgattctctcttctaaaggtgctatcagcaacccgtgggtcaagtaaactttttcatccttttttcatgttatagcaatgaacaaacaaaaaaatcgtacaaaggggcaagcaccttatgtacgactgggcaaataaataacatattttcagttattatttctaaagctgtaaaataccacgttccaacgaaacggcaacggcttcggatctggaatcaacaccaagcttgttataaatattcgttaaatgtgcctttacggtacgctcggaaattcccatatcaaacgcaatttccttacttttaaaaccatgtgcaacagactttaatatgtgtctttccttatcagttagaattaagtttctttcgtgtgattctatctcagcttctctcttattcgtagtagcaaatacccttgctgttatttctggctgaagcagcgtttcaccccttagcgcagactcaatagtgcgaaataagttttctcgactggtatcttttagtaaatatccttttgcccccaatgagagtcccttaatcattaaatcatcttcgttataggtcgtcaggataatgactggtgtttcattttgtttttctctgagggctttcatggtttccaaaccactcatttgtggcatatataaatccaacaatatgacatgcggctgaagttcttcgatcaatttaagagccgttacaccttctccagcttcaccaatcacttcataactgtcattggtctccagcaccagctttaatccttctctaactacccaatgatcgtcgacgattaaaatcttgtatttcatgataggtctcctttagtaagaggcgcctctatttttatagctgtaccttcttgaaatatactgctgatattgatttttccacccagcatccgtacacgctcatgtatgcctattattccgtaatgccctgtttgcttggcaataatatctgtatcaaatccttttccatcatcgcgaatctgaatttcaatcttgccttcattatctaaaatatgaatccatacggtattagcatgtgaatgtttcgctacgttggttaaacactcgcttataataaacaatccatgttcgaacaacagtctggggacggaagctttaattttgatgttgcgtattacacgaatgctcgtagccattgtaaatcgctgtatttcttcctccactgcttctgcaaaatcaacttccgagatggttttcgaacgcagattgtctatagctcgccttgaatcagacaatgttcttcgcacttgtgacatcgattgttggacgatctcctgagctctttgcgtactcccttttgtcagatgggcatcaatggcttcaagttgcatgattagcccagcaagcccttgagccagcgtatcatgaagatcacgggccatacgttgtcgttcgttagcaattgtaagttcttcgaccttttgatgtgcgatttcaagttctttaagaacgttttgcgttcgaattcgtgctttgacttgtttgagaaaaagaacggcataagctactataacaactgcaattagaaaaaatagagggatgaacaaaacaaactgcctgccatcattatgccagaccacagccacacaaaaaagtacataggagatcaaaaatacaagaatgaccttaagcggcttataataaatacctatactctgacccaccaaaattggcattaaccccaccagtacaatggaaaaactgttaggtagaagaaatgcacttgaaaagatcaatcccccttgcacaacaaaataagcccatgaaaaatgtttcgcaactctatgagcatgcaagtacaagaggatgtgcaatatgatgattacagtgaataagacactttgcagcagatttagacccccgaacaaatgttgaagaatgacagactcactataaattataaaaatccatattatagttaatacttttgaaatatctttcttctcaaattcaccttcactttcacttatttccggatctagattttggacctgtacattgaattcatcgttcataattccctcctacaattctgaattcggcttttcaacttattagagacaacgccgctatgacgacctggtcaatttagtttggacagaaatcatttatatattattttacaaaaaaacaaacagaaaaaaacgtacacatgggcaatatcatttgtacgtttgggcattaaatactatttgttcgactccagccaatatgtgtcatataaaaagcacgcaacaggttatcctgtgcgcgcttggtcattctctatttttcctctaactcatccggtacatcgtatttattgatatgtgaagttattgctgcaacggcttcgctggcatccgtcgtggccggtacttctctaaccacatcatccgtctggtcacgaaaattcaagcggtctgcctcgatttccttctgttgattgggtttcatttttcatatcgctcctttcttattccagtgcctgatctcgttctgttaacgtgtataaaggtacttcccgttcctcttctggattgctcagcgcataaatgcgtgccgtctcactctgctcgttcacatgctgaatataaatgggtaacccatcacacaacacattcgccataatggaagaggacgctatttcttgcgctctttgaacattcacttagaaaaaacctcccttgctaagtagagttcgcctttactatgcacgagttaaatatttgttatacacatttcatgccaacatgtgtttcacgatcatgaaaggatatcatttgaaaaaataaatattattgttattatggattaagagattcagtgaaaactgcgatcttaattgtagaaaaaaggagtaatgatggatgttaaacgtattaatggttaactttccggcagaaggacatgtaaaccccacgcttgggatcacgcaagcctttgcagcacgaggggaccaggttcattacattacaactgagaaatacaagaatagactcgaagcagttggagcgaaggttcacctgcatcctgatctagtcaggactgcttccattgataccaacactccggcaggactgaacgcatttatgaatattcatatccagacttcgatggacatcttagccatcactcaggagctgtccgagcgtattcaatttgacttggtgttctatgatcgattcggagctggtgaattagtaagagattacttgaatattccaggcatttcttcatccccatcttttctcatttcaaatcatctgatggctgccaatctcttccgctccgatgctaaagtaccgtttcagcctgatgaacaagtcacgtcttcactgcatctcatgaaagaaaggttcggtgttgctcccaaagatctggttcaatttatgaacaattcaggagctttgaatgttgtatatacgagcagatattttcaaccgaatggtgaacaatttggggacgagcatctttttattggccccagcttcccggagcgcaaaggagaaaattcattcccgctggacagcctacagggtaaaaaggttttatatatttcgatgggaactgtgctggaccacactgaagacttttttaacacctgcattgaggctttttccgattttgaaggcatcgtcgtgattgcagctggcgagaaagctgactttaccaaaattaacccgactcctgagcactttatcatctcgtcttatgttcctcaattggaggtattacgtcattcagatgtatttattactcatggtggaatgaacagtgtgaatgaaggaattcactttaatgtacccttggtcgtgctgcctcaggacaaggatcagcccatggtcgcgcagcggttaacggaacttcaagcgggctatcgaataactaaggatcaaatcaatacacaaacgttaagagatgccgtacatgaggtagtgtcaaacgcagcgtataaagagagcgtacaaaaaataaatgacagcttccagcaatccggcggtacaaaagaagctctcgcaaaaattgatgcttatcttgatgcttatctgcaacataagcgcgcctaaaatcacacgagcaaaatggccacaaaaaaacaggaatctgaccatccacggtcaggttcctgtttgtatgcgattctatgtgaggatatcccacttctggaacgaggcaatcgtacagtttccgttcgcgaacgctcgaatgcccgtagattccaatcccggatacactcttcctgtgaggacgtattcaccgtcgccgatgaatatttccaccgagcttttatcgacaaaaacccgaagctccaggcggccctcgtttaagcccaaaggcactcttctctctccacccgggcctataccggcacgttctcggttaaaacggaacagaccgtcatcgggacggtacgacagtacagtctcctcttcgctacccacccgcagtttcaaaccgaattcatcggtgttactggactcaaactcaaatacgaccttcagttcgtagctatctccgcgcgtgtccataatctgctcacctgtcagtaagatatctcgctgctcgaacagattgcatcggtaattctttacctcttcaagtggacggaacagcagcctggcgccgtcgataaccgcttcccgcggaagactcatcgcaccagcccaatggtgcccctcctgagtcggcatctccgactcccacatatccatccatccgataacgatacgccgccctttatcatccaaggttgactgtggtgcatagaaatcgaatccgtgatccacctgagcataccgctctgccgtaaatgttccggcaacggaattgaaatcacctataccgtacatggtggaatgcagattgcggtaagcctccccctgtgcaggcatgcgctgcggggatagcataaatacgtgccgaccaccgagcgggaacagatctggacactcccaattatcaccgaagcgtccgtcactcacggctagtacattgacatacgtccagcttttcaggtcttcagaacggtaaagcagtacaagtccattccctttggcatcattagacccgagaacggcgtaatattgatcttcgtgcctaaacaccttagggtcacggaagtctttacggctgatcgtgtccggtatagcgtcataaccgatgaccgggttgccctcccacttttcgaacgttattccgtcttctgataatgcaatttcctgcgactgcttgtaatcctgatctttgtcaggcccggttacaacatgtccggtatacatcaggacaagctttccgtcccgctcaatcgcactgccagagaagcagccatcctggtcgaactcaccgtccggtgccaaagcgatcggtagataatcccacttcataagatcgcggctgactgcatgtccccagtgcatcggtccccatactgatttatacgggtaatgttgatagaacaagtgatattgcccgttatattgaatgaagccattcggatcattcatccagcccaattcagccattaaatggtagtgcagccgataatctggccgaagcatatgcttcgattgggaaataaattgatctgcacgctctctcgtatacgttctagtctgtttgataaagcatcctccccctgcagttatttaatcgagccttgcataacaccctgaataatatacttctgggcgaacagatagatgataatgatcggaaatatcgtcagtaccaaacttgccatcaatggaccataatccactgtataggttccataaaagttatacgtggacaacggaagtgtcctttgctccggatcgaccagaatgagggaaggcaacagaaaatcattccagatccacagtacattgagaatggaaatggtggcagtcgtgggcatcagtaccggaaacacaatccggaagaatgtctgaaaccgcgtgcaaccgtcaattagcgccgcttcctccagttcctttggaatactctttacaaaaccatgataaatgaagacggccagcgagctgccaaaaccgatatacatgtaaatcaacgaccacttgctgttcagcagatcaagtgacccgtagatttttaccaatggaatcatgatagcctggaatggaatgatcatggatgcaaccatcagcataaatgtatattggttgaacttggtgttgtttctgacaaaataatgggccgtcatcgccgcgaacagtgaaataaacagaacacttaacaccgttatgaccaatgagttggtgaaggcagcgatgtaattcattttatcaaatgcattcatataattgaccatactgaagctctctggaagcgataacggatttgaggtgatggccatgttttccttgaacgaattgatcagcagaaagacgaaaggtacgatgaacaatatgagtatgactgtcagcacaatgaatttgatcacggaggaagcaattctttttcttgtcattacgcctccacctccaacttcttgctaaaataaacctgaagcagagtgatgagagcaaccatcaggaacaacacgaatgcttctgcctgccccacaccataatcacgggaaaggaatgccttttcatacacatgcatcgacaccatttgagtactgctgaacggcccacctttcgtgagtgcaaggttcacgtcatagaccataaatccgcgctgcagggacaagaatatacatacgatgaaagaaggaaccatcaagggcagcaccattttccgcagtctggtccagctgtttgccccatcaatgcttgcggcctccataatatcattcgggacaccagtcaaccctgcgatgtaaatgaccatcatgtaacccgcgttctgccacacggttacaatcacgagtgcccagaacgctttgtcgggatcagccagccaagtcgtgctgagcgactgtatgctggcatgttgtcccaaatagacaagcacgttgttgaatataaactgccatataaaaccgagtacaatgccgccgacaaggttgggcaggaaaaatcccgcccggaaaatactctgtccttttaacccttttgtcagcacataagccagcataaaagcgatcacattgataagaacaacggtataaaacacatacttgagcgtcaagctgaacgatttccaaaactcaatatctctaaaaacagccagatagttttggacgccaaccagcgatagtgtggtggaaataccatcccagtttgtgaacgtcagatagatgccgtacaaaaatggaatgatcattaccgttatgaaggcaaacaaggttggtccggtaaacagcagccgcgtccgcagccgattccatactcctttttccgcaatcatgatgatccccctctctttgtccctgatttctctctctattccgggtactttgaaaacaaccttattttacggtcttccagtagttttcgatttctttaaccagtgttgcacgatcgccctgtttcgccagatacttttgcatggaagatcctgtcttggaccagtggtcggcaggcagcatactcatcgactgctctgacttgccttttgcgatataatcctggatggacttgcccagcgggtcggccgcaggcagtgtaatatttttgaacgccgggatgatgtttgcttggttcacgaggaaatcctggcctttctcttcatagacgatccagttcaggaacttcttcgccgcctcttgctgttctggagtagccttctccttgtcaataacaatgcgcttggatacagcagacgaaatctcctgattgccgtagtcatcggcattgttgctgatgggtacaggcagaaaaccatattctttgttagcggtatcaaaactgttgatttgcggccatgcccagttgcccatgaaccaaatgccaacttcacctttgccgagcagttccggtccgcgttcataagttcctgctagcggagaagcctgatcgatattgtatttcatcatgacgtcgaatgtatccataagtccgttaaatacaggattattagccaagtccgcctggcccgcttttagtgacgccatgaatttgtccacttcagccatgtctttgttctggcctgcataagcaagaggcaaataatgagcgcccagggaccagtccattgatgaaatcaccagtgctttctttccggatgtctcgatttgctgaaacagtttttcaaggtcatttcgggttttaattgtggtgggatcaaagcttccgcctaccgctttatctacaacggctttgttgtaaatgaatccgtagccttcaacagccagtggaaacgcgtaatttttaccatcaactgtcgtagcagtggtagcgttttcaacagtgtccgcattccacttttccccgcttagatcgaggatacggtccttaaatttctcaacatcacctgtatctagcatgatcatggtcggtgggtttcctgatgcatacaaggcagaggcacgctcaaaaggagatccaccagtcggaaccggctggatttcaacagtaatgcccggattgtctttctggaacgccttcgcggcttcctccagctgtggaaggatttcgcctttggagttcaaaagcgtaattttcacatttttcgaatcccctgatccccctccagaagccgaattaccttctcctccggagccactgcatgcagacaccaccataaccaaaagaagcagcattaccatccattgaactcttttgaatttcctcattgttgtcatccccttatttatataatggctctgaacgcttaaataaaacgcttacaaacggattatatgtcaaaggtttaatttgtgtcaatcgtttgacatgttaaatttttaacatgtactaaaaaaaatctgttccccttgttagaggaacagattttcattcaggtcgttgcacgctcaattagttcaacaggcagcagattgacaggttgtacctgttccccttccgcctgcctgcggatcagctcgaccgccagtctgccgatgtctgcaatcggctgtcttaccgatgtaagttccggcgtcagccaggaagcaacgcttacatcatcgaagcctacaatgcgtacattctctggcacatgccttccagcgcgaatatattctttcagcgcaaaagcagcaataatatcacttgttgcgaacactccatcaacatccggatgttcatgaacgagttttgaaatgattcgctcgtactccttctggtcgaacacattcaagtctgtttgaacgatcacatgctggacaccatccctgcccacgacatcccggaatgctttggtccgctcattggacagcatgttcagctccagatttccgcatatatgcgcaattttctggcagcctttgctgatgagcagctccgtagccagctcgcctccgcgataattatccgaggatatgtaaggaatacacgggtcaatctgtctatcaaatgtcacaatcggtgaattcaaatgtcggtactcttctacttctaatgtatggctacccataatgatgccatccacccggttccgcttcaacatatcgatatacactttttccttcacgggatccatatgggaattgcacagcaggaccttgcagttttgctgataggcatagaactcaacctgattggcaagctcactgaagaaaggatgcgagacatcgggaataatcaggccaataatattagactgcttgcgcaatagggatcgtgctatttcattcggttgataattaagttcctccattgcgtcgaacacttttttgcgtgtagtttcgctgatatatccccggttgttcattacacgggatactgttgtgaccgacacgcccgcttttaatgctacatcatgaattgtcgccatattaacctcttcccgcacaaaataaatacatacaaactatactctctcctcatcatttcaacaaccttacataacggaagcctaaaaatggacgtaaatgttaggtgacggaactttgtgaatcccaaattagaggttacagcaagttctactaacttcatataaactgatcatcatacataattcgcgaagagatttcttcttccatttgttcaccgcctgctgagtgattttgagttctcatttctataaaataatacaacagcctatccaattggataggctgttggttgctgaaagtattaacatcattctgattgtgcgtcagtcggtgcattaatgtatgtatctgtaagcacatcagtcggtgcatccgcaggcacattatccgttgccgattcactgttctggagtagtgctctcggataggcctgtgcacgctcatagtaccagttaaacaagaagcgggccatcgcctgacgtcgggtatcgccatcccactttaaccctgctgttgggtccgcaaatgaactccttgctccagattccagcagaaagccattcatgtgtgcggtcatgctgacattaccggctgctgtaaatatggacttcgtgtttttcccaaatccatcattagagccgttaaacaaattccagtactctgaatcgccgggttgtgttttgaaccaggtaaattctgtaatatttattggataggcttgagctgccgccttaatgttggaatcccattgcgattgcagcttgtccttgttatcataagctccgtagcctggataccagtggacagcatagccgtagttgttcaaggggtctgtcagcgggtgttttgccaccgggctgtaaaattggttgtatccaagtcctgcagcccagatgacattatccgctcctttacttcgaatcgtggaaatgatagagttctggaatcttctcagatcattccaatggtcaagaaaatcattctcgccgggatagcctccccaatgcccattcgcatacgacttaattggctcgttgatcagttcaaacatgacgttatccgcgctattaatagccggctgcgaggcaagatacccccagatttgattaaatttgtccaaattggattgtgttgtaccctggtcgttagccaaagtgaaatcaagaccaagagtaacataaacgccctttgttttcgcataattgatgtatggaataatcacattttgtgtaactgcctgtaaaccggcgaagttgtatgaccctgcggccacatctcccatatcctggcggtcaataaacaatcggacctgattcatataccaaccgtggttgcttccatacttcggtctggtgtctgtaaaggtgtcggtgatatccttcaaataagccaaaattgctgcatgacgattgttaccattcaatttgagataataattactgttttgataggtccagtatgctcccgacggctgatgccagccactcaaaacaacaggttttccgctgctgttcaccaattgattgcccctgacatggagctctcccatgggcatacctgaccatgcatctatatgttggtcaaacaccggttttaaaggcaatatgaatacaagtatcaaaactattttacataccatacctaattttttcaaagaaaggcctcctcctcaaaaatttaattgactattatgccaaaagaataaaatggtataaacatgtagtggctccgcttcctgagtctatcctattgcaaaatcatcatctcccttaatggaaaattataacgtttatttgtatttcttgcatctaattgtataacttacatttccaaaccacaacttgataaaatttagtttttttaaatttttttcaagtgttaagtttgctatagtctacgcctcaatttcaagctacaatgaagataccaaatatggaagagttttatattttttcgataagccggtcaatacttgaaataatgtattattgccagccgtttctttcatgtttggtcaatcttttatggaggtgtaaagtgaagaagaaatcttggtttactttaatggtcacgggtattgtctctctgtttttttcggtaagcgtttatgcggggaatgttttttgggaaccacttaatagtttcaattctggtgcatggcaaaaggcggatggatattccaatgggaacatgtttaattgcacttggcgtgccaataatgtcaattttacgaacgatggcaaaatgaagcttggcttaacaagttctgcgtacaataaatttgactgcggagagtatcgatcgacgaacacttacagatacggcttatacgaggtcagcatgaagcctgctaataatactgggatcgtatcttccttttttacgtatacgggacctactgatggcacacaatgggatgaaatagatattgaatttttaggcaaagacacgacaaaagtgcaattcaactattatacaaacggggtcgggggtcacgagaagattgttgatctgggctttgatgcatcaagtggcttccacacctatgctttcgattggcagccagggtacattaagtggtatgttgacggggttttaaagcatacggcaacttcaaacataccaagcacgccaggcaagattatgatgaatttatggaatggtactggcgttgacgactggctgggttcgtataatggagtgaatccgctatacgctgaatatgattgggtaaaatacacgagcaattagcccgtagtacaaaagcagccctgtaggggctgtcaggctgtcgagaaaccccctgtttttttgcagggggtttaaaactgtcttagtggtctaaaaactagggtcctcagatcgttttaaatcgatttttgttttaaaagatgcgtctccccatataaaaatagaagtgtcgaaaagtcctctggactttctcgacactctggcagccctgtaggggctgcttttttgatgatgcattgattcagccatgttccggacataaagaaaagaagcataatttcctgatctgaaaatccaattcgcgacatcatttctttgccaaagcgactgagaaattttgaatacatagctatttgcataaaaagtacagcggagaagctctgcttcctaaacctcttatttcaattccccattttttaaactttctttagaattatatgcatagattactcataaattttcgttaagaattttaaggtacgccgagtacattgcgttcctccgttccagttgtccggtagagtgcttgcacttgttgaactaccaatacagtcccttgcgatacgccaataatctgtgagaactgaattcgattgagtttattcgttttccgaatactctttatttttccccctatatcttcattgttccacctacttatctataaaaaaataaaaacagtcccgatataaaaactttccattgagactgtttgagttaaggtactgtattttcttgtaggtaatatttcaaattaagaatggtgttgtatttataatggaaaaaagtgttaggtgataaacgcgaaaaataaaaagtctgaaaccaccacaaattaccgtaaaaagaaagttggaaacttgtactattacgataataaaattctcataaccatttcctcaatatactgaatgtcgcatataacgtgcttaaatgatcaattttctttttcaaagaattatctctaataatctgtccatctttagtccattgtccatatatttgaactaaccgccctgtagttcgtgagagttcaagaagtactgtgccattatatctctagctagttattaattctctttttttgtttgaatgatagcttgattttacttcattctttaaatagtgaacttatggaatggtttgattcttagtataccaaaggtaaactacgatttctgttgtgttttgtcgattttccaatattgaaatagttactcagcggcacttgacgtcagattcctgtggtgggtttttccctttcatttggaaaaaaacacccggcaggatgcgtaccgagagaaatacggcatacacccaagccgggtaagggattagaaaataatatcaatggcctctagcacatcttgctcctgttcggattgcccgttcaaggaaatatccttcaacagcaccgaaggctgttcgcaaatttgggtgatgatcacgagcaggtcctgagcgaaattgtcgatcagattgcgcgtaaacaacttggtggcatattcaaactgcccgttcattccctcatccagcaacgaaatgaccaaggtaagatcaaattgggaaaccgtatgagtttccggataagattcgatctcgatatccccgaagctttgaacgttatcttccttggtttccagaacaaacatgacatcgaatacaggattgcggctttgatctcgcggcgcctgcagctttttcacaagctcctcgaacggataatcctggtggtcgtaggcccccagcatcgtttctttgacttcgttcaagtaagcgaggaacatctgctccccggacggataatggcgaatcgccaaagtgttgacaaacattccgatgagcggctccaggtcggcatgtgtgcggcccgaaaccggtatgcctacaatgaagtcttcttgtcctgagtacttgctgagcaggattgaataggccgccaataacaccatataaagggtggcaccgttctcatcggcgatgcgctgcaagctgtcggtcatctgcttgtcgatgctgaaaggcagcacatctccctcaaagctgcgagcggcaggtctgacaaagtccgtaggcaattcaagcgttggcagttcgccttccagcacgtccagccagtaggcttcctgacgtttcagccgctcttttataggttcggactgctgccaagcggcaaattccttgtattgaatccgaagcggttccagagtctcgccgttatacaggcgcagcagctcttcgacgaagatgcccatcgacatgccatccgtgacgatatgatggatgtccagcatgagcagatgccgttccgcttcccattcgactaagcccacacgcagcagcggcggccgctccaaatcaaagacgcgcacaaagccgtctacgatgctcttcgtttcactatccgtcgctttcgtatactcgacggcaaacttcaagtccggataaactcgttgtaccggttcgccgtcgaccatttcgaagccggttcgcaaaatttcgtgacgagctatcaatcctttgagcgccgcctcgaattgattccgttccaagcgcccgacgagaaccgtcatgccggacatgttgtagctaagctcggcgccttccatctgctgctggatgtacagccgtttttgcacggaggaaagcggatagtaatccctcttatccaaaaccggaatggaaaggtgttcctgccgctccaattggctgatcgcttcggccatcgcttcgatggtcgagtgccggaacacatcgcgcagcggcaggtccacgctcagctccttgtgcaccttgctgaccagcgtcgtcgcccgcagggagtgcccgccgaggtcgaagaagttgtccgtcacgccaatcgtgaccggtccaagcacgtcctgccagatggcgaccagtttcgcctccagttcggtgcgcggcgccacgtattcgcggcctgcgcttgctcccccttccggcgccggcagcgccttccggtcgattttcccgttcggcgtcagaggcaggcgctccagctcgacgaagtacgacgggatcatgtaacccggcagctcgctggcaatcgcccgtttcaggtcagccgccgtcagttcgccatccgttgtgtagtacgcgcacagcgctttctgcccgttcgcatcacttcgaaccagcaccaccgcttcgcgcacgccttccacccgcagcagttgcgactcgatctcgcccgtctcgatccggtagccccggattttcgcctggttgtcgatccggccgatgaagtccacgttgccgtcttccatccaccgcgccaagtctcccgtgcggtacagccgctcgcccgcggcgaacggactgtctacgaacttctcttctgtcagctccggacggttcaagtacccgcgcgccactccgactccgccgatgaccagctcgcccagcaccccgaccggcaccgggttcagatgcgcatccacgatgtagaatttcgcattcagccacgctttgccgatcggcacattgcctgtctgcggcagcttcgccagctcctcgtcgtagaaactggagtcgatcgccgcttccgtcacaccgtatgcgttgatgatccggaacaacgagccgaagcgttcctgcaaggttcggtaatccgccacgctgcagctgtccgagctcgtgatcaacagctccatccagttcatatccagttgctgctcgtgcacgtaatccaggaacggcacgagcagcgccggcgtcgattcgaagatggtgacccgctcccgctccatccagtggtgcagacgtgacggatcgatccggtcgtccttcggcacaatcaccatcgtgcctccgttgtacagcgtccgcgcgatatctcccacgaacacgtcaaacgagaagcttgcgagctgcagtaggcgcaccgggaactgatccaactggtattcccgccggtagcccgccgccgtattcaccaggctgcggtgctcgatcatcacgcccttcggcttgcccgtcgttcccgacgtgtagatcacgtacgccaggtcctccggacgggcttcatggaagctgtcggcattcgtccgctcctcgctgtacgaagtttcgtcgtcgaggtacagcaccgccgccagcgccagctcctcttcgccgagccaggcttcggcgcgctctcgcagcgccgtttgcgtcagcagtaccttcgctccgctatcttcgagcatgaaccgcacgcgctccgccgggtaatccgggtcgaggggcacatacgccccgcccgctttccagacagccagcacggccaccagcaagtccaccgaacgctcggcgagaatgccgacgatcgtctcccggccgatgccgcttgcgcgcagcgtagccgccaagcggttcgcccgctcgttcagatccgcatacgtcagccggtcgttctcgtacacgacggccgcctcttccggcgtgcgctccgcctgttcctcaaacagccggtggaacgcggccgcaggagctgcttccggctgcgccgggttaaacgcgccgagaatttgctctttttccgccggtgtcaaaatacccagctcggcaatagtcgccgacgggttgcggagaatggattcaagcagctgcaagtagtgtgcggccaatttctccaccgtttcggttttataaagagcagtggcgtattcaaacagatattccaagccttcctcgatctccgtgacgtccaagctgagatcgaatttagaaacaatttcttcgctggcatacgtcgacaaatggagtccgggaagctggatttccaaattctctgtattctgcaaagcaaacatcgtatcgaacagcggattgcggcttaaatcgcgagccacgttcaccttatccaccagttcctcaaacggataattctgatgttcaaaagcgcccagtgtcgtctccttgatttccttcaagtagtcaaggaacgtcttaccggcagccggataactgcggatggccagggtattgacgaacatcccgatcagcggctgaacgtcgctgtgatttcttcccgcaatcggcgtacccaccaccacgtcttcttgccctgtatatttatgcaataatattgtataaccagcaagcagaaccatgtaaagtgttgcgccgttctcggctgcaagccgtttcagactctcgcttttctcgctatgcataaacaattgcagcgtacggccctcgtagctctgcatagccgggcgcggatagtccgtcggcaattccaaaaccggcagctctccgcggaacatgtcgagccagtaggcttcctgcttggcaagctgagctttctgctcgtccgattgctgccataccgcataatctttgtactggatgcggagcggctccaactgctccccgctgtacaagcggacgaactcttcgatcagtacgtcaatcgaaacgccgtcagatacgatatgatgcgtatcgaacattagaatgtgccggtccggcgccagttcggcaaggcctacccgcagaagtggcggcttcgctagatcaaacggacgaacgaattggcgcaccgtttcttccgcctgctccccgctgatctgcacatattccacctggaaggcggcttcttcgtaaatccgctgaaccgcttcgccttttaccatctcaaagccggcacgcagcgtttcatgacgagctacgagcccgcggaacgcttcttcaaaccgctgccggtcgagctccccttcgagcagcatagctcccggtatgttgtagctcagctcggcgccttccagctggttcaagatatagagacgtttctgagcggaagagagcggataatactcgctaggttccgtagccggaatagccgtgaacgagccgatctccagccgctccatagccgcggccatttcctcaaccgtcgagtagcggaatacgtcgcgaagcgggaattcaacgcctagctccttatgcattttgctgacaagcgtcgtcgcccgcagggagtgtccgccgaggtcgaagaagttgtccgttacgcctaccgccttctcccgaacaagcacatcctgccaaatggcggccagcttcgcctcaagttcggtgcgcggctccacgtattcgcggcttgcgcttgctcccccttccggtgccggcagcgccttccggtcgatctttccgttcggcgtcagaggcaggcgctccagctccacgaagtacgacgggatcatgtaccccggcagctcgctggcaatcgcccgcttcaggtccgccgccgtcaagccttcttccgctgtataataagcgcacaaagctttctgaccttcttgatcttccctgacgacgacgaccgcttccttcacgccacctacactcagcagcttcgcttcgacttcgcccgtctcaatccggtacccccggattttcgcctggttgtcgatccggccgatgaagtccacgttcccgtcctccatccaccgcgccaagtctcccgtgcggtacagccgttcgcccgcggcgaacgggctgtctacgaacttctcttccgtcagctccggacggttcaagtacccgcgcgccactccgactccgccgatgaccagctcgcccagcaccccgaccggcaccgggttcagatgcgcatccacgatgtagaatttcgcattcagccacgctttgccgatcggcacatggcctgtctgcggcagcttcgccagctcctcgtcgtagaaactggagtcgatcgccgcttccgtcacaccgtatgcgttgatgatccg

SEQ ID NO: 2601 - DNA, 4642 bp, Unknown
  Kingdom: Bacteria, Phylum: Firmicutes, Class: Bacilli, Order: Bacillales, Family: Paenibacillaceae, Genus: Paenibacillus
aagaagcggtcattatggcatgtacggacgaaacgggccaaacacagctcgtggcgtactacgtggcgagtcaagagcttggagcgggtgaactgagacaggagctgggacaagagctgccaagctatatggtgccgtcgtatttcattcagttggagcaaatgccgctgacaccgaacggtaaaatcgaccgcaagtccctgccagcaccagaaggcggtttgcacagcggagcggattatgcagcgccacgcactgtaacagaacgaacactcgtagcgatctggcagtccgtcctgggcgtgccaaccgttggtattttagacaatttctttgacctgggcggcgattcgatcaaggcgattcaaatcgtgtcccgtgcgttccaggcaggctacaagctggacatgaaggatttgttccgctatcccattgtcgcaaggctggcaccgcatatgcacgaggtcagtcgtatggcagatcagggagaagtgagcggagaaacggcgttgcttccgatccagcatgggttctttgcgcaagcccaagtggatgcgcatcactttaatcaggccgttatgctgcaccgggagcagggctttgacgaagctgctctgcgtcaggcacttggcaaactagcagagcaccatgatgcactgcggatggtgttcagcaagaccgagcaaggctataaagcatggaaccgcggaatacaggaaggcgagctgtatcatctggacgtgctggactttagggatttgacggataaagccatactcagcgcggcaattgaggcgaaagccaatgaaattcaaagcagtatccagctgtatgaaggaccgctgttaaaggcgggtttgttccactgtgcagatggggaccatctcctgatggcgatttaccatttggtcgtggacggggtatcctggcgtatcttgtttgaggatttggctactgcctatgaacaggccgttcatcaggaagtgcttcagctgccggacaaaacggattccttccgttcctggtcacaaaaactttccacctatgcgaatagcacagccatggacagtgaacacgcctattgggagcaatggaacgcagcggcttgggctgaccaagtacgtttacctgaggatcaagcgcaggctgagccctttaccttggctgacacggatacagtggtcgtccagcttacggaagaagagactgaacggctgttgaagcaagcacaccgcgcatataacacggaagtgaacgatctgcttctgacggcactgggcatgatgctgtacacgtggacgggtcatgaacgcagcctgattaatttagagggacacgggcgtgagaacattttgccggatacggacctttctcgtacggtaggctggtttacgagtccatatccggtattgctggacatcggtcgtgatcccgcttggtcagaacgtatcaaacaggtcaaagagagcctgcgccttattccgaataaaggaatgggctacggaatctggagatatttgagtgaatccggtcaagcggttggtcagcaagcaggtgtgctgaaccttggtcaatatcaagcttttgccgagccacaagtaagctttaactatctcggacagctggatcaggacttgccaaacagcgatatgcgtaggtctccttactcaattggatcgatcgctagtgaccggacgaagatgaaatatgcgctagatgtgagcggaatcgtaacgaacggcatcctggaactcgacattcggtataacggcaaagccttccgtaaggacaccgtccacatgctggctaatctattaaaatccaacctgcttgaaatgatcgagcattgtgtcacacgggagcggaccgaattgactccaagtgatgtattactaaaaggtctgacaatggagcaattagatacgattaaggagcagaccaagacggttggggaattggaaaatgtgtatccgctaacccccatgcaaaaggggatgctgttccatagtttgatgaatgcagaaacaggcgtgtattttgaacaggcaacctttgatctggaggggtactttgaaccgtccctattcgaggaaagtctgaagatgctggttagccgacatgctatattacggacgaatttctacagcggctggtatggtcaaccgttgcagattgtctatcgtcataaaaatccgagcttcttttatgaggatgtcagagggcgcgaacacgctgtagctgaatttgtgacccaggataaagctcaaggctttgatctaagcaaggatgcgcttatgcgagtatccgtcttccgcacgggtgaaagctcataccgttttgtatggagcttccatcatattgtgatggacggatggtgcctgtccctgatgacggacgaagtgtttggggcatatgttgccttgatggagcacaaacagccagagctcgcacctgtcaagccgtatagtgattatatcgaatggctggaacaacaggatgcgcaggaagcaacccgttattggagtgactatttggcaggttttgagcagcaaaccttgttgcctggggagaacgcacaagcttctgtcgtcgcacgcaatgaagaatcagacggaagcggtggaagttcaaatgccggctatgtttcggaaaagctgccctttaggttgggtaaagaacggactgcggcattaaaccaaatggccaagcaacaacatgtcacgattaacacattgctgcaaagcgtttggggcgttattttacagcaatacaataataatcaggatgttgtgtttggtggtgtggtatccggtcgtccggcagaccttccaggcgtggagaacatgattggattgtttatcaacacgattccagtacgcatttgcagtgcaccggatgctacatttgctgaagtattgcagcgcacccaggaacaggctttggcctccagtgtctatgatacgttcccgctatacgatatccaggcactgactgaacaaaaacaagacctgattcatcacattatggtctttgaaaactacccgatcgggcagcagatgaagcagatgggcggttccggcgagacaaaggcacaaacaggcttctcgattgccaatgtggcacttgccgagcaaaccaactacgattttaacctgattgtcgtgcctgatgaggatatctctatcctgcttgaatacaatgcgctcgtgtatagccggtctgccatggagcgtatccagggccatatcgaccatgtcatcggacaaatcgtgaataatccgcatatccgtgtgaatgagctggaattggtgacaccggaagaacaggcacagctcgttcaggtctggggggatacggcggcagcctatccgcaggatcaaacgctaagtgcactgttcgagcagcaggcagcgaaaacaccggatcaggtggcagtgttgtgcggagcggaatcgttgacctacgctgagctgaatgagcgcgcgaaccgtttggctcggacgctgcgtgcggaaggtgttgaaccggatcaacctgtaggcatactggttcaccgttcgctggacatgatcgtaggcatttatgcgatcctcaaagcaggcggagcttatgtacccatcgatccagactatccggcggaccgcatccgctttatgctggaggattcgggtgcgaagctgatactgacgcaattgcatttggcggagcaagcctcactgagtttcgacggccaggtgctggtgctggatcgcgaggacatttaccacgaagacggctcgaatctggagccactggctgggccacaccatgtagcctatgtcatctatacctccggctccacgggaaaaccgaagggcgtgatggtggagcaccattccgtgctgaaccggattttgtggatgcatgatcggtacggcttgagtgcggaagatacgatcctgcaaaagacggccttcacgttcgacgtgtcggtgtgggagctgttctggtggtcgctggtcggctcgaaggtgagcttgctgtcggtaggcggggaaaagaacccggaagacatcgtcgacacgattgcccgcgatggcgtgagcacgatgcactttgtacctgccatgctgcatgcgttcctagaatatgtggagcagcagccacaggaagtgatgcaagcgaagctgggcacgctgcgccacgtatttgccagcggcgaagcgttgccgccacagcatgtggcacggttccaacggcttgtgtcgagcctgactggagcgaagctgatcaacctgtacggcccaaccgaagcgacggtggacgtatcgtacttcgattgcgagccggatgaggaatatggagttattccgatcggaaaaccgatccaaaatattcgtctgtacatcgtgaaggaaggcacggagcaattgcagccgatcggggttgcaggggagctgtgcatcggcggtgtgggcgtagcccgaggctatctgaatcgttcggagctgacggcggagaaattcgtagccgatccgtttgccggcggggaagcaggctatgaacggatgtaccgcacaggcgatttggcgagatggatgctggacggcaacattgaatatctgggccggatcgaccatcaagtgaaaatccgggggtaccg

SEQ ID NO: 2602 - DNA, 4657 bp, Unknown
  Kingdom: Bacteria, Phylum: Firmicutes, Class: Bacilli, Order: Bacillales, Family: Paenibacillaceae, Genus: Paenibacillus
aagaagcggtcattatggcacgcacggacgaaacgggccaaacacagctcgtggcgtactacgtggcgagtcaagagcttggagcgggtgagctgagacaggagctgggacaagagctgccaagctatatggtgccgtcgtatttcatctggttggagcagatgccgctgacaccgaatggtaaaatcgaccgcaagtccctgccagcaccagaaggcggtttgcaaagcggagcggattatgcagcgccacgtactgtaacagaacgagcactcgtagcgatctggcagtccgttctgggcgtgccaaccgtcggaattttagacaatttctttgacctgggcggcgattcgatcaaggcgattcaaatcgtgtcgcgtgcgttccaggcaggctacaagctggacatgaaggatttgttccgctatcccatcgtcgcaacgctggcaccgcatatgcacgaggtcagtcgtatggcagatcagggagaagtgagcggagaaacggtgatgcttccgatccagcatgggttctttgcgcaggcgcaagtggatgcgcatcactttaatcaggccgttatgctgcaccgggagcagggctttgacgaagctgcgctgcgtcaggcgcttggcaaactagcagagcaccatgatgctctgcggatggtgttcagcaagaccgagcaaggctataaagcatggaaccgcggaatacaggaaggcgagttgtatcatctggacgtgctggactttagggatttgacggataaagccatactcagcgcagtaattgaggcgaaagccaatgaaattcaaagcagtatccaactgcaagaaggaccgcttttaaaggctggtttatttcactgtgcagatggggaccatctcctgatggcgattcaccatttggtcgtggacgggttatcctggcgtatcttgtttgaggatttggctactgcctatgaacaggccgttcatcaggaagtgcttcagctgccggacaaaacggattccttccgttcctggtcacaaaaactttccacctatgcgaatagcacagctatggacagtgaacacgcctactgggagcaatggaacgcagcggcttgggctgaccaagtacgtttacctgaggatcaagcgcaggctgagccctttaccttggctgacacggatacagtggtcgtccagcttacggaggaagagacatcaaaattattgaagcaagcacaccgcgcatataacacggaagtgaacgatctgcttctgacggcactgggcatgatgctgtacacgtggacgggtcatgaacgcagcctgattagtttagagggacacgggcgtgagaacattttgccggatacggacctttctcgtacggtaggctggtttacgagtccatatccggtattgctggacatcggtcgcaatcccgctttgtcagaacgtatcaaacaggtcaaagagagcctgcgccttattccgaataaaggaatgggctacggaatctggagatatttgagtgaatccggtcaagcggttggtcagcaagcaggtgtgctgaaccttggtcaatatcaagcttttgccgagccacaagtaagctttaactatctcggacagctggatcaggacttgccaaacagcgatatgcgtaggtctccttactcaattggatcagtcgttagtgaccggacgaagatgaaatatgcgctcgatgtgagcgggatcgtaacgaacggcatcctggaactggacattcggtataacggcaaagccttccgtaaggacaccgtccacatgctggctaatctattaaaatccaacctgcttgaaatgatcgagcattgtgtcacacgggagcggaccgaattgactccaagtgatgtattgctaaaaggtctgaccctggagcaattagatacgattaaggagcagaccaagacggttggggaattggaaaatgtgtatccgctaacccccatgcaaaaggggatgctgttccatagtttgatgaatgcagaaacaggcgtgtattttgaacaggcgacctttgatctggaggggtactttgaaccgtccctattcgaggaaagtctgaagctgctggttagccggcatgctatattacggacgaatttctacagcggctggtatggtcaaccgttgcagattgtctatcgtcataaaaatccgagcttccgttatgaggatgtcagagggcacgaacacgctgtagctgaatttgtgacccaggataaagctcaaggctttgatctaagcaaggatgcgcttatgcgagtatccgtcttccgcacgggtgaaagctcataccgttttgtatggagcttccatcatattgtgatggacggatggtgcctgtccctgatgacggacgaagtgtttggggcatatgttgccttgctggagcacaaacagccagagctggcacctgtcaagccgtatagtgattatatcgaatggctggaacaacaggatgcgcaggaagcaaaccgttattggagtgactatttggcaggttttgagcagcaaaccttgttgcctggggagaacgcacaagcttctgtcgtcgcacgcaatgaagaatcagacggaagcggtgcgggttcccattccggctatgtttcggaaaagttgccatttaggttgggtaaagaacggactgcggcattaaaccaaatggccaagcaacaacatgtcacgattaacacattgctgcaaagtgtgtggggtgttattttacagcaatacaataataatcaggatgttgtgtttggtggtgtggtatccggtcgtccggcagaccttccaggcgtggagaacatgatcggattgtttatcaacacgattccagtacgcatttgcagtgcaccggatgctacatttgctgaaatattgcagcgtacgcaggagcaggctttggcttccagtatgtatgacacgttcccgctatacgatattcaggcactgactgaacaaaaacaagacctgattcatcacattatggtctttgaaaactacccgatcgggcaacagatgaagcagatgggcggttccggcgagacaaaggcacaaacaggcttctcgattgccaatgtggcacttgccgagcaaaccaactacgatttcaacctgattgtcgtgcctgatgaggatatctctatcctgcttgaatacaatgctctcgtgtatagccgatctgctatggaacgtatccggggtcatattgaccatgtcatcggacaaattgtggacaatccgaatatccgtgtgaatgagctggaattggtgacaccggaagagcagacacagatcgttcaggtctggggggatacggcggcagcctatccgcaggatcaaacgctaagtgcactgttcgagcagcaggcagcgaaaacaccggatcaggtggcagtgttgtgcggagcggaatcgttgacctacgcggagttgaatgagcgcgcgaaccgtttggctcgaacactgcgtgccgcaggtgttgaaccggatcagcccgtgggcattttggttcaacgttcgctggacatgatcgtaggcatctacgcgatcctcaaagcaggcggagcctacgtgcccatcgatccagaatatccggcggaccgcatccgctttatgctggaggattcgggtgcgaagctgatactgacgcaatcgcatttggcagagcaagcatcgctgagtttcgacggccaggtgctggtgttggatcgtcatgagcaggatggcaaggaaatataccacgaagatggctcgaatctggagccattggccggacggcaccatgtagcctatgtcatctatacctccggctccaccgggaaaccgaagggcgtgatggtggagcatcattccgtgctgaaccgcattttgtggatgcatgatcggtacggcttgagtgcggaagatacgatcctgcaaaagacggccttcacgttcgacgtatcggtgtgggagctgttctggtggtcgttggtcggctcgaaggtgagcttgctgcccgtgggcggggaaaagaacccggaagacatcgtcgacacgattgcccgcgatggcgtgagcacaatgcactttgttcccgccatgctgcatgcgttcctagaatatgtggagcagcagccacaggaagtgatgcaagcgaagctgggcacgctgcgccatgtctttgccagcggcgaagcgttgccgccacagcatgtggcgcgattccagcggctggtgtcgagcctggctggagcgaaactggtcaatctctacggtccaaccgaagcgacggtggacgtatcgtacttcgattgcgagccggatgaggaatatggaattattccaatcgggaaaccgattcaaaatattcgtctgtacatcgtgaaggaaggtacggagcaattgcagccgatcggggttgcgggtgagctgtgcatcggcggtgtaggtgtagcccgcggctatctgaatcgtccagagctgacggccgagaaattcgtagccgacccgtttgcaggcggggaagccggctatgaacggatgtaccgcacaggcgatttggcgagatggatgccggacggcaacattgaatatctgggccggatcgaccatcaggtgaaaatccgggggtaccg

SEQ ID NO: 2603 - DNA, 909 bp, Unknown
  Kingdom: Bacteria, Phylum: Firmicutes, Class: Bacilli, Order: Bacillales, Family: Paenibacillaceae, Genus: Paenibacillus
atcttggtcaaattgtcccaaatagttaaagctgatttcaggctcggttacaaaacgctcttgctcacgtgctgcggacaggtatctcaacataccgtagccgatgcccttttgtggaatgcggcgtagtccttcttttacatgtttgatgcgctgtgaaaggtcttgccccacgctcatatccagcacaaccgggaattgggtcgtaaaccagcccacggtacgcgtaatatccagttctggcaaaatggattcccgtccatggccttccaggctcacgagcactcgttccatgcccgcccagcgatgaatcgtcagtcccaatgcggtaagcagcaaatcattcatctccgtgttgtaggcacgatgcgcctgttttagcagctgctccgtttcctgagctgtccacgtaactgtaatgttctcgctgtccctattgaaggaatgaaaaggggactcgtcttttggaagcggctgatatacgccttgttccatttcctgccagaatgcgagttctgctgccatagccggactgttcgcatattgagactgcccatccgcccaggtgcggaacgaatctgttttgtgcggaagacgagccgcttgtccgtttaatgcctgctcataggcggtcgtaatatcctcgaacaaaatgcgccaagatacggtatccaccactaagtgatgaatcgccatcagcaaatgatctccatcgggacaatggaacaaccccagcttcaccagcggtccttcgcttaaatgaatgcccgcttgaatttcattcactttagcctcgatcgctgcagatacctcagactcatggctgaagtcggcccgatccagcgtatacagctcgccctccccaatcgcgcggttccaggcttcataaccgcgctccgtaggtcggaa

SEQ ID NO: 2604 - DNA, 128289 bp, Unknown
  Kingdom: Bacteria, Phylum: Firmicutes, Class: Bacilli, Order: Bacillales, Family: Paenibacillaceae, Genus: Paenibacillus
tctaaggggtgcacttcacacagctagcagggtcatttagacgtttttaggagttatactgagtgaaagacgtgtgtgatccaacagccttttcttcacaaaatcaaatccaaagtgatttagtgatgatcaccaacaagataaagagcactaatattgctcctgtagaagtccacgcacctccaacagctggacctgcactgttaccgttacctgtaccgcaactatcacctgcatataattcctttacttgttgtacaccttaatatatgtataactacgttctatgaccgggtattcaggtaaatagaaaaaatccccgccgaccaattaaggttagcggggattttggggactgatgtttaagctcctccaatggtaacctgaggctggatactatggtggtttaaggcttgatccggcacagttataataaataacaaaaagctagccgcgataatcagcagtaccgtttttttcaacattagtcatccacaccttttcaataagatttaaaaaaccagctttggtttcaggaacagcatgatcccgaaaatgtaaaaatagccccatacaattaatgaaataagtctcattatttagtgtatgataacttaccgttgaatacatcaaatgtttaaaaccatcattgtaggagcctcgatgtaaataataataagctaactcgtaaccaaaccacgcgatatagtccggtatcacttgctgtgtatacatatcatcggatggacgatgttcagaaaacgaattaatctccgattcaaatcgtttgagtatatcgtctacatctatactatattggtttgcggcaattataacattgagcagttttgatatcttctcgttttcgctagtcgccgatgtggctacaatatattcaacataatcatgcagcacatttatatctcctgataaaagtttatatacgtaagtattaccttctgcccaacttttgaacaagctaatccagtgccgggtatcttcgtcagtctccattacccaatctaaattagcgtaggtgtatgtatagtctagagcttgttgataatcgccttgggcttcacagacgctagcacacaacaggtcagcataggaaatgtatacaaacaatggacggcttagcttatcagtagagtcagtgtgttctcgactgttctgttgatgtttcagtgtatattggatttcggctttagctctcattttcttcgccatttcgtcaaccttgtcccatttacgcaaagacctgtatacgttcgctaaatcctttaaagcatcaagttggtctatttcatcaaggcgctcaacaaaaacttcaaaaatcgtagctgcactaagattacggctttgatcgtctccaacttgaatcgtaaatatacgatattgacagactgccaatcgttctgaatgttgatatttctccgcttcagctaccccctcatagagcagtaatgcagccgcatgtcttccctgcgccaacaattcttctgcaatttcaaatagcttgggtgaatacagtagattgtccatgatggctccaaccactcgacggatcgcatccaacttgtccaactccgcacagcgaaacaaaaatggctcgattcgcctcatattcggaggatggtcgatgatgtagttttctatgaacaagtcataaaagtgaccttccggtaaacccatagcctcagtaattcgatccagttggttaacagacaaaggcttgtttcctgtcacgatagcacttactgctcccctattcatatccgcaatatgaccaaattgagttaaactcaatccttcttgttgtaggtatctgtctaattctgctcgaatcgtaggtgtatgcttcatgccatagccacccttcgcatagaaattccagtattttataatcatttactatttttgcccagtaattaacagttgtcaatatctttttttgcgaatcatgtagaaaggctgcgtttgtcataagggtactcctgtaaacaaaaaaaagcaccccactggctttagccagcagagtgtttcgtatttccaaacgcttgtgattattcctcattatctgtagttggactgtcagccgacttaccatccacataagcctcagccagaatgtaagcaatcactgcaccgaatgcacgacattactatcgtattttggacacaatcgtaaaagagcaccctgactttccgcggattcgtttctatgatctaagacacgctcataacagggaactcatgaacactgaaaaaaccactttactatactaaaggttagaagattgttggaagattgtccagaatcacaaaaaagcgcgccctccaaaaagcttggaagccgcgctgtgcttgagttttatagaatgctggtgaagggaattgaacccccggcctacgcattacgagtgcgttgctctacccctgagctacaccagcaggtcagtgtaactgacaacaaaaactattatactcttagttacataaaaatcaatcacttacatcaactttttcaactaggatttggatttagttcggtaacatttcctgtcgtggtgccagatagtttctctgcgacggaacggagcttttggtgactggaggaaggcttgtcacggcgatcatcaattttgaccgaggtggaaacacgcttagctccagacaggaatggcgcttcgtgcagcgcagcaatggcggtgaacacatcgtccaacgaaccttcaataatcgtactcatggaggtaagctcataggtaattcctttttgcgtcttcaacactttttgcatctgggcaacgtagtcgctcaggcttgtactccccgttccaatcgggatcactgtcacttctgcaatagccatcgccaagttcctcctttaatttaaaatcgtcgcttctttaaaaatctaaaatctcagtccgatagagcgagcaacctgatttcacaaaaatagttcatatgtatgctgcttgtttctgtaggaaacatctttatcattcattgtaccgttcaaactgcctcaattcaaatacagcccgcgacttctctgcatattttgattttccattccttttcctttacgtatggcttcaaatgttgctataatactccttgcacttatttgaaattttaagtttatatacacaatatgttgggttaaatattcataacacgtctaaatatagtgatgtagccgataaatcgtacgggaaccatcttttcccccttcattggcaggtgcatcgctatttctatgttattggattacatacagcccccaaatgctgtctgaccatcgcttttttcgccattatcttctcatcatgatcattttcatgcctattcccaagtatgattccaaatcaggaaagcgaggaattaatcctatgccacaactcgtaaccaaaccaaacaatcgccagttggcttttgatgaaatacgcatttccgtatatgccgaccgtgtactcagcgggctggacaagctggataaagatcgtctcattcgtggtgtaactagcaagctgcgccgggacgaagtcactggggatgacatcagcaacgcgtttgcgatggctgcccttgaattggttagtaaggaagaaccggactggaaatttgccgctgcacgtgctttgctcacttccttgtataaaaaagcggccactcaccgccgttataaatcctatgcggacgagccttacggtgctttttatccactgatcactgatttggtccaaaaaggaatttaccgtcaagaactactcgactactataccaaggagcagattgatgagttgggtgattccatattgccgaaaaatgatctgctgttcgattatatcgggctgttaacgctgtctgagcgctatttggccaatgattttgacggacgcgtaatggaactgccgcaggaacgctacatgatcatcgcgatgtacctgatgcaccaagagcctgccgacaagcggatggatttggtcaaggaagcatactgggcgatgagcaacatgtacatgacagcagctacaccaaccatgtccaatgccggaaaaaaggtggccggacagctctccagctgctttatcgacaccgtagacgactcgttggaaggcattttcgactccaatacggatgtagcccgtcttagcaaaatgggcggcggcatcggcgtatacctcggtaaagtacgggcgcgtggctccgatatccgtggacataaaaatacaagttccggcgtcattccgtggattcgccagttgaacaatacagctgttagcgtagaccaattgggtactcgcaaaggtgcaattgccgtatatctggacgtattccacaaggacatcctcgcgttccttgacctgaagctgaacaacggtgacgagcggatgcgtgcacatgacgtgttccatggcgtatgtctgcctgatctgttcatggagcgggtcgaagcacgtggtgaatggaatctgttctgtccgcatgaagtgaagaaagtgatgggctggaaagatgacaatggtcgtccactgggcctggaagatttctatgatgaaaccttcggttcgggtaccttccgcgaaaagtatgaggaggcgtcacagcatcccattctctctcgtattacagtgcctgccatcgacattatgaagcgcctgatgaagtcacaactggaaacaggtacaccgtacatgttctaccgtgatacggtaaaccgggccaatccgaaccgcgcccatggtatggtatattcctccaacctgtgtacggaaattatgcaaaaccaatctgcaactgtagtagaaaaagaagaattggtcaccaaggacggacaaacacgcatcgttatttccaaaattcctggcgactttgtggtgtgcaacctgaactccatccatctggctcgtgcggttccggcaggtgtgctggatcgccttgtaccgattcaggtacgtatgctggataatgttattgatatcaacaacattgaagtactgcaagcacaatatacgaacagccaatatcgcgctgtcggtctgggtacatttggactgcatcatctactcgcactggaaggtatccgttgggaatccgatgaagcagtaacctataacgatcatttgtatgaaaaaattaactacctggcagtcaaatccagcatggagctagcgaaagaaaaaggccgttatgccaaattcgagggttctgactggtctactgggcactatttcacttcccgtggctatacggatggtacacgcgaaggcaaatttgtcactacgtccgagtggagcgagcttgcagaagaagtcaaacaaaatggtgtccgcaacgcatggctgttcgccatcgcgcctaacgggtccacgtctattattgcaggctctaccgccagcattgatccattgtacgagctgctttcctatgaagagaaaacaacttacaagattgctaaccctgcaccggatttgaacgaaaaaaccatctggtactacaaaacggctttcttgctggatcaacacgcttcgatcaacatggcttctgcacgtcagcgtcatattgaccagggccaaagctttaacctgtatgtacggcctgatattaaagcaactgaatttttagagctgcacatccatgcctggaaatcaggtatgaaatcgacctattatgtacgcagccgcgcactgacgattgaagaatgtgatagctgcgcatcctaaactaaaggagagaagctctcatgcagttacagaagatttttaacacggaagcgccaaatcgctctacccgtattattgaaggcgaaagctccggtattttgaattggaacgatattcggatgccgcatatgtacaaattgtataaagtgctgctgctgaaccactggattccagatgaaattccgatgtccaaggacgcgtcccagttccctgtgctggatgccgaagaacagcgcaccttcaaaattaacatcggcctgctggctgtactggattcgatgcaaacaatgtttgtcggggatgtaaaacgctattttaccgattcctcgctggaagctatttcagcaattatcgggcagcaggaagtggtgcataaccagtcctactcctacgttctgtcttctttggtgtcagatcaggaacagcaggaaatttttgaatactggaaaaacgatcctgtcctgctggagcgtaacacattcatctcggacatttatcaggagttccgcgatgagcagaacccacaaacctttttccaggcgatggtagccgatttgattttggaaggcattttcttttacagcacatttgcgttcttctacaacttggctcgtgatcagaaaatgatggcaaccagccaaatgatctcgtatattcagcgtgatgaaaatcagcattgctacttcttcgccgaagtgttcaagcagctattgtccgatttccctgagctgaataccaaggaaaatacggactatgtctatcgtatgattgaccgagctgtggagctcgaaacgaattgggcgcattatacgctcaaagaggttcgcggcatcgacttgaacgagctgagcgattacatcaaatacatggcaaatatgcgcctgagactgcttggtatggacaaagcgtacgaaggcgtagatgtaaactgtatgccttggatcaaaccattctcagatgaagcgctgaatgcgacaaaaacggacttctttgaagcaaaatcacgcaattatggcaaggtcggagatgacaacggatttgacgatttgtaagtcataagatacagccttagcacggtacttaccgggctaaggcttttttcatgagaatttacgcaaatacgcaaaaaaatcatgaaacatctgaataactattcatattttcctatttgtacacgatatatatgaaggtgaaaaaaacatagtaaggagcatattatgaaaagcagcgttaaaaaaagaatgggattacaatccaaactctacttcatcttgctcattcctttaatagtgattggcgtcattgttctgtggacgaccaatcaatctatccagaatgcttctctatcaaccatgcagctaaacaatgaaacgctggcaaagaacacggcccagctattggacaaatccgcagttaagagcttaaatactgattcatctgagcaaagcagcgagtataaacagcttcgtaacgagttaaatacgctcaggctgcaaactggaattctgtacatctatctgtacaaccgtgtgggcaatgagtggaaaattacggtggatggagccgcatgggacgacaaagactatagtccattcggaactcctgtaagttttacccttaaagaaacggaagagaaattgaaacaaggggaaacagtgactacagatattacaacggaccctgagtgggggacgatgttttcctcctttactcccattaaggatacagatggaaccatcattggttatttgggaatcgatagatccctgtcctctgtgactgaagtatacgaacataccttgcccgaggcctaccgattagttattcctgttatctccatcattctgatcatctccattgcggctatgatgctggtaacccggcggatactgcgtcaggtgagatttattaaaaatacactggagcaagtagccgacggcaaccttacggttacatcgtcgcaagtaacatatgatcagttaggcgaaattagcaaattgacaaacaaaatggtggaagccatgtccaatatgattgtggatattcaaagcagttctagcacactccagcatgcatcagagaatatcgtcgtgacaacggaggggacactccaccaaactgaggaactgtcccgcacactccagcaaattgccgatgtctctattaaccaagcggatcaagcagtggaatcggttcaacaatctgaccgattaggacaaacgctggatgaagtcggaagccatgtgcaacaatttacggatacggccgatcatctcaatgaggttcgtaatcaggtaaccagtgagcatgaactgctattagagaaaggacgagaaagtgccctgcgtatcaagcagatgcagcgtatgtcacacgcgttaaccgaaaaatcgcgcgaagcggctaacatcggtcagcaggtacagggcatcgtaaagcagacgcagattttgtcctttaatgcatctattgaagcctcacgtgcaggcgaagctggcaagggtttttctgtggtcgctcatgaaatgggacaacttgcccagcaatctgccatatcgattcgggaaatcgatgaaatcttaagcagctttgttgagcaaattgagcaaatgggtgatcaatttgatgagaacataaagaccgtcaatgaacaagaaatccaaatttcggtatgtctacagtctgttgacaaagtcacccaggtttcacaggaagttcaggagttagctgcacatctagctcaattgacggcagaaatgcaagaggtacgtcacagcgtagatcaacatttaaatcacacagccagcgcggcacagcagactgccggaatgacagaagatgtatcagcaagcgcccagaagcaggccctagcggtaaaagaactatccgaagtagcccgcaatctcactacactatcaaacaatctgcagcgtcatgccgaccagttccaggtaaaaaacgctgaatagtgaatattatgttggattcgattcaactgaatgaaaagaagtaaactaaaatggagcattcgctaacgtagcgaatgctccattattatgttttgaaagccgagcagagttcacctttatccgagtaggtgcatacatataacctagaagtgtgtattcaagcacttcagaaccatacccgttcttatgatggaggtagcgccgctgttttcacctgtttcgtataagaaggatagcctcccgtatgctggagcatttcgatttcacgcaaaatacgcggcaagtcagcgaccgagttcatcacgatgtgggctcctgctcttttcaaaccatatacactctgtctgcgtcgttcctcagccactctgtcgtccgcttcatggctggtcgtttgagctgcggtcgtcacgctttcgttatggttcaagacaccaatcgtccatacaccggcgttccgtccttcttgcatatcggctgctgtatcccctactttcacaatatcgctcagcggaaatacctgcaagcgatgtgcaatttcatagatcatccacggataaggtctcccctgcgaaacttcacaaggggcaaccatacaatccagcgtatagggggattgtgcaggcgtaaatacgtgactgagcatctccatcggacaggatgcagtggcacctgactgaatgcgacgatcctgcaactcctgcagcgccctgtctataccgatagcaggctcagccccttggatcaaggagcggagaacagggacaagctcaagataaatatgctcaatatccactctgccaggatgcgcatcaaagcattccagccattttttccgaacctctgaaagtcccagcacatttgcaatatgatcccggatcggcattcctcgcccatgagatacctgttcttcagttacctgtatacctttccatctgaaaatgtcacgcattccctgggttaagcctcgtcctccggggtctaacaatgtactttcgagattaaaaataaccgcctgtatcatgcaatccccgcctttccgtaccacggctatccgcaatctttattttgcttaggaacatgatacacagctaacgtaaactgaaatgtcgtaaacggtaagcggattgtaattgaaaataaattccttgattggttatgaataccgagtgtgataagaggaggagtcgcaacatgagacagccctggaatgaatttaattccaaaatgccttggcggatggagcttggttgttatgcgctgaataaactggcctgtggaggattggtttttggtctcttatggatctactgctatctgacagaggaaataacagggattcctctgactatagcaggcaatagtggtgaactgaccgcgcagctgtgggcctatggttttgcccttcctgccgctcttgccgctgatgcgctacgcgatcttttaccctggcttcgcaagcccgagcagctcaccctatacctcgctgcaggattcagtgtctttctcctactaggttctttgatgtcgcctgccggaacgggcattttatggagcaacggcatagcaggtgcagggattacactgctgtattatggaggaaggcactggctgaaccgtgaatatggattacagatcatgctggccttcctcctgccactgctgctatggcctatagggcttcaataatgtcgccagcgatcacagaggcaggatgctggcgatgacgtgcggctgtttctccagccgcaccatgcagatacacgccaaacgctgctgcctgggaagcattcaagccctgagccagcaaacctgcgatgatgcctgttagcacatcgcccgcaccgcctgtcgccatcccagcatggcctgtggtattgacgtaggccgttccgtcgggacaagcgatgaccgtgcgcgctcctttgagcaccagcgtgaccccacgtgtccgggcgtactcccgggcatgggtgatgcggtcacgctgcacctctgctgtcggtatgcccagcagacgagccatttcaccggggtgcggcgtcagtacgaccgccgcacttctcggcttccaagcctccagctcaggccccgccgaggcgaggatgttcaaggcgtccgcatcaagcacgagcggaccgccgtattcctcccacaggcggcgcagccagcaggtgtcccctgcaaagcggccgaggccggggccgacggccagtacatcacgtgcctgcgcgagctgtagcagctcgtctgcggagtcggcattccattcgccgtctccacctgctgctgcggcagcgagcatcagttccggcgcggcgccaatgacgcgcggcaacaacgcctcgggcaccgcccacgtgacaaggccgctgccgatgcgcagggcggcacgtgcggccagcaagcccgcgccgctcatgcgcaggctcccggccgcgacgagaacatgaccgtaggtgcccttgtgcccgtccggcacgcggctgcgacttacatctacgtccagcgcagcgcgcagcgtgtcacgggtcaagagccgcagctgcacgccgcactcacgggcaaggccaggtggaataccgatgtagcgtaccaccacatcgcctgcggtcccggcgcccggatattggacgagcccacgcttcaagtaagcgaggcatacggtgacgcgcgcacgaatgcacggctcgtgcagcgcacccgtgtcggcgtcgaggccgctaggcacgtctaccgacacgagcggcgcgccgctggcattggcctcgcggatcagcgaggcgtagggttcgcgcggcgggccttgcgtgcccgtgcccagcagggcatcgacgacgccggaggcgccgcgcaggtcgagggtatcccggccatagaggatcaccgggatatccagagccgcgatgatatcgcgttgcgcagccacttcaccgcgtagcgtgtctggcggctcgacgtacacaacggtgacgcgtagccctgcatcggtcagatgacgggctgccaccagtccgtcaccaccgttgttgcctttgcctacgaggatataccagtgttctcgttcccgtaagtcatgtcgtccttgactccacgtctctgtccgtataacaccgccatgtcccggtatatcccccggccctgtgtgtgtaacctcttctgtccactgcgaccccaacacttcagcacgatcatttccacgtgttagatcagcagtgcctactgagaagccgccgccattgctcttcccacttctttcggcacatagcttcaacacctcgtaagctaccgcgcgcccggcattttccatcaaggtaaggaccggaatacccagcttgtcaattgtatagcgatccaattctcgcatttcttcggcggtcaccatatacatgcttttcgcctcccgtatagctatccctgcttattaatatccaaccgtaaaacgggaattgacaaactccccttctactaactcatcaatcagggctaccgcataatcttcgaccgagatacggctatggcctaattcgtcaaccaccaaatgatccaaaccaatacggaactgtcctgtacgttttcccaattcaattattccggcaggactacaataggtccagtctacatccgcagcgcggtacagctccagtgcatctgcatgggcagccgccagtggcttcacttcctccggaaactcggcggtatccatgaggcgttcaccgttttctgttttcagacttcccgctccgccaacgacaagtatgcgctccgcgccggaacgccgagttccttccagcaaagaacgagtcgcttcgagcagttcttcctcttctccaaacttgggaccgtatgcgctaatgatagcatcgtgccctttggccacgtccgtaacggaattcggatttaaaatatctgcttgaaccaccgtcaaatattcactttgctccgtcacacgttgcgggtcgcgcaccgccgccgtcacttcatacttacgcttgattgcttcctttactaacgcttgaccaatggttcctgttgctccgaaaataataactttcatataaatgtgccctcttcctgtctataatttacttactgttatttatccgttttatatccagcctaaacccgtacagcatgtcagcttacagtccccccggctgtcgccagtacatcccttccgacctcggactgaccaattggaagccgaattgcgcatacaagcggtcggccggcttatccgcgatcagtgtcacaaggctgcccgtacggttgattcgatgtctcatgatgttctgttgcaatttctacatttttatccatgctgaatctcctcctgcttgtaatcttgtctattttaccaaaaaacacttcatatatcctggtcaaagggatacaagcccttgaaatgcctgtatggtctgtgcaatagtgtagaaagaacaatggaaggagggattgcgggtgtccccgacggacttcgcggcgttagccgcatatatctcacccggtctgattgccttcctgctggcgttgtctttgctggtatggctgtatgttcacagtgcagcccagcttcgaaattcacgtcagcagcggctggaagaattacaggaatcgctgcgtatttatggacgattagctggttgtctccaaaccgctacccagaacgggttcaataacagcgaaaagcagtaccagaacggactcatccacgctcttcaggaagccaaagctgctctctatttgacccctcaccttcaagagcaggttcaagcatcccttcgggagtgtgatacattccgcagagaattgcttctcaaatcactggagcgtgaaatgaacaaactcatcgaggaacggcgtcttgttctgctggaatctcatgctccgggctggggaacagcattgtggaagctattgcgcccagcagctggtccgttggcgctggcaggaatcgtctggttggtcacaaggctggttatggaactgatagcctccagccatgtcgatgttagtctgcccgatactgcacaatctgcctcatggctcatagggtgtgcatggatgaggttcgtttccggcttgatcgctctactgtatgtgtaccgactgatgaccctgcgcagacaaaatgatctggacgtgacggcatcccattttccaacaagcctgttgtgcttagtgatcgccgctgtcgctctgtttcaatggatcggaccggaagcatctccctacatactggctgttcagcttgtgctgttcttgattggcttccgacttacccgcggccgctcgcgcagtgatcgtccttatgttggtcatcccggcttgatcaaggcagattcttctcaacatcaggatttacacgcagcagataaagataaaacggctgactcttctttggcagaagaacatatccggtcctaaacaccaatagcacaggattctattcccgtatccaccctgcaaatcacataccatcacaggacatcccaacaacaaagaaagagattatggggtgtcctgttttttgaacaatttttggctttttgaggggttaggcttgtgccagtgatcaaggaaagggtatattgtttatataaatgtaaatcatatcgttttttatgtatgaatattgaaaaaaatccatatatgttaaactaccatcaatttatgatgtgcgttagaattggaggaactatgcaactggacatttctgaaaaatcacttcccgtttatgaagcgctggccagtgaggttcggctaaacatgattgttctgcttgcggagaagcctatgaatatacgtgagctggcggaagcgttgggtctcagcagtgcgattatgacgatgcatgttaagaaactggagagagcgtccattatttcgaccaaaatgctgcctgggcgaggcggagtacagaaagtgtgctcactggctacagacaaaattgaaatcgccatgccacgctaccagcaggatgtacgacaattccatcagacggagatttctgtgggacactttacagattttgaaatacaggcgacctgcggactggctaccgtcgaaaagatcattggtgaattcgatgagcctcgttcgttcttggaccctgagcgcttcaattccaaaattctatggttcagccaaggatatatggattataaggtgccgaatttcctactgtccagccaaaaagctgaggaactggaaatttcgatggaactatcatccgaggccccttttaccaatgataattggccttcagatatcacttttttcctaaatgatgtgaatttgggtacatggaccagcccgggggatttcggggataaccggggtaaatacacacctgcatggtggcctgattttatcaatcaatatggtctccttaaaagacttcgcgttacctccgaaggtacctttatggatggcaagcagatatccgacgtgactttaagccaagtactgattgatcagaagcaatggaaattccgtattgccatattggatgatgcccagcatgttggaggggttactctgttcggtaccggatttggtaactacaatcaggacatcctgttccgtttgtactacaaacatgcagaaaatcataccaaaacagtaacggtagaagctggcgatactagcaaatagcttttaggccacttcaagacctgaacacggcgttttgcccatacctttcatgggaaacaaagcgccgtgttttattttttcatccacttatatcgtactcttttgccacatgctatgcgattagcgtataggttcaatacacacaggtgaaggaacctccagcacatatcccgttcgggtcagccgtccatcctcactatggatggcaaaagatacgatgttgtttccatcctgattcgctactaccaaataaccggacaagatgttgaagttacgcggtgtgctgcccaaggtttccacccattccaccgtcttcagcttgccgctgtccagatcgacatggtatagcacgatgctgtcatggccgcggtttgacacatacaaaaagcgtccacagggcgtaatccgaatatcggctgctgtattttctacatctataatgccttctggcagtgtggacaggctttgcatcaatgtaagctcaccattacgttcgttataactaaacacagcgactgtattgttcaactcattggcgacaaaagcatatggacgcgaaggatgaaaaaccagatgacgcggtccagaaccaggtggcaaatctgtctcacgatgggtcaccagtattccatcttctgtcaaacggtataccacaatctggtccagtcccagatcacataccagggcatactgtcctgaagggtctggaataatcgaatgtggatgtgccgcatcctggcggtcctggcgaatacctgagccggtatgctgaacttgccccgacatgtctcctaaccctccagcttccgtcacagggaacacaacggcattgccgcctgaatagttggaagccagcacatatcgtccatcggatgttacggaaacatagcaagtatgcgctccctccgtcccttttcgatccaaaggatgtaattcccccgtctgggcattcacctgatacgcatacagctcaccttcttctgtttcactggcagcatacagcttcgtcccatccgggtgtagtgcgagaaaagaaggcctctcaatcccttccacacctccaaccatgcgcagatcaccattggtcacatgcaaagcacatacatatattcctctttcctgacgagacgcataggttcctgtataaaataactgctcattccgctcttccatcggctctcatctccttctagctgttttttttatatattatctagctctaagctctactatttgtcttgttgtaaactcatcatgcattattacccaagattctgttgtttcattaacgtttcgcgatatatgcaaaaaaatagcctccttcggcgcaatctgtggttcataagaacgtcacagttcactccaaaagagactaagtttacgaaaaatacaatattaaaccgctgtggtttgcgtatctctgctattccattttacagccagccccaaactaagaatgagaatgactgccccaaaaatgtatggcaaattgatatgcacctcgaacaatgtacccgcaagcgcaggtcctagaatattaccaatactcatataagcattgttcatgccggctgcaactccctgctcatcccccgccattttggataaagcagtattaatggctggccgcagcaacgacgtagcggtaaagaagatgagcgataccccgagtacataataaaagttgccggagagcagcataagcacaagggaaatggctgaaaacagaaaggaaccgataatgacgcctttttcgccaaaacgattcaacatcgggctaatgaccacagcttgaatcacggttccgaccagtgctcctaccgtaataatgatagcaatatcacgctcattgtaatgaaacttgcccgtcacgaagaaaggaaacatcgtttcaaaatgcgtcagtccaaatgttaacgtgaatatcataatcagcaacataaagtaaggcttgcggaaagaaagggcaaactgtttaatcacattgtcccgtttgaccttgacattccgaaacttcaactgtttctccagcgacaaggtttcgggcagcataatcaaggaaatcagtgcagctacgcccgatacggccgccgaaacatataagggcgtacgaattgagatatctgctagcaagccgcccacacctggaccgatcacaaagccaagagacatggcggcacccaacaaccccattcctctaccgcgattgtggaccgttgtaatgtcagcaatataggccatcatcggaggaatcataaaagctgcccctgcacctcccagcaaacgggagatatacagcatcgtcaacgattccccaatcgcaaacaatacagaagacgccgtcatgattaccaaaccgataataatcatttttttacgtccgtatttatcggaccattctcccgctagcggcgaaaacaggaattgggttaagccaaacacggcaaccaaataaccacccgtttcaccacttcctcccaaggagctcataaacttgggaaggatcggaataatgaggccaattcccagcatggcaataaacatattaatcatcaaaatgaccagcggccccatttttaactgttgtgaatctgacatgtagcgttttgtcctcctcaggttctttatttcgtatacgaaaatcttattttgcaaccatttcagcaaaactctccattatattaatagagtgtgagacaaataacaatcataaaatacttccgataaccctgaatctttcctttggcagaacagcaaagaggaacaacctgaatagacgacgttgtccctctcataacgattcataatcctttatttttgaacaatagcaattgcaatatcataatcaaattgctgaatttctgtggatggaatatcaaaaggattcacaggcttaagccgattcgactcgatccaatatgccccctccgtagtattacgctcgtaaccattacgctccatccaagtaaacaggtcatcataaatggtgttcagtcgttcacgatctccctgaaaacgagtgaccgcatacttcccttcaggtatctcaattcgttcaaggctatccggtatttcgttccaagaggacactttaacgcccaccttgaccgtcatacttcctttctcctgagcaactgtccattggggagttaacacatagcccgtatccacgtccagacgaccagggtgaatctctggaacagtctgttgcacccgttgccactgcttccgtacctcatcacccagctcggcaaaaggggcctgtgcggtcagagccgccaccttgaaagcaggtaatcgtcgaatgtccacaatgagatttgaattcatcctatttcctcctcatcaagcggatgctactctggtctctacgatccctgttgtggatcttcgaatagctcctgtatcatcttttccttgttattcagaaattgtttcgtgatgataaaatgatcggtttcctccagcgtcggggtgtcgatcccttcatgtgtcagatgatacaagatggaatctgggtaagccatcaaaataggggaatgagtagaaatgataaactgcgagccctgctgcaccagttcgtgaatccgtgcaagcatggccatctggcgcaaaggtgataacgcagcttccggttcatccaaaatatacaatccttgtcctccaaaccgatgcacaaaggcagcaaaaaaagactcgccatgcgactgctcatgcagcgatttacccccataggaatctcgaatcggtcgccctcctccttctcgatccagctcgtcgatgtgagtcgccacattatagtagctctccgcccggaaaaagaagccatcccttggcttttccacccctctcaccagccggatatgctcatacagtgaggaatgcgtggcttgtgtagaaaaattgaaatttttagtaccgccctctggattaaatccccacgcgaccgcgattgcctccataagcgtcgatttacctacgccattttctccaataatataggtgacggaaggatggaatttcagttcgttccattggtgcagggcttttaagttaaacggatattggctctcgtcagcatctggaggccatatcagctccaggcgacgtatgaaaagattgcggtcccatatactcatgtccagttcagctccattgccaagcaattcactaggttttccatcattatattggaattatttacagcaatcaatcggaaatcccatttcgtaacccttctgttgttattcaagcgattattgtaggtataatgtatagtaatgttcattgggcatgaattctaagtactttatttcgtgtatatctcattcttttcaagcaggtgaatctatgaagtcaaatcacaaaccgacccaatcctttaaaatcgtacagttcttgatgaccatctacaggcagcgattgacacgtattctgctaccgttggctgtactggcttttattatatgggaggccggacgagaactaaatgactttaatctggcacgtatgtttcatgagctgcggcgaatggatgccacgtttctcatcgaaattggcttgttctcactggctgccgtggcggctatgagcgcctacgattacgtaatcaggcatcatttcaagcttcaggtcaagcctgggacgacatttcgctacgcgtggatctccaataccttcaataatgtctttggttttgcaggctttacaggagcgggacttcgcaccgtactgtataaaaaaagcggtgtgccgttaggtgtcatcacctctgccgtcgtgtttctttcgccggtcgtcattaccggactatctttactggcttggggggccattgtccatttgtatccggtacagcctgtgctggatgctcatccttggcttcattgggcgctgtggggaatggcattgtacctgccgctatttctgatcatgcagcgctccaaacggtactccacatggttcaacaagggagaaggacagctttcctggtccactatctccgcttccattagtgcttctctgctggaatggctgctggctggccttacctttgcatggatcggctcgcacttgctccatgaacttccgatccatgctgtgttcggcatttatgtgatagccgcgattgccggattgatcagtcttgcacccggaggggtgggggcattcgacatcattgctctgctcgggctgcaaatggcgggagccaactcagatcgggcactggctgtgctgctggtctttcgtatcttttattacatcatcccgtggctcatcggcttggtattagccgcgctggaaatgattccacgtaacgagcgcctgaatcagctagctgagacgggttgggattattcccttaatgcctggcagaaggtatggggctggcctggtcaattccggtttttggccgatctaggggtatgggcgcttggtaagctggtactcatctccggcgtggtgcttcttttgtcggcagctacgcccggtctgttatatcggctacgttttgctgagcatttgctcagcctgcccgtcatgcgcttgtcgcatgaaatctcggtcatcatcgggattatgcttgtcgtcctgtcccacggaatctctctgcgtattcgtagagcattgcggctgacattgatactgctgctgacaggagctattttcaccttcactaaagggctagattttgaagaagccttattcctgctgtttgtggcgttaatgctatggatctcacgttcacggttttatcgggtcagtgctccgctgaatcggcacaacattttaatatggggtggattatccctactcgtaaccggggcttattttatcattggggcaggctccaacactccttttatgcgccatttgcatgccaaggtccatctggacttttttatgaaccgcagcgattacggagttaccgctgtgtttagtctgattttggcatgggtattcctaacggtgtatttctttcttcgacctcagcgtagcatcgccaatctacccgacgcgcaggagctggataagctaaaagaatttttggaacggcagggtggtaatctcgtatctcatatgctttttttgggtgataaatatctgtattggaccaaaaacgaacaggtcgtcattccctatgctcgcagccgggacaaactgattgtattaggtgaccccctcggtccaaaagaacgtgtaagtgaagccattcaggaattccaacggttcgcagatcggtatgcgttaacggctgtattttatcaggcctcgccggagtatttgtccatctatcacgagaacggctatcgctttttcaaactgggcgaggaagcactggtaccgctggaatcatttacactgacgggcaaaagcaatcaggcgctacgcagcgccaaaaaccgctttgaccgcgagggctactcgttcgaaatcatccaaccgcctctcgaggcgtcactgattgaagagatgcggcatgtttcgaatatttggctggacgggcgcaaggagaagggatattcactcggctggttcaaagaatcttatcttcagttggctccgattgcattgctaaaggactctgaagggaaggtcatcgctttcgctacgatggcccctgcctatgatcatggacggacggtctccattgacctgatgcgccacttgcctgacacgccaaatggcacgatggattatttattcacacgggttattgagtgggccaaggagagtggatatacgacatttaatctgggaatggcaccgctgtcccaggtaggacaaagcgaaaaggcattacgcgaggaaaagctggctcgacttgttttccaatatgggggacatttttacggttttcaggggcttcggcgctttaaggataagttcaagccccaatgggagccgcgctatctggcctatccggcttctgtctttctaccgatcctgacgctggagcttgtttatctcgtgtccaaacgatcggactaaacaaagggctgacaacaggaattttaatagcctaacacaacgtaaaaaagggtgttcccaaccacgaacggttgcaggaacaccctttttattcacaaatgttcttagaagctgccttttacaacaacttcagacaatggaaaacgtcctgatggacgtgctggcacttgtgccttacctacgctaataagcatagttggcaggtaacgtgctggaatattgaattgctcgatcaattgtgctggaatgaaaccgcccattgcgcaagtgtcgtagcccaaagatttagcagccagcataatattttgtgctgcaaaagcagagttcaggatggctgcatcgcgagctacttgcggattttggtatgcgccgttgatttgacctaccaatgcgtcacggatttccgctggcagtgcgcctgcttctaccgcttgatcataaatgacggtgttgcggttcgcttccaaatcacccaatacggcaatcgtaacggaactttccgctacttgaccctgattgtaggcgataggtagcaatttttgtttgtccgcttcgctttcgatgacaaggaatttccagtgttgaaggttccaagcggaaggagcttctatcgccgcagtcaaaatagcctccaaatcttcctctggcaatttaaaatccttaacatagctctttaccgcgtgtctttcactaatagtagatagagtttcattttttggactgctcgacattctaggcacactcctaatttcttaatatatatctaacttgaatcctcattaacttcccaaactactgcaattataaaaatgatagtgaatgatgtcaatatgtttaagtatgaccctgcactcaaaatacagtacaatacggattaagacatacatatcggcagatgcctgccgatgggacaagacacgggtgagttcattttgttctcatttgaattaaaaaaggagcgttactatgattggatcttttaaaaaaacggatattgctttgtttgccgcctgggttgtagcttgtgtggcaactttgggcagtctgtatctcagcgagattttggggtatgagccttgtaagctgtgctggtttcagcgcattctgatgtatcccctgacccttctgctcgggatcgcctattttcgaggagattcggagatacgccgttatgtcatgccgttggctatcattggaggcgcgatttcagcctatcattttatcattcagcgcatccatgcagccgccaaagcagctgcgcaaacttcaacttcctgcggcagagtatcctgtgaacaggattacctgaactggttcgattttattaccattccttttctcgcactgatcgcctttatccttattattgcagccatgggttatatcatgcgtcaggagaaaaaatcagctcaaggagaggtacaagcaaaggaactcgcataagtatgaaagagacctcattataggacccattaccaccaagaggcgtataatccgcttgccagaggaaagactgtaactaaatatatccattgcatatgtggtataatgtaaaaggtttgcagtctgtccaataacgcttatattccttatagagggggccagtccatgtttcatattagcaccccattgctgcaatatggcgcaaccttcggtatgatcgtaatcgctatttcggctattttcatccgtatgaagacaggccatcgcccgattaatgccaaaaaaatcatcattcctccgctcggcatgagcaccggttttatgatgtttgtggtgccggaagtacgggttccctggctttgggcgctgggcgcttttctggtcggctggtttattttttcttacccgttgatccgcagcaccaaatttgaattgcaagaagggctggttttcgtccaacgctcacgtaccttcttttttattctgatcagcctgctgatcgtccgattgctgctgcatgaatttattcagcattacattaccattccgcagacagcagggctatttttcatcctggccttcggaaccttgttacactggcggcttcgtatgtatttccaatatcgtcagttcgttccgaacgagacggaagttcgcatctgacaaacgggtttttaacatgcacgctcgcatgttgctgtatagaccaaaaagacacgttctcccaacaggagccgtgtctttttggtctttttggtcttttagtctatcaggtctacattatgcattccgggaaaaaggagctactcgattgcgtccctctgtcttcgcagtgtacagcatcagatctgcctgctcgatcagctcttcatgctcactctggcgttcggggagccagatgaatatgcccagactgactgtcattcaacccgttagtctgtatgctcccgatgggtgcctgcttttattgctgggtcaaaatgatcggaccatctgctgtaatggccagcgtatgctcgtattgcgcagacaagccgccgtccaacgtgcgtgcggtccaaccatccgcatcaattttactgcggtatgtgcctgtgttgagcatcggctcaattgtaatgaccataccctcttttaagcgtggtccacggtgcgggggtccataatgaggaacttgcggttgctcatgcatttcttccccgatgccatgcccaatgaattcgcgtacgaccgagaagccttccgcttccgcgtaggtttgtatcgcatgggaaatatctccgatccggttaccgataacggcttgctcaatccctttatacagcgattccttggtaacatccagcagcttttgcgcctgctcagacacattacccaccgcatacgaccaagcggaatctgccagccagccattcaggttcacaaccatgtcgatcgtcacgatgtccccgtccttcaacggtgtcttattcggaaagccgtggcaaatcacatcgttaggtgagccacaagttgcaaactggtagccgttatagcccttttgctccggtgttgcgccatgcttcttcataaaggattccgcaaaggcgtcaatttccagtgtcgtaatgcctggcttgatcattttggcaatttcccggtggcaagcagccaaaatgtctccagcttttttcatattttcaatttgttctttggttttaatgataatcattaaacggtctccttcttttccgtgttcgttccacttttcactgcttcttttttctgcttctattgtaacgctaaaagcagcgaaatggaaccgatgtcaactgacaccgtttacaaggatctcaaacggggtatataatactccataacttgtataccagtatgcaaaattatttccaagataggagtatcctatgaaatatccaacaacctggttacagggcgcatcgcttggggaaaggattgcttgtgaacttcggcttcagattatacggggtattcagacgccaggcactgttctatctgagaatcagattgctgccgattttggtaccagtcgttctccggtgcgtgaagccttgaaggcgctctcgagcgaaggactgatccgtttagagcgcatgggggcggttgtcgttggcatgacacccagtgatatggaggagctattcgatgtgcgaatgctgattgagcattttgttgtacaaaggtatgtacatagtgataatgccacattggtgactgttttgaatcagatgattgacaaaatggaagtcgctctcaagtacagggatgtcgttgaattttctcttcaggattttaattttcatgaggctctggttctggaagcaggccatacccgtattcttcatacctggaatggtatgagacagctaatcctgacggtcatgttagctgcgacagaacaacgatttgcgtctaacatcgaagaatcacaagtcacgattcacaaacatcgaacctttgcaaacgctttaagtcaagggaatgctcaggagttatcgggatttattgaggatcattaccgagatacccgcaacgcggttaacgacagcgtcttatctccctacagaaagacatcgtcctagccgcaacatgcgtgacaaagagccgatgtaccgcgcttcatgcgtttcttgctggcgcggttctcttttacattaaagttgtcgacaagtatacatttagctacacatatataaataaggaggcattacttcatgaacacattactcggcttgagtcataacgcgtccctgctcatatgggcgctagttaccgtcattcttttgattttgctgattgccaaattcaaatggaatcccttcgtttcactgctgctttcgtcggtatttctcggactggttaacgggatgccgggacatgaagttactgcctccatcaccaaagggctcggcagtacgctcggctccatcgccatcgtgatcggtttaggcaccatgctcggtaaaatgatggcagaatccggcggtgccgaacgcatcgcgaccacactgatggatcgttttggtgaaaaacgcgttcattgggcgatgatgattgtaggctttatcgtgggtattcccgtattttttgaggttggtattattttattaattcctattctgttcacggttgcccgtaaaatgaatatgtctctgctgaaaatcggtattccgatgctggcaggactatcgacggtacacggccttttgccaccccacccggctccgatgatcgcgtttgaagcctttaacgccaatattggacgcacgataggatatgcactcatcgtgggcattccatccgccattattgcaggcccggtcttcggcgcttggattggcaaaagaatcatggtcagaccttccgagaggctggatgagcagttcagaaatacgacgggacggtcgctgcctcctttttggattactctgttcaccattttattacctgttattctaatgcttagcggatcagtcgctgaaatcgtagacccggccaatacacatccgctcactgtatttttcaaattcattggtgatgaggttatggcattgctgattgcggccgtgttttcttttttctcgctaggctatgcacgtggtctaaagaaagaggatttgtcccgttttaccagtgaatgtctggcaccaacagcctcaattatcttaattatcgggagcggcggtgcatttaaaacggtattgatcgacagcggtgtaggtcaggccattgcagcagtcgctacaggagcccatatgaatgtgattgtatttgcttttctggtcgctgcgctcattcgtgtagccactggatcagcgacagtcgcgatgacgacaggctccggtattgtcgcacctgtactggcacttacacccggcgcgaatgtcgaactggtcgtccttgctacaggagcagggtcgctgatcttgtctcatgtgaatgacgccggtttttggatgattaaagaatttttcaatatgacggttccgcagactctaaaatcatggaccgttatggaaaccatcctctccctggtcgctttcggtttgattatgctgctgagtgtgttaatttaacgataatgagctaataacggtaagtgaaggggagattgaatatgacagacacccgatatatgatcggcgtcgatatcggtacgaccagtaccaaagcggtgcttttcgaagaaaacggcaatattgccgcccagcaccatgtgggctatccgctccatacacctgagccggatgcggcagaacaggacccggaagatattttcaaagctgtcgtgacgacggtgcaagaggtcatgaaacaaagcggagtgtcagccgagcatgtgctgttcgtctccttcagttcggccatgcacagtgtgctggcggtggataagaacggcaagccgctgaccgcctccatcacttgggcagataaccgtagcgccaaatgggccgaagcgctcaaacatgaatacaacggacacgatatttatttacgcaccggaacgcccatccatcccatgtcaccgctaacgaaactaatgtggattacgcgggatttaccggatgttgcgacccagacgtataaattcatttccattaaggagtacatctttgcccggttattccaccaatatgtcgtggatcactcgatcgcctctgcaaccggacttatgaatttgcagcagctggattgggacgaggaagcgctgcaccttgcaggtgtgacgaaggagcagctatccgagctggtgccgacaactcatgtgctcaaagggctggatgagacctatgcgcatgacatgggcctactgaagacgactccttttgtgatcggggccagcgatggtgtcttgtccaacctcggtgtgaatgcgatcaaacctggagttgtcgctgttaccatcggcaccagcggagccatccgtaccgtagttaataagccgctcacggatgccaaagggcgctttttctgttacgccttgacggaaaagctgtgggtcatcggcggcccggtaaacaacggaggtatagtcttccgctggatccgggatgaatttgcagcctccgaggtggaaacggccaagcgactgggacttgatccatatcatgtgctgacccaaattgcggaacaggtacgtcctggctccgacggtctgctctttcttccgtacttatccggtgaacgtgcgcccctgtgggacccgaatgctcgcggctccttcttcggtctgtccctgcgtcacaaaaaagagcatatgatccgcgccgctctagagggtgtgctgttcaatttgtataccgtcatgctcgccatggaagaagtcatcgacagaccgtcagtcattcacgccactggtggatttgcacgctcggagctatggagacagctcatggcggatattttcgatcaggaggtcattatccccgaaagtctggaaagctcatgtctgggcgcagctattctgggcttgtacgcactgggacggattgattcgctggatgctgtgtccggtatgatcggtaccactcaccagcacaaacctgtagcagaacacgtggatatttatcgcgatttactgccgatttatatccgcatttcacgtaaattcgaagaagaattcaaggatattgcagaatttcaggccaagtccctacaatctttaaattagtggaacctgttctaacgctgctgcgtattaccgttttataaaaacctgtctatgtcagttgggggcagggtaagaaggaggattagacgatgctcaaacaattactgcaccgcctgctacattccacctctcattctcataagcggcgatacagcagctcagaccgttattatgaacgtgaacgtaaacgtcattcttcttcagacggttacaagaatagccacaatggacaccgctattacaaggataaacgccgtcattactccagttcttagccaaacaacaagaagtagcgacggaatagagcgtaacacaagaagcatgccacaggctccttcaaaccctataaagcgaagacccttcttatctcaagggccttcgctttattgttgtgcgcccttcgttatgcagggcaacatctgtgcattttacaggaaatcggccaagaccgaaattacagaaacagggttttagagatgatcaccagcaaaataaacagaaccagaatcgctcctacagaggtccatgctcctacgccgcaacccataccgcctactccacacatatgactcatttacaacactcccttcgctcatttacaggatcattgtatgtagacatggtcaaatgcgtaaggggggcattcccccatttttgcggcgaatgcctgtttatttttagggacgttatgggttaacctcaagcagcagcaatgcttcctccagctcttgcataaactgtcggctattctcataacgtggccgaatctgaaaaagacgctccagcatgtgacgcacaggtgaactcagcttcaattcttcctgccagcttgccggcggttgatccggttgaggctcgtaactgctatatagcataaaaagcattaaatgtccgacatcgtacaaatcgctgtagacggcgacatcttgtcgctcaggtgcacgcttttccagcatggattcggtaaatacatcctcctgtcgctctcccaacgccagagcaagaccaaagtcgatcaggtaaggcttcccctcatggtgaagcacattgggaatacggatatcccgatggatatagccccgttcatgcacatgcagaactcgctccattaactccaaaatgtagacaatgcattcctgttcggtaaaggaacgctcctgttcaaatataagctcctccaacgtcatgccggagatgtattccataaccacaactattccgttcgaatgttcgacaatttcgagcagcttcggaatataggggtgttccatctgccgcataatatgagcctcgcgctgcaatagctgaactgccttcgcccgtttgctcggtctgggcattttcactgccacctcttgtccactgtgccgatccagacagaggtaggttagaccatagctccccatgcctaaaagtgaacgaacatcataacgtccgctcagtaaatcgccaggctgtttcggataatccatccatgattcatatgcgtttcgcaaccaagcaaacatatttagatcctttcctctacatgccgcagcaacgtttcttatacggcttgttctcgtattcttgtattccgttattataccatccacgataaaagaccatcagaaccgggaaggtctgatggtctttatcagggaagatgctggttatgcctctctgcgtctgcgcggtgtcagaccaagccaggacaacaacgaaccgcgcgatttgcgttgcctgccctggtaggtacgcaaattagtaattagctgccggtctcgttcctcgtcaaccttttctttcatccagcgtttttgatcctccagttgattagacaggctgatattcttttccaccaaacggctatgctctgcttccagctcctccaaacggctccgcatttccgacaatgcagtttgcaccatgtcctgcatctgcgccagttcttgcggctctacggactcccgcgtttgtacggatgcaggtgcttgctccaatctatactcaatagttggttccaaagtctggaactcttcctgcgcctgtaactgcataggttcctctgacagttcctgagcattcatttcatcctgtaactctgtcagttctaccgtagcagctgcttgcgcctgtatgaccgtctcttccctgccctcagccgccgccattatttcttcccaggttgcggttagtgactcagcatccgagatgggtggcaagcggaattcttcatcctccatttgaaagggagcggtcactctctcaagcaccacctgaaccgcctgctccatcgtcatatgctgctcacgcaacgccctccgcatcaccttcaagcactcaacatcctcagcactgaacatcctcgattgattcgcggaacgctgaaacacatacccctgctcctccagcgccgctgcatatttacgaagggtactcgccccgattcccaactgttttgctgcttccgtcgtcgatttgctttcttccatttaatcattacctccccggatggtatggaaagaaataagcttgtatatgtagaattcgcgaaatccattggaaaccctttggcaaaaatgttctaatattgcagactgctaagaacctttgtcataacggaatatttgtagatatacaagaaacgacattgcagagcatacttccgttctgtatgtccttgaaactctttaaagaacgtcatataaatgtcatactttcattgttttcatggcactattccttccatcaagatagttcaggttataatttgcacagaattcaccttaaaaataaattgaaacatgctctcctatcttccagtaaaagtattgataattcacgttcactctataattaatcctaaagaacacctctattcacagtttatttttaatttcccggaatggaggcaaaaaaatggatattttcaaaagatcagcaatatgttatgttatgtaacgtaaaatgtatttcaggcataatttgtagcatattaacgttcgctggaacgaggaggcaacatagatgaaggggaaggcaaggaaagtagctattgtcggcgcgggaatggtcggttcgagctgtgcctactcaatggttaatcagtccatttgtgatgagatcatgatgattgaccgcacgtatgatcgggctttggcccatgcactggatctgtcccattgtatggattttacgtccacacgtaccaaggtgcgtgccggcacgtatgcagactgcacggatatggacgttgtgattataacggctggagccaaccctaaaccgggtcaagaccgcctatctgtgctggacgacgcagtgcttattaccagagagattgtaacagcgattatggagggtggcttcgatggtatattcgtcattgccgctaatcctgtcgacattgtaacgtatatggtacaaagtatatccggtctgccgcgcaacaaggtgatcggtacaggcacctccattgactcatcccgactcaagacgttgctttctgaagtattttccatagatccgcgtagcgtacaagggtatgctcttggggagcatggcgaatcccaattcgtcgcttggtcacacgtcacgattggcggcaagccgctcttacacattttgcgtcagcataaggaacgattcagccacgtcgatctggacgacattgcccgtaaaactcgggatgcaggctgggagatcttcacccgcaaaggggccacttattttggtattgccaatgcgctggcgtacattacccgttccattttaaatgatgatggtaaaattatagcggtctctgctgtattggacggcgagtacgggcacaccgatgtctgcacgggcgttccggcgattatcggcagcagaggaatccaagaggtcattgagctagagctaagttcggaagaacaagcgaagttcgacgcctcttgccaccttatcagcaataatatccgtgccatttcaggcttagtgtaaaccaatggcacagtaaaaaactccttacactcattgaggataaggagtttttgcagtccccgtatttcgccctatatctctttataacgaaatactgtcagtcccgccaacgtaaatacgacaaagctacctattataaccgtcaacagtgtgtcagttggcaccatgaacgccccgaagttgtctcttccactcggcatcatcgccaataaaggctgtgtccatggatagtatggaccgtaggtttgagaattggcgaccagaatattcggcacggtgaagacgaaattcaacgcaagcggtgcggcaaagctggaccacaagaaggacaccatcaactgcaacgcagccagcggcaggcaggctacccagcctgcgagcaaactttgagcgatcacggcccatgggattggtccgttcatgtcctgcacagctccaacacccagcagcgctcctccgaacagtagctgggtcaatccgaccaaggccataataatggtcaacttagccgcatacagactggtacgggacaatggcaatgacatgagttgcttccaaccgccgcccccatgctcgaatcggcagactagagatccaaatacggcggtcagcatcggcatgaacagcatggcatgtaatgtaagcatggcagtcaacagcaacagccagttccctcccggattcgccagcaagccaatcaagacggcaatcgccgggctgacgagcgcaagcagccaaacgggcgatttggccattttcatacgttcaacagaaagcagccgtatatatcctccgaacattacgccacatcctttcggctaaaatgggccgctgtcagcagactgaggagtatgcccgttccgcacccgacggacgcaaacatccatgcttgaggtgcaacccatgcgaattgaggccaggccaacggaaaccattcggacagctgtgaagcaaacaagctgccgatgcctaacgtaatgcccagtgttacaggcaacgcttgattatggaacgtgaccgttaaccacaataataatacgagcataggcagcgtgccgcccaagggccaaaacccgagtcgtagcagttcccctatcggtgcgggctctcccccgaagccaagaatcattcccaacgcccaagtcccgaccgtcagcagtagacaggacacgcacagcattccaatggccagtgctagcttggccatataaacgctaaatttggatataggcaaagctagcagctgcttccaagagttagacgaatgttccacattcgccagcatggaagcgaccatcgtagctcctaataccagcgcaagggggacaaaaatagcgatgttatccatcaagccttcccataagcgccccttgtattgcggaatcagataatcatagcggagtccaaagttcagtccctgcatcgctaccagccctaggggaccgaggaacaccaagaaccagattccctttctgcgtgctttgagcagatccgccgtgaacgctcgcagcatcataaggaagcccctcctttgcccactacctgcatgaacatatcttccagcgatttgcggcgttcctccacacggtacacggcatgcgtattttcgaccaatcttctgaccagcagcgcaacagccgcatcattcatgttctcgaaatccagcgccgatccgtccttcactgaatggtagccctgctcacgcgcaatcaactgggctgcttccggttccgacactacgatccgaatcccgcctgcggattcctgacggagattatgaatcgtgttttgaaagaccaactctccttcacggataatacccacggtattcgccatatgctctacctcactcaacagatggctggataccagtacggtgatcccccgttgctcgggcatcgcctgaatcaatgtgcgcatttcctgaataccctccgggtccaaaccattcgtaggctcatccaaaatgagtacttcgggattcccaagcagggctgctgcaatacccagtctctgcttcatgcccagcgagtagcctttgactggacgtttggcatgcttggtcagtcggacgacctctaatacttccgcaatgttttgcttgggtacattcaaaatacggcgaatggcctccagattttcaattgcgttcaaatgaccataatacgaaggatactccaccaacgagccgactttacgcaaaatatcgagcttatgtctgcgaatatctttgccgaatatacggatcgttcctcgagttgggcgaataagtccaagcagcatgcggattgttgtcgtttttcccgctccattcggacccagaaatccgtaaatatctcctcgagctattttcaggtccagctgattaaccgccgcgcggcctttgtatattttgctgagactgttcgtttcaataatgtattcgttcaagttcctcacctcgacacctatcgtaacgtgccaagtttaaagccaagggaactctgagtttaagttttgtttaaaaaacggattcgggtcccggctgatgaactgataatctccctctccaaattcatttcgcgagccagcagttctgtaatcgccaaaccaatcccggcccctttttcactggactgttgctccataccgggccctttatctacgatgaccaatgtctctgtcccattatctttctgtacttgaacaccgatatatcggcctgcggcagcatggcgaactacattttgaaaaagattatccagcagacggcggaagccttgctcatcgacattccacaccatactatgttcgggcaggtcgatatccacttcaaaaccctccttttcccacaccggataccagctggctacacactcccgcactagccgcaggatatcacgcggtgtgttattcatagtgtatttcccactagctagcagattataggtgagcagattgtcgatcagactcccaaggtcttttagcttgttttccatcagtgtaatcgactgtttccctctgctgcttagattttcaccatctagtgtatacagatggctacgcacgaccgtaagcggcgttcgaatatcgtgtgacagatccgcgaccagtctcttccgcagctcttcctcctgacgctcacgtccccgactttctgccaactgctcaaccatctgattaaatgcttcttccagcttgccgatttcatccgggcgtccagtggtaacaagaataggcaagccatcctctcctcgctgcgacatggcggcctgaagctgcaacagtctacgccgaatgcctccaaaaaacagaagagatacgaatataaaagcgcccaaaaccaatacgataaaaaagagatagtacatgaacatgctactatctgtaggtggctgttcaaagaacgaacggggcacttttaacaccatatagccctgatttacatcattcttgcccccgccaataaaggctactaccgtaaacggcccctcatagcttgcttgcttcataaaagctatagcctgcgcagcgttccattgttttggcatgttaggttgtgtcggtaactccaaccttgttttacctgcggtatccacccaaaatatttgtgagttagggaacatatcttgttgtattttgcgcagatgggctgagatttgctctggtgtggctcccttcaaagctacagcttcgcgatgccagctattttcggtatgggtagtagagggatagtaagcgtttttaggcttgagctccgccccccaattcaataacacgctatatatcaaggctgtagcaggcaacacaatgggcaatagcatcatagcaaccacaataatgaccagataacggaacaacagtgaactgcgaaaccgacctccctgacccggcctagagctggggtgcagcctcctccaatttttgcgcgtcctgctcattatgctttcacccgatatcctacaccacggatcgtctcaatgatgcggggtgccgcaggatcgatctccagcttttcgcggagatgtcggatatggaccattaaagttttgtctccgtcgatatatggatctccccacaccgcttcatacatttgctcttttgtcataatttggcccaaatgccgcagcaaataagcaaaaatgtgatattgcttgcctgtcagtgtaatttcctccccggtatcacggttcacaatacggttatcaggagagaacacagagagatgccccagttgtaaagattcttcgggcacggttcccgagcggcgcagcaaaatctctatacgtgctatgagctcatccgggtgaaagggtttggttacataatcgtcggcgaaatccagtccttgcagcttatcgtcaatggatgtacgggcagacaacatgagaatgggaagctccgggtactctttcttgagccgcttccccatggtgaatccatccagaccgggtaacatcacatccaaaatcacgagttggcacgtacgggctgcttccacagccccatccccgctgcgaagccaggttacagcgtaattccgctcttccaaatactgatgcgtccaagcaccaatatcctggtcatcttcgatgtatagcacatttgttttcataatagacacctacttatcgtttttcttttatgtaatgggcattatagcatttatggtacatgacccacttaaaaaggttaataactaccttatacgacatacgcttcacattttcaaatttgaatgctcgtgaaaaaaggaggactacccgatgctgctagaagcgatataccatcacccgaaacgtaattgggcttttggttataatgatgaaacgatatttctacggctacgtgcgaagaaaaatgacctgaataccgttcatgctctcaccggagataaatacgattgggaccgtacccgacagcttgtcccgatgtccaaattcgctaccgatggcaggtttgattattatgaatgcagcataaaacctactcaccgtcggctgaaatatggatttttgctagaagacggtgaggaacgtatttggatgaacgaggacgacttcaccacccaggaaccccaaaatgcagataaactgttccaatatccgtttttgaacccgattgatattctgaagccacctgcatgggtgaaggatgctgtattttatcagattttcccggaacgttttgcgaacggtgacccctctatcagcccagaaggtgcagagacatggggcggaacaccacaaagagacaattttttcggtggtgatcttcaggggattctggatcacctggatcacctgaacgagctagggattaacgccatatatatgactcctgtgttcaaggcaacgaccaatcataaatacgatacagaggattatatggaggtggacccgcattttggggacaaaaagacattaaaaaaactggtcgatgcctgccacgaccgaggaattcgggtgctgcttgatgcggtgttcaaccattcagggcgtacgtttaaaccgttcgttgacgtgcaggaaaaaggcgaagcctcgccttacaaggactggttccatgtacatagctttcccctggaagtggtggatggcacaccgacgtacgatacattcgggctggaaccgatgatgcccaagctgaacaccgaacatcctgaggtgaaaaagtacctgctggatgtagcaaagcattggatcgaagaaatcggtatcgatggttggcggttggatgtggcagacgaggtggatcacgccttttggcgggaattccgcactacggtcaagcaggccaatccagatgcgtacattttgggtgaaatgtggaatgaatcatctgaatggcttcagggggatcaattcgatgcaacgatgaattatccgttcacctacgcggtaaatgattttttcgtcaaaaaagtgaccgatgctcaaagctttgccttcgccatcggacgacagctggcccgctatccacagcaagcatccgaggttgccttcaatctgctggatagccacgacacaccgcgcctgctgacactgtgcggggatgacaagcggctgatgcgactggccgccctgttccagtttacgtacatgggcgcaccctgcatctattacggcgatgagatcggcctggatggagatgccgatccaggctgccgcaagtgtatggagtgggacaccgacaaacaggaccgcgagctgttcgacttttaccgcgagctgattgcgcttcgtaaggggcacccggtcctccgtgatcagggaagcatcacctttttggaggcacagccagagggcacctcacttgcctacgagcgccgcagcgaggaagaagtactgctcgtgctgctcaaccgttccgatgaggatcacgtttttgaactggacattcctgagcaggaatggcaattagcctttggcgaaagccagtggtccgttagagagaaggggctgcttgccaagcttccaccctacggatacgctgtactgaaggcagcgcctgctcggtcagtaaaacctgcttaagaggacgatgtcaagacgggaagcaaggcatccgcctataaaggcggatgctgatgaaggtacctgccgaataacggcaaaaaagcgaaaccaccaggaacaagatagttaacttgttcccggtggtctttttacgttgaaaatgagcttctattgtcgattatttgtttttaacatctgttcttactaccccaacatccgaaacattgatcgaaatagggttaccgccttgtcctgtctgagctgaagaagacagccagtacagcagtttacgcgggtagcgtctgtgttttcaattgcacgtacaactggtgcgtcacctgctgcggctcaatacccaactcatcttctagtattctgacgaagctttcataatgcttttgcgcagcggtataatcgcccagttgggcgtaggcggtcagcagcagactgcagatatcgtctgagtacggctcccgttgctgtaggctgagtaagcgctgaacagactgccgggtacgacctgagcgaagctcttctctcgccagctcagaagcacatgccagatacatattgcgcagcttctccctttttgcatacgcccacgggtaatcgtgctcctccagatagttgccacggtatagtgccaacaggctctcaatacgcggcttaccgccgctaccggatgcagcccattcggatattccccgctcgaatagctccacatctgtaatccagccattgcggttcaagcggtagcgatccagattatattccagcttcgtatcttgcatccgttctttcaacgccttgcggatttggtaaatggatgtgtgcaggtgaacaacagccttgtccaaatgatattcaggccacagcgcatccagcagttgttctttgctcacccattccccttcatggtgtaataagaaggaaaatagctcctgtgactttaatgtgcgccatttgaatggtttcgcacctacggcttcctgtccatcctccaaaatttcaagtttttgaaaacaacgtaccttgggggattgctctgctgaagctcccaaactagaagaacggggatcagccagcgtggctgcaatccgatctaacgttttggatagccgccgggcatgaacgggctttaacaagtaatccagtgcttgcagctcgaacgcttcaatagcatattccgagtacgcggtcacaaagacgatatgaatatgagaatctagctgttgaatccactcggcggcctccagaccattcatttctggcattccgatatctataaaaacaatatccgcacgttctgccgccagatgatccagccccgcttgtgcagacgtatatttgcccattaccgttaaccgtccgtccgcctccagtaaccgttccaagtaggttaatgccgacctctcatcatcaatcaaaatcgccttcatttgtgtccgtactcccttcctgctgcaaccatttatcatgatgctctatttacatgctatctgctttatccttacgatttttaatttcttatattttatatatcgtatcattgcgggcgtgactttagcttttccgacaaatgcactgtacttttttttattcatcggtattccggggcgagatcgtttccggcacacggaagcttaccgtcgtcccttgcataggattactttcaattcgcaatccttctccatacatatggataagacggcgatggatattacgcagtcccacgctggaagatacatgatcctccgacagcagctgttccagtcgctcggacggaatccctacgccgtcatcggtcacgctgaccacaaaatcggttccatcctcctgcacaaccactcgcacggttccacctgttgcccgttgcatcacaccatgccgtatcgcattttccacgatgggctgaatgcttaatggcgggatgagcgaccggatgttccttcctacctctacggtcacctgcaaacgttcttcaaatcgtgctttttccagtgccacatacgattctaccaattccaactccttagataatggcactgtattctccctgttctgaaaatcaaaactgccccgcaaatactgactcagttccatgagtagctccgttgctttgtccgggtctacggctacggtcgaaacaatgacattcaaggcattgtacagaaaatgcggcttgatttgtgcctgtaaaaaggccatttccgaacgcaccgcttcctccgccgaatgacgcatgttcaacagcgtgcgcacacgcgcctttaattcctcagcatcaacaggcttacgtagaaaatcattagctcccgccataaaacctgcgcggatatccccgggcaggtcgcgtgccgtcagcagcaacaccggtagctcggacagggaataccgttcccgtatccgtcggcacagctcaataccggacatttccggcatcatccaatccgtaatgactaggtcaaatcgggaacggccattcagcatgtgaagtgcctcctcggcatgatccaccgccaccacgctacaacctgtggtatataataactcctccagcacccgaagattaaccgcatcatcatctacagccagcactttgtaaggaacagtctgaacttgccccagtgcatcctcttcatgcggaatcacattccgacccgacgtcacaccaggctgcaatataaccgcagacgaaacatctttttgagcttcatgtgccaacgttccggtctgcgctaagggcagtgtaaaataaaaggtcgaacccttgcccaatctagattctacccggatatgaccaccatgcagctccaccagacgacggactatgcctaatccaagccctgttccactgtatccttcatcctcagcattcgcccctcggttaaaaggttcaaatatattcgaaagatgctcctgggcaataccggacccggtatccttcacactgatttccatttcacggttccccgctttggcagagattacgatttcgccttcctccgtaaatttcaccgcattacccaacaaattgtacagaatctgaatcagccgatcctcatccgcatccaccttgggcaacgaattgggcatttctttgacaaattgaatctttttcttacccactgtatgacccaatacctccagcacggacttcacagctgcctgtacattgacaggccgacgatttaaggctaatctgccatttttcaaattagaaaaatccagaatatcgttaattaaaaacgaaagtctgcgtcctatattcgcaatcaagaccaagttgtgcttttgcggctcattgaattgtgtcccgtagcggtctagcatggattgagcgatattaattactccatgcagaggagtgcgcagttcatgtgacgtatttgccagaaattcatcttttaacccatccagtgttagcaaccgtcgtgacaggttctcaacctccctaaacgaatgtacaaaacgtttggccagcaggagcgtttgagccaatacgaatatgagcatttcataggctgtcactccacgcacatctccccagcccagaatatacacaaaactagtcactacaatcataagaatgctcataatactaatgactagcagtgcagcgtcatccgtccgttgaagaagcccacgaatcaagatcagtaatacatatcccacactgactacaccaaaaagaagaataaacgcttcaaaggatgagagtaccaatgtaggcagaaatagccccatacccagcatcagtgcggttgtaatattatagaggcgcagcacgagccgattcataacaatctgcgtcgaaagatgaacatagtggatcagaaaatagtagaacagggttgacgagaacgactgtattctcagtatccattcataaggtaagtccggtattccccaagccagcagcttttctccatgtgtcagaatataaaataaagccgcgatacaaaagcatcctaagtaaagcaatgccttctcctttttacgtaaaaggtatagcatgataaaaaatacggtaggaataaaaaatcctgctatcagtatggtgtcctctgccattgcaacttcccggctatgcgtaatactctcgtaatccccaaataacagtggataaatgattccaccggaggagtagctataattagccacatgcacggtaatatcagccgaatgtccatctatcgctgcaaatccaacatagggaacattgccctgcttgcccttgtcggcagaaacagagggaataccacttgctcccacgttttctccgtcaatccatacttgactggcgctgcgaatgttttgcatatagatgccgtacagattttccgctttttcaggcaacagcacacggatatgataggttccatatccggtcgcctgtcccttaggcatccactgattccatttaccaggcacatccacaatcttggcagaagaactcgtttccagcctcaactctgaagaactctgatgattttcccaatccttatcttgttgcatttcatgaaaggatgaaggttgcacaagctgattggggtaaaattcccactcccctcccagctgtacagggccttccttttcagggtcccaattacgcaaatcaataacaccgttgtgtgctttccaatgactgtttccggataaaacacccgacactaacggatacaccggcaacgcaaccgcaagcagaagtataataaaaaataaaaccccctgttttttcataaatcccccgctcttttcaatatcgtctatcttttagtatcggttattctaaccagctgtattagaagcgctgcccatgcaaaaagggacgcccgccgcagacaaaaatctgtgcggaatcgtccccttttatacacccttgtactttctttatttcccttattaaggaatcatgccttcatcattaccaccgccaggaatcgagcctgaatcgtctccgctgctatcgcttggtggtattactcctccactgctgtcgccgcttcctgttccgctgttgtcgcttggcggcgttgctccaccgctgctatcgctgcttcctgttccgctgctatcgctcggtgatgttactcctccactgctgtcaccgcttcctgttccgctgctatcgcttggcggcgttgctcctccactgctgtcgccacttcctgttccgctgctatcgcttggtggtgttgctccaccgctgctgtcgccgcttcctgttccgctgctatcgcttggtggtgttgctcctccactgctatagccgcttcctgttccgctgttgtcgcttggtagtgtttctcgaccgttgctgtcactgcttcctgttccgctgctttgttgctggctggctacaaaatctttatactcctgaatcgcatcttccagattcatataatttttcttgatttccggcataggataatactggtccagacgattgaatgcatccactactctgtgaaagtagaccgtcgtaggatctgtaccatttactgtaagcagattgttcgcaatgttcttgagctcattgatatcaagatcagttacgatccatttggattggtagttcgaaagtgctgtaatcaaatctgtgttagcctggtctacctgaagctgtgtaatatccggagtattaagcacaaggtttgcctgattaatttgcccttgaagttcttcgttatcttgttgggtataatgacggccgaacgtctgaacttcattattagctatacttatgtttaaatttaacaacatggtatccactgctattggtgcagcatacttgctctgtacctgtttcaactcctcgtatacgggaacaacgtcttgtaattcaaagctgggcaaacctaagaagatagaggcatgctctgaagcagaagacaaagcttgctgggcttcagcgcttaatgcgcctgaattttgcaccaaaattccattgatcgatgtctgcatttcaatgatttcgtgtctcaattgtagccttttctcgttatatttttcaatataggcccctctagcctgacttaattgattataagagatcaccaattgctcctcaggagtaaacggcatcatgagtgcaaagttggcttgttctgttagttgctctaaagggagcatttccgtattcaaataattacgagcgatagggtcagacagcagttttagatgaacgtcatgaaccagctgctgcagtttttcccgagttgtagcaggcactggcgcagtgaattccgcaagcctttgactcagctccatgttcaagttcaatacatccagctgcgtcatagcggtgtgcatcttctctgtatactcctgaatgagattgtctagttcagcattttgagaaccactctgatcgtagataacctgcgcttcttgtaaagtatttttaagcactgagaagtccgctgcttgcagtgccaagaatgattctgtggtaccttctattttttgtgtccattcgtccaactgctccgttgtagttaatgggttcacatatacatttaatccttctctcactaaggacttgtaacgcgctttgtctgttttcaaattctccacacggtccgttacatcgagaaaatgcagataggcatctctgagtcttaccgatgcttcatatactttaattactcgacgcaggcttactacttcccgatccactatattttgaggcgcattcccttctaacacattattgccaaattgaattgcttgacttaatgaatcatcccaaagaggtgggaattcgtcgctaaccattcgattttgctcaagggtagtcgaagctacctgaatcagtctaactaattcctgtgttccaatcaccggttctgtggctgaatctgtgtacgcagaaacatcctgtttcaatgtgctgagcgcttgatctacctctgcctgtgtagctgtagtattgttcagtaccagcgtagcctgatggattgctgccgacaggctttcctttgccgtagccgggtagagtgcctgatccggtccaccctcacctgcacgatccagcagatctttggctgcatggacttctgcctccagctgactgcggtctacgttgacaatgtcactgttgtgttttttcttatctttgctctctgtttccgtgacaaccgatccagtagaggacgagttcgtcgagccattcacgagactaacagcttctttcatcgcatcatagttaatgataacatcctgcggctgtttttgttccggcaggttaagctggttgattgtagctcccttagccagcgtaataaaaggaacgcccacatattgtgatgcatccagcaaaccaatactaccgctaaccaacagcttgcccagtccctgttgcaacgaaacgcggctaatcgcggcatttccctcggtcacgatcgatgcgtcatttttcagcgtcaggttgtcgatcttcgtcgtcccggttgcagtcagcttgccatccttggagccaagctccacaccagaccatgccgtattttccaaaatggccgatacaggctgggtccctgagcctttgatttccaatacccctgtagaggacatgttcttcaaggttaccgagccattaacgatcaggcgcccctcaaaagacacgcccttgccgtcaaaaacgccaccgtctgcgttaatttccagcttattcacacctgtcagtgtacgtaaattacggttaaggtcgaattttgccccttttaatacagctttgttattttcaccaaacaaaccttgcaaagatccctccaactgatacgggatatttccgattcgaacggtattgccctctgatttcacttctcctaccggatgatccagcaggctgacgaatacttccgcaccactctcccggttcaatggatttttcaaatccgttgtagaagcatcctctgataacagaccataagagcgggcaacttgaactgcattttgctgtgcattcgctgtgccggtatcctgtaagtccattgcacgtacgagcgatacgatcagttcttccttggtaatggcatcccccggacggaacagttccccgttacctgtcatatacccggctgcacgtacagcctcaatatagggagcgccccatgcatcggacgatacatccataaaagaagtctgcgactggttgttaatttccaactggaacagactgcacaaaattttagccgcttctgcacgggtcaaatttttttgtgccataaaatcgccctgattaccgcctgtcatcaaacccaaggtgcgagcttgtgttacaaatccagtttcgctttgcgtatctgctgtcgctgcataagcagtctggacgccgcccacccaaggcagagatacgattgaacctgaagcaatacccaataccatcgcagatgcaatccatttattccgatttacaagtttcaacatttccactcctagacactatttattggcatatatcctgttatatcaaaggctttagtcatgtttagttctacgatttatgcaaccaaggaactatgctaagagaagtatacgaaaccccactgaaccgattctgaacaattagtcctatatgaaggcatcacgcaacaaaatcgcttgacttggagtgaactccaaatgtaataatatccggtgtaagtagctggagtagactacatttgaagaaaacaatatctaggaagcgaggtataatcaaatggactatgtgaaacttggaaataccggcttggatgtatcccggctttgtcttgggtgtatgggctttggggttgcagaacggtggattcacccatggatactagatgaagatcgcagtcgtcccattataaaaaatgccctggagctaggtattaatttttttgataccgcgaatgtatattcagatggaactagcgaagaaattgttggacgggttttaaaggattatgcgaatcgagatgaaattgtcctcgcgacaaaggttcatttccgtatgcatcaaggcccgaatggtgcgggactttcccgaaaggctatcatgagtgaaatagataagagccttaagcgactggggacagattatgtggatctgtaccaaatccatcgctgggattacaatacccctattgaagagacgatggaagcattacatgatgttgtgaaggccgggaaggcaagatatattggtgcttctgctatgtacgcatggcagtttctaaaggcgttacatgtcgctgaaaagaatggatggacccgatttgtttcaatgcagaatcatttaaatctcttatatcgtgaagaggagagagagatgctgccgctttgtaaggaagaaaaaatcggtgtgattccatacagcccgcttgcaggtggaagattgacgcgtgatgcgcaggaaacaacacatcgttccgaaaccgatcaagttgcgaaatctaaatacgatgcgactgcagataccgatcgattgatcgtggagcaggttgcggccatcgcagaaaaacgtggagttccccgcgttcaaatcgcacttgcctggttgctacagaaagaaccggtaacagctccgattatcggtgctacgaaaacgtctcatcttgaagatgcagtagctgctctttcgattacgttaacacctgaagaaatcgcattgctggaagagccgtatgttcctcatccggttgttggcgctcagtaaatatggatgaaatgacagtttcgaaataagaaacgacaagaacgccctatccatttacatagggcgtttcttgatcagaaatcaggaggtgaagtctgcatgttgatcgcagaagtaagcaaaaaatttgaactatctcaggatacactccgctattatgaacgcatcggacttattccgcgtgtgaaccgtaataaaagtggcatcagggattacacggaagaagattgcagatgggttgaatatattaaatgtatgcgaggcgtaggacttcccattgaaattttgattgagtatgttaggttgttccagcaaggtgatgaaacgatgaatgctagaaaagagctcctaatagagcagcgcaagcagctcattgcaaaaatggaagatatggaaaatgtgttggaacgcatggattataaaattacaagctatgaacagacaataggtgaaaaagaaaaacatctaatttaacccctgcgtgctttgcgggagagcagattccccaaggactgaacaccttgtacaaacaagactagaatgatgacggtaatcagcataaccagcgtatcaaaacgttgatagccatatgcgatcgccagatcgccaattccgcctccgccgaccgcaccagccatagcagtagcaccaatcagaccaatggctgctgtcgttaacgacaaaatcagagaactgaatgcctcaggaagcaaaaagtatcgaatgacctgatacggggtcgcccccatcgcatctgctgcctccaatatccccggatttacctccaacaacgagttttcgaccagccttccgatatatggcgcaatatatataatcaaggggacaattgccgcactggtcccaatggatgtattcacaatcagacgggttaacggaatgatcgcaatcagcaagataataaacggtaaggaacgaacaatgttaatgattggattcaaaatattgtgcagccatttgttctccagaattccgcctgaacgggtgatgacgagtaaaataccgatagggataccgatcagggcgccaatgaataatgatatgctgaccatgagcacggattcatacaaagcttcccacagttgatcccaggtgatcgtagttcctgtaatcatcatagactctctacctcctgaatatggactcctttgctcttgagaaaatcaacagccttctgaacggcatgctgtccaccgcgcagttgaatcgtcatatagccaatcgtcgtttcttgaatctccgtcatgttggcaaacaaaatattcacgtggatatcatgctcccgaatcaattcatgaaccaccggatcagaagcaacctgccctataaattccagcttgtatattcgctgtgattcttgctgttcgaacgtttgcagcacactctcgggtaccgtatcgtgaatgaccgtgcgtacaaagctctgcgtcgtcgggtgctgcggctgcccaaatacctccaggacattgccctgctcgatgatttcccccttttccattacggctaccttgttgcaaatccgctgaatcaccgacatttcatgggtgatgatcaaaatggtgatcttgtattccttattgattttacgtagcaagtcgagaattgactgtgtggtctgcggatcaagtgccgaggttgcctcatcacagagcaaaatggacgggttactcgcaagcgcccgtgcaatccccacacgctgcttttgtccgccggaaagctcgctggggtagctattcgccttgtccgacaatcctatgaacgccaaaagctcttttacacgcccctctatttcgcgtttgttgcgcttaagcagcaccaacggaattgcaatattgtcgaacactgttttcgattccagcagattaaaatgctgaaaaatcattccgatcttcttccttaccttccgcagcccagaggtcgagtaggtatttaactgttccccctcaacaagaacctctccgctggttactttctccaggcgattgaccaaacggatcagcgtacttttccctgcgccactgaatccgataaatccgaaaatatctcctttatccactttgatatttatattttttaacgcttcaatacttagaccttttctcacataggttttggatacattcctaagttcaatcatgagtcctaactccttccgttctcacaagtatgtaagatgttctaagctgattgcttttctttggcatgaatgatcgaattaaatccgagtattctagtgagttttataaagtatactacttcgatttaatatccatgtcaatatgtgttttgagtctggttagttcacgtccttgcataaatcagcatgatattgcaaatggtatgaaatatgccgaagcatacacaccttgcccgaacgggacggaagcggaggaagatagatgaagcgaatatttaccttgtggctatgcattgcagttatagggatgttgacagttacggcagaacccgcatgggctactcagactgttggcggacagccttatcattttgggttcaaaaaaagtaagggaggggagctgccttccatcgcacaagaaggctttatgcaactaatcgaaaggcaaggtggcatctttctgggggataccactaaaaaagaattatttctcactttcgacaacggctatgagaatgggtatactcccaaagtgctggatgtattgaaggccaaaaaggttcccgccgccttttttgtgacagggcattttgtaaaagaccagcctgatttgatgcgacgcatggccagtgagggccatattatcggaaaccattcatggagccatcctgatatgagcaccatttcttcgacagagatccggtctgagctagatcgggtacgaaatgcatcggcagagctaaccgggcaaaaagaaatgaaatacgtccggccgcctcgcggcatttttagtgaaaaagcattggcttcctgtcgagaagccggatatacgagcgtattctggtccgtggcttacaaggactgggacacaaatatccatcaaggaacggactatgcctatcgtcaagtgattggtcagctccaccctggtgcggtcattctgctccactccgtatccaaggacaatgccgaggcgcttggttccatcatcgacgaggctcgcaagcaagggtatgagtttaaaagtctagacgaccttaaggtgaaacattatcactaaatagtaatcgaatttaatgagtcgatacgttatcagcccgatccacacctgcccatggtagccagtgtgaatcgggctttttagtttacgaccaaggaaggtaatggatataacgatatggatgggctggctgccaagctttcgccactcggcgtggtcatccatcaataccgtaatgaacaagtgctggacatcagcccgcaaaatatccataaatggaacgcgcttcagaagcttggtgtgcagccctgtcaatttatcgccttcggcaatgatgcgaatgatattccgatgttcagggaggcacaccattccgtcatgattcatcaccatgctgaactggctgccttcgcgactgaatcgatccctaatgagggggaaaatcaagaagaccagattatcgccaaaatacgtgagttggctgaaatagtaactatttagtccaatgctaaggaaggggagcaacgcctattgcatggttagcttatacaccctggcttcataagggcgcagcttcaaggcatgcagttgttccccttgaaccggcttgtagttggacagcagcagctccgccttagcgacaggaaagtcctcctcgggccagtggtacaccggatcacggtcaaagaaattcaaaatgaccagcaaacgctcttctcccagcatacgagtgaatacatacagctccgtatccagcggcaacagcagcttgtattcgccatagactatgacctcatgttgtttacgcagagcaatcaacttgcgataatagtggaaaatcgagtctggattacttctttctgcctctgcattaatgtgtgtgtagttatcgttaatcttcatccacggctctccatcggtaaatccggctgagggtccagcattccattgcatgggagtacgcgcattatcccgacttttccgccagatctctgccataatctgttcctcagactcaccgatcttccgttgttgctcataataattcaacgtttccacatcccggtaatcatcaatggacgggaatgcaatattcgtcatcccaatttcctcaccctgataaatataaggcgtaccctctagcatgtgtgtgaaggttgccagcattttggccgactccacacgatattgtccatcattcgcaaatcgcgagagggcccgcggctgatcatgattgttcagataattggcattccatccttcctcatgaagcactgtctgccagctgctcattatttttttcagctccaccagtgtccacggcttggatttccatttttctgtccccagcccttgggcatcaataaacatgtgttcaaactggaaaaccatattcagctcatgccgctggtcccctacataatcaagcgcctgttccggtcctaaaccagacgtttcgccaactgtcattaagggataacgttccagtaatttttcattcagcatccgtagaagcacatgtacctgttctagattggaaaagagctgataggcacgtaccaaggttcgtttgtcaggattatcagcatccggcagcccttcggctttgacaatatgggcaatggcgtcaaaacggaagccatcaactccctttttcagccaccattccaccatgcggtagagctcgcccaccatctcttcattttcccagttcagatccggctgatgctcggaatacagatgcatgtaatattcgtctgtaagcttgtcatatttccacactgaaccggaaaaatacgattcccagttgttcggatatccgccatttttgcctgttcgccatatgtagtagtcccgcttcggattatccttggacgaacgtgactccgtaaaccacggatgctcatccgatgtatggtttaataccaaatccatcatgattttgatgcctcgttcatgcgcctggtgaagcagttcgtcaaaatcctccattgttccaaactcatccataatggcataataatcactaatatcatatccgttatcgtgattgggcgatttatataccggacaaatccagattacatcaatacccagctcacacaaataatccagcctggacaaaatacctcgtaagtcccctttaccgtctccgtcagaatcctgaaaactgatcgggtaaatctgatatacaacggcttccttccaccatatttttctaggcatgtttccctcctgtagcttctctgtacatccaatagcttatgctcttaacatacacgcaatacctgtctgcgaatcgttggtgaaggggaacaagagtcttgtaagcttgcttccgcgcattagcagagccgctataacctacggagatttattttaaaaaaatattttgcaaaacaggttgtaaaagtggacctggcgttacctatatttatgaactgaccatatacatgtactcaaagcggtgccatttttgaataaaaggaggaattgacatgaaccatcgacccaaggagccaaaggatctgattgtggaaactgctgtgatcccgcccaacatccatgtggacgtggagtcagccactgaggggggaacccgccgcctgatgcttagcgataatccggagacgcttacccatgtgacggtacctaccgagcaagccaccctgtggcatgacgtggtacgcacgacaacccgaacggtcaaacatcgcattttcgggtggcattataacaaaatcggcagcgctgttaaactgggcatcaccgtagagaacagaagcgcttctaaactagaagtacgtcatattgaacgtgcccttaagattgtgcctgaggacggcaactggattatagatgtcgggcagtctattgccaaaagctgtttggcgggtacgatggaacgtctgaagccagcagaccatcataaattcggaaaaggcactgccctgctggaggaatttgagttacctgaaggatcgctggccggattcatctatgacctcacagtagaatttgctgaaggccatggtacgctggattatgtgattcgcaccgtgatcagcaaggatacgcagaccgatctgcgtcagattcatatggatgcgcttcctcccgtacctccaccccaggcgcatccacgaggggtgtggtccttttccgaaacgaatgcgcggatgccagagtacgtggtggggcagagcgccaactatcgggcgtgtgccaccaaaaagctgaacggcgagactcctgccgatctgctatttaccggggcacgcagcgagctggtgcctgcgctagataatcgcggacaattcggaacaatatacaacgcgaccattcccatcgttaatgacagtgacgaggtacgtatcgtacgaatctacgccaatccacgtgggggcgcgttcgccggatctgtacgtgtggatgattgtgtatatggtattcctctgctacgagataataccaaggtatgccgattggctgatatcagcgtccctcccggcagatccagctatgatctgagcttcatggtcgccggcagtgcaactacgccgctaggtctgtacgtcattacactatagctgtgctcacgatgactggatgagcgaacgtggggccaaaattttcacaggatatggtctgcttaatagtaaatggagctgtcccaaagctggttttaaactttattggacagtcacgcttcgtcattagtataaaaaagcgcgagtgcaagggttattcccccctgtagctcgcgctttttggttcatgctcacccatttgagcaagtttggtcaagcgaaggcacgtagtcctctccgccgccatacccggcatggcgatgaccatacccggttacccggtttgggtcagaataaataccgctctatttgaaccgctggacctgcctcgaaggcataatggtcaactctggaatattgacatgctccggctgctctaatgcataaagggcagcttctgcaacatcatcgggatgaagcggcaaaacgctcgaagcaaacgcccgaatttcctgctcgggatatccggccacctgcgaaaattccgtcgccaccgccccggggtgaatcgcagttacacgaattccttgcgtactggtctccaaacgcaatgcagaggctatggcgctaacgccgtacttggtagcgctgtatagtcctcctccggcaaccacttccttcgctgcaatagaggagacaatgacaacatcccccttggcctgttccctcattggctgaagtccgtacttcagtgtcaggacaagaccgtgcacattcgtcttgtaaagctcctcccacctttccagttccacttctgccagtgggcttcgatacccgaagccagcattggcaacgataatgtcaagccgtccccagcgttcaagaatggcgtggaccgcctgctgtacgtcttcagctttttgaatatcggcaggtattgctatgacctcgtacaattcctcttggtgcaagtcacgaattaattcatccaatcgttcctgacggcgtgccaatacagctacatacgcgcctcgctttgccagtttttttgcaatcgatgccccaatgccgctgcttgcgcctgttaccaaagctactttcccggccaggctttccttcgctttccaggataatctcaactcatccaatatcatgttataccctccccaagcttatttgtttaaaagcacgcgatgaacaccctggctgcctccaggagctgtacctatatataaatatccgtcatggtttacagccgtggttaccccataaagcgagccttcaggatcatgccagcttccgatcagtttaccctgcggattaagctccacagcaagcccatgcttcacaggtgcgcttgcaccgctgagcagcgattgaggcaatttggccatcattccagccagccacgggcttccatgcatctgatctacaaagggaatacgtgttgtgaagagaccgacccagaaatggccttgatcatcacgcgtaatgttatccggaaaaccggcaagattatccacaaaaatatccgaagtccccttcttcggccctttgagccagtatcgggtcaattggtagtgatacgactctgccacaagcacaaaatcttcgtccgcagacaaggcaaccccgttcgcaaaataaaggccttccaacagaactgtcgtctgcttggtcaccggatcatatttcagcaaacgtccatgtggcttgttctcggcgatttctttgaagactacactgccataattggaggtgtcagaaaaataaatggtaccatctttagcaatatccagctcgttggccaaatagatcggtgtgccgtcgacttgattggccaacaccgtcacgtttccggaaggatttaccgacagcaaccccttcttaacatccgtaacgatcagatttccacttgcgtcaaacataagtccattgggcgttccttgggtatctgcatatagctgggccttttgcggattgcccttagtatcaaaggcaaccttataaattttcccgtcggagtctcccgtatataaatttccttccttgtcaaaagtgataaattccggaaacttaggggcatctgtaacaagctctgcggagctgagtttgttgttttgttgccatggacccgcttgttcaaatgagggggccgaaggtgcaaaccattttgcaggctggacaggggaagggatgagcataaaaataaccactcccagaaggattaccgccagcagcgataatccggttctgcgtacccatttacgcggtttcttattctttcttccttgagaatctttgacaggtaaatcagctttactgggcattagattgcctcctatgtgatgtgaataatattccagcattttgcataattcgattccccacgctcgaaagtacaatatatagacgaactaaaccgtttcgatctatatattgctgatttgaaatcgctcttgggatttatgcaaaatgctcatttatatttgaacgacgattttaccgaaatactgttttccttcagccaaaagtgcaaaggcttcgctgattcggctgagcgggaatacccggtcaatgacaggatgtaaacgatggcgggaaatggcacgattcatattttcgaaatgttcccggttaccgacttggctgccgcgaatcgtcgcagccttctgcaaaatgctggtgacatcgaactcaggaatagtcaagcccgataagaagccgaccatgttcacagtccctccggtacgaagtgcattgatggattgcgccattgttgccgctccccctacatccaggacatggtcgactccgccgtctgtcagctccagagccaccttatcccactcgggaacttccgaatagttgattgtctgccatgcgccgagatcctttgcccgttccagcttgtcattgctgctcgatgtgataattacccttgctcccgccatcagagagaattgaagcccaaagatggaaacaccgcctgttccttgcaagagcaccgtatcccccgctcgcagcccgccggattccatcagcatgctccatgcggttaatgctgcaatcggcaaggtggaagcctcctcccaagaaaggtgatccggaatggcgacgaccccttcttcatgcagaacgatatattcagacgccactccactgagcgggcctcccagactgtcctttaagacctccgctctcgtgctcccgccaatgaatttctgttgtaaatttgccgctaccctttgtccaatctgaaattttgtaaccccttcgcctacagctacaatttcacccgctccatcagataacggaatgaagggaaattgaatgccgattggcattactccgttaatgattaccaaatcccggtaattcagagacgctgcccttatgcggatcagaacttccaatcgtcctggcaccggtatgtcaagttccgtcaaggttaactcttcaaagccaaaaccatttttcagttgcactgctttcattttggttgtcctccctgtaatgttaaactttttacctagtatggatacagtgtattacgtaagaaacaccgtttcctatgtaatacactgtatccaattgtcttcaaaacgtcaatctttactttaaaaataaaaatggtcgtaaactgttccaggcttttaacgttccttaccaagtaaaattcgagactgggtggcttcgcttgtccagaacttgctcaggtgaggcaagcatgaccaaaaaacgcgagttgcaaaggtgagataacctctgcaactcgcgtttttttacgttaatggtgatataagcactgtccaatagaattggaatttgcttatgccacagccttatttaagctccaacttttataaactacgtctacttaaatttgttcctgacttatattacgctactaagcatgaaattggagggcggaccaagctccggcttgccaaacaaataaccctgagccagtgatacacctgcttcacaacaaaattcaaaatcctccatctgctctacgccttcagccaacacttggcctccaaaaagaaaagccgattctacaatccctgtaatttgccgcttctgatcaatgttactatgacagccgtcaattatactgcggtcaattttaacataatccggctgaaggcaattcataagctctgttgtagaataacctgcccccacatcgtccagggctaccgaaactcctcgattgcgatattgatcaaagatatgatgcaaaaaattaaggtcgtctatctcttccgtttctacgacctcaaatacaaaatccttcgtattcatggataaccgatcaatcgtctcaaaggtgtgattcaagcaataagccggattataaatgctcgaagggagaaagttaataaaacgtttaattcccgccggaaggcatgttgcacttttttcaatagcggaaatacgagccgagcgatccagatgagcatgcaaaccagcttcacgggcgatctcaaacagttggaaaggctgaaaaggtctctgcgcatgtgacggacgcagtaaaaactcaaacccgataatatccagcttatggtcaacaataggttgcatatggctggaaaaactttgatccttaatgatattcacgatatccggatgttgcagtctggcttgcaattgactaaataaaagccactcctcatatccttcgacatggtgcaggccggtcaccacaacttgcatttggttcaagtattcctgcggcagacgagccagtccgttaaccagctgttccagctctgaacggctgtcatagcgaaactctatgccaccctcacgctcatgttcctgcttcatttgttccgatagcatacccaaaccatctaatgctggagtaagcgacaccctggaatgcctaattctgagcaatccttgatccttaataggtaatatgatgctgcaattgctgcatgtcataatggtcctcctcggaacaattttccggttttttcaccattatatcacaaataactagaacaaaagtactatataactacgtatttttacaaaaaactagcttattcttaacgacaacttaggacttaagtatatattcgacaaaagcagaaaactttttgcactcatgataaattcgggggctgttgtttttgacattaaaaaaagcagcaaatctcttggttaaagagacttgctgcttcattctgatattcgattgagaactaaagttcgaagttatttggacgcctttggcttcgttgttttagctggtttaacagtcgcgggtttggtcgttttaacagctggctttgctgttgctttcgcgggagccacagcttcctttacaggagtcgttgctgcactaggcttagcgccagcttttaagctgtatttggcaaagccgtctgccgcgctgctcaagtatgaaatttgttgatttcctgccagcacgtctttggcatcaggagaggactcgaaagtaacctttgcctgaccaaaaggagcaatagaccagttgccatccgccgctggattaatcgttccgttcgtacgaatatagtcaacaatgacctgacgactttcatccggtgctgccatcacaattcgtttgccatctgggttaaccagtttggatgaggaagcacgatagttattggtggccacgataaatttttgtgcaggatctatagcctttccattgtattgcagatccttgatacgatgagctgaagaatcaataatagttcccttggcatcatatcgtgcaggctgagttacatcaatctggtaattcacaccgtcaatgacatcaaaattgtaggttgggaaatctttgttaatcagcgattgctcctcagtttgctttggatcaatgcggttgaactgacctgcagaccactccagccattcctgaatttcagcaccggtcacttctacagcatgaaccgtgttcggatacacatacaggtcggatacgtttttaatcgctaccgtaccttcaggaatattggtgtaatactcggctccgtttcgaccgccggccttgaatggagcgcctgccgacaatacgggaagtttttcgtattcagttcctttaagatggttttgaacataacatttctgtgcattcgtcacaatttgaatagaaggatcgtcctgcactaatgcaaaatagctggtaatcggtgcagtcgttgttccgacaggttgacgaatataatccaaggttccttgatgctcttccttgatcgaatctgtcagtttgtagtcaggagtaaactgcacagcctggttagtggtattcacaaccggacgtacttcagactgagagtttgttacgttccactcgcggtttttcttttccaggctcaggtcaataatacccagctccttgccccatgaggaagcttccacggccggtacgccgttaatggttcctttatctagatctacacccttcatttctttaaaatcaggaccagggaaagatttatgagcatgcccaaacagaatcgcgttaattccgtccacctggcttaaatatttaacggcattctccatcattggcgtttgcggcacatcctcataacctgtgtgcgcaagcacgacaataatgtcagcaccttccgtcttcatttgaggaataaactttttcgccgtttccacaatatcctttgtaacgactttatccttcaaattggcttcatcccactgcataatttgaggtgtgaccaagccgatgacacccactctgagcgtatgctcttcacctttctcatccgttaccgttttatcaagaatttgataaggggtaaaataatttttagtagcttgcccccccttatcaacataaacattcgcatttacgtaagggaaatcggctcccttgagcgatttttccagaaaatcgagaccatagttgaattcgtggttgcccactgtcgccgcatcatagcccatcaagttcatcatcttgtagactggatggacaccgccttctttttcataggttttgtttctggccatataatcgcctaatggattgccctgtaacaaatcaccgttatcgaacagcatgctgtttcttgtttcactacgcgcctgttggatcaaactggctgtgctaatcaggccatattcgttggtttctttgtccgaatagtaatcgtagttcatcagggatgcatgaatatccgttgtttccatgatccgcaaattcactgtagcgctatcgcgagtattgctagctgcccaggttggagcggctgaaaacaccagcatgctacaagctacaacggttgctgtaaaccctttaaaccaatttttacgaaataacaaaatatacccctcctcattaaggtgtatgcctcatatacatacttttgcacatatatgtaagccttgaacccaccatttctattttaatccaacgccagacaaaagagtagtcattcacttaaattatttatgaaaaaataattaattctctcaaaaataaaaaaccagcaaacctcctaaaaaactcggagattcactggtttatccatttatattctcattatttattccacacttggcgctccgtttgctgacccacatactcaatgcgagtcggattcacgtccagaatgacataatcgggatcatccggtccggaaaaccattccttcaaggaatcgttccacacttgtttgcgtagcccctcatcagctgtaatctggacagtagcctccacttctacgacttcctttgtaccgccaacttcataacccagcagcagataagcattcggattatcctttagctcatccactttatgcgttttgcgatctgtcgccagatgaatgttcattccatcgttaaaaagggccatatagcgtactttcggtttgccaccctctaccgtacctaacgagcaaaatttgttgttatccaaagccttcacaatggcttgttctagttggctacgatccaatgtttccgttttacccacagtacaacaactccttttcacgaattagaattctttacggccatgccattgggcaccagcccatctgaacctacctgcgcagctgttctgaaaataacatgacccgatcagatcggattgatgcatgctcattttcagatcaaagctcacagtaaaagtgtaccctgtcgttcggcaaatgaaccgtcatctcttcctccatgctggacagacccgcattcaaggcatataatcgtcgtagtaaacccgaataaatgaacccattaaaccatacaatgccaggggtgctggaatcggccggctgagagtgtgtcccaagacactgacccttacaacctgatctgggtaatgccagcgtaggaatgcttaagcaagatgtgcctttttacataggaccatcccttactttggtatatacaagcgcaagcgtcccggaaactcggggcgctttttttgttgaagattaagttgttggaaagatcgcgtccggcagatgttatttttatgaaaatggggaacataagctgtctgattggatggataacgggtaattaaaggagagaacacaacgatgaagcgcatgaaaatattaagcctgggactgatcagtctgtggctcatggccctgaccctgaccgcttgcggtggaagtccctccacatcccaagaagcggctcccgctaccaacactcaaacgtctactccggcaaaggagctcaaagatgttaaagtcgtgctcgactggacacccaatacgaatcatacgggactctatgttgccaaggacaaaggattttacgaaaaagcgggtttgaatgtccaaattattcaacctggttcaggcggagccgatcaaatggttgcctctaatgctgcaccttttggtatcagctaccaagaaggcgtcacacaggctcgtacgcaaggcgtgccgcttgtatccatcgctgcggtgattcagcataatacctcaggcttcgcagccccggtagatcgcggaattaagagcccgaaagattttgaaggtaaaaaatacggcggttgggggtctcccgtagaagaagcggtcatgaaatccatcatggattcagacaaaggcgatgtgagcaaagtgaagatcgtcaacatgggcaatgcagactattttacagccgtgaagcgggatatcgactttgcctggattttctacgcatggaccggaatcgaagcccaacttcgaggtgagccattggatatgctgtatgtaaaagattattccaaaagcctcgattactatacacctgtaattgtgagcaacgaacagacaataaaaaatgatccagaactggtcaaagcgttcatggacgcttccgcacaaggctatgaatacactatcgcccatccagaagaagccgcggacatcttaagcaaagctgtaccggagctggataaaaaactggtacttgccagccaaaaatggctaagcccgcgttatcaggacgatgccgcgcaatggggtgtgcaaaaagcggaggtatggcaaaactattcggactggatgtacgaacgcaagctgctcagcaagcctttggaagtggataaagccttcacaaacgacttcttgcccaagcgctgatcatttgttaaaacgctaaataagactgaactagagaagtgaacgaagtgccactacgcagccggatggtgcttcccatcgctgttgtacctagatttcttttatgaatatccagaggttgaaatctgggtacaatggcgaacgctaacgcttgtacagcaccattccgcccacttcgttcttttgcttgttttgcttttataaaaatgctacacaacctagctttaaaaataaggtgctttttaaggcggttggcagcgtagcggttcatttgaatctggagaagcgcagcgttcgcccttgccgttggattcttaccttttaaaatttattcaaagaatcccacggcaacagcgatcgtaagatcaaatgaaacgcgaagcggtctccccgccttaaaccaccctattttctcaaaacaactccacaataaaggacaggtgaattttcatggctaacacactgctcagtattcaagtaatccctaaaactcctaataacgaggactcttacccgtatgtagataaggcgattgaggtcattcagcgctccggcgtcaagtatcaggtgaacccattggatacgaccatggagggcgagctcgacgagttgctgaaagtggttaaagaaatgcacgaggctttgacggaagcgggtagtcccagcgtcatttcacagatcaaaatcgcacataacccacaaggcatcagcatgaacaagctgaccgagaaatatcgcccatgaatccgaaaggcaagaacgcgtcctggtggaaaagcgtatggccgccccttgtggcggtcctcttctttttagcggcttggcaaggagcggtttcctatttacatattgaatcctggctgctgccagctccatccctaatcgtacaagagggcatggcgcaatcggcgttgcttggcacccatacatgggctacaattcgtctgacacttgcgggattcgctatagggacagctacgggactgctgatcgccatcgttcttcatacgattccttttctcaaatctgctctatacccgctcttgatccttagccaaaacattccgattatcgccctcggtccgttgctcatggtatggtttggttttggcgtgctgcccaagcttatggtcattactttagtatgcttttttcccgtggctgtagcggccatggacgggctgactcgaacagaccgtacgatgatgaactatatgcggatgtcgggtgcaagccgcatgtctatttttatgaagctggagctgccacattccctgccgcaagtcttttctggcgttaaaattgctgctacctatagtgtgatgggcgcgatcattgccgaatggatcggagctagtgaaggaattggatattatatgctgctgcaaaaatcggcctatcgcacggacctcatttttgcagccatcggcattattgtcgcactcagcttactcatgtttgtggttattttactactggagaaatggttggttcgctggaaacccgatcgagagtagcttcctccttgaattaaatacagcaaagaaaggacgtagcgcgtatgagtctgcatccgattgacttatcatcacacaacgtggctaatgaacaacgagccggggaacaacagagtccttcaactgctcctcctgctttggaattggacgggatcagccttgccttccgcgaaaagcgaagcttactgcccgtactgcaggatgtatccctcacagtcaagccgggagaattcgtttccctcatcggtccgtcaggcagcggcaaaagcacgctatttcacatcatcggtgggctactcaaaccccagcagggacgtatccgtatgcacggacgggacatgactggtgaacgtggtcatatcagctatatgccgcagcagcccgcccttttcccgtggcgtaccacgctggacaacgtactgcttgggcaggaaaatgctccacgtaaaactacagcagtcccccctgagtacgccagtgaacgcgagcgtcgcaaagaagccttgcaatggctcgagcaagttggactaggcaaatttgccaaggcgtacccacatacgctgtctggtggaatgcaacagcgcgcagcctttctacgagcactactcagcccgcaggaattaatgctgctggatgagccgttcagcgcactcgatgcgctgacacgtgcagatatgcagcaatggttattacacatgtgggagaagaaccgccgttctgtgctgtttattacccacagcattgaagaagcactgctgctctccgaccgcatctatgtgctgtcggcgcgacctgcttcggtggtgcatgtcgtagatgtcccttttccccgcccgcgtagggaagaaatcaccctcgatccgctctttattgaatggaagcggaccatgaccagctggatgcgcgaggaaaagtacaaactggacgccaacatggacaatgctcagagcgtccacaagaatatcccggaagatggattgaatcgacatgagtgacgtaaaagttcgatgtgcattgaaatggaacagccaaacaaagccaggcttggatttgaccgcaattgagcccgctccattaatcgatgcgcatattcatgtagacagctatccgcctgaacaacaggagttattgctcgcttcacttgccgatagcagcgtccaagccgtgatagccgtgtcgatgcatctgggctccagccgagccaatctacggttagccaagcgttaccccgagctggtacgaccagcctttggctttcatcccgaacaggctctgccaccgcaagctgagcttgacctcttattcgactggatggacgaacatgtacagcagatgatcgccgtgggtgaagtcggcttgccctattacaatcggctggaagtctcacagagcggttcaccttttgacctcgctccctacatagcactgctggagcgttttatccagtttgcaagcaagcataacaagcccattgtcctgcacgccgtttatgaggacgcagacaccgcctgtgaccttctggaacgtcacagcgtcacgcaggcgcattttcactggtttaaaggctctgccgccacaaccgaacgtatggcgcggaacggctattatgtttccttcacaccggatctcctgtacgaagaagagatccgcagtttggcaagacagtatccgtctgatcagatcatggcagagacagacggtccctggccgttcgaggggccttttaccggacaagagacacatccccggatgactgccgacgtcattcgcgcgtatagcaagctgacccatcaagatgaatctgccgtccgtcaaatattttatgaaaatacgagacgcttttactcactatctgattgataaaggataccagctatttactcactggaaggtttacaaccacaacatgcaactaaagcaaagaacctccttatttacgcgggacttcatcatgcgtaaataaaggaggttcttgtattttgcagagtttttgtcgctactcagcttttattgcttcaagaaacccttttgttccaaaaatggcttcatctgcaaacgtgctggctcggtcagtctcgcggccatttgctcagaccatggcgtagagcgttgaccgcccgtacgctccttcaaatattcggctgatgtgtggtcgtatacctctacagctttcatcgtctgatttttgtcgtagccgttcatatgcaaaacaccggacagtggaagacgtgggcgcaagcccgtttcctgttctggtacaccaatacacataccgaatactggatacaccagctctggcaaccctaacaactcagatacctctgctattttagtacgaatgccgccaatgtagacgatgcccaggcccagtgattcagcggctaccgctgcattttgtgcagctaacgcggcatcaatggtcgcaaccgtatagttttcgacggacccttcgtaggaaggctggcctggctggtggtgaatcgtcacctgcttcaaacggtacaaatctgcgcaccataccagaaacgcggggcattgctcaacgtaagcttgccctcctgccaactcggccagttttgtttttaaagaaggctcggtaacggcaataacggtatatgcctgcacattactggacgaggaagccatttggccagctgccacaatagctgcgagctgctcgtcggtaacggcggcgtctgacttaaattttcgcacagaccggtgattcatcaacaaggaaatcgtatcattcatgactgcttcactcctaatccataatataagctctttatctacttcaagctgtgagtatacgaagaagttcttgcatgcttgcatggcactcctacaaatattatggaactttcgtgaatgataagcaacctgacgtgacgaaggttaacagtatggtttaaaaaacaaacacaacaaaaagcaagcacgcagaaaaccaattgtgcgtacttgctctatactctgataataactttatctcgctacagatgtccggcagcacgctatcctgctggtgcatccatacatttcacaggttcacccgttgcagacgcagtgcattcagcacaaccgaaacagagctaaatgccatggctgctcccgccaaccatggagcaaggaagcccaaagcggcaatcggaataccgatcacgttataaccgagcgcccaaaacagattttgccgtatgtttgtcatcgtccggcggctcatttcgatcgcgtcaggaatgctgttcaggttgccgcgcatgagggtaatatccgccgcctccatggccacatccgttcccgtgcccatcgccatcccaatattagcagtagccagcgcaggcgcatcgttaataccatccccaaccatagctacgatcatgccttgttcctgaagccgtttcacttcttcagcctttccttcaggtagcacctccgccagcactcgttcaattccggcctcggcggcaacagcccgcgcagtccgttcattgtcacccgtaatcatgatgacttcaatgttcatcgcccgcagacgggcaacggcctttcgtgacgtttctttaatcgtgtccgctacagccaccagtccggcataggaaccgtccacagcgaccagcatcgcggttttccctgcgttttccaactcattcatatactgctcggctgagtcatctattgcgatgccttccctgctcatcaatcggcgtgtacccgccaatacctgcttaccttccacatgcgccttcacaccataacccggaatattttcaaaatctgtcggtcctaccagctcaattcctcgatctgcaatcccctttacaatggcttccgccagcggatgctccgagcttttttctgctgcaccgagcaaccgcagcaaatcgttttcagccaagccgcttgcaccaaccataacatctgtcagctctggcttgccgttcgtaactgttcctgtcttatccaataccactgcgttgactgaacgggtcatttccaaatgctcgccacccttgaacaaaataccgtattcagcggcacgtcccgatcctgccataatggacgttggagtagccaagccgagcgcacaaggacaagctatgacgagaactgcaatcattttctccagtgagcctgcaaaatcagtcggcgtcacaaggaaaaaccagacgataaaggctaacacagcaatagcaacaacaatggggacaaaaataccggaaatctgatccgcaatccgctgaatcggggccttagagttttgtgcatcttccacgaccttaataatccgggacaacgccgtatctccacccacacgctccgcctgaatacgtagtaccccgtttttattaagcgtcgcccctgtaactgcggaacctgcttctttttcaaccggaagactctcaccacttaacatggattcgtccactgcggaacgtccgtccacgaccacaccatcgacaggaattttctcgccgggtcgtacaataaagatatccttcacacgtacctgttcgatcggtatatcaagctcttgtccatcacgtactacacgtgccgtcgtcgcctgtaggctcatcaggctcttgatcgcctcggacgaacgccctttggctaccgcttcgaaccatttacccactaaaataagcgtaattagtactgcacttgtctcgtaatacagctctggcatggtcatgacaggcattcccgccatcccctccatgacatcagacggacgcagcgtaaggtacaagctgtaaaaataagccgcagacgtacccagtgcaactaacacatccatattcgaactcccgttgcgaagcgctttgtacgcgcccacataaaactgccaaccaatgacgaactgaatcggcgttgtcagcattagttggaaccatggattcaagaacagttccggcacataaatccatgacgtaaaggaaaaatgagccaccatcgcccacaacaacggaaacgatagcactgcggacacaatccacttccattttttacgatggatatccttactgcgcacatccgcgatattgtcctcagcgctctgcgggatcgctccgtagcctagctgttcaatcttgctcaccagatcaccaaccgcaatactccccgcggcatattccacatgagctgtttccatcgccaagtttaccgtggcacctgttacaccaggcatccgattcaatcccttttcaatccgggttgcacaggccgcacaagtcatgcccgtcacattcagattggcttcttcacttacagttccaaacccaagagaagcaattttatcgcgaaactcagggatctccacctgcttgggatcataggatatcgacgcctgctccaaagccaaattcacattagcctgtgccacaccatctattcgatttaaacctttctcaatacggcttgcacaggcggcacaggacatccccgtaatgtgaagcgttgtctgcttgtcaccgtcggtcgcacgattttccatggtaaccctcctcttataccccagtggggtatataatatccaaaaagaaaaagcttctaatatggaagcttctccttcaaaacaagtctttcacacataaaatatcttcagcttaaacaacatcatagccttggtcttcaatggctgttttcagagcttcaacgttcagcttggactcgtcatattctacattcacttgtttcgtttcgaggctgaccttgccggtagcgccaactttctccaaagccccttctactgctttcacgcaatgattgcagctcatgccttctacgttcaatgtaacttgtgccatttcttttcctcctcagggatacttccgtacccataatgtgtatgaatactactcttaacgaattagctttttgaccgtaaccagcagctcgtcaatcacttcctgctctcctgcctgcatgcgctcaatgacacagcttttcatatgcccttccaacagcagcttaccgacaccattcagcgcggactggacagccgcaatctggttcagtacatcgtcacagtaggtatccttctcaatcaagcccttaattccgcgaacctgaccttcaatacggttcaaccgggatacgaggctgttcttgaactctgccgaatgatgactttttctaactgtcttttccctgtctgttccacagtgattctcatggatttcagtgtgggaaacaggttgctcctcagccatacatcagcctcctgtgtggtgtatatatgcatttatgcatttgttatacccctatcataatatacccccatggggtatgtcaaccttccagaaaaatgtcactttttcgtctcaatttttgccactgtttctactcaagcgaattaaactgatcaaaataaggttgaagcaacttcaaatgttcctcgtaatcttctctttctctttcagacaaacgatctggatacagtaccccattctcgccagttatacgtgggatatacttgtaaaactcggtgaacagtacacgaaactttacaaattcatcctccgtcagaatctttttcgcatagtccagctcgacctgtaaatcgatgcctgcgtgggcctttacatctaatgtgcccgtaatggcagaatcaccgccatcttttttaccatcgtccgtttgggttagcacttttccctgattcaacttgtcataatacggctccagcttggcagatatatgatcgtattcacgctgttcctctgcgcttaagcgctccttgtggagtgcgccgttttcatccgtcattttcagattataggcgccgagttttctcaataaccccataaaaacagtgaactcctctttcgttaaatgcccctgcgcctgctgcaacttggattctactctattatattcctctggcgatcctcccatttcaattagcttttcctgtgaaccatacattgtatccgccaaataagtataagtagcaaaagcacctgttggaatcagtaataacactacgagaagagttatcacaatataccttttcataggtttaggtcctcctttttcaagccgttcaatttgacccataatgttttcttttaattcagccggagccaatatgtggtcatcatcctgctgcatcaccctacgtagttcttgctcaagcttcatggatcttctccacctttccgattagaaaatgttcctgctgctctttcaatcgaagcttttgcaaagccgcgtgaattcgtgattttaccgtgcctaatggtatctctaaaatgttggagatttcctcttgggaatattcctgcaaatagtgcaacacaatcacctgtttaagcttgaatgaaagctgctgaacagcatataacaacgcatgatttgataccttgttcacaatttcttcagaaaaatcatgagatgtatgaagttcgagcctctttgctctgcttgtgattcgtagcctcatccattgttttctccggtaagtccggatctgacgcataacgactcccattagccaaggctgaaaaggacgtctttcgtcaaattgctcaagtgatttatatacatgaatataaatttcctgcaccacatcatcagcatccactttctcttccaacagaaaatgcaccgttctatagactgtatgaattgtttgatcatacagttccctgtaagctttacgactgccagccagcgtctccgcaacaagagcaatcatcaaatcattctttgtcaaatttgccagcctccttgcgttgtccaatcctgatctccccctttctttcatctcacactatatattggcaggaaaccgaaatatcgttcgattctgtttcaacatcaggaaaatagtctccgcataatcattctttaacaggactactactcttttggtaatatattgatataatattaaagttgcaattcccacttggcttgtatatatccaaacgagcaataataacaaatcatacatcgaaggagcttattaaaagtcaatgaaaataaagattacacccttgttacggcttatccaaggcctgttgtggtttaaaatccttgtaatcattatcgcaggatgtgtatttatttcagcccaaccgacaggtggggagtcttggttaatccatatggcctcccgcacgctatccatcacccatccacttgaaggttctaccgctcatatggtcggatttgtattcggaaaattgctctttcgattacttcctacaataatgatcctgctgtttattgcgacaaaaaagtataaacttacccttactttactgctcttcgtatccatttttggtttaaacatcaacggaatagaccctttctttcccgttcatatctgcatgcttatttccattctggttcacaaaccatctcgtatgtacttaaaacagatacctctgtccgcaaaggaagccgaagatatctcgattgcaaaacggtaaaaaaactcccatggactgaaatggttcacgtatcagtccatgggagttttttagtttaagttcgccttatttcaagccttcgcgcgtgcgtccttagcaagtacgacaaagcttaatagcgcaccaacctcggctatagctataacgaccgccatcggcacgggggttgttccactccccaagcctactagcggtgaagcgatggaacccagcaatagaggcaacaaaccaagcatggcggacgcactgcctgcggagcgctgctgactctgcattgccaatgaagtcgtcgttgtacttacaatccctacgcaggaaacgacaaaaaacagaggaactaaaacagcaaacaattgacctccggtaaaggctacagtaagcaagctgattccggctacagccgcaattaccagacccgacaagagtaactgtcgttcgctgaagcgacccacaagtctacccgtcaactgggaaaacagtacaatccccaaaccattcactgcaaaaatgatgctatacgtctgaggggaaaccccgaaaatatcctgaagcacgaatggtgagccagcgatatacgcgaacattgctcccgtaatcagcgcctgtgagagggcatagcccataaagcgtcgatcggcaaacagatgaccgagtgttcctagcgtctgcttcaagccaccggatgagcggcggttagctggcaacgtttctggcaaacccaacacgacggcaatcagcatagccacgccgactacgcaaagtaccatgaacacaccgcgccaggaaacaaaattcaaaatgacaccgcccagtactggtgcagcaatgggggccacgccgttcaccagcatgagcagtgagaaaaagcgtgtcaactctttgcccgagtaaagatcacgggctacagctctggaaattacgatccccgccgagcccgtaagcccttgaataaagcgaagcgcaatgagcataccgatattcggtgcaaacacacataacagcgatgccgcagcgtacagaatgagcgagatcaccagcggtcctctgcgacctctcacatcgctaagcggaccagcaacgatctggccaacggccagtcccaacagacaggcggtcaaactaagctgcgccagcgaagtggtcgtatgcaaattgtcggctaatgtaggcagcgacggcaaatacatatctatggacaacggcccgaaagcactcaatgcacccaggacaaaggcgatccataatattcgcgatttggtcatatctgcggcaaccataacagtattggataaccggttcataataataatcatccttttcacaaaaatataaataattacttcaatacatcatgatatcactcatttcgtctggcttcgaataattacacgctaatccgcaattttttttcaaaactgctatatatcaggcaggaatttaccaatttcaggtcgaattatacgataaccaaaacaaaaaatttgtggaatctggagaatgataatggtctatgatggagtgctactgggtctcattgtaggtctgttcagaggaggatggcggcaaggtctgatccgtttcagtcaaattggccttatagccggctggatgttccctgtgctgctgctggtacaattcattattttttatgcccaggaaaagtgggcttggctggcagccattaacgggtatctatttatgggagtctacttggttggattgatatttctctggttgaacagacatcataagggattcaagcttattataatcggcgtattaatgaattttatcgttatggcggtgaatggcggcaggatgccggtctcgttgagcgcttcggaggtgctgggtccctattatacagatatgcttaaatccggaagtgtcatctcgaaacattacatgatggatgcgagcacgcgtctatcattgcttggtgacattattcctctctccaagccctatccccgcacgcaggtgattagtattggagatgtggtcatgaacttcgggatgttcctgtttatccaaagcattatggtcgtgaagagaactaaggataagcagcaagaaaccaatccccgccacgcctagtgcacaccttattccaaggaagggagggaaccctatgaaaaacttgaaatactcccgtgtgattatcaatgctattatcgtggcttctgtcatcattgctttgacttccggttacaaaatcgggggctagtcaccgataagaaaaaaaggaagcacaggctcaacaaaacaggctggattccggcctgttttttcatgtgaaatttccgattacaaaattgtaaattaacccattcacccctggtagctttgacatcaagatacgacaaggcaggagaagaaatgatgagtataataaaaaagctgcaagaacgggttaccgcgacgggaatatacgtgttttccatatgtatggtaggcgtgatcgtcctcctgtatacgaaccaatggtcctttttgcactatacgacaacagagtgggtcacgatctattccctattgggagccgttctgattctggagcattttacattccagctacccccagccagtaacaagcagtccatggattcctccgtgtatctggcttgtatttttgtgcatggtaccgaaattgccatcctgattttgctgttaaatgtaatcatcgctatgttccggcacactgagttgtcgtggtggaagcataccaccaatttttccatttatgccctttccattttcctgtcttcaacagtatttgaattaagcggcggaacgcagggggctttaaaccaagatcattttgtttcctacctactggcgttgatctgctactttgcggtgaacaccatcacactgggcatctacttttatatcgcatacaaagggtccttcaatgagcttaaacaggcttttttggctgaatccctgctcgtatacttatgtacactcattctgtctttggtattgactacactaatttataacaacggcattttaggacttttgctgttccttgggctaagcatgctcctgtctcacgcattcaagcaaatgttcacgctgtatcgggaaatcgaagaaaaagcgaacatggatcgcagaacagggctatacaatcacagctactttgaaaatacacttgaagctgaattaaataaatccagatccgagaatactcctctcagtctggcgctgattgatatagatgatttcaaaaaatacaatgatcatttcggtcatctcaaaggcgatcagctactgggatttctcggtgagtttcttaaaaaggagacctccggcacccacatcaccgtatcccgctatggtggagaagaattcaccctgctgatgtccggtcataccgctgaacaagcatatgaaacagtcaatgctattcgaaaaagattaaatgattctcgttatgagggtgttgaaatttttccacacggctgtctgtccttctccgcaggcattgcacaaagccgcattgacatctacgacaaatcacaactggtcgatctggcggataaagccctgtactacgcaaagaaacagggaaaaaacatcgttcatacgcacggaagtttaaatgaagtggagcgcgaggtcgatctggggcaggatattcgggatcttgaacagcagcttaatttgttcttgtacaaggatattaacactttcaagcattccaaacgggtatttagatatgcagcagacatgagcgatatgcttcaactcggaccagaggataagcggcgtttcatactaggcgccctcattcatgacattggtaaactggagattccctggaatattctcaataaaaaagagaagctgtccggtgaggaatggcagctggtgcaagcgcatgtcatgtggggcaaacgaattgtcgaagccaacgaacgattcatagatttggttccttttgtggagctgcatcatgaacgttatgacggaggaggctatccgtttggctttaagggcgagcaaattccacgtttatgtcggatgctgacgatcatcgattcttttgatgcgatgacaaccgagcgcccctatcaacctaccaaaacgttcgaggaggccattgaagaactacgtgcttgctcgggtagccaattcgatcccaaactaacggctacttttatccattatattcaacataagcaacctgctttcacggatttcatggaaacagggctctaattccttcataggttcttcctctttgcccctagcgtggttgaaatcgtcctgaatccaaccacgctaggggttttcatatgattgacattttgtataatgcttattatttcaaatttcatataaatgtcataattcgttccatctattcacgctatatgcactatgattaagataggaatgggtttgtccgtataaaatgttacaaatggggatatcctcgcttcaagtaatcgagagaaggtgacttcacaggcatgttgtacctgtccagaccagcccgtgtggcttgtctcttattgctgtgtctcccccttctaatcctgtttcctcactcttcgtgggctcatgcatttgtcattgaatccagtccgaccgaaaatcaggttttggacgagtcgccttctcaggtgaccatcaccttcaatgaagatttgcaatctgcctttatgtcgatcaaagtgaccgacgaaacaggcaagcgggtcgacacaggaaaagcacagcttgacccgaatcacaaagccaccatggaaatccaattgattccagaggtgaaaaatggaatttactccgtcaactggagagctttatccgcagacggacatccggttaatggagtcattccatttcaagtaggtagcggttccaatgcgcctactcatcaagctatcgcatctgaaagctcagggacatcacgaatcgacttaatcgctgtccgttggtttctttacataggactatcgctgctttttggagcgatttgtttccggctgttcatcttaccgagcataagccaagacaagaatcgaagtgaacagcatcagcaaaatcagcggccctttgacacattaccccgctggactaagctgctatggagcggctacggcataacgtctgctgccattctgatcagcctgccacttcaggcttcatgggatgccggggtttccatcagggaaggcttctcactcccgattctgggagaagctctccaatttactggagccgggcaaatttggtttatccagatgattctcgtgctgctcctaagcgtaacgctgatttacgcgctggattacagcatttcgaatcgccagcgccgtctttggggctacagctcagctctcctaacgctatgcctcatgctgtccaaagcctttgtcggtcatccggcagcggctacccatccagctccggccattgcggcggactttgtccatctcgcggcagcagctttttggatcggctcacttgccgtcatggtcgtgtgcctgcctgttgccggagcggagttgcccgtatccgagcgggcaactttgcggcaagccgccctgcgccgctttgccggctggggcattgctatggtggcagcgctacttgccaccggtatatatggagccgtgctgtacattccggctccctccatgctgctgaacacgtcctatggactcgttctgctcggcaaggcagcgctgctgctagtcatgctggcctttgcggccagccagttccgcagcgcacggcaagcggcgcccagcaagcaagccgcccggggattgcgtgccgaggtgtccgtcggcctgctcgtgatgctgttgactgcggtgcttactcacctgtcacccggccaggcacctgctgttccgtttgaggagactcgcactacgggcggatacaacgttacgctgtcagtcagccccaatactgtaggcagcaatgaattcaaggtatccgttcaggatagcaaaggtgctgccgtttcgggaatccagcaggttacattaacgctcacaccagcagatcctgaccaagatcaacaggaatttgttttgcccgtaaagcagcaacaaccattccgcagtcaggaattgatgacctccgaaggaacatgggcggtaaaagtacatgctctgacggcatcactcgatgcggttgatgctgaattcaccctgcatgtaggcggtaaaaagtaattattttatacttcaggattgtatgaaatcctcacttaaaaggagcgaattgaatatgaatacaacgattcaaacagcaaaattcagattttccaggcttgcgacctctatgggtctaattgcggcgggtgccttactttttgcaggaatggccagtgcacatgtgacagtcaagccttctgtttcacaacctaatgcgtgggaaacgtacacattgaaagtacccgtggaaaaaaacattccaaccaccaaagtcgccttgaaaattccgaaagaggtcgttttcaaacaatacgagcctgtaccggattggaaagtagccacggaaaaagacagctccggcaaagtaaccaccgtgacctggacgactgaaaaagacggcattcaagcgggtcagtatcagcgtttcagctttgtagcgcaaaatgcagaccaaaataccgcagcaccctgggacgccttccaatattacagtgacggaagtatcgtggaatggacaggtgacgaaggaagtaataatccacattccattactgaaatcacggcggatgccacgtccgcaactcctgcccctgccgcagacagcggacacgattcagcgggcacggcagcaggccatacgagcacagatgcggctaaagatagcagcagccccgcacctgcttcgaacaatgctgtagaagctacacctaccgcttctgctccagccagctctgctacacaaacgacagcactcgtcctctcgatcattgcagtcgttcttggtgccgcagctgtcggcattgcactcaagcgccgcaagtaatctgggttacgtataaaggttaagaccgttttaaaaagaaaagctgacacctatttaaaaggggtcagcttttttggtatgaaagaaaacgattaatattcagcttaaatacatacttagattcatctcatcctattatttcacattcacctttctatcatttttttggtaaaataggtagaaccctcacgattctaacatgatagcattgcaatctattgagcataggagatcataggatgaaaatcgtaaataaggctctgttatctagtgctatctttctgagtaccacagtgggcttctatagccctttggcacaagccgagaccggtaagatcagcatcatgctggacggatatccattaccgttccccgtacaacctgccatgatgaacggcacgaccatggttccctttcgcgctatttctgaggctcttggcattacagtgaaatgggatcaagccagccaaagcatcaccgctaccaaagcgcaaggctctgctaccaagcaggtggttctaaagatgggtagccgcaatgccacagtggacggacaaaaggttcaactaacagccgctccgcaaaccgtgcacggcagcaccatgattccgctgagctttttcgggcagcagtttggagccacggtgaactggaaccagggaacacggacggtctccattacatcgcctcgtgaagctatgtatacagtaggcttctatgcgctgtcttcctttgaccaaaaatccaaaataccggattttaacgcagttgccttcggctggagtcgaattgatacgaacggacaatttacgacaaacggcaaggaatacaaatggcctcaagccgctggaaccgtaacaccggagtccattgtgcaggaggcagacagccaggggacttccccttacctgatggtctattctggagatggcaatcacgagctgaccaagattttggaaaatgcgcagcttcaagaacagaccatttcccaaatcgtcagcaccgccaccgacaaacaatttaaaggcattacgctagacctggaaggtttggggtggagcggcgataaagccaaagcgcgttcagactacaacgcctttattaaaaagctatcggccaaagcgcatcaggccgggctcaagctcaccgtcgttctgcatccgctgaacagctcttactctggctatgactacaaaacgctgggcaatctggcggacgatctgatcatcatggcttatgattacggacagaaggctacgcctgagcctttggaaaaggtggatgaagccatacaactggccttgaaggaaacctcgcgggacaagcttattttggggatttcgatgggtagcgaaaaagacagcaccgttaacgccaagatcggtttagccaaacgttatgacctcaaaggaatcgctatctggcgcttgggcatcattggagaaacagcctggacacagatgaacgaagccatcgagtttaaataagtgtatattttatctaaataaccctgaccttattccgcccgctaatgatttcttatgcgtcttctatgaaatcatttggcgggctttcttcattccccttaacagaagtgcttgcctgatttggaagttgtcgtcacaggctcgcaaccctgttctccatagaagatcccccagtctctcataaaatccagcaacggccttaacgtatctcctaacggggtaagcgagtattccacacgcggtggattctcattataaatttcacggtgcacaatgccatctctctccaattcgcgcaactgcaaggttagcatccgctgtgtaatattaggcaaggtccgtcgaatttcgttatagcgccgcggtcctgtggtcaaatgatacaagatgactcccttccatttgccgcctataaccccgacggttttcgctaccggacatccaaaattaacgctaactgcatgttccatctcctgtgccatgtataccccttctttctgtagaatgtgtaaaccaacagccccagacgtatgacaaggaacaaatatgtgcgtacttgttccctgcaaaaactttctatatgataactatatattcgatatcagctctcattatagtagcagaaaacccatagagtaccaactaaacccatacccaaaggagtacattttatgtctaatacatcagctaaaaaacaggaaattctggacgcctttctgttcaggcacgccacgaaagaattcgatcccaatcgcatcataccggaagaggattttcagttcattctcgaaaccggacgactttctccaagctccgtcggttttgaaccatggcagtttgtagttgtgcaaaatcaggcattgagagaaaagctggctgctgtttccagcggcggtcaaaagcagatccctgcggctagccacgtcgtcctgattttggcgcgcaaggatgttcgttatgattctccttacgtggagtatatgtataaagaggttaaaggtatgtctgaggaggactttgcctcactgctaggccgctataagattttccagggtgaaagtcaacgtctgctggaaaacgaacgtacgttatttgactgggcttccaagcaaacctacattgccttaggcaatatgatgacagcagcggctcagatcggtattgattcctgtccaattgagggctttaattacgatcaggtgcatgccatattggaggaagaaggactgctggagaacgggctgttcgatatttcagtcattgctgccttcggttatcgtgctcatgaacccaagcgggaaaaatccagacaaccactggaaaaggtcacacgctggattctgtaaatattcgtccaatactgttagtcaatctttaagtttggcactgcctaacaggcgggcttgcgatcattcatcttaacgatgacccattgcagcccgcctgtttatttaaattttttttattctacaactttttgcttatagccgtagtcaagttatcctatataataagatgtatctgcctaaaaaggagtacagtacacgtggaaagatcagagatattgacaaggattgttattgtcgatgatgaagagttggctttggattatatgaagcgtctgcttggcgagttacaaggcatacatattgcaggagcttttacgaatccattcgtggctaaggactatattctacttgatgatatagatatagcttttttggatgtaagactcccagggatcagcggaattgaattagccaatcaaattttggagcacaaaccccatattcagatcgtttttgttacggcttacgataagtacgctattcaagccttcgagcttaacgcactggactatctgctcaaaccggtcacgacagaacgtctcatcaaaaccatgaatcgcattctgaagcgtgacgatcaagcctccatgcctgagaatcagccttcagttcttcagttacaggtttttcaatatgtcgtcttcacgtacccgaatcagcaacccactgttattcagtggagaactaaaaagactcaggagttgtttttgtacttgctccaaaatcatgaccaatgggttcgcaaatcagccttgattgaattactatggccagaatatgaggaagataaggcctactctcttttatatacagccgcttattacattagaaaagcgatagcgccgtatcattcctttttagagatttccaatactaatggcggttatattttgcatacacaaaacgttctgttagatacagaaagatgggagtcccttctggcatccgctcccctgatgaacaaggaatccattccctattatgtaaaaatgatggaactttataaaggggactatttacaggaatatgatttttggtgggttgaaagtgaacgccaaagactgcataaaatgtggttatccatatcattaaaaatggcagagtggtatagagggaactcccagcctgaagaggcgatctctatttatgagggcatctgtagtcgtcacccccaagaagaggaagcctactggggattaatgaagacctgcgctgagatgaataaaaataacttagtgatcaaatggtatgatttattatcatccgccttatgggaagaacttcatgagaagcccaatgaacaaattacaaattggtttaaagagtggcaaatggctcatgcctaattttttacgactgggagtaattctccggaacccgtagagtccccattagaaccgtcacttacttcgcctcgttctgtataggacctacgggacagagatattaagtttcctgtctttgtgccttgggaacatggaagcctaccgttgtaccctggttgggaagactgctaatatacagccctttaccgtatacttgcttcaaacgtcgatccgtattttgcaatccaatcccgctatcctgttcttgctgaggacctagcacatgattcagctcctcttgactcatgcccacaccatcatcaataatcgctatttctgtgccatcctcccgctgctgaatacgaatgcacaatgtgcctccatgtatccgattcatgataccatgcctaattgcattttctgcaagtggctgaatcgataacggtggcaataacacggatatctgttcgtctacttcccatacaatatctagtctactcccaaagcgttccttctctatataaagataagattttaggagagcaagctcatattccagtgatacgactctatcaagattttgagggttaaagcttgatcttaaatatttaccgaactcttcaataagtttcaccattctggtgtgatccacatgacttaaggatgcaatggtattcaaggtgttaaacaaaaaatgaggtttaatttgtgcctgtaaccatgcagcctccatccaaagcctctcccttgcggactttttaacatcagtcaaggcacggacccttgatttcaattccatggaatccacaggcttcataatgtaatcgttggcccctgcaagaaatcccgtatataagtcctcctgctgactacgtgctgtcaacagcaacacaggcagctccgaaatgctaaagtattccctcacacgccgagttaactcataccccgacatttggggcatcatgacatcggctataattaaatcccattcccgatgatccagcctatgcaaggcaccctgggcactggttacagttacaaggtcgtaaggctccgaggcgagaatgccctctaacacccttaaattaaccggatcatcatctactgcgagtatagcagatcgtgcagagcctgccgcaacctgcatcacagctgcattctgtagagctataaaatcagtacctgcttcttcatccatacacacctgctcgttatcgcgtgattcgtctggggtaggtgagggatcaagcggtagtgtgaaagaaaaggttgagccttgaccaagctcagagcttacactcaaagatcctccatgaagctccaccaattgtttgctaatactcaaccctagtccaagcccatccccaataaccgtcaaatgagaatttccttgttcatatggacgaaatattcgcttttgcgtctcctcatccatcccaacgccagtgtcacgcacctgaatactggccatttcgccttggatgtgtgcgtgaacggaaatggtcccctcagcagtatgtttaacagcattgtgaaggagattgaacaggatttggattactcggttttcatccgctaatacatttggaaaatcagcagggatgtttactaccatgtttagaggtttcccatctgtcatgaattgaagcatatccaacacacccgaggctacggccttgggcttcaagcttcttttttccagaataatatccttttcacgcagacgtgtaacatccagcaaatcattcaataataaggacatacggcggccgaccgtaacgagcaattgcatgtttctcctgttgggttcatctaggacgccgccctgattctccagcacggtctgtgctatattgatcatcccatgcagaggatttcgcagctcatgagaggtgttggccaaaaattcatttttcacctgatcagcgcgctgcaatctggccgacagccttctcagttcagcattcgtattaaaaaaccgtttgaaccaataggatgcaaatgccacaaaagccaacacaatatcccaagggtaataggggagatcattcgttttgaaaatgccccacagcatgctggatgcgatgctaatggatgctagcaacagaaaaacagcctctttttgccctctgaatgttctaagaaaagcaagggagggaactgtagcacatagagtaatagctgggaatgcgataatagccataagaaatgcataaaggctggatgtaggtgcaagtaacaccagaaccgcaaaaccacagtggcctataaaaacaatctgaatgattcgggatcgaatcaacagagactgcgctagcttcagtacacacatgcctattccaatataggaaagggtagttatttttaacgaaagacctagatttatggggaaccattccaataaaagcttgtcatcgtctgtcaggatggataataccgtgcagattacaattcccgcaaaatacagaagcgccttcttttgtggattcataaaaaatataacgactatatataacccgtgaagcagcaaaataatacataccataatttgcattgagatcgtgaagttggttcggctattcacagcatccgcgcttccaaaaatgataggcttcataattcctccactagcagaaaaatcaaaattggatacttggatgacaatctcaatggcctggctgttcgcatcaaacatagcagagaatggaacagttgatcctatatgctgttcgaccttgctagagacctgaccactatgactaattaaacggccgttcacaaatatgttggatgccgtactgatcttcccgatccgaagtccgtataaagtgtccaacgatctgtcactcaaaataagcagccgataggttccaatgccatatgccttatgatccacaggagataccgactcactccataagcctggtacctgaatggactgacgctgcttctgcataagtaaggatttcagttccgcaggagaagataaagttccaggataaaattcccactccccatttaatggtagggtctttatctcctgtaaattcaagcccctcagatccagaattcccgccttggcccggggataatcctgattgtggtaataatcaaaccacaacaaacgcaagccgataatcacgatcaggaatgacagcgtaattaaaagaaagttccgcttattcatccactggtgatccggcaccaaacatcagcgtatcgttgctggtctctcatctgaaccagcagcattggatggtgaccaatcctcatagtttcacaaccttgtctacataaatttcatttatcgttctttagcacagattgcccttgctactcaagcaacatacgaaccgcagtaaggacaattccaatcagaaagcctgtaagcgcaccgttaatccgaatccactgtaaatcctgccccagtttatcctccattaaggcaatcagtgaagcatcatccattctatttacattttctcggactagattaccaatttggctatggtttgcttccactactccggtaacacctgctacgatccacgagttgatcttgtccagcagctgcgtatttctccataaatcagacagcatttgatccagtaagggtacaatgtatgtcgttacataatcggcatcctccatataatccagcagatagcggcgcagctcttcgagcttctcggatatagctgcatcaccttcccaagaatcaataaaggtgtttttccaatgattcagcccttccctgaccgtatctttggctgccaggcggatcagctgcgtgttgataccttccaagacggcctgacgacgcggatgtccttcatcttgaagctccgctacgcggtccagcaaaaagtgacgaatcatctcgcccatacgctcctcattcaaatagccaaggaaggcgttcagggcaaactgcataagcccgctgacctgcaagccactaacagcctgcatccccagagtgccaagagcaaccccggtgtctgaccgcagtagccaggactccgtctgctccagcgcataatccaacgcccgttggtcatacttccgctcgccagcttgccgggcgagtgcctctagcaataaccctatatcgaattcagtcgcctgtcgcttaatcccggttgtgatgaccggggccagctctgccagtggaagcgaacgaacaagttgcttgacaaggacatctatgaaagtgaccgcttcgggcgtacgtattcctttttctacatttttcagtaccagctcagccagtctaatctcggcaattttagatgcaatactttctttatgaagcaaattgttctcgaccgtgttaaccaaggcatcggtcagctttccccgatttttggggagaagcgctgtatgtggaatcggaatgcccagcggatgacggaataacgcggttacggcaaaccagtctgccaatcctccaacaagtccggcttcaaaagatccagccaaaagacgggcccagccaaattgttgaaaaggtaacgtagcagcaaagcctgctcccatcatcacaagtgaccaagctgctgcggtttttgtgtttttcgtttttcccatcctgtagtcctccaaactgactgtaaaatttgtttcattacttctgtagtaccatcatatcattgcctgtacagataccaaaggtcactgtactctcttgcgaacaaattgcatgatattcaaaattttcacattttcttaaattaagttcgcataaccacacttatccatacattttcgtgaacaaaatctccacaataaagctataactattttctagcaaaatgagccctttgaatcattttgtcgaaatatggtcccatttttcccgataccgaaaggatatataactcagaaagtggaattgcaagactatggtatattcattgaagaaactaattttccccagcctcatccttttcaaataggcactttatgttatatttgttatatattgttcagtccctaatcgctacatgaattactttaatgtgataaaataacctttgtaaatagggactccggttctaaaaggatattcgtaaaacaaactacaattatcatactaaaattgtttttttgtaaaggaattggatatgacaacaaaccaaaaaaatgcccagtatgtctggagtgaagacccagttgcaattatatgtacaccctcttctttcgctaaaaaatccctcttctatatacaggaaataggctatttcaaaacagatgcttatgtaatggaacggcaaaagctcacctcttttttgctccttttcaccctgtctggaaggggggaattgcaatatcgagacaaggattatatattgaaacctcatgatatgctttttattaattgtgaagaatatgtacagtacaaaacttcctgtcagaagacatgggagtttattagtgtgaatctacatggcaatcttattgaccatttctatgaacaattcgataaacacaataagcccgtaatctcactaaaggattcaagtgcagtattggacaagctgtacaccttattacaggtacagccagaaagaagcttatcctctgaactgctctcatccaggctaatcgttgacttgttaacgattattttgcagtacccctacaccaatcccaacgcgaattcagatggaaccgcagaggtgcgcaaggtaaagcaatatctggatcaatcctattgtgaacggatcacgctggattcacttgcagacatgttcgctctaaacaagttcaacctggctaaaaactttaaaaaacagattggcttttcccctattgagtatcttattaatgttcgtatcacggctgctcaaggctggcttaaaactagtgatgtagctattgtagacatcgcacaatatgtgggcattcccaacacaagtcattttatcaatctgttcaaagagcacattggagaaacgcctcattcctatcgcaaaaaatggggaaaccgtataaaataggtcttatgtataatctgcaagcttgttttgtcgataaatagcgaaaatttgagatttaaacttgcctaatagagtacctaactgatagaataaatatacaagctattcaggataaatggcaaacttgtcgaaagacaaggacgcaaagctacagggccttctgtatgatggcagccagctaccggttgaagtggctttttgtcgtgcttttttttcgaaaactttatacgaaatggcaaacctgtcgaaaggcagggacgcaaagctatagggccttctatttatgatggcagcctggccaccgaaaggaagttttttatggggaaaatgatattttccacacttctcctatttttcatgctatccgcaatactcttaaattcgacaatttacgctgctgatagtgttgtatggttggatcaaaacaatgtaaatcatgggacggtcagtgtgcgttactccgttaaacctaacattaaaaccaagattttggttacaaaagatgcgcaaaaatactcttataatctgacacccggaaagtccgaagaagtattccctctccagatgggtaatgggaactatagcatcagtattttggaacagcttaatggtaatcaatataaagtgataggacaagatacgatcgagttaaagctaaacgatagcaaagcggtatacctcaattccgttcaaaatattaactggagcggtactaatcaagcgattcaaaaagcccatgaattaacccaaggcgcaacaacggatcgtgagaagcttcaaaaaatttatgattacgtcattagtcatatcaagtacgactccaatcaggccttcgccttaacgactgactatctaccgcaaattgatcgtacgttaagctcgcaaaaagatatttgctatggttatgcttcactgatggctgctatgttacgaagtgtagatgtaccaaccaagctggttatgggcaaatcttcctacgtggacacttaccatgcttggaacgaggtctacatcgacaatcaatgggtggtcgtagacactacagtagatgcagcactgtataagggtaaacaaaaattcgaaatgatcaaagatccctccaaatacattaaaacaaagcaatattaatatcaatgtttttattaatattattttaaaaaattaaaaaatgaagaaatagaactacatttcttgtagagccttgatcacatgatcaaggctctttttctatccttgttgagaaattgttgagatgtggcatgtattctagtccagaaagacattgaggtctaacccattatcctaatttcgggactaaaggaggtaatattcatccccgaatgtaaatttccataaattatgaacaagaaatcaatgcggctaacatagcatcagatgaatgattgatgaatatataaatacagccctcttgacctcgaaggaataatcattagccgctaaataaaagtattttaagaataggagatttgtttaccatatgagaaaaaaatggaatacagcagttgttgcgttattgctctttttgcaatgcttattcagtacaacacaagcctatgcacaaaatcccgactctgctctgccagtgaccccaggaaccgatccggttcagagtgtgactaacgatgtatatccaaagccctcagagcctattaacatcccacctgctgtcccggctccagccgttgaggcaactgccagttcaacttctgaagtgagggcaactcaggaaagtattttaaccaagctaaccctcacagattcctctggaagtgttattgatgcagtgtataatcccgatagtcgtattgatattggctccgccatccatttagggtatgaatgggagctgccgaaccatacgtataaagctggagacacctttacctttcaattacctgagcaatttcaaatttacacagacattacatctcctctgacgaatacggatggagaagttggtcatttcaccgtagaccgccaaggtaaagtaattatgacttttaatgattacgtggaaagccactctaatgtcagcggtaagctggaggtcaaaaccgattttagcaaacaaatagaaaaaggcagcacacaagtcattattgcgattccaatcaaaggcggcgagcaaacggctatcgtaaatattaagcctgcaactggccctactttggaaaagcaagggaaattcgatggaaaaaatcgaattgattggacagttgacgtaaataaacaattggattctataaaacacgccgtagtaaccgacccaactccccaaggattggaactaatcaaagattccatccgggtatatcatttgcaaatcaatgtcgacggaaccaccgtgctacgggacactgttagtgcagataagtatacagtcgaagctgatccggccgggacgggctttagaatccgctttaacgaggagagtataaacagcgcataccgaattcaatactccacgaacatcacaagcgaggataaccgtttctccaacacggctactttttcaggagacaatgtgaaggatctctctgcatcagctactgttaccgttaaacgcggggatcttctaagcaaaaaagtagagcaatacgatccagtcacacaaacaatttcatgggcaatcaaatataattttgccaacaaaaaaatccctgcagcaaaagcggtattgagtgaccgttttaataacagccaacaattcgtcaccagctcacttaaagtttataaaggggatacgcaagaggagcttcctgcatcggaatacagggtcactccagttactgacgacaacggtaccaacggtttcaatctactgttcaatgcagatattgatgccccatataccatccgttatcaaaccaaggctatagatcgtgtacttaaaaatggtaaaataacgaacagtgtaacatcggacggagtaacaaaagaaacaaccacagaactgaaaagtgtaattatcaccaagggctataaggaaccgaactataacaccaaaacaattccttggatcatttccattaatgcagataaatatacaatggaccaagtcgttatcgacgaagtctttccgaatggcggtctggcattattgccaaacacattgaagatccaaagcgcggatggaaaaacaacactaacatcgccgtcagactacgaactgatccctcttacgctagattataaaaaagggttcactatacgttttcacaaaaaaattcaagacacgtatacaatcagctatacaaccacatttaacaatgaatggaaaatcgacaaaaccaaaccggacttttggaataaagcctctatcacttggttatataacggaacaacacaaaccgcggaggccgaagctcgattatggccggacaatatgacccagcaaaatggggctaagtcaggtagctacaatgccagttccaaacaaattacatgggacattaaagccaactataaccgcaaaactctaaatcatgctgaaataagggatacattattacagggccaaaaactggtgccaggttctgttaaagtgtatgatatgaccctgctcgggtggtggaatggcgtacaaaagggggccgaagtgccttcgagccaatatactcttgttttaccttccgctgctaacaacaatgaactgagcgtccagtttaaccagtccatcaactctccttactggatcactttccaaacgacactggaaggagagcttatggataaagagattaacaataacgctcaacttatggatggaaaaaatccagactcggaatgggcagccaaagtgactgtgcctcacggtggagaatacgtgacgaaatccggtactcagaatggaaataaaatcgattggaacatccatatcaatgaagggcaatcctatgtctccaacgcgaaaatcgtggatacgcccagcaataatcaaattctgattgaggattcttttcatctatattccaccaaggtatctgccaatggagaagctaccaaggacactgaattagtcaaggatcaggattataagctaaaaataacaacgactgctcaaggtcaggaatcctttgagcttgcctttacgaaggctatatcatcgggctatattttggaatatcaatcctttattcaagctgaagacaaggcaaaagtgagcaataaggttaatttcgagggcgaccgtttgaccaccgaaatcagggaaacaagtaaagagatcatcgtgcgtacatcctctggttcgggatcaggaggaggagttacgggaagtctggagattaccaaagttgatgaggacgatcacaataaggttctatccggggcacgttttgcactctatgacaaggatcagaaaagagcacctcttgtccaaactaccaattcggacgggaaaatcgtattttcttcattgagttatgatgactacattctggaggagcttgctgctcctgaaggctacaaaataacagcgccaaaaacagaaatcaaaatagatgcaaccatcaaacaaagttcaggcattaaagaaatcgtgatcaccaacaaaaaggacactccggttgatccgggtccaggtacacctactgatccaagtacgcctacgaatccaggcacgcctacaaatccaagtacgcctacaaatccaagtacgcctacaaatccaagtacgcctacgaatccgggatcaggtaaaaagcatgataaggaccctgaaataactgaacctccggtgacgcctgttacgcccgtaacaaccgaagagccgcaaattatcgaagatgaggatgttccgttgggcgttccgactattgaacagccacctgtggaaccagaagtgcaaccacccgctgaaccaggggtgcaagctgacacaccagaagcagaccctcatcaggagccttctccgcccgtgaagattgaagaagatccagtacctaaaggtgtaattcgtctaccggcagaaggaccagaagatccaagtgacccggggcatacacccaaggtggatacattgccaaagacaggagaaaacagccctgctcccttctatgtaagtggtatgttcttaattcttctgggtgcctacctaggttataaacgaacacataaaaaataaataacattttataatcaaaaatcccccttctcagctcatcattagcgagaaggggaattattttacatgtccgttctatgaattactgtattaggaggcttttcaattgcgtaagctggcatacgtgagcatcatgttaggaatcatcattatgttatttcctaccgctaatgaatggttggaaaatcaaaggcaaaaagagctattacaagaagctgaatcattatcaaacacagatacatccgatacatcgacactgactcccgaaatgattaaaggttatacagatttgtccaattggctgacaaataccgcagcagcggatgggccacaattgtctcaaactactccctcttcgtcggctccagagcaagctccaatcgctacaatccagattgatcgtatcgggctgaaacttcctgtgctcgaaggtgcgacccaaaagcatatgagatatgccgctgtacatatgtcggaaactgcgacactcggccaggtggggaatgctgccatagccgctcatcgctcacgaacaactggacgtttatttaaccggcttaatgaggtgaaaatcggggatcagattctaattcacactcggggtgaaaaatacgtatacaaggtctacaacatttcagtcgtcactccttcaaatgtctccgttttaaaaagcatcaagaaacaaaagcttctcacactaattacctgtgatcctcttgtaaatccgacacatcgactcatcgttcatgcaagacaactgacctaataccgctaatagaagcggaacaacctataaactatattggtggtgaccccattgagtatatctttaacagccttacttttaattggcctaactttggttttgtggatatatatgttaattcttttgcattctatgatgatggaaagaaattcactgcggaaacttgcctatcaggaccctgtaacgggtctgttcaaccggaatgcacttgagctattttggaaacgaagcaacggcaaggagggttttgctattatgtatcttgatctggatggattcaaagccattaatgacacatacggacatcaaatcggtgataggttgctcagacgggtaagcaatcatttactccaggtgacaaactccaatcagaaagcttttcgaatcggtggtgatgaatttctactcatgatgaaggattatgatgccgatcaggtcacagttctagcagaactgctgctgcaaaaaatcagcgctccttataacattcagggaatcaaccttcaagttacaggaagcattggtattactatgcatccttctccgaagaagcctctgccttctttactgaaagaggccgatatcgccatgtaccaagcaaaaggaatggggagaaactgctatgctgtataccagaggatcaaacagaggccaagcgtcagatcatatgacactgcacgaattataaagtttgcggcttgttttcgaaaaaaagcaaagatccaaagtatacaacaaatggcaagcttctaacactaacaaagatacccgtaacatcaaatcaggcgggtaagtcctgtttatccaagattatacccgccgataaaatattcctactccaccttaccctttgcaatcagcttgaaatcatcaaagtggaatcctggtgcaaccacacaggttaccagcacaggctcatcccccagcggacgtgccgtttgccatactgttcctggtacgagtgcttgtggatgctgtcctgcctccacatccgcaccgacgataattaccgtttcttcgccaggctcttctccgcttccacccaatttcaactctacagggcttccgctatgatataaccacagctcatcggaatggaccacatgccactcggagaactcgcccggatgcagcaagaaatacgtagacgaagctgcaaagcgcggaccggaatatacatcaggcagcacaggtttcggaatttgaaaattagccttccacatctctttgtaccaaccgccttctggatggggctccatgcccaaagccgttacaagcggtgaaatagctttcgtcattgtactaaccttcctttaccctaaattccttcttccctactgtaaaacatagcgttgcttttgtcacgtttctcccttggcatgtcgaacgctattattttatgtcaaattaaataacattaaattgtgaatattcatttgattttatcatataaatagcagttaacaagtaaaagaacataccaaatataatacgcgtaaagttttatgacataaaatcttgttttttattgtaagcttatagtatcatgagagaaattttgaaattctaatagagcttgattatgtcaatccgtctactaagctatgtatccaagcctaaaaggggtgagctctctgatccagtttcgcaatgtcaacaagcattacggtcacttccatgtactcaaagacatcaatcttcaaattaaggagggcgaggtcgtcgtaatcatcggtccctccggctcgggtaaaagcaccctgcttcgctgcatcaatcgtctggaaacgatatcggatggggaactgatcgttaacgagatccctgtacacgacaaaaagatcgatattaatgccttccgccgcaacatcgggatggtgttccaacatttcaatctgtatccacacaaaaaggtgattgaaaacattgtactggcacctatgaaggtactgggcatctcgaaagaagaagctactcaaacagccatcacctatctaaagcgcgtcggaatcgaagaaaaggcacagagctaccccgcccaattgtccggtggacagcagcagcgggtcgcgatcgcccgtgggctcgcgatgaatccaaaaatcatgttgtttgacgagcctacttcagcacttgatcccgaaacgatcggagaggtactggatgttatgcgctcgctcgcccatcagggcatcacaatggtcattgtcactcatgaaatgggctttgcacgtgaagtggcggaccgcgtgatttttatggataaaggacagattttggaagacagccaacctgccgaattttttcagaatccgggtgaggaacgggctcgcctgttcctgagccgtctgattcatcattaaacagactaccaatgtagcgtaaatcgaaaggggaatgttctgatgagaaaaagatttcaatggagtactttggtgctggtagctttatcttgtctgctcgtgttggcaggctgtggaggcaaagaaggagcggcaacgtcggggaatgagccggcaacagccaacgggctggaagcgatcaaacagcgtggcaaactggtcattggtgtgaaatacgataccaagctgttcggactgaaagacccggctagcggaaaagtagaaggctttgatatcgacatcgctaaggctgtagccaaacatatttttggcgatgaaaccaaacttgaactaaaagaggtcacgtccaaaacacgaatcaccttattgcaaaacggggacattgacgccattatcgcgacgatgaccatttcggatgaacgtaaaaaacaggttgatttcagcgacgtctattttaacgccgggcaatctctgctcgtgaaaaaggggagccccatcaccgggctggagtctctgaccccaaaaaccaaggtgctcgccgtgaaaggctctacctccgccaaaaatatccgcgaaaaagcacctgaagcaacgatattggaattcgaaaactatcaggatgctttcaacgccctcaaagcaggtaaaggagaagcattgactacggataactctattctgctcggcatgcagcagcaagacccgaattatactcttgtaggcgggaacttcacagaggaaccttacggcattgcagtgaaaaagggacaaccggaactgctgcaagccattaatgatacgatcaaggaactgaaaagcagcggtgaatacgataagctccacgagcaatggcttggggttaaacccgaatagtattcttgtgaaggagccgccattgcgagctccttcctttcttaggtctggataaggaggtacattcacagatgcttacttttgatatcaacgtactttttgatcatagcgaccgtttcagagaaggcttgcttcataccgttcaagctagtgtcattgccttgattggaagctttattctgggggctattattgccatcctccgaattgcgccttttaaatggctgaactggatcggtaccgtctatgtagaggtcatccgcaatatcccattgctgatcgtcgtactgtttttttatctcgggcttcccactttgggcatccctttggacggattcgtatctggaacgcttggattgaccgtatacacggcctcctttattgctgaagccatacgtgccggcattcaatctgtgcccaaaggtcaatttgaagcggcaaggtcctccgggttgagttacaaccagacgatgatcagcattattttaccgcaagccatcaaaattgtattgcctgcgatcggcaaccaattcattaatctggtcaaaaactcttccgtgctggctattgtggccggactggacctaatgtattactcggacctcattaactcggataccttcctgcccatcacagtatacgccatcacggcgctgttgtatcttatcttgacggttccgcttagctttcttgtactatacatggaacggcgtctgtccaaaacatcctaaggagggaagcccgtatggatttcggtggattgtttgtgtggcctaatgtgcgttttatactggagggcttcctgctcacgctggaggttgctatttactctatcgtgttcagcttcgttctcggtatcttattcggcatcctgcgctatactcgcttacctgtcatttcacaggttgcagcctttatcattgatctcattcgcaatcttccattattgctcattattttcttcatcggtatggttttaccatccatcggattgtcgatttccctcaagtgggcagccattacaggcctgtcgatcttcgagggagccatgatcgccgagattgtgcgcagcggtctgaattcggtccataaaggacaggtggaagccgcacgttcctccggtctaagctactctcaaaccttatggcatatcattctgccccaagcgcttcgtcgcatggtgcccccgattgtcagccagttcatttccctattcaaggatacctcactggctgtcattatcagtttgccagagctgacgcataacattcagattgtcggtgggcaaaatcaatcctttgtcattccagccctgctgttcgcagctttcctgtactttgctgtcaattacagtatgtcactgattgcacgcaggctggaagttcgtacacattaaagctcgtgatactcatcagcgttgccactagttggaacgcactgttagtacagcttgtatcttttcaattaatcgcttcaatgcttctccctgataacggccagaccgataaatcaactctagctgaccctggagcacgccgcacaaaataggtacagtgcaaaattgtgagcgatccaattctgccgcaagggactccgtctgtagagttacggcaagtccctcctgcacccagcgcaggattgaaggtatggaatttgtctccaagacggttgcaaagggatacccgcgatcctggaagcacttctcaatgagcttcctaccgggatgacactctggctgcatcgcccaggatacatgcctcaattcgtccagcgtaatggaagaacggttggaaaacacatgctctaccggaacaacaagacagtagttctccgtacaaagaggaagctggacaagcctttcatccgtacccgaatgcagcgtaatgccaacatccattcggttatccagcagctgttctgttacatcaaatgatggatggatgtgcaggctgactctaggaaatgactgatgaaaatggataagcatttcatgcaatgactcctccagctccggtaatgcgataccaatccgcaaactcccgcgttgctcggtgcgcaactcctcaatggaagcctttgcttgctgtaaatccttgagcgcatgtgcactgtgttgcagcaacaacttcccagcatctgtcattttaatctttttacctgcacggtcaaaaagcgtcatgcccaattcctcctccagcgccttgatttgcaagctaagcgtgggttgggagattccgatcttttccgaagctttcgtaaaatgtagttcctcgcatacggcaatgaagtattgaagctgacgtatttccgtcttccttctctcccttcgagaatccccagaatgattgcatgaaaaggtcataagaagcgcaagatcggatccatccggttcgcgcttcttcttcaggttattgcgcttttttgagattattgggctacttctgctttttccgcagtcagcgtaatattcgcaaacgtgtctgcatcgtactccttgccgcgggtaatatcgtaattggctacccgattattcactgcctctaacgagtaacggaataacgtcggtacgatgggtgcctcctcgctcatatacgcctgccactgattgtatatatctttacgataattgtcgtcaaaggctttaacagacaccccttcccgcaacagcttatcattctcttcactcgtaaaacgcgaatagttaaagctggctccgcgtccatacagtccactagggtctatatctgaacccgtactccacgcaccgccaaaaatatcaatgtcggggtcatccttttgcacacgatcatagaaagaattgaactcaagcagacgaccgtccaccagctcgacatgaagtccgacatccttccagttttgcaaataaaacttcgccagcgattcagctgtcgcatctccgctcattgccgcataatggagcaccagttccttgcccttagggtcctcacggtatccatctccattggtgtccacatagcctgcctcgtccagcagctttttcgccttgtccgtgtcatacgtgatgccctttgcattcatatcatgatatcccttaaaggcaggcggaatcagggatgttgctggaatccgaagtccatgatagagctgcttgccgacctgctcattattcagcgcatagccaagggccagacgcaatgacttgttcgccagcttggcgttcgggtccatgatatttagattcttggcctgatcgaatttgcccatcttaaagcctacatagctataagataattcctcctgaccgagaaactgtacatttttcggattgctggcctcattgtaacgggtggttggatagctggcccagtcaacttctccacttttcagcgcctcggtaatgacatttgggttcaccaccttcagatgaaggccatccaacttgggctcaccgtggaaataatcttcatttttgacgaattccacagattcacctgtgaccatagatttaattttgaacggcccatagccaatcggatttttacgaacaggatcagatccggccatatctttcacgggaatattctgaaatacctttttctccagtggtgtagaccacagtcccgatttcaccgaaggattaggttccttgaaatgaatggtaacctctttctcattcagcaccttgatgccagaaatggttttggccttacccgcgtgataatcctccatgcccacaatgttggtcataaagctatcataacgcgggccttcgtagtctttatgaccgatcacttcataggaaaaagcatagtcctctgccgttacgggattaccatccgtccagttcagcttgggatcaattttgacagtcacagccttattgtctggggaaaaggaaatcgtcgccgcccctttaccgtcaatatttagattggagtcaatcgaaaacatagaagggtagaaaaactggaagacttcaaaatcaggattgccttcataaaatacaggattcagaataccttcaaaaggggtatcagacacgagtgcataattgatgatgccacccttaatcggcgtcttatcgttcttgaccgccttcgctagcgctgtggcattcacctgcttgctgtcggaccttgagccgcctgtaccgtcagacgatttccctccatttgaagcggaaggcgaaccgctgcatgcggccagtgaaaataccaaaattgcagatagaacaggcaaaattccttttttccagtgtttaaccattgtaaatccctccttgtcattgtccttatccttgaacttcagttaacccaatcgttgtctggcatccgtggcgcgtttgagcgcctggccaataaagttaatcgccagcattagcaccaaaataagcagtgaggctggcaaccacatccaccagctattctgcaaaacatccgggtcattagcataactcaccagtgtacccaagcttggagtagactccggtaagccaaagccgagataagaaagcccggtctcaatcccgatattccccgcgaggctgagggtcaggttgacgatcacgaccgagctaagattgggcagcacgccaaaccagatgattttccaattgggtgtgccaagggttttggaagcctgcacataatccagttcgcgctccgacaacaccttggctcggatcagacgtgctttcccaatccataaaaaggcagtcataatgaaaataaaggaccctatgccgcttttgggtacaatgctgacaaacacgatgaccagcatcaaaaacggaagcaccagaataaaatcaatgattcgcatgatgatgttatcgaccagtcccccataaaaaccagccagcaaacctaacgttaagccaatagcggcggataacaatgtaatcgtaaagccgatggtgaaggaattgcgggctccaatgaccagctgaccgaaaatatccctacccgctcgatctgtccctagccaatgcactgagcctggagcttcacggatcgcgcccaaatcgaccgtcgtgactacatcctgatttacaaacaggacagaggcatatataaagatcaagaacagaattacaaagccaatggaaaccaaggacattttgtcacgcaccagctcacgacgtagtacagaccaactggatggtgatttacgaatgatttccggcgtgaagacctcttccacctgtatagacaccataatccctccctttctctagacttgttcgctattcaattcgaatgcggggatcgactttgcttaggatgacatcagataaaagagttcctaatagcgccaagaagccagagatcatgaccagcgcgttcacgactgaaaaatcccgttgagtgatggactggagaaataattggcccaaccccggataaccgaaaatagattcaagaaaaatattgcctgcaattactcccgtcaggtcatagcccaaaaaggcagcaatcggcaatagagagtttttgaaaatatggcgggaataaattttaccttcgggtacccctttggaacgcgctgttttcacaaaatccttcagtcttgtgtcaatgacctcattgcgcaaatactgaatcgtagccgttgtactgagcaatgcgcctgtaaccgccggtaaaatgagatgatacgacttgttcacgtaatatgaccatgtccccggctccacgcctacatccacactgccgctggttggaaaccagccgagcctgaatccgaatacgtacagcagcaacaacgcgagtataaataaaggtgtcgcaaagctgagataggtatagcccactacggttttgtccagcaaactatgctgataacgaccgctgagtacgccgagcggaatggcgatcagatacgtcagaaccagaattactacgcccagaaagaacgtgttccccagacggctgccaatcagatcggtaacgctaattttatgtacataagatttgcccagatccccgtgagcaagctggacgagccagttcccatactgcacccacaccggatcattcagtcccagtctttgtcgctgttcttccagtgcggccggattcagattgggtgtcgaagtaataagtcctgtcagggcatcccccggcattgccttagctaggaaaaatataagcacgctcagtgcaaaaagttgagggatcataaccagcaaccgacgcagtgtaaatttccacatattctgtaccccccttatggtagcgcgacttgatgggatggacttactgattttagtgcaaacggctttccactcgcgtctagatgtttggatagctctgttttgtaggaggataaaagcattcgccttttcttggcattttccagtctttttgtaggatcaatattgggaatggttgcaatgaggcgctgggtatacagatgctgtggacgctcataaatgtcttgctcgctcccctgttccactagacgtcctcggtacataataccgatttggtcacacatatggcggataatacccaagtcatgactgatgaaaagatacgttaaattaaactcccgctgcacatccttcataaaattaagcacctgtgcctgcacggaaacgtccagcgccgacaccggctcatcagcaatgatcagtttggggtttaatgtcagcgcacgcgcgatcccgatccgctgccgctgccccccggaaaattcatgcggatatttgtaggctgcatcggcgttcaagccgaccttttccagcaacgtctgtactttccttcgttcttcctcactgctcagcctttcaaaatttcgcagcggttcagcaatgacatccaatacgcgcttacgcgggttgagcgaagagtatgggtcctgaaaaatcatctgaatatctctacgcagtggatggcgattgttacggctcagagctgcaaggtcctttcctttaaacagaatccgtccgctcgtcagcttatttagaccgatgatcgtcctgcctgtcgtcgtttttccacaaccggattctcccaccagcccgtatgtctggcctgcctcaatgctgatcgacacgccatccactgctttcacctgatcgataacacgctggaagaaaccaccgcgcaccggatagtggaccctcagatcatttaactctagtagtgccatgagcagcctccccctttgcctcgtcttcaaaatgaaaatgctgataacatgtacaacggacccaatgtccaggggaaatttcatttagttggggatggtcttcatgcactctctgctgaatccagggaatacgcggagcaaagcggcaactattgcgggggatatcttgtaatgagggaacaataccgccgatgacatgcagtgattcccccttggtatgagatcccggcatagaagcaagcaaagaacgcgtatacggatgctgtggatgcctgaataattcaaaaacatcagcgctctccacgatttctcccgcatacatgaccaccacgcggtcggctacttctgccacaacaccaagatcgtgcgtaatcaggataattccgctctcagtctcctgttgaagctgtttgagcaagtcgagaatttgcgattggatcgttacatcgagcgcagtcgtcggctcatctgcaataataagagaaggtcggcaagctatggcaatcgcgatcatcacacgctgccgcatccctcctgacagttcatgcggatactgatcatacacacgcacaggattcggtatatctacactttccagcagctccagcacacgttcccttttttgcttcgtagatagtgacgtatgataatcaagattttcctcaatctgcttgccaatgctcatcaacgggttgagtgctgtcagcgggtcctgaaaaatcatgccaatgcccgctccgcggattttattcatttgccctgaagaaagacggttcaggtccgtgcctttaaaaaggacctctccctctacacgtgtgcgttccatgtcatgcagttgcgggatagaaagcgccagcgcgcttttgccacagcctgattctccgactacagccagcacttcattggggttgaccgtcagatccagatggtcgactgcggggtgatattgatccttgatgcgaaaagagacggataatcctttaatttccaacacgggttcggtattcaatgcgcgcttcctccattctccatggtcttgtcccgcttattctcaccatgtttgatgtttaaaacctctcatgaacattacataccgtttttgtcggaataatttgaatacatcctatcaccagtatatggatatatcaattaagattatgctatcaacatcatttaaaaaatcaatgatccagcagtagcgcggcctttctggcacaaaatgtaatgaaataaccaaccacaggttaattttcatcacaaaaaaaagccgcctgatccctctacagggatcaaacgactaactagcactagctcatattaaactcttggcgttaattacgaagccgctccataggagccagacttgaacgttctgggatcataccatttgtagcctgctgccggagcagaccaaggctcaggttgcgcttccgtggaagccgcaggctcctcgaacggcagaagcttcgtcggctgatcaagagtcaaacctgccacatcggacaatttcgtgtagtcctgcttccatgcaagccattggaccgtttgcaccaggagggtggcatcatccacttccttgaaaccatcatatgtcttcttcgactgtccgttttcctcacgcacatatttcggtgtagcatcttctacaggggaagaatcaccgatgaacgctgccttgccttgacctaccttggagatagcggcataaggcccttctgcacggcccccaccgttataaactccctggtctacagcattcccccattttttcgtgcctgaagggatataagcaatgcctttagccttggtaggatcaataatagccagcgtagatcctgcatgcattgcaatcgagcgcacacccttggtaataccgaaagattgatctgcggctacaatgtcagtagcattcacgtcaccaagcgcattataacggaaacgaacaccaaagttggtcgccagccaatcggagcttgttaatccttgcatcgccggtgatgcagcttcttctgcagtcatgcctttgaccggattagtataggctccacgacggtagccattcataacttcggaggaatcccaacggtttttgttacggtccgcattataatgatcggagatgaagaagacgctccccccgttattcacgtattgcagcagagcagcctgctcggatgccttaaaggcaacattcgcttcaccaataatgaacacatcatattggcgcagcttgtcatatgttatggcctgctctccataagtaaaaggaatgggacgattcaattggtctaccgtaaagcctacattacgcagtccattggcaaagtcggagaaggcgccttcaatgacccaatctgctgcaccagcggtctgtgcgtgcgtattatcgaacagcacctttttgccttttccatccggcaatgtagtaccgggttgacccgggttgccaggttcgccaggttcacctggttcccccggctcgcttccgctcaccagttcaacagcgcttgggcttttcactccaccaaaattattgtaggcgccgagtgtacccgtcacacgaattttgctgccgatcagctcaggatggcctgacagcccaaattgccctctgtacgctgaagtcagctgtacatccaatagattagacgtattacgttcatttgcctgatcggcaatcagtacgttaaaatcattcgcgaacggagaagaaaagttagtcgttttcgatccggtagcatgtccgacgatgtagccttccaccgtcaccgtacctccactactttggccctgaagtgcttcggctactgtcaatgctccctctgccttgacctgaccgaatggtacgaagatcccgatcagcagtgatacgattgctgctagatgcagcatcccttttaagcgtgaatctgtaaaccgcaagccttttaccatacgtcaatatccctcctatgttttccataaatgtacttgtcctttatcagattagccgccaatcttctaattccttcctgatttcatccataattatgtaaattttaatcttctttattggtaacgcacctgtttatgtaaaaattgaaccctgtgattgacaccgagcacggcatacattaccctaaggaagacatgtagaacggtatacgcgaatgaagatgacgggagagtctgtccagggagcctacactctggcggcaccgaaggagcaagacgccagcacccggctggcggataatctctcaggtccatgtatcgtcatctgacgcaactctggagagagcgcaagccacccaaggggtaaggcggtaagaacaccgcacgaaactctcaggtaacgaggacagagataagggaaacttccttatcctgtccttttttgtgctcacattgtgcgtcagcattaggaaccgtcataaccgcgcaaagacgcggaaataccatatagtatggtattagaacatacagggggccacaccatgcgtttcaaagatgtattttctattatcggcccggccatgaccggaccttccagttcacacaccgcaggcgcggtgcgactcgcacgcgttgcccggcactggctcggagagcagcctgaccgcgcccgaatgacactgtacggctcctttgccgacacgtataaaggacacgggacagatctggcgctcatcgcaggactgcttaattacgatacggacgatcaccggattcccgatgccgagcaatgggcggagcaggctggaatggccgtggaattcgccgtcagcggactccccgcccctcatccgaacactgtccgtttcgagctgtggaagggcgaggatcagcgcacactgttgggctcctccatcggcggcggtagcatccatgtccagcaactgaacgaattccgggtcaatctgaccggggagctgcctacactggtgcttctccactcggataagcccggtacattgggcgcgataacttcagcgctgggcgcggctcacattaacattgcctatatgcacgtagatcgcaagggccgggatggtgaagcactcaccgccattgaaacggacagttctgctccagctgaactaattgcggaactgcgttctttacctcatatgtatgaaattaagatgattaatttgaaaaaaggagctgaatccgatgcggtttagccatttgcatgagatcagcgctttatgcgctgaagaatccaccacgattggccgcttgatgattcaagagcaggtacaagaaacgaatacaacggaggaagaaatcttccgccaaatgtctgattattatgaagtcatgaaggaagccgttcatcgcggtcaaacacaagacaccgtatcccgcagtggattgacgggcggggacggcaagcgcctagccgagtatctgcgggcaggggaaacctgctccggtgatgcctccgcgctcgccatggcttatgccctctccgtgtcggaggttaatgcatccatgggtcgcattgtcgccacgcctaccgcaggctcatgtggggttatccctggtgtattcatcagtgcgcaggagcggttcggctgggatgatgagcatatggtgaacggactattcgccgctggagctattggctacgtgatcgccaacaactccttcatttctggcgcggagggaggctgtcaggctgagattggctcagctatcgggatggccgctggtgctatggtcgagctgcgcggtggtacgcctgaacaggctgttcacgccgtgggtctcgctcttaagaacacgctcggcctgatttgcgaccccgtcgccggactcgtggagatcccgtgcattgtgcgcaacgggctgggagccgtgactgcgcttgccgcagcggacatggctttggcgggtgtgcgtagcgctattccgtctgacgaagtcattgacgtgatgcttgaagtcggcagtgcgatgccgtcgaagcaccgcgagactgccaaaggcggcttggcccagacgccgactggcaagcgtttgaccgaatcacttacacgcaacacaccgaccaagaaggataagtcataatttataagcggaagcctccttaaaataaaagagcaagcctatcgtccttggacgtatgcttgctctcttttttactgaacggttacctgtacctttgtcattttacctgcatatttcacagtaattacagctttacccttgccctgtgccttaatgttaccgtctttgacggtcgcaacaataattctggacgaggaccagacagccggtttggaaacatccttctccgactcatccttatacgtggctgtagccgtaaccttagccagctgtcctgtcttcaaattcaaagcaacttcgtctgtttgcaggtatttaagcgtatcaacatccacgggtacactaattaccttcccgccaaacttcgcctgaatgttagctttaccgtagctaaccgcagtaacctgaccctttttaacagtggctaccttataattagacgttttccattcagcttgggccgtaacgtccttttctttaccatcactcgatttaaccacaatcgcgatggttttttgatctccagatttgagcgatagtgcaattgcatccgcttcaatcttttgcgctacgtccacttctaccgtaaacgtaatgttttgcttgccatatgaagcagtcacagttgccttaccgctaccattcgctttgatcaaaccttcgctaacctcaaccacttttacattgctagttgtccaggtggcgtccttagttacatctgtttttgtaccgccactcttaactcctgttactttcagttgcttcgtttcctgagcaccaagcgcaattacacgcgagtctgtttccagacggtctacaaggcctacttgcacgttaatcgtcagttttttgccattataggtcgctgtaataaccgctttaccagcggatttacccgtaatcgttcctttggacacagaggcaatatcttctgcacttgaagtccattctgcatcctgtgttacatcttctttacgtccatccgcataagtagccgtcagagttgcagtatagtcctcatcaatatcaatcgttgccgttttggaggacagagacagatcaccgggtacatttacggataccgtagctgtaactgttttaccaccataagaagcggtgatcgtagcctcacctgttttataacccgtgacttctcccgcactgacaaaagcgatgtcttcattgctggacttccactctgccttacttgtgatatcttcttccgtacctgttacatacgttgcggtcagcttgagctttttggattccttggcattcaggctcagcttgtcctcactcaaatccagatatctggaggtttcgacatctgtcttgatcgaaacggtcttatctccatacttagcggtcaccgtagccgaacccgctccaatcgccataatcgttcccttattcacagtcgcaattttttcatcgcttgatgtccaagtagctttatctgtgatattcgttaccgtcccatccggataaacggcagaaacttgtacttttttagattcatctagacggagaaaaatattggattcactggctttcaacttattcgtttgatcgacatccaccgaaatcgtagcggacatcgttccatatttacctgtaattgtcgcctttcccgcgctatagccggtaatggtgcctttcagtacatccgccacagctgcattgctggtgctccactcagcggactctgtcacgtcctgtaccgatccatccgggaacgtcgctgaaagcttaaccttctcagtatccttcaacaaaagagaaacctctgatgaactgacatcgaggcgtttaacctgctccacctgcacagcaatggttacggtctgttgaccatatacggccttaatattagctgtacctgctccctgagcggtaaccaatccgttcactactgtggctaccttttgattatcggaggtccaagtagcatcacccgaaacctgagctgttgtattatcactgtatgtcgctgtcaaatcaacctgtcctgtaccgcttgaacgcaagttcaggctttgtacactggatgtcagcgccttaacctttttcgttacatgtacctgaaccgattgtaccttctctttataggtcgcaaccacggtggcttccccttcagccttggccgaaactgtaccattatacacagtagcaatagctgtattatcacttttccaatccgtgcttacggttacattcgaggttgtcccatcgctaaaaacagcagtagccgtcaacgcagccgtatctccctgctgcaaagttacctcgttagaggaaaggacaatcttggaaagcaccgcatccgcagcagatgcaaatcctgcatatgatgtaaaacttgaaatcaggatgaccaacgccagaaaaccggaccatctattcttcaaaatctaattccctcccatttcaaaacttaaattaaggatttcgcaaaatccttacacctacgttttatgtcgtcatatggaaaagaatagtttaggcttcgaaggaaatttggtccttattaactagatcgtttctgataaaaattagacattacaatttgtgtagcttcagagccatagtgaagagttttctcaacagatccacaatctcgcatttacaaacagctatatgctgctgcgcgaactcttaaatgatggtattcttccatattaggagccagttggtgcatataaacgacggagtaatcagatggtattacattaacagctcagccaccgtttccttccaacgatggatcaccgattccggttccttgagacgaaccgtgacacctgtcaagatatccgcatattgggccgaatcttctctggctgagaaaacatgcgctgcaaatcgctcacgtacatgcttggctccgggcaaagcaggcagatgttccagcgacaaccgcacataatgcgccttccctccggtgaacaccgcaagcgtcgccttcccagtacggatcatgttgcctgtcgtggtcgtacccggccatagtgccagacgcaaattcccctcgtcccgcgctacaacctcgcccacactaatcatcgctatgtgcggccactgatcttccgtgaccgtcagcagcatcattgcttcatgctgcttgtccttcagctccttaccgtctagcagcgtaaacagttccttaccgatccttggtgtctgcatgaagtatattcccctttacttttggcctataacttcaaagtaccataatttacggctacttacgaacgaccctatatccgctctggaataggaggaacatgagcagcattcggaatatcttgggggtttaccttgaacgccgatttatactttgctggatccgtaatgctatccggttctgaggtccgccatgtgaacaggcatacagggcacaacaaaacctcccaggcgcctttaactggcgagcgggtaacaacctccgaacgattagattcacaacggggacaaatatgcatctgtcagcactcctttaatctttctttatttttaaaaatattcagcgaagcatttggctcaactttttctcccattctgctacacccaacggggaatcgagcgactgcgagtaatgtcctctaatatccggtgctacaggtgtcgtcgcatccaatatcattttgtgcgtcatacctgccggatcagagccggggtcaagcggtaaaatagacaagccaggaacaatgacagcatcatgctttggatgaagcttggtggataaagcccacatgacctgcggaagattgaacggatcgacctcctcatccaccacaatcacgagcttgcaataccccaatccatgcggagtcgttaacgcacgcatccccacagcctttgcaaagccgccatatcgggttttcgtggaaataatagcgaccagcccatgcgtatacatggcattaacagccacgatttcattaggaaaagcatccttaagctgctgaaacaacggtacacttgtattcacaccgatcatataatccgtttccgtccaaggcatcccgatgtacagatgctcaaagataggctgtttgcggtgatatacacgattaatctgaatgactggcatcgcgcggccgccggaatagtgacctgtgaattcaccgaatggaccttcatactcacgttcacctgctaacacttcgccttccaaaatgacctcggctccccaaggcagatccagatctgcatccttcgctttgaccacacgataaggctcaccctgaatggcgcccgccatctcatattcggattgatcgtacagcaacggcgtagaagcagccgttgtaatcacaggctcacatccgagggcaatggccaccttcagattttctccgcgctcctcagcctgacggatatggatcgcaatatcatgctgtggtacaggctggatgcccaaacggttcttgcctttcacctgcatccggtataggccgacattttgcttaccgtaggtgtccgggtcatccagatcgcgtgaaactagaatggctttatccagataaaaccctccgtccccctgattcaaacgaaacaacggcaaaatatcaaacaaattaatatcctctgtaatctcgacttcatgaaagggtgcggtttcttcccgcttcacgggcaccggaaattgtccatagcgtctggcaaattcaaaaaactgctccttgagcggcgtgtttttgggcattcccatcatgagggcgtgattgggccaggagcccatcacattcattgcaatacgagcatccgtatatccatagatgttgttgaaaaagagagcaggcgtcttatctccaagattgtttaacgctctgttagctgctgccaggtccggctctggctttacctcatcgctgatcgtgagtaattgtccttccttttccaaggtgtgtagaaaatcgcgaaagtctttataggccatcattcattctccttcgtctttcgatttctcaagtctggagtcattctgcttcattccatcccagcgtttggctgcggttgtgacaataccgaactgatccaatgcacgaaaaacaatatgatccaccaattcctcgatacttgcaggatgattataaaaggcaggcatcggcggcaggatcatcacgcccatacgtgacagctccagcatattttccagatggatactgcttaatggtgtttctctggtcatgagcagcagcttctttcgctcctttagtatcacatccgctgatctggtaagcaggttgtccgccataccaatacgaatggaggcaagggtcttcatgctacaaggagcgacgaccatgccgtctactcgaaaggagccgctggaaatacgcgcagcctgatccttatacgagtaaactgcatccgccattgcctccacttccttcaccgtgtagcctgtctcataggggatgttcgcaatagcccacggggatagcaccagatggctttggaccccagcctctcgtaattgttgcaatatacggataccaaagatcgaccctgtcgctcccgatattcctacaatgattttcttcatatgtcccctccttccatcccatcgttttatgttcacccatgcattactgtcaaaaattatacgcccgttccctgcacacgaaaaatatatataatatatgtaatgcatactttaaaagtattcaaatcgaagcgttgtttagaaatgaggaggaatcccccaatggacttgaagcatctgcattacttttgcgtcatcgtggaggaagggcaaatcaccaaggccgccagaacgctcaacatggcccagcctccactgagtcaacaactcaaaaatatggaggacgagcttggtgtaaagctgatttaccgtgaaggaaagaagtgggaaattaccgaggccgggtatacactgtatacacgcgctaaacgattattggctgaaatggaggacacctgtagagaaattggggagtttgaaaacaaagtaaccggcacacttgctataggcacgtcatccgcctgtatgtctctgattactgaacaactcagtcgctttcatcaggtttatccagaggtatacgttaaaataggacacggagacacacatcatctggaagagctgctgcaccaaaataaagttgatctggccctgctgctgcttccgatagatgacaaatcgtaccatacgattgaactggagggcgtttcttttgttgcggttcttccgtgtgaatgggcagatcgccatcccagtggggaaattacattacaggaagctgccagctatgacctcttgttgggacgccgaacagaaggacacggactatacgaaaccgtcatccgcaaatttcaggaacaccatcttattccgcgcgtcgtactagactgtccagaaatatcgaccattctctcgctcgtttccacaggcatgggaattaccattattccagacgctggcttgggacaagaatacggggacagatttcgcacactctccattaaggagccattccccttcacacagcctgccgtcgtatggcgcaaagatcgttatttatccaatgcagctcgcaaatttgttgaactgctacaagctggagacacaaaaaagactgttcccgagtagatgctctaccgctctactcctgaaacagtctgatgctagatgaacttccttcattcggtcgttgataccgccttacttgactccttgatgccgatactcggttggagtcattccacatttgcgccggaatacctgtgtaaaatgccgcatatcctgatagccgatccgctccgaaatatcagccagccgcagatgaggatcactgagcagccgcttcgcctcctccatacgcaggcaaatgacataatccttgtagccttgtcccgtcttttgcttgaataactggctgaaatacaccggattcaaaaatacgattgaagccaccttctccagcgacagctcctctgtaaagtgagcccgaatgtattgcaatgccacatctaccgtatgcatgcctttgcgcagacattctcctgtatccgctgctgcggctgcaatctcctctggtgtacgtcttagtcgcgccacctcttcaggtatggaggcaaaattgtgatgaacacccgaacgtgtaatttgtaggggcaccttcacataacgcttcagatgggattcgagcaacgtctctagccgtgcggcctctgcttcatcccttagccttgcaatgcccagcagactatggcggtctagactgacgacaaagccgctgcctcctgcctcaatgagctcggacagtacattttcaatcataaaatgctccagatgcgtctgcttgtgatcaggttccatgcgaaccatgaagagatggaattccggataattttcgacaaaaggctgtatatccagcttgcccgtgtccagtccaagggcatagcgttggaaaacggcttcacgcaaataaaccatattggatttgagaagcctaccctcgttcgcctgctgcgaggccacaagcgcttcggctgccagtatttcaatgcattccaacagctttcttttaccaatcggctttaacaggtagtctttggcacccagctttactgctctttgtgcataatggaagtcggaatgggccgaaatgacaacccactgcagatgaggatgctttcgcttagaaatacgcatgaattccagaccatccataccgggcatcaggatatcagttaatacaatatctacaggatgctccgccagaatgcctgctgcctcctcggtggaagcagcgagatgaatgccgcaggttggtagagcttggccaatggtacgccgaatcccctgccgaatcatattttcatcgtcagctatcagaatattcatgtttctcctccttctgtggcagaggcacacttacagtgactgttgttccggccccaggtacgctagagatccgtaggccgtactcttctccgaacatgtgccgtagccgtaaatttaggttttgcaggccgatgcctcccgcctgcccgctgcccgcctgtttgctgccgggttctgccaaagcgacctggaccacctcccatcgttcgtactccatccctgcaccgttgtcgatgatgtgcaggctcaatacaccgccatattcctccgctctgacgagcagcttgccacctggatccgcatgaagaggctccaatccgtgcttcaccgcattttcaatcaatggctgtaaggtcattttcggcaagcggatatccatccatcgttcttcaatattgatgtctacggataccctgccctccagccgggcttggataatggtaagatagtggccaacctgctccacttcttcacgaaggcttacatcggtcccctcttcccaatggctgctgtaacggaacatatgggataaggagagaaccacctctccgagctgatcttgtcccttttcgtccagcatccaatagatcatatccagcgtattatatagaaaatggggattgacctgcgtctgtagcgcgtgcagctccgcatttttttcgctgaccgatgatatacgcaccagctcaatcagctctgcaatccgtcttaccatatggttaaaagaggtagctagttgattgatttcttcataggatttggtgtttaccgtatgacggaaatttcctgtctctacccgcttcatttcccgaatgactcgcttgagtggaagggaaatgctcctggagacgatagatgcaattaacgccgacacaataataagtataggtgccacgataaataagtacctttgattttgcaccagctccacgttcagatcctcactaggtgtcacactaatcacagaccagtcggcaaacggcaacttggaagcgattacaactctttcattacttcgatttacaataacatcctcctccggtacctgctgctctagattttgcaaatccggtggcggatcagaggaagtggccgacacaattcgattttcatgacccaacaaatatacctgactattggtgcctaaccgcaaattgtggagagcggacaatacagaacgcggctcagcctcaaacaggacaataccaatcggcttgtgttcatccagatcatagagctgccgcccaaacgcaaacacgggtctggtttccacctgatcaatgacagagtgaggatacacgcccagccatgcaattttgcccgccgactttcgaatttccttataccattccgtatgttcgtaatgagtatcaatgacattcatataatttccatagttatataccttgcctgtgtctgtgatgacatggatgccaatcagatcctcacgcgaataatagatagcccccagaatattcgtaatcgtacgttcgttgatgtaattgacagcaggtaaatcactactatccgtcgtcaacagacgaaccaaatccatattgttgctgatcgatttggagagactgttatagctgccgagtagcaattcgaataggcctgccgtctgggatacatttttacgcgccagttcgctgaccttatcatggaactgcaccgtagtacggttgtaaaataatagactgaccgccagcacaatgccggacatgctcaataggaacagaacaaacaagcggtattgaatggattgaaaacggcgcatcataccaccgcgcgctcctttcgcatcggccgcctatcctttaaccgctcccgcaaccatgcccttggtgatattttcggacagaacaaaataaataataatgaccggtaaggcacccatgactagaaaagcaccaatattaccgtagttcacagaatactggctgacgaacgtatatacgccgaaagggagagttttgagcttctcggatgagataaaggtggcagccataatgtattcattccagatgttaatgaaagttaaaatacataccgtcatgataggcggaatcgagatgggtaagattacactgcggaaaatacgataaatgcttgctccgtcaatgtaagcggattcttcaatttcgtggggaatggaccgcataaagccggataggatgaagaccgcaatcggtgtctgaaaagcaatgtagggtaaaatcagtgagaaatacgtattcagaatatggacgtttttaaacatcaccatcagcggcagtagtgtggcttgcatcgggatcatcatcccgatcaaaaacaaagtcagcacaacagccccgaagcgccaacgaaaacgtgtaatcgcataagcagtcatcgagcttaataaaatgacgaaaatcatcgtaaccccggtcaccagcacactgtttcctaaataacgcaagtagctccctgattcataggcttcctgatagttgtgccactggggcacttgagggagtgcaaagaaacttgagctcaatatctcttcattcgtcttcaacgaataggtcagcagccaaaagagtggatacagctgcgtgacaattaagattgccaataaggaaaagactcccgtttttttcaaggcattcacagttccatctcctttagcttaccttattttcgattcttttgaaaacaaaatttatcacaattgtaaatgacaagcaaatcactacgagaattgaagccaatgcgctgccatatccgtatttcatcgataaaaaggacatattgtacatatacgtggatacagtatccgtcgcatgggctggtcctccacccgtcatcacccatatcaaatcaaacgattgcagggagccgataaatgctaatacaattgatatcttgaaaataggtacaatgagcggcagcgtaatatagcggtctgctttgaatccttcagctccatcaattttggctgcttcgtacaactcattcggtatgttttgtactccggtaaactggataagcaaatgatagccaaaatactgccacaacgatacaaaatagagggcgtacatcgctatctgcggttccgtcagccatgagcgtgtccagctttccagcccaatcgccatcaaaataccgttcagcattccacccatcgaggccggattatagatcgtcttccacagctgcccgataatgaccaccgatagaataaccggcagaaaatacatcgtaaccagcgtattggccttacgcacataacgattaagcaagatcgccagcagcagacagaacggaatctccagcatggaaaacacagcaaacatcatagtccgtttcacggatggccagaatactgaatctgctgtaaaaatccgctcaaaattagccagccccacgaactttgcctcggcaattccgttccaatccagcaatccacaatacaccgacaccagaatcggaacaaataccatacaggtatacaacaacaggcagggtagcacgaaaacggcaatggtacgtgctggcaccttcagtacattcatgctctaatctcctttgtgttgattctgaacatcttctgaggatgcgaaacctacatgatttccaatcagggaagaagcattctgccccctccctagtgcctgctacttcaggattttgcaaaattcaatgccagtcgctccaaagtgtaatatctagacgaaccaggccaatttgatctatatattgttcattgggagtcgcttattggatttttgcaaaatcctcacttatttattcgcttcaaaagtgttctgatgttccttggcaacttgtgcagagtcttccttttgcacgaacaggttttgaatgctactcagatgcgcctgcgcaatagccggattcatcgtattatcaaaagcgagatcgcccccttttacattcttgaacagctcattaagactaatcgctaactcggagtagcccgcttccttcagatcacccttcattttctgaccgctgccaatcgcatttttcaaatcaaactgaattttgggcatctccttaataaaatagtgcagaaaatccttcgtttcctgtaaatgctcactgttcgcagataccgcaaatgcgctgcccggcgcaattacatactcattcacatcacccttgccattcaccgtagggaattgaaacgctcctaccttacccgctaccgaagaagcatcaattgaccccgtttcccatgtacccatgatatacatcgcggcttttcctgttttaaaaatattaccgcctgcattgtagtcaatagaagtagctccatccgggaaagctcctgactgcaccaactcctgaaatgcatccaccgcttccacaaaagccgggtcgttaaacgtctttttgccgtccagtacatcattgagaaaattcggtccttcattcgtacgcaacaaaatgttcataaaaaggagggaccccgtccatgaatccttttccccaatggcaatcggagtaattcccttcgccttcagcgttttaaccgtcgtaatcagctcgtcaaaggtggtcggcaacttctggattcccgcctgcttgaacagttccttattgtaaaacaccacttctatattgttgccatccggaaaagcgtagagcttatcgtcgaaactatagtaattaagaagtccattctgaaaggtatcttttaacccctctttatcagccacatcgtttaatggagccagcagcccggcatctacaaatggcttcatctgtgcagccgggtttacaatcgtgatatcaggtacttccttcgccgctgcctgtgtcttcagcttaagcttttgttgatctgtatttagcgaatccaattcaattttgacatgaggatgatcctgctcgtattgacctacaatttgcttaatcattttgtacgaaggggtgctcggatcaggattaatgttctgaaaggtaatcgtaacatctttcgttgcggtgcctctgctcggttctcctgaatttcccggacttgggctttgtccgttattacaagctgccagcgtcaatgccaaggcgctcgccaccactacggcaaacgctttcatttttgttctgctcatggtctttttcctcctcttgttgaagcattgcgcaatttgccctccttattggtggacactcaatgcccgcttgttcttttcattatgttccatagaaaagacgtgaacaatgcgtgaacttaaggagaagggtttgttttttcaagccctcatttgcgtgcttcaaaattcattcatatcataacttgcaatttatctagaacacaggcataatatgaataagatcatattttgataatgattatcattattaaatgataaatacacatagactttaaaggaggcaggaccgcagtgaaagaaactttcagtaaaacctccctgcatattgatgattatttggaccttctcaatcttgccgtacaagtcggagataccaagtggcaaaaagaaattacccgtaaacttcaagccttgagtgtccttcagacagaacaggttgaaatagattaactccccagttaatactgtcctttgttaaaaatgctaactaagcaccactatacaaaggacaaccaggatatcataaaacttttgaccgaatccatgagaaagatctttcatgtgaatgataaatgaatcggttataggaaaaagagcacagcccgttaaggctgtgctcttttatattgcttggcgacgtcctactctcccaggaccctgcggtccaagtaccatcggcgctggagggcttaacggtcgtgttcgggatgggtacgtgtggaacccctccgctatcgccaccaaacatgaatttgctgtgcaaattcttccgtatggttattcggttcatcacttatcgtgtgaatgaatagccatgcgcttattgtatgtatttctacatacattcaaggttacaccctgaaaactggatccgaaactcatttgcgctttattctttaggataagccctcgacc

SEQ ID NO: 2605 - DNA, 302652 bp, Unknown
  Kingdom: Bacteria, Phylum: Firmicutes, Class: Bacilli, Order: Bacillales, Family: Paenibacillaceae, Genus: Paenibacillus
taatttcgttattgaacaagtctttaatcgcagacagatatagccagcaatcacccacacgatattgcgtgatatctgtgacccatttttggttaggtttggccgccttgaaatcctgttttagcagatttttcgccacacgaccttccgtagaagaagcataattgcagcgatgcttccggcgaatttgtgagcggatccccaagatctacatgagccggagtacctttttatggttcatccagactccatgatcgtgctgcaaacatagttgaatttggcgatagccgtagactccgttatactgctcatacactttcttcacaagagctttcgcgtcctgatcccgatcagttcctctccgttttaagaaggcgtaatatccacttctagagaccttaaacagcttacagagttcgctaactggatactctttagcggccttctcaatcgttacatacttgtgctcctcatctcctgcatccagatttccaaacacttttttagcatatcattttcccgttttaacttttggacgtacctgtcctggtccatatattccttccgtcgtcctcgttggtccataagtccgaattcaccgagttccttgtacttccgcatccattctttcaaccgatgtcgatctgcaatcccgaacttctccatgagtttacgatatgtccaaccttcttcgatatgaagccgtatggcctctactttggtttcaaacgtatattctttaaacttctgtccttttttcgctggcataaaaaatgcaccccctagaattcatcggataaaccaggggtttattccaatgtccattctaaggggtgcacttcaataaaccaggggtttattccaatgtctattctaaggggtgcacttcacttacgggccggctctttttttgtcgtggctaggtatgaggtagtaggttatggactttgcctacaatacagatactttagcagacaaaattaacatcttctttactcctattgatgtaacctatgtataaaagataaataagtcttggtctggatatcctattgcctatagagttgtttgatttacaatcaattcacgtaatcttcatgattaaaaccgaataaagtcttgaaaaacatcgacatagtgttataattaaaacaggatttagattaagtctaaattaattaataaatatttattggattcacgcatgggattttgaagaaaatcagacactactgttaacgagtatccaagctttacaccaactatattttgaatgaaaacgagaggggattttaacatgagtacattaaatcatacgaacgcacctacacaagaggctattcaagaattgcacaaggcattgaatcgtcaggtagctacctggtctgtattgtatacgaaactgcattatttccactggtatgtgaaaggacctaaattcttcacactgcatgctaaatttgaagagctttacaatgaagcaacagctaatctagatacgattgctgaacgtttgttggctattggtggccgtccggctgcgaccttgaaggagcatttgcaactttcagctattcaggagtctgcgggtgagcagacagctgacgatatggtgaagtccgttgttgctgattttaaaaccatcactgttgaactggctaatgggatggaagcagcggaagcagcacaggataaagcgacagaggatcttcttaacggcttgagagaagcaatggataaacatatctggatgctgagtgcgtatttgggataattaattggtgtatatttccatgtatatggagatcaggtgaacaagatacacatcccgttggttccagtctgccacaggagtataatgacgagaaggcgtggaagaccacgggctctcgagtcatggagctgccgggatggggtgtatgatatggaagtaaaacaacagcttttgcatgaagcggagcagtttatatatacatgttatgaggagctgggccgaagccgcgatgaagcggaagcccggcttcttaatattcgttacgacatagaggctacgggaacgtatgatcatacttacgaagagctggaacacggagcgctcatggcttggcgcaatagcaatcgttgcatcgggcgcttattttgggacaagcttttagtcagggatgcgcggggcgcatcagatgcgacggaggtggtcagcgagctactggaacatatacgcataggaacgaatggcggtaaaattaagccaacgcttactgtatttcgcgcctccaagccagggcagccgaatatccgcatctggaaccatcaactcattcgttacgctggatatgaaaccgatcaagggatcatcggggacccgatctcggtggattttaccaatgcttgtaaagacatgggctggcaaggggcgatgactccttttgatatattgccactggttgtggaagcaggcggacggtctccagagctatttgatattcctgaacatttggtgatggaggtagccattgagcatccagaactttcgggtttcgcttccttgggattacgttggtatgccgtgcctatgattgcggacatgacgctggagattggcggtatcatctatacagcggctccctttaacggctggtatatgggaacagaaatcggcgcccgtaattttgcggataccttccgctataataggttgccacaggtggctaagctgatgggactggatacgacgagtgaaacaacgctttggcgtgatcgggcgctggtggaattgaatattgctgtgctgcattcttttaaaaaagcgggagtcagcattgtcgaccaccataccgcagcggcacaattcaagctgtttgaggaacgagaagccaaggctgggcgcgcgctgacaggcaattggacatggctgatccccccgctatccccggcgacaacgcatatttttcatagctcctatgataatcggcttgtgaagccgaatttcggagttcaagagaagccgtatacgtcgagacaggctactagtacagcaacagacacagtgcttcagcagaagcgccaaggctgcccttttcattccggataacgatgggaatgacctaatggctggattaggactccagcttatcccatgcaacgataaatagggtagccagtggccctattaatagggagagcagaaaccaatttagcccgctccgatttttggactgtgccaagccggcattaatcagggcaagcgttccccaacctatataataatcttctgacatggtattctcctttgtaaaaaggtataatatcgtactgtatatggtatgaacacatccatgatttcataagtttaaagtaaatataactttatatatcctggtttgaggagcgaagctaagttggaaagaaatcaggcagagcgcattgtcgctgagctgttggaacgggctgctataggtgtgacagtcaagctggagaaacgtttttctggtggaaggctgattgggggcaaatatgctatgaatgctcacgccattaccatgtatacggacgttatcgaaacacagtgtgtacagatgttcggcagcgttgatcgagttgaggagtattttacggttgtgcttgcacatgagatcgggcacgccgccgatacggaattagtggacctctccgatgcgttggagcaagagaacgggatagggacccggcaacgacttgcgctgcaaattgaagaaaacgcatggaattatgcgcttagattggtgcctgaaatagaagcaacgtttatttctgccgtaatagacgagtccttgctggcctatcgggtcccggttatagagcagtccgacattgcgtaacgatgatgatccaagagccgtcaggctctttttttgttaattagaacatacgagatcgggtcggatgatttaaagaagtagctttttaagctgcgacacgcgtccttgggatagttcgagcatttcggctaattctttttgagatacattaggatgctcctgcatgagctgttttagtttattcaggagatcattctgatttctgtaactccttcttttcttgggctggacaggacgggattcattcaaatgactggaaggattatcgctcttcagattttcaatacaacttttacatatcagatgatccctaaaatagctcaaatgatctacggcaccacaaaaatagcaagaaacccccgtatacttgcgaatcatcagtccctctggggtaataaaaaaatcgagggcatctccaatattaatattcatagaattgcgcagctccttgggcagcacaatgcggcccaaatggtctaatggccgtgtcattcctgtattcttcatcatttttcccctttcctgaaatgcgcttatagttgtaggaattgtatgtatatatgctggaagtacaaagcgcttatattacagtttgttttggtatagctatgctgaaaaaaaaagctccggcatgacgaacaattacgtctgccggagcattgtacagccaatgaatctaagatgtcatgtcgaattactgtgggttggttgtccaaataccggctacttttaattgaacccgtggaggcagtttcaatgcggctaatgtcagatcggccaaatcctgcggttgaagcatgcgatcctcatcaccaatagacaatcctgcgtttgccgccagttctgtattgacagtacttggagtcagcgcggtgacacgaatattggatttacgaacttcctgcatcagtgcttccgtgaagcccatcaaagcaaatttggatgcgcaatatgccgagcctgttgcaaaacctcgttctcctgccgtcgaggaaatattaataatgtttccgctcttttgtgccagcatgcttggaagagcagcatgtgtaacataataggttcccatcaggtttacgcgaataatacgttcccactcttcggggtccatatctgcgactgtgccaaaggtagcaatgcctgcattattgatcaaaatatcgacagcgcccaactcgtgttccagtgaagctacagcggcagcggcctgtgcgcgatcagatatatctgcaacagcactcaccactttcacaccgtatgtactccccagcgaatcctgcagcttttgcaggtcagtcaatgttcgtgagattaatcccaggttaacgccttccttggctaaagtttcggcaattgctttaccgattcctttgctggctcctgtaataatggctgttttattcttaagttccatccagtctcctccttttcactccataacgtgattgtgcatgtgagcacatggttacattatacaaggttaaactcattgaaccaaacttcgcctctgctgaggtattcatctagaggtctcctatttggaaatattaatatcccctgaggtggtttctacctttatcacgttcacactaccgggaacagattcgggagtatctatactcccagagtcagagtggacattataaacacctttaaaatcgggagcttgtttaatcttcacgtcaccagaatcagcattcacttccaagttggctacggcacgttgcgtaatatttgtctcccctgaggttagggaaataaggccattaccgctataatcgcggatggtaacatcgcctgaagtaagcttcaactccatatctgctgcaagctgactggctgtaaaattgccggatgttaaatttgcgatcaggtgggtactttggaggtttgtaatctcggcagtgcctgaagtagcggtgatggaagtattctgcacggaggcatcttgaagttttacattccctgaatgtgcatctacctgtaggtcagttagtgtttcgccggagggcatctctacggtaatcgtttgatctaaatcaggggtgatcgaaagaaatgacaaggaagcggccggctccgattgaatcgtaagcttaccgttctcaattcgggcattatgaatttggtcggctacctttgtctgaacttctccactaatgcgtatcgtaccttggtcgccagagccgggagtaaacaaaatagagacatcatcagaactgtccactttcagcttctgtagctgaccacgtgtgaacgtccattttttgttaatcgcagttgtttccttcatgacttgttgactccatggggcaccgtaagccaccattccggctacaccgatcacaatgcacagacctgcagcaataaaccactttttattcatgttgttagtaagctcccctcagggtagtctgattccatttccagtatcgtactgtgcctttgaccataaggagtaagagataacgtactccaggcagcagcaatagacctatacccgtcaacgtgatagagaaaaagaatttggccgggtaaaaggtgctgttcagcgcataatcagtaacggcgagaaggggggctgcaatgaagatgaccgctaccacggtcaatgaaacccatactacccatagggtagccataatcgggatggagatcagcaagttgagaaacagcagccctaagaaagtaaaaagattgcgtgcgaagcttccctggcgaagcggaggagaagcgttccaggctgcattgggatcatccaaagcttctcgggcaatatcctctgggttacccagctcattggcaatctcactttcgctttttccattgaccaacccgtagtcaaaatgctggctcaaatcactaagcagctcattgcgtacctctgcagggagaggagaaagacgctgctccacctctgtaagaaactgttttctattcatcggaatttccttcctccagtaggcttgcgacatgatggacaaaatcattccattcccgcgtaagtatttttgtataatggcttccagtatcagtcagccgataatatttacggggaggcccctcggtcgattcctgtaaatacgttgtgcagtatccttctgataccagacggcgaagcagtggatatagggctccctcagctacttcaatatgacgggagacggcttgagccaactcgtagccataacggtctctgcgtccaattagaactagaacgcacagttccagtaccccttttttgaattggatgttcacattcacgagcggtgctcccttcctggatgttatcaatgattcataggtgtcgttcggaataaggggaagaaacgtgtgtttgtgtataatttgtcacgggtactaattatagaacagtagtcaggtataatttaacatcatgtactgattaatgcaaggtactaaatttttaataataaaatatttttgccgaaatgggtatattttctttcttgaaggctttatcgaatagcgaatgttgtagaaaaaagtagtttcacttggaaattcctcgaaatctggctggaagcccaaataagatgccgctttaatttcattcattaaaatgatagattgtaaagtattcaatagggttaaagattactttttatgaagaggtggtaaagggtggattggaaacactggtatatggaactggaacacgatgatgagtcttgggatgtatctgaggagattgttctgcgtggtgtagtacatgttgatttttgcgggcagccctcggaagtagaagtcgaatttatcgtgggagccgactccgaagaacaggcacagactatagaagaacctacacagttgcaaaaaaagacatgggagcagtatatggaatattcgtcaactattcatcctcaagtgttggagtccatacaccatcattatgctggcatagtggaaaagtaccggaatgcttacagtacatggggagaggacccagatgaatatgcgccttatgtggagcggccggaacaattgttggatcgaatacagcttatgtctatactgatttccgactcatcggcaaaggatgaactgtatttgaattttagttgctcctgggatcgagaacatggcttaggcgtacatatgaagcagatgaaaatggagcatattcaaggcgtatatacattatataatctagaataaatcccctttcctggcttttagaaaaaagggccggaaaggggaataggataaggcgaaatgatggcgcgattggatacgataaaaaaattagttagatacagtcaatgcagcccgggctgcttgagccgcttgtaccatttgtcgcaaggcggcgacagattcctctttggtgcgggttttcagaccacaatccggattaacccagaacaaatctgatggcagtacgcgcaaggcacgctggatcatgcttagcatttcagatacatcggggatgcgcgggctgtggatatcgtacacgcccagaccgatgcctttgttgtatacctgatcttcaaagctgacaatcagttctccgtggcttcgcgaggtttcaatagatataacgtcggcatccatatcggagatggactgaatcatatgctgaaattcggaatagcacatatgcgtatggatttgggtcgctggctctacggtggccgtggtcacaaggaaggcttgaaccgcccaatccagataggcttgctgctgttcttttttcagcggaagcccttcacgaattgcaggctcatcgacctgaatcatgccgatgcccgcttgttccagtgcctctacctctgcccgtaatgccagagccaactgtaaagcaacttgactacgtggaatgtcattacgttcgaaagaccagttcaaaatggtaacaggacccgtaagcattcccttaacaggcttggaagttaacgattgggcgaatgccgtttcttccacggtcatgggctgatcgaaggaaacgtctccgtatataatcggcggtttgacacagcgggagccgtaggactgcacccatccgttttgcgtaaaagcaaagccgttcagcttttcgccaaaaaattcaaccatgtcggtccgctcaaattccccatgtacaagcacgtcaatgccaatgtcctcttggatatcaatccattccttaatttgctgttggatgaacgttcgatattgctcggcagaccattctcctttgcgatagtgcaggcgggccttgcggatctcggcggtctgcgggaagctaccaatggtcgtcgtaggcagtggaggcaacttcagcttattttgctgaatctcacgacgctcggcgaaaggaacgctgcgtgacagaggctctttggccaacaggtcggccagatcggcagttgtctgtacgcgtgccgctgaactgttgaaacgggctaccgcatctgcactttgtccaagcttggtgagtgcggatggatcgtgtttgccaagtgcagctgtcaggatggcgatttcctctagcttttcatcagcaaaggccagcgcttgcaccagctccttgtccagcttgtgctctgcctccaggctgactggcacatgcagcagactgcatgatggctgtacgataagctgctcggcagtggtctgttctgctaactgacccagcagtgcagctacagcgttcaggtcgctgcgccatatattgcgtccgtcaatgacaccagcgcccagcgtttttcctttaggaaagccatgctgcaatatatgctgaagattttcgccatcatcatacacaaaatcaagacccagcccctgtaccggaagtgcggacagacgctcataatgatctaggctgccaaagtaggtttgcagcattatatttaaggagggcgcagcttgggtcaaagcttcatagacttcttgaataatgtccagatcctctactgggaatgaggtggtcaggacaggttcatcgatttggacccactgaacaccttctgctgctagctcagacaggacacgggtgtataaaggcaggaaggttcttataacagaggcaagctccttacgatcatagcctttggaaagggtaacgaatgaataagggccgatgagaaccggtttaccctcaatgcctagttcctgttttgcttcacgataagcctgtaagggtttattttcagtgaataccgggactgcatttgccaattcgggaacgatgtagtgataattggtattcatccatttggtcatttcactggcggttgctcccttctgaccgcgagcgatcccgaagtacacggacagaggaatcggacctgcgggacgatagttgaaccgttcaggtactagaccgaacatcacagatgtatccagcatgtgatcgtaataggagaagtctccgacaggaatgcgatcaatccccttgtcacgctgcttgctcagatgctccaaccgtaattttttcatctccgtctgcagttcgctttcgttaatgctgccgttccagaagcgttccagtgctttcttccattcccggttttcgccgatacgcggatatcccagattactgctaatcaagccggacaattcaggccattcaataatggacatgtacttttcctcctagtgggtagctgttttatttttacgtaccaaaaaaggcattcttccccccaaggttaaaaataagtaggggaaagaatgcctccgtgattaaaaaatcaaaaatacggcgactgctcttaacacctccctatcttccgtaggtacttgcgatgttgttaaaataggcaggtctcctgacttacggatcatgacgctcagcactccttcccggtctgtggaccagtggatatatgaacagctgaaagttccccgtttacagtggcgggaccgtgccggatttgcaccggcttcccttttaagcctgatctgaatagaacagacacctatctccaagctatgcggttaaggtatgacgaataattatgcactcgtatacttgttcaccatcataagtgaaacttacaggatgcgcaatagaaactccaatggaatctgttagctatatgaaaaaaagacaagccttacccatgatgggggcttgtcttagattagatatagcatcttgcttgctgggtaagcatcgccttatgtcaatgaaacggtatagcctgcctgaatactggctttcacatctaccagacgctggttgcgactgccccggaagggaagggtcaggtccttttgctgttctacaaaacgaccatccacaatcacatcgcacaaaagcgccagttcctgtcgctccggatctgtgagtagatcttcatagacaaagccagtgtaagcccacacggttcggtcgggacaggcctcgcggaagtcacgcacaaattgcgagcattctgctgctgagaaaaacgggtctcccccgcagagagtcagtccgtccaacaacggattttccatgatgtcacgaatgacctcctgttgtcgttggggggtgaatggctcgcctgcacggaagctccatgactctggattaaagcatccaggacaggcatgacggcaaccgctaatgaacacgacggtgcgcaggccgtatccttcgttcagagattccggaatgtagccacacaaattcacttatgtttcacccggtctcgaacttctgcctgttttgcggcattaaagcgaacggtataatctcctgtcagatatccggttacccgacgtaagcgctgaaagtgtgtgtgctcctcatctgtgccacattgggggcagcttgtcccgataatcccttcataaccacattccgtacaacgatccaccggatggttgatggagaagtagccgatgttctgatgcagcgcatactgaacaattttaagaaacgcatccgggttattccgcgcattaccgtccagctcaatgtatgaaatcgcaccagcgttgcataggttatggaacggagcttccaagctgattttacgagcagccgggagcgtgtaatacacgggaatatgaaaagaattcgtgtaatattctcgatcatttacctcaggaataatcccgaaatcacgttgatccagcaatgtgaacttgcccgacagaccttcggcaggcgtagcgaacaatgtaatatttaaattgtggtactcactcattcgatcgcaatacacgcgcatggaagtgatgattcgctgtgcctcgcggtatacgaaatcatcctccccgtgatgtttcccgtatagtgccttcatgcactcagccagcccgatgaacccgatcgaaagcgtaccgtgctttagtacacttcccaccttatcatctggtgccagttgttctccaccttcccataccccttcgcgcatcataaagtccgaggctttggccggttggctggtctggatttgataacgatgaattaggccatctaccgcaatgcgcataacttcttctagtctcgcatcaaagcgatcacggtcaggtgtcaggcgtttgcctgtgcaaataccatactcaatgccaagtcgcaccagattaatggtattgaaggagagattccccttgccactctgccggtttctaccgaaacggtcagaaatggtgcgggtacggcaacccattgtcgctataatggtatctggatcatcagcacggtaaaaaggcaggttgaaggtggcatccacattcacaaaattgggatacatccgtctgctagagcattctaccgcccgtaagaacaaatcataattgatgtcgccttctgcctggttgattccctctttacattggaaaatatgttgtggaaaaataggagtttccccgctgcccaagccgcgaatagtggcctccagcagcgattgagtaacaagccgtccctcagcagacgtgcacattccgtaattcagtgaagtgaatggaatctgtccccccgcccgactgctcatggtgttcaggttatgaatgagcgattcagcagcctgccgggtttccgtttccgtttcttcgcgtgcgaatgcgtaggaacgagggcagacttcttgcaaatggggattggccatatgtagttcgtcttcagacagactggattctatctcttcctcgaacaaccggagtcccttgcgcagatgcttgcggaaggaccgggcaacgtatggggcaaggtcccaatcgattttattggcagagacacctccgaattggctgttttgctgagactggaatatgatggcgactagtgccatagcagacataatcgtttgcggtgtgcgcacagagccgttgcctgtattgaagccgtctcgcagtaaacgaccaaaagggataaagatacaatttgtagttccgagtgcatattggtccaaatcgtgaacatatacatacccgtggtcaatcgcgttcgtcagttcaggcggaagtacccgcaggtgtgcataccatttggcatactcggacccaagcttgctcattttgccgctgaacgattctccattcaaatttgcattctcccgcagcatgtccagatcttgtgccccaatgacccgctcgccgatgtcgtataattgatgttcctccagcaccttcatcgtaaaaccctccatatagtaaaatatatatatttttcacaaaaacaacatattgatgatatcttgtgttaaccaattgtttcgatctatatattgtatatacgtatacattgagagtatgtgactattgtcacattggtaggagcgggcagcataaaaaagccagatacagagtaagggacacatccacgaatatgcaccttactctatatctggccatcgtagttgcgaggaaaatgataggcttgcgagtacatagtatatgatcttgggatattgttttgagaaggtttagagtagctttttcaactgggacacccggccttgggaaatatctagcatttcggcatatactttttgtggcaggttcgggtgttcctgaatcagcttgcgtagcttttttaccatttcaccttgctgcactctagattgcttgggttgccaggttgtgttggttcgggtcggcttagaatcttcttgagcctggatagcatcggtgcttgtggcatgcacattttcatcggtctttaatacctggatgcactctgcgcaaataaagctgtcgcgaaaataagttaaatgatccaccgcgccgcaaaatttgcaggagacaccggtgtattttcttagtacaaacccttcttcatctacgaaaaattcaagtgaatcaccgatattgatatccattgtggtccgcatttccttaggaagtacaatccggcccaattgatctagaggccgtgtcattccagtatttttcattagagcttcctccttccatgatatatcctgattataccaaaaaatattatttttagctttgtatattgaaggtaaaatacaactttttttgtctttatgctgcggtctctctttcaaccagtataggatgttttcggtattgttgccggggtatccctttttagctacgatatattaaaacgctttcataaataaactttttatcatcttaattaagcttatgccacaattgagctgcgtttggatgcgccggacaacgaagctgtggcacgtgtgaacgtgggcaatacaggaggggcgcaagcatggacttcgctcgcggaagcggtacattcagtctttggcacacgtgatgtatacctgttgttgagcggagaagtgcggctagctcattttactttgggcgctaatgctacagaggattccggctttcaggcttgaacttacttctgacatcacgtacaatgcattcaacgaagtttctacagcttaggggtgtcatctcatttgaatagtgaaaaacgactacgcaccgcaacgcccaaatggcttggggtggcggtaaaggcgcttgtctatttggaaaagcacggagaactctgtgccagcggttcaattgcccgttccattgactgcgaagtcactttggtgcgcagggtgctgacgcgacttgtacaggcagatttgattgcagcacgcgaaggtcgtgagggaggctatgtgcttacccgctcggccgaccatattacacttgccgatatatatcacgccattgaaatatgtgatccgattttcccgggtatgatgcatgaaccggaaaccaatcctttttgtgaggagttggcgatagccgtatccgaaattttagccgagagcgaacaacgtatgctagaagtatgggggtcccatacgctggcttcgcttgccaatcgtacatcactcgtggtggagaaatgcaatcataatgaagattcaaaatgataatagccgatacgactctcaagagagggttgtatcggctatttctatgaaatggtcatgcctcaaattatatttcatatgagcaaacccggttacgtcctgcatttttagcttcgtatagtgctttatctgcctgctccagcagggctgccccggacatatcttcaccggtaccaggaaaggtcgtcacgccgatggacaccgtgactttaagaacaagatcgtccgctaaaataaactcgtgctgatttactccactaagaatctgattagctatgcgcagcgcttgtcgaaaagcacaattcggcaaaagcacggtgaattcttcccccccgctgcgggtgactacatcattaggacgacatttttccattaaaatctgcccaagctggcgcagcactgcatctcctgccgcatgtccgtaggtatcgttgacttccttgaagtgatcaatatccaacaccagtacagataagtgctcgtgacgttggcgagcttgagggagctcctcttccaatgaaaactcaagctgtcttctgttgcttaaattagtgagatggtctgtgtaggaggtatgctccagtcgaagtaacagctcattggatgtgttgatagattcagcaatgaggtacagaagacatccgccgaccatggaaatgaagaattggagcggatacacgtgcagaacatcatcaagatttttcaaattaatcataaggggacagaatataatgcccaaagcaaaaacgttcataatcatcagcttgggtaaacgtgaccaggacagatgtgacaataaagcgcaccccaggccaacgagcatcataaaaatagcgcctacaatggcttgagtgttgataccaaacagcagtaatctacctacacatacaaacagggtagccatgagcgctgctgggccgccgatgtaagtggcggtagctacgatggccagatgacgaagatcggcaatcgtattaaatcctactggaattgaatagtacatcataacaatgccgtagcacccaaaaagggcacctccaatccaatgtatcttacgcttcaaggtgtgcagccggattttatatctttgtgatataaggccggttatgtacaaaaaggtgacaaggatacaggtatttacaaaaaacgtactgaacaagatgctaaccctcccgagaggcatatttcttcattttatcaaaaaaactgacattaagcttgcaaatgaagaatttattgaaatttattacgcgggtgcgcatataacgtttcgtccacgtgtttggtgcataactgggaatagattgagcatactccaaagatacaagaataaggaaaaatgggcggtatctattgctgccttactggagatgaggtttgctcatgattcgctatccctatcgcaaacataataaaaagtcgggtgcggacaagaataaagaaaattcttcacgttctttaaagatcgaggctcatttggataccaacttacagcaaattaaggaatcgacgtcaaacagcccagacttcttgattcgccgttttaatgtcggactaaaggcggatgtccctgccgccattgtatttctagatagtatggtcaagacggatacagtgaatgagctcgtcatgaaatcattgcttagccgcccatctgccgaggtggctgctgaggtagaaagtgcagaagagctttacaatcggatacaggctcatgcgctggaactgggtgaagtaaaggattgcgatgattggaattccatgatggaacaactcttgatgggagatacgatcattctgctggaaggctgtaaaaaaaccatcgcatgcggcacacgcggaggagagacgcgggcggttaacgagccctccacacagtctgtcgtccaggggccgaaggatggatttgtggaatccctgttcacgaacgtctctcttgtacgtcggcggattaaaagctccgatcttacgatggagatgttcaaagtgggaagtacgtccctcacgaatgtggccatactgtatatgaaaaatattgcagattctagtgtcgtagatgaagttcgcaaacgggttaaagccatcaatattgacgccatatttgaatctggcatggtagaagagatgatacaggaccaaaatctcacaccatttccaacgatctataactcggaaagaccggatacgattagcagcaacattatggagggtcgggtggcactcatcgtcgatggaaatccatttgtactggtgatgcccactgtatttgctcaattttttcaaagttcttccgattattcggaacgttatgacatggcaactgtcatccgagtcatccgttatatcagctttattattctaattttggggccttctctctacatcgccttaaccacttatcattatgaaatgataccaaccccactgcttattagcatactagcgcagcgagaatccgttccttttccggcatttctggaggcgtttattttggaaatcacctttgaaatcttgcgagaagcaggtattcgaatgccccgtgtgggcggacaaacggtatccgttatcggtgcgcttgtattgggacaagcggctgtggaggctggaattgtcaccccgctactcacgattgtagtagcgctgacgggaattgccagctacgcgattccgacatataacatggcggtagccgggagactgttccggtttgtttttatggtgctggctgcatttatggggctgtatggcattacattggggctcattgcgctgatcgcccatatgaacagtcttcgctcttttggggtgccctacatggcccctttcagtccttttgtgctggagagtcaaaaggatgcggtattgcgaatgccgttttggatgatgcggaaacgtcctaaaagtattacatcaacaaatcagacacgaatgaaggatggaagcgggatttccccttccgataaaacttcaccaatgcgggaggggggcgctcagggtgcatctggagaaggagagtgaacgaagcacagtaccctttaaatggagaatatggatgctgagtttggtggggctactagtcatgccgcttctctctggctgctgggattcagtggagttgaaccagcgggcagtagtcgcggctataggcattgatgcggatggtgaatccgattatgtggtttcactacagattatcgtagcggatgaaattgccggggctaaagcccgaggaaataccccagttgtgctgtatcagcaaaagggaagcaacctttttcaagtgattcgcaaagcttcacagaagattccgcgggtagtttctctggcccatgcgaggattgtcgtttttggagaaaagctggctcgacgtggtatcggggatacgttggattatttggaaagggctgcggagccccgactaacgatgaaaatgctggtagcacgtggtgaaacggccaagaacgtactggcatccatgactgcaatcggtcgtattcctgctaatgatatctcgggtaagctagaagcgtcccagcgtatgtacgccggggattacgcagtgagtctagacgatgttatccggagtatgtccaataaaggtagtgggcctgtccttactggtgtagaagtagaaggtaatttggagcaggctccccttaaggctaacgtggatactattttgcccgaagcggttgttcgcattaacggtatgggtgtgttccgtaaggatcgtctcgtccattggctggacgataaccgagctattggattatctatagtaaacaataaagtgaaaagtgctgaaaccgcgttgagctgcggcaaaaaaggtgaaatcattggaatcgaaaccttgtattctaaaacacatgtacacagtctgatcgagcaagggaagccggtatttgttattaatttggagcagaccgggacgattcaggaagccgagtgctcgattgacttaaaaagtccagaggttatgtatagcttgcagaaacagtggggagaagaaacaaaaaaagtgattacttcaacggttaaggaggttcagcgtagtcgcagtgatgtactcggcctaggccatgcactggagaaaagccatcctgaacagtggaaaaaactctcacctgagtggaaccgctattttgcagaaagcaccgttcgtgttcaggtgacttcggtactgaagcatacacaggcacggactagcccttattcaaagggagagtccaatcagtgaaatcgggaaaggagggaaggcattgaaaaagatacaaatcgacgcaaaagagatgatttccctgatgatgctgtttgagttggggacgtccatgatgtctattcccggaagagatgcgggcaaggatgcgtggattgctattcttatcgccgcaggtttgggagccctactttttctatgctacggcagccttcaccgccactttcccgacctactcatgacacagtactgcaaggtgcttctgggcaaaactgctgggagcgtgcttgcctttttatatattgtgttttttctttacggcggagcacgcgatcttcgagatactggaatactgattgccgaccggacattacagcatacgccgttaactatcgtctgtgtcctgatgattggtcttgttatgtatgtgatgcatttgggaattgaggtcgcaggccggacgggacttatgcttttattcttgctgctgctgctgggcttcgctacgaatatcttgattttattgtcaggtattgttcatatgagcaatatattgcctattgcccagcatggctggcagccgatatgggaggttgtctattcacaagccttgatgttgccatacggtgagatggtcacgtttgcgatgatccttcccacattaaagaaaggctaccgtgccaacggggttggggtcaccgctgtattgttgggaggcgcaatcctgtcttttgttacactgtcaaatgtggttgtgcttggggaggacgtattcaaacgggccacttacccgctgctttctatgatcagcaaggtggaaatatcagatttcgtcgatagagtggatgtaattggggtcatgactgtcattatttttgattttttcaaaatttttattttctattatgcagcggttaaggctgctgaagatgtattacgtgtttcataccataaactgattctgccgtttgggcttatcatgcttgtttcttgcgtgttgatggctcagggctatcaagaacatcttgcaacaggcgagtttgtactgaaatgggtgtttccggtatttgctgtgttccttcctttcttgttgcttacggtgtcatggctgaaaaagtttcgcaacaaaaaaagaaaggagtatgcctcgtgagtcatcgtcttgaaaacaaaacatacatcagcacggggcaattgctcattcttatgtttcattttcttacaggcaacgcagtcaccattaatatggatagttatatggagcgggacacgtggattattcaactcgttgctatgattctggggatggtattgttccgaatgtactgctacacagctgaaacgttccctggtaagcctcttacaacctatgctagtgaattggtcggtcatacatgtggaacagtcatgggagtattatatattttattttttttatttctaacaggcggcaatttgcgcgatgagacagagctgattcgtatttctgtactggagcaaacgcccaacctggtcgttgccttccttatggttttgtgcgtaatgtatgtcctttggttaggatttgaagtattagctcgaacaggacaaatcatgcttattgcagtggtgactgtcatttttgtggggaatgtactgttgattttatcggacagcattcatctgcatgagctgacgccggtgatggagcatggctttaaatctgtgcttcattcagccattcgggaacacttggcatttccatacgcagaaatgatttgttttatgatgttcgtgccccatttgaaaaaaacgtcgcagatggccagaacaggatatgcgggcattatcgtaggtggtttcgttttagctgaagccgcaatactaaatgtggctgttatgggcactgacattgcacagcgctccatctttcctttactcagcacatttgggaatgtacagttttcagaatatttacagcgtctggatgtgattgttctgatgacgatgattgtgggcgatttttttaaaattgccctgttcttctatgctgcggtgctcgggatctccgatatttttaacctcccctaccggaaaacactactttttgtcgggatcattgtcttactgtggtcacaggtacaaacacccagcatgattgagcatctttctcttggacgattatcgtttatttatattcatccgttatttgtttacatctttcccttgctgctctttttggccgctcttttgcatcgaagcagagttagaacccgaggaagaagcggaaactttcagaaaacgggaccatcgtgaaaagaggaagtgaaatccgtatttaatttgtttttttgccacggtcacaaagaatacaagcagcattcctgccaagacgatatattcggatggacgcatagtactaaaagccaatgccatcggttcccacggggtatgagtactgaatagccagttcactagcagattggtgccgagcataagcatcataaagagtgtgaatatccacagtattttcataaaatattcctccgatgtgtatgagctgagatgtaccatgtatacattgtgttgcaaagccgttcaatttatccgatcccattgacttgaaataaattaagatttatacttattctaaattgatttttattatgattgtaagtttgtaattaatataatctgcgttggttaagggagatgcggtatgagaactttaaatttaacttcgcagcgccaagcggtatatgatgtggttcgtgaagcccacgatcatcctactgcggccgatgttatgaatcggttgatggagcgcggatataatctggcctatggaacggtatataattcactgcgttatttgacggataaggaattaatccgtgaattgaagctgggggaagctgctagtcgttatgacggacggatggacgatcatcagcatattatttgtcaggtatgcggccgggtagatgaagtgatgagtgaagtcccacatgattggattgacacggttgcgcatgaaacggggtataatattgcccatgcccatgtcgtattcggaggagtgtgtaaggaatgtcaaagcaagcgaatcagataacgaatcgtttcaaagtggctgacatgcctagaagggtgaagggtagttggacatcgatgttagcagctccctctacacctacggtgcagaccgttccctccaatgagcctttgtattgtccgaccacacgtcgtatcattctaatcagttcggtaccgggtgtagttcacgggttggtgcgtacgttgtcagatgcgtgttttgatgtgatggtatttcatcgctgggagcctgaagtgcagcgtcatctgggaagcgatctattgatttacgatttgaccgccaccgaaccacagagtgaattactggatatccgcaatcgtctggaggtagaacacatgaaagacacaccggttatgtacgtggttcaggatcgggtgtctgtacatgcgaatgagctgcttccttcagaagaggtgctggtgtggccgctggcttccaatcatatggtgcatgacattgaacggatgattgtacgccatcctgccgcttcccgtcaggcagcgcaagccagccgtcgtacggtgttcaaggacctctggattgaccgagataaaatgctggtatataaagaagagagtcaactgaatctgactaaaacagaatacgatttgctgctcaagctgattgatgctcaaggcaaagtgatctctcgcgagcaaatgatgcacgatatctgggagacggattttgtaggcggcagtaacgttgtagatgtgcatgtcaaaagtttgcgcaagaagctagatgatcgacctgcggaacctgaatatattgcaaccgtaagaggtgtaggttacagattggcagattgacctgaaagttatgaataccgatgaatttccgccggatggagacattcggcggtttgtatatgattccatgaagaaactgacattaggtgtgacggttgactttagccggatatatacactacaatcggtagtgtgaggtgcttcttatgaaacgactgaattttaaagctggcgaaaccgggcttaaccgatttttcgggcctctggaagccaagattatggatattttatggtccacttcggatcggagtatcaaagaagtgcagaccgcgttggagggggatcgggactttaacttcaatacggtaatgaccgtgatgaaccgtttagtggacaagggaatactgagtaagagtatacgtgggagaacgtctttatatcgtccagttttaagtagggaagagttcatgaatgagcaatccaagggactcagtcacgaattggtggatgaatttggcccgcttgctgtcaatcatatgattgatgctctggaggtggccgatccgaagttgatcgaacgtctggaacaaaaaattaaacaatggaaaaaggatatgtagcgatgtggaaaacacgttctaaattactgtttacagcaggcgccttgatatcgggtttcgcccttatacagatgggtatgtacgccgggcagcatgttttcggctggaaattgaattataacgtgtttcaaatttgcagaagtttgttgcagcactacggaattggctacatggtggatgcgctcagcgggctggttttcgttactttcgctattgccggaggagaagcagtcagacagtgtatggctaccagggcagcttttcgcagactgcaccgaatgcgagatcttgcgctgaccgaagcactgggtgagcgatatcgtgaactcgggaccgatcggatatgggtcattgattatgccaagccagccgcctttaccatgggattatggaagccacgcattgtattgtcctctgcactattgtccgtactggacaagtacgaggaagaggctgtcatataccacgaagcctatcatatgaaacattatgatccgttgaagacctggttgctgcaagtgtgtgctaaacagctgttttacttgccggtgctgcgtcacattaccaatcattataagacggcccgtgaaattttggctgataacgaagcgatccatcgagctggttcacccgttgggattgggagcgcattgctcaagcttttgagtatgacgcctgccaatactcgcctggtaaactccgccgcttgttcctcgtttgcagaaacgtccattaattatcgtatctcacgtattttagaccctcagcaagaaccggtcattcaaatgccttggcgttcgattatgttttccagctatgtgctagtgatgctgacacttatgttcgcactggcgctaatctagttggacaagatgtttcttacgggtggcgcttttcgcgctcccgattctcattgtgcaatacactacattatgtagtttgttgcaggattttatacaacttaaaaggagatgagcaaatgaatcaaacgcttatgaatattggattattgttggtacgaatctttacaggggttatttttatcgttcacggtgcacaaaagtttcagggattagacggaacctccggcttcttccaaagtatcggactccctggttggatggcccctgtggtcgctacggttgagctggttggaggaattgcactggttctgggtatcggaacacgactggctggagcggcattgaccattgttatgattggtgtattgctaaccgctaaaaaaggacagccttttggctcgattgaatttgatctgctgattctgttcaccagccttcagcaagcgcttgtcggtggacgttttctggcagtggatcagttatttggccgcaaaaaagctgaaaacagtaacgtacaggtctaaatgttcatataaccgcgtccttagtcttatagggcgcgttttttgtttttcccctttgtgaaatttcattgtaaatcatttgctactttcaaccgatataactaacacggaatgtaattcaaatatatcgttttatgagcaaaggggaaaaaacatgggaacaacgcgaaagagaaaaactatatggacactcaggaacaagctaagtttaggctttttacttgttttgctgattccgagcttaagtatttccattgcgacctataaatcatcatataatgctatggagaaacagcttcacgggagtgcgaatcagggggtagcgacagctaactcgattattgaatacgcaatcgccagtaaaattaaagatgcgagttatttggcggagcgtctggacggctcgatgataaatggtcgaaacagccctttgattcagcccaagctgatccaatacaagggtttgcacgaagatgcgacggatatttttgttggtacaccggaggggctgatgatccggggggtgcccaaggaggatgaagggacatttgaccctcgcaaacgtccatggtacatcgaagcgatgaagcagcccggtaaggttgcaattacgcctgtgatcatcaattcatcgggtattcctgtagtcgtagtatctcagacgctttccgacaagtccggggttattgggatctctctgaatctggaaagtgtacgtaaactggcctccatcaaagtgggccaggaggggtacatcatcattttagatcatacgaagaaattcgtagttcatcctacggctaaagcgggctcatctcctcaggagagttcgcttgatacgttgtatactgcgccgagcgggaacttcaactatatgcatgaaggtcgtgagaaatatttgacctttgtaacgaatccggataccggctggaaaattgcaggtaccttctatcaatctgagattagcgatgccaccgctgccatgcgttatgtaaccattttcgtgttggctgcctcactggtgattgctcttatcgcgattttcctgattacccgttctgttttggtaccgattcgtaagctgcaaaaatcagcagaacgaatcagtgaaggagatttgacgggcgatttggaaactggaaaaacggatgaggtgggcgaattgtctgctcactttcaaaccatggtggatagtttgcgcacgatgattcgaagcgtacacgaaacgacagatcgggtaagttcttcagcggaggagctggctgcaggtgcagatcagacaactcaagcgattgagcatgtcaccattgctatccaggaagtagctgtgggcagcgaacgtcaggtggagagcgtcaagcacggctccgtaaatatggaggagcttgctcagcaagcagcgaatgtatccgagcgtatggtgggcgtatctgaacatgtgaagatgaacgctgagtcggctcaagagggcagcaaggctgctacgcaggctgtccagaagatgcatgacatcgatgagaccgttaatgatctcggacaggccatggactccctcaatgagcgctccggtgaaatcgtgaatatcatcagcgttatatccggtattgccaaacagacgaatctgttagctctgaatgcgtccattgaggccgcacgtgctggggaccatggtaagggatttgccgtggtcgctacggaggtacgtaagctagctgaggaatcagcgaaatcggctaccttgatctcggagcgtattgaagcgatgcaggtggatatgaatcatgctctgggtgctatgcatcaagcgcggacacgggtgacggaaggcattgattcggtaaccacgtctgagcaatcctttgcggaaatcagccaggccgtggaacgagctatggtacatatcaatgacattaccggagtgactcaggaaatggcacgagggactgtaggcgtcgtagatattatgagcgatattgcccacatttcggacgaggcagcgagcaacaccgagtcgatctcagcggcagctgagcaacagctcgcttctatcgaggagattgcttcatctacagcggacctgagccaaatggcagaggaattgcgcgaactggttggacgttttcaggttgaaggaaaatcctaaaatgataaaaagcgcccggatacaggagactatactctgtatccaggcgctttttttaatgttttagcataatttctggtttgcagggttagaagttaacgttggaaggacttgcggcgatccagacggaaacggacatcccgtgagctgtcggaaggacgcagcgaacttctctgaaacatattgttcagaatcagtgcgaaaatgactagcactgtcccatatagttcaaaacggctaatggcataaccttggaagtacatgagtaccagcgtggtaattggtacaaagttaataaatagaattccgttcagtggagacagctttcggattccggcattccagctaagcagggcagctagccctggaagcaggatcataaagctcatttcgtatttaactgaccacacagcctgccaatccggcaccacaatccagttgaaagcagaggcaaatgtgacgactacgaaggagacgagagttccaagcaggcaggttagggttgaataccgaagagtagaccatcctgcaaaatggctgcctcccatggaatatacgacccatccgacgacgcctacgaaaataagcagcagcggcagtaaatgttgtccggcaagcgtgaaaaaggtccattttccgttcgtgatcacaagtaaagccccagccagcgcaatcaccatgctgattagtgtatattttggaggcattttacgagtcatgatccataccatcgcaatggaaatcatcggcattagcacttccattatagaagctaccagagtacctgctgcccccatcgcgtgctgtccctggaaaacggccatattataaatggtgaatcccatggtcccaaagaataacaacgtcttgcccttgccctcaaagcgaaatgccgtccgtccctctttgagccacaatagcacgactaaaatgagtgtaaccgataaatagcgcaaaaatgaaaagtacagtggattgatatgttgtaatgcaatgtgcgaaaccggaaacatcgccccccaggacatactggcgattaggcataataaagatccggtcatgatttgtctgttcatgatgtacaaaagctcctccttgccggtctcagcggacatatcttatggacacatcataaaggataggaagctgttggtaaaatgattgaaaataaacattatgatcatttaaaatgataataagtgacaaggcgcgtcaattttgatggccccttgtccttcacaataaggaggagcagtagtggatctgaacgatttaaacattttccagacggtggctgcgcatggcagtgtcagcaaggctgcagccgagcttagctatgtccagtccaatgtaacggccagaatcaagctgctcgaaaaggaactgcaaacgcctttatttaatagacataagcggggaatgatcctcaatgcagagggcaagcgtctgctgcaatatacgaaaagcattttatcgcaatttgaggaaatgaaacatgcgtttcagaatacctctgcaccttcgggggtactggagattggcattgtagagactgtcattgccctcccggccattttacatgcttattatagcaagtacccggatgtcgagttgtccctcaaggccggggttacagagtctctggtgcaggaggttgcagaaatgcggctggatggagcttttgtgaccgggccggtcaagcatccgctgattgaacagtttgatgtgtttcaggaaaaactggtcctcgtatcccaaggagatgacttttctgtcgaggatcttacaacccgtccactcctgctgtataaaaaaggttgcggctaccggggacggctggaaacttggctcaagatggaggggattattcccaagcaaattatggagtttgggacatttgagacaattatcggcagtgtggcggccggtattggaatgactgtttttcccgaatcgttgatcagcgggctggtgtctcaaggccttgtatgcggtcatgcgatgcctgagccgtacaatgaagtaacaacggtgtttatccgacgtaaggaggcctttgttaccagtactttgcagtcttttatagatgagattatcactcagacagaggcgtagctttatcgcttgggctcggttacaatgagagggatttgatctcatttttcttcctgaaggagggctattatgtttacaatatatccggcggcttcccgattcagcttcgataagggctggttgcggggaagtcacagcttttcattcgcggagtatcaggatgagaacaatacagcgtttggccctatgcgtgtctgtaatgacgatgtcatcgcaccgggacggggatttggggcgcatccgcacagtgatatggagattgtttcgattgtgctgtatggggaactgcgtcatgaagacaaccatggacatgtagcggtaacccgttttggaggcattcagcgaatgtcagcggggcacggcatcattcatacggagcacaacgcttcacaaacggaggatgtcagtctgctgcaattgtggtttagcccgcatacgagaggactgaaaccgtcatatgaggctacagcattcaatcctgagcgtcttcacggtcagcttctgcctgtcgttgccggaaagcgcgtaccaagcacggagggtgaaatagctgcaatcaaccaggatttaacgatttatttaagcaagcttcagcctggagaacaagtagaattcacacaggccgagggtcggcgcgtgttcctgttcgtcatcgaaggctcgctgcgtgtgaacggtgaacatattctgcaaggacgcgattccgctcgtattgagcaggagccgaagctctcactgaaagcagaagattctgttttttatatgttgattgatttgccctaaaaggaggtgcgcacaatggcgcagcaggaaacatggctgatcaagcatgctgtcacgggacgtagctttgctgacagccgcaagcagagtttcgattgtcattttgaatcggtggacggtgtgtttcgctttacgcttcaagagctgccgcgtgagacggcggaggcgattgtgcgttatagcggggagttgaacgtatttcgttttgtaaccccggtagacgacggacccgtagtgaagcattggtattacgtcaccccggaaagtgtggaatatcatgatcagacagataagcttacgttcgaagctggttctgagattgaataccttcccgaggagtattggggagattaatcattcctttatcataaattttcagatatatgatgaattttcgaaggctctgcatcattgcagggtctttttgttatccgttcaatatgttgagttcattggatacataatcctttgcaggctggtacatcctatatgtcatattatctgttcggctcattcgtaaagggggaataacgatgaagaaagggcgctttcccaagttgccgaagccaccgtggagccggagagcgattccagccgcagaccgcaagacacgaaattccaatgtgcctaaaggactgcctgagtcatcgtggctggaacagccgctatgtagcagtgtggaagacaatttgattgctttgcgtgatattttcaaggattgctctgatatcgtctatcgagagctcatgatttcccctgaacgcaaaggggtgttggcttattttgaaggtacggtaaaatcggaggatttgcaggatcatatcctgcggcctgtcattctgggcatgatgctcaaggaccctgaagtgaacggcaaattggagccgctggatgaaactcgtatctccatgtcccagaccaaaacgatggacgaatggaagatggtatcggcagcgatactggacggcaatgccgccttattcgtagatggcacgcctcgtgcgtatatttttagcgccaaggggggcgttcgtcgtggcgtagaggaaccacagacagaagcggttattcgaggtccgcgtgagggcttcactgagactcttcgcgttaatacggcactgttacgcttcaagctgaagacctccaagctcaagatgtacagcatgaccatcggaacagaaactcaaacgagcgtcgtccttacttatattgaagggatcatagattcgaagctggtggaggatgtaaaaaaacggctcagcgatattaaaattgatggtgttctggagacggggtatattgaggaactgattgaggatcatccgttttcaccgtttccgcaaatggaatacactgaacgtccggataccgtcactgcgcagttactggaaggacgttttgccatttttgtggacggaacgccttttgctctgattgggccagtcaccatgtggcagatgatgcaagcgagcgaggattattacgagcgctttttcatcagtaatatggtgcgctggattcgttttctttttctcgtaatggctctctttctacccgcattatatgtagcggtgacgacctatcatcatgatatgctgccgacgacgctcatcctgagtattgcggcggctcgcgaatccatcccttttccagcactggtggaagcattgatgatggagatttcctttgaggcattacgggaagcagggattcgtctccccaaaacagtcggtcaggccgtcagtattcttggtgcgctcgtcattgggcaggccgcagtacaggcaggaatcgtatcggcgcccatagtcattgttgtgtcgctcacaggtattgcgtcgtttactataccgcgttttaactttgccatcacggttcgtctgctgcgatttcccatcatgctgatggcgggtttattcggattgtttgggatcattattgcgacaacgctgattgctacgcatctaaccaagctaacctcgtttggtgtcccttatatgagtggatatagcccatacaaccatatggatcaaaaggatatcgtcgtccgcgcgccttggtggaaaatgaccaaacgtccttcctggattggtaaagacaacaacaaacgagcgaaggaaaagatgaatggaacgcctaaaagcgaggagggatggtgatgaagcccaaatcgaatacacaacaaatacgtaaagtcgctgtgctctgttgtctgctgctatgctctgttctcttgggaggatgctgggatcgccgtgaagtgaatgatgttgctttcgtgatgggtaccgggctggacaaggaaggcgatcagtaccgggtaacgatgcaaatcgctctacccggacaactcggatcttcgggcagtacaggaggagggggaggtaccagtggtacgaaatcctactatctggagtccaaaataggcccaagctttcgaggagcaagtaccgaggaacagcgcggagtttcgcgaacactcaattactcccatcggcgggtgctgctgttcggcgaggcgctcgcacgagaagggattagcaaaatgatggatgtactggcacgtgttccgcagaaccgtctgtcgtccctggttgttattacgaaggggtcagcgatggaaatgcttcaggcagacgcaccgattgagcaatatccagcggaaatggtgcgtgagctcaatatttcctatatgaaaaaacctcgttccgttaagctgttgatgaattccgtcctgctggaaggcgttgacccggtggtaccagtaatgtctctggtgaagaatgggccccctaaccttaaagaacagaagacgaatattcaggtcgatggactggctgtgtttcgcaaagacaggttaacaggaattattgataaccacctcagtcggtttctgcttttgggtatggagcaggccaaggagacagaaatatttattccccctcccaaaggtagaggttacatatctgtacacctcatcgaaaataaagtccaaattaagccccatatccaaggggatgagattcgaatgaccattcatatgaactgcaatgggaatgtgaaggaaaatgagacgagtttcgatatttccaacgagaaaaatttgaagtggctggagcagcagacagccgaggaaattaagagggagctgggagaggctgttcaggtgattcagcaaaagtatcgttcagacgtacttggtttgggccgggctattattacgagtcaaccggatgaatggaaacggatcaaacctcaatgggaacaactgtatcccaaggtgaaggtcaccataaatccggtcgtgcatattgagaatatcggtgcggtcaccaaaccattcggggtcaaaaaggagcaaatccagaatgaataaagtatttctgttacctttggtgctggttatgctcttcatgtatctgatggaccgtaaaaatattcacaatgcaccagccatcaatcgctgggtctcccgcgtactgtatgttattagcattggtatctggatttacggaacatcaacgaagagcaccgtttatgtggctacatggctgacccgttttattgacttgtggctcccccctacgttgtaaatcgtgtaatggatgcctgcgggcaaaaggaggatgtacctgcatgaaacagttcacaaccagacaaattgtgctgcttggtgtattgatggaggtcggtattacccttatacatgctccggcgcaggcagcggatcacgcgaatcagcatgcttactggacctgtataattgcggctatcgtgctatgcttgccgatctgggcgatgttgaaacttaaacgccggttccctgatcaggatctgatgcaggcgatggtgagctctcaccctgtgctgggccgtgtgctgcttgcaatctaccttattttattcctgatcatctttgcacgggatttgaggattattacggatctggtggaggtggtgcttttgccgctgactccgattgtggtcacttctcttattgtgctgttgactctggtatttatggctaaaggtggaataagcaccatcgtgaatatgaccgagaattttataccgctgttgattgtgacgctgttgactatgcctcttttttttgggcgtaatatggatttttcgatgctgagaccctacttacatccagaagtagagggagtaatcaaggggagttggcgcatgctgggttatatggccgatattatgatagtcccctttgtgatttctgggaagagctataatgggcgtagtgcgtggtttgggcatttgctcggaaccgcttttctgaccatgctggtgctgctatccgagttggttattggtgttcctatcttgtcacggctattttatccatcgtatgaactggtgcgtcaattgcagctaacagactttctggatcggttcgatttgttcgtggcagtactgaccgtaccgacctttcttacgaagattggggttgatctgtacgttaccagtttggcggtaaaacggatgtttgcccaagcctgggggagcctgatggtttggcccgtaggtttgttaggctatgtctgttcgtttatgctgttctccaacattgtgcaaatttatgagttcagccgggagtggaccgcggtaataatcattttttttgtacttatgcccttggtgctatggatgttgctccgacccaaatctaaagaaaaagacgacggtgagcattcatctagtggggagcgggatagtagtagtcagaaagaaagccagcatggaggcagaacagaacacggccgcttataagattactgtattcatcggaaaagtaattcttatttgtcttttacccctctgattgtatacttggtagaaagaaatacgacttctacaagggaggcaacagaatggcacaacgcatggcaggtaagagagtcgctcttgcgggtccccgtaaagcagaagaaatggcgctgctagttgtgaagatggggggtgagccagtacaacgtccggctcagggcacggtttttctggatgatatcgagctgcgcaacgctgttgtatcgtgggtgaagaaccctccggactggtacatcttcacgacaggtatggggctggatgccttgttcgatatggcagaggatatgggcgtggctgagcagattatggagcttctacaatcttccaacattgcagcgcggggctacaagacggtcaatggactcaaaaagcgtggctttacgccagtagtacgagacgaggacggaagtttgatcggattgacaggagctttcgccccatacgatctgaaggggaaagaagtattgttgcaactgcatggcgatccagccccacggttggtaaaatggctggacgagcagggggcagtgacccgccaggtacttccttataagcatatcccacctgaggaagcaaaattgcaggcgttactggaggatgttatccatcgtaatgttgatgctgttacgttcacgagtggtccgcaaatccgatttttagcccaatatgcgagagagcaaaatcgaatcgaggatttactggaagctttccgcgaggatgtgattgctgtatcagtagggaaggtgactgcgcagtccattgtggaagaggggattgaacgagtcgtgtttccaaccgaagagcgcatgggcgcgatgatggtggagcttggcaaatattttgagcataacgattcggtgcatggctgtggtctgaagatcgtgaatggtcattgaaatgagatagaaattataaatatagtatgctaaaaatgaacttatatttttggataaagcgtaaaataaagataagggcctgcgaggtctttatcttttttttattggacatgcatcgacaaagatttttgttatagcgaaaatatttagctaatataatgaataagtttcgatgcatgatacttaggacaggagctgagacgttaatgaattctatttgtgtatttgccgggtccagacctggacattcatcggtatatgttgaagcggcaggcaagctgggagaagccatggctcgccatcatatccgtctgatctacggtggctccagtagggggctgatgggtcaggttgcggatggcatgctggcgggtgacggtcaggtcactggcattatgcccaccctgttatttgatgcagagatcattcatcggggagttaccgaatttattgaagtagcgagcatgcatgagcgtaaagcggcaatgagcgagatggccgatgcgtttatagcccttccgggtggcttgggaacctttgaggagctgttcgaggtattgtgctgggctcaaatcggcattcatcgcaagccgattgggctgctgaatgtgaatggatattttgacccgttagtagaaatggtgcgccatagcgtgcaagaggggtttaccggggctgagcatccagcgttattaagtatctctgcggacccggatgaattgctacatatgttaaaaaataaagcagagaacttgaaataaagcgtttttcgtgcttgcacaactgattgaggcaaggttatgataagacccataatcaaatagcggacagacaaggtgcctttgcggttgagcaaagggtaacagggaatcgggtgcaaatcccgagcggtcccgccactgtaaggaagaggatttttttaaatggtcactcgtgaaaaacggggaagacgaaagaatctgttgatgccaagccaggagacctaccttgatctgtatgcaccgttaaccttcgcggagaggatgggtgtacgaaatcaggaaatcaggcacacgttgctttttccatgttggttagaggtttgcgtggatatgaacgtgcagcagcgtttgaagcgtaaacagacaggtggaaaacaacggcaggctggaggaagacaaatagtgtcttcttacgctgtttgttcgtctgatgagagatacgtacatagaaaccccatccgggcaggatggggttttttgagttacaggatgtccataaatcattgaaatagataggatagctgccctgaaaaggatgaataggaggagcacgatgagcccattaggaaaattgttggtgattggatttggaccaggagatatggaacatatcacaaaacgggcgctggatgcgctggccgaaagtgaggtcattatcggctacaatacctacgttgatttgatccgtccgttgttgaacggacaggagattgtacgcacagggatgacagaggaagtgagccgtgcgcaggaggcggttcgccaagcagagatgggcaagaaggtagctgtcatttccagtggagatgcaggagtctatggtatggcagggctggtgtacgaagtgctgatgcaaaaaggctggcgacgcgaggacggggttgaggtagaagtcgtgccagggatctctgctattcagtcctgtgcttcactgttgggcgcgccagttatgcatgatgcttgcacgatcagtctgagtgatcatctgaccccatgggaaacgattgtgaagcgcgtagaagcagcggcttctgccgattttgtgattgcattatataatccgcgcagtggccgacgtacccgccagattgtggagacgcagtccattttgctgcgttaccgcgatccgcaaactccagttgggttggtgaaaagtgcttatcgtgaacgtcagcaagttattgtcacgacgctggaagatatgctgaatcatgacatcgggatgctgacaactgtaatcatcggtaattcctcgacaacggtgtatgacggcttgatcgtgactccgcgcggatatcagcgcaaatacacgctggatgcgaccgagcaagcgctcaagccgcatcagcgtctccgtacggaagcggagccgtggtcgctgggcgcgcaagaggccgcaccgcaggcaggcgcagccccgactacgctcgctggtccctccgcgagcggcgctgcgattgcgacgcaggcacgcccgcaagcgatggctgccgtgcaggcaacgaccgctgtgcaaaccggcgcagcaaccccggcatcgctggcggcagaggcactaagccgcctcgctgttggcggcaagctgcctgacgcagccaacgctcgctggagcgggcaagcgcctaccgccgagagcaccgcaagaacgtcagcggtggccggagcgggggctacggccgggatggcgacaggcggctttggcaagcctgcgctgtttgaggtgggcgtttccccgggtgtgggaaacaagaagttcaccgctcgccagatggcaatgctcgccgaggtagcgggtgatgacggcgagctggagtacacgccggatcatcagatcgtgctgcgtgtgccgtgcgcagaccccgaggaactggtcggacgactgcgggatgaacgattcattgtcatgccgatcggcgatgtgtttaaggtgaaggcgtgcgacttctgcaatatggagaaggatgacgctgtgcctgtggctgaacatctacaggttgtacttggcggattacaggcacccaaggaaacgagcattgctttgaacggatgcggtatggcctgctatggagcggtgctggaggatattggcatcgtctatcgcaagggaggatacgacctcttccttggtggcaaaaaattcgggcgcaatgctcatgccgctcagcccgtagcggaagggattccgggtgatcaaattactgacattgtggagaacgtcatcgctgaatataaggaaaaagggcatccgaatgagcgttttcataaattttttaaacgtgtaggtgtcgttgcgggtttccggcatgaagatgcaccagcaacggtagaagtgaatgcggtttgtggtgattaatggactgaaggcctgatgaactggatacaagcatatatataaaatagggcgtcatgcaggctatccctattaaagaggaggaaaaaacagcagtggatgcaatattgttagttggacatggaagtcgggacccggaggggaaccaggaactgctggaatttgcacaggcagtggcagaccgggtaccggatatgtgcgtggaaacctgtttcttggagttgacacgtcccagcattgctgatgggatgcaaacatgtgtggagaaaggtgcgacgcgtgtcgttctcattccgattatcttgttcgcagcggtacatgccaaaattgatattccgatggctattgatcgggcaaaagcaaaatatccacaggtggaatttgtatatggacgcccgattggcgttcacgagaaaatcgtcagcattctgcaaagccgcttgaaagaggcccgtccggttgcagttccagcgggaatgaatagcgctgtagaggcattttccgaggtatccgacgaagaaacggcggtacttgtgttaggacgcggaagtagcgatccagatgcgaacagtgactttttcaaaatcacccgtatgctatgggaacagctttcttatacgtgggtagagagcagctttatcggtgtgacgcagccttcttttcccgatggattggagcgttgtgtacgactgggggccaaaaagattatcgtgcttccctattttctgttcacgggtgtgctgattaagcgcatcggagaaatgacccaggaatttgccgaggctcaccctacattacaagtggaaatgggaggatattttggtttccatcctcaactgattgaactggtactggagcgagctaaggaaggcttgttcggcaaggttacggccaattgtgataactgccagttccgtctggaggcacaggagcaccaccatcatcaccacgaccatgatcatgaccaccatcacgatcatgagcatcatcaccatcaccatcacgatcatcatgcacatgagcacgatcatcatgatcaccatacacacagccacgaccacactcaggagcatgtccatgctcacagccatgatgaccatgatcaccatcacgagcattcacatacgccatctgtagtgaatggaagcgggcaggtgaagggctcatgatattcatgctatgtggaacgagcgatgctcgggaattggcgctgcaaatccgtgacaatggcttcaacgtattgacctcggtcgtaactgaaagcgcggcagccagcttgtccgaagcagggctggacgtacgtacaggacgaatgacagccgatgaaatgagtgcaatgattcgggagcagggaatacaggcggttgttgatgccagtcatccttttgcagaagaagcacatgcgaatgcgatgacagccgctcgcgaatccggagttccttatattcgctacgagcgggcgggactggtgtatgacaatcatccattgctccacatcgtgtcttcctatgaagaggccgcattagaagcgaagcaactcaaaggctctgtcatgcttacgacaggcagtaagacgctcggcacgttcaccaagcatttactcggagacccggagattcgtctggttgcacgcatgctgccgcgcttggacaatatggagaaatgcggcgaactgggcatggagcaaaagaatattattgccatgcagggacccttttcccgcgagatgaacgaagcattgtacaaacactatggcacgaccgtgatggtcaccaaggaaagcggacgcacgggagcagtggatgaaaaggttcaatctgcattggagctggggattcacgtacttttgatttccaggccggaagtggaatttggcacagtatttgatcatttcgacggagtcatcgacgcactgcgcatagcaaaagagaaaacttcaatttgagttgagccttacccctgcgagtccagtccatcaggaacgacttctggcatgtatttaaaatatagtcatcttaaaacaggtgtttttaaaaggtatctatgattttgtagcaatgaattgtcattttcctaaactattttctaattttccataagggagtggtcgatacgatggattttaaaacagatttcaaaccgctaacggtacagccgcaggaaattgagggtaaaagcttcgagatgatcacagaagaattgggagagcatccttttacagcagagcaatatcccgttgtacagcgtgtcattcatgcatctgctgattttgagctgggccgcagcatggtgtttcatccaaaggcgattgaagctgggattgcagctattcgtgcaggacagcaggtagtggcggatgtgcagatgattcaagcggggctgagcaaggatcgtatccgtcaatttggcggggatgtgcatgtgtacatatctgaccctgacgtcatggaagaagcgaaaagactgaatacgacacgcgccattatttcgatgcgcaaagcgattcaggcgggcgaaggtggcatttatgccattggtaatgcgccgacagcgttgctggagttgatccgtctggtaaaagaaggagcggctaaacccggactggtgattggcatgcccgtcggtttcgtatcggcagcagaatccaaggacgagctgcgcaagctggatattccgttcattacgaatattggacgcaagggcggcagtacaattgtcgtagcagcattgaatgcgatctccttaatggctgtccgctagatgcggttgtccgtttgctgtatcatgaaatgaattagaacatgatcagcagaagaggttaaggaggaattggcatggaaaaggaagcggcgtccgccaacaggcccaaacggatgaaaagcggtgaagctcccgcgccggacaagccgatgcggtcaggctttacaacgggggcttgtgcggctgcagtagccaaaggagcggtacaactgctcatcacgggcattccaccgaaggaagcagtgatatcgctgcccgcgggcttcgatcatgcgtttgagctgatcgagcctgtgttggatgcggacgaagcttcctgcacgacgatcaaggacggtggcgatgacccggatgctacgcatcaggcgaaaattatcgcgtccgttagctggcgcgaggagccgggtattgagctggatggcggcatcggcgtagggcgggtaacgaagcccggtctgcctgtgcctgtcggggaagcagcgattaatccggtgccgcgacggatgattacggaggctgtgacaggcgtgcttgaagaacacggatcggccaaaggtgtccgtgtcgtcatcagcgtaccggacggcgaagaaatcgccaagaaaacgctgaacgggcgacttggcattctaggcggtatttccatactaggcacgcgtggtgtggtcgttccgttttccacgtcagcttataaagccagcgtcgtgcaggccatatcggttgcacaagcgatgaactgccaggaaatagtcctgactacaggcggcagcagtgaaaaatatgccatgcaaatgtacgatcagctgacggaagaggcctttattcagatgggggattttgtcggctttgccattaagcatgggaaacggctgggaatgaaaaagattattctcgtcggtatgcctggcaagctgtcaaaggtagctcaaggtgtcatgatggtacactccaagagcgctccggtggattttggatttttggcccaggttgcgcgtgaggcaggtgtggacgagtcgcttgcaacggcagtggcagaggcgaatacagctacgcaggtggcggatatgatgaccgaagcgaatgcgcttagcttttttgaaaagctgtgtacctatggatgtcagcattgtctggaccatgcaggtggtggaattgtcgtggaaatggtactggtaacgatgaaagggaacgtgctggggagggcgagagtcggtgagtagagtgattcgtgtcattggtatcggtgaaaatggagcggcaggtctgtcgcaggagacgctggagcacattgagcgtgccgacctgctggttggtggagaacgccagctagcctttttcaaggcattcgctggggaaaaacgaacattaaagagcggcttatctgccgtggtagaagaattgggacggttgcgcaaggacaaggatattgtcgtgcttgcgtcaggcgatccgcttttttttggaattgcaggttatttgtctgccaagctggggtcgaaacatctggatattttgccgcatctcagctcggttcagcttgcgtttgcgcgtctcggtgaaagctggcaggatgcggtgctggaaagcgtacatggccgtccgatgactggattggcgcagcggatcgatggacagaacaaggtcgcgctgctgacggacgaccgcaatcatcccgccgcagtcgctgcctatctgctgcattatggcatgacggaatatgatgcctttgtcggcgagcatttgggcggaccggatgaggcgtatcagcattatacattggatgagatggcgcagagaacgttccaaccactgaatgtggttattctgcgccgccgtaagggtggagacgtgcctgcaattcgtcggggatttggcttcgaggatgcggaatttcaccagcgtaagccggaaaagggactgatcacgaagcgtgaagtacgcgtattcagcttgtccgagctgcgtctgaccgaacgaagcatcgtatgggatatcggcgcaggttccggctctgtagcggtggaatgtgcgcggctggccaagtatgggcaagtatttgccattgagaagaacgaaggcgatcttgctaatgtcgaagcgaacaaaatcaaattccgtaccgatttcccggttattcatgccaaagcgcctgccggactggaagatctgccagacccggatgcggtgtttatcggtgggagcgggggagaattggccgaactgattcgtctgtgtgcttcccgtctgcggaaggatggacgaattgtagtgaatgctgcaacgattgagacgctgcatgacggtatgaaggcgatgcaagcagcaggtctcgatacttcggtgacgttattgcaaacagcgcgcagcaagccgattttgaatatgactcgttttgacggactcaatccgatatatgtcattacaggacagccgtcggtggacgtggctgacgaagtagcaggggagtaagctggtaattcaagagggggagagagacagcatgaatacggcggcaacaggaacactttacggcgtaggcgtggggccgggtgatcccgagctgattacagtcaaggcgtatcgcatgattcaggaatgtgcagttgtggcttatccgaagaaacgccggggaggtaagtcgtatgctcacgaaatcgtggaattgtacgtcaacccggaggaaaaggagatgctgggactcatttttccaatgaccaaggacccggttgtactggagcgggagtggaacaaaacggtggttgcttgctgggaggcactgagccaaggcaaggatgtagcctttgtcacagagggagaccctaatctgtacagtacctttattcatttggcacggctcatgaaggatctccatcctgaggtgccgattgtatctattccgggcatttcgtctgtgttgggagcggcggcagcgctggaattgcctttggcagacggagatcagcaggtcggtattattccggctacggatgatcgggaagcgatgaagcaggcgattgagaatcacgatacggtcgtgtttatcaaggttgccaaggtactggatttgattttggatgtgctggatgaactccatcttggggaccgtgcatcagtcattaccaaggtcacttccccttatgaaatggtatggcgcgacgcacgtgagctgcgcggacaggagcttgaatatttgagtttaatggtggtgagcaaatgacgttggagcccaaagtatatatcgtaggagcaggtcccggcgacccggagctgattactgtcaaaggctcccggattctacgcacggccgatgtggtattgtacacggattcactcgtgaacgacgagctgattgccacggccaagccagaggcgcaggtactgcaaagctcaggcatggatttggagcggcaggtcgagattatgagcgaggctgtgcaggctggacgcagtgtagctcgcgtacatacaggtgatccggcagtgtacggagccattttggagcaaatggtgttgctgaagcagcgcggagtagcatacgaaatcgtaccaggcgtcagctcggtttttgcttctgcggccgtgctgggtgcagagctaactgtgcctgacctaacgcagacggtcattctgacgcgtgccgaaggccgtacacctgtaccggatcgggaaaagctgcgggacttggcgtctcatcactgtacagtggcactgttcctcagcgcaacgctggcaaagaaggtggtcgttgagtttctggcagcaggctggagtgaggacacgcctgtagcggttgtgcagcgcgcgacctggccggatcaaaagatcgtacgcacgacgcttgctcaattacccgccgatttgcgtgcagcaggcataacgatgcatgccatgattttggcaggctgggcgctagacccggagctggtggacaaggacgcgcatcgttccaagctgtacgacaagtcattcacccatggctaccggaagggagtgaagcccggtgagtaatccatttgccgctgtggcaatcacgaagcatggagtggaaatggtgcgcaatttgggagccagctttccgggcacggatgtgtattacatgtccaagtttgagcgtggcgacgagcaggcgcttggcattcagttgttcgaaggctcggtcaagctgattttgccggatttatttaaacaatataacggtattattttgtttatatctctcggtgcagtggttcgtatgattgcaccaattttggtggataaaaaggtagacccagcggtagttgtcattgatgatcgtggcgagcatgtcattagcgtattgtctggccatttgggtggcgccaatgaattgacccgccatgtagcggctgtactgggcgcacgtgctgtaatcacgactgcatcggacgtgcagggcacgatcccggtggacatgtttggtcgggaattgggttgggtggtcgatagcttcgacaaggccactcctgtgagcgccgctgttgtgaacgaggagcctgttgcgctcatacaagagacaggcgaacggaactggtggcgttatgacaagcctgtacctggacatatcaaggtatatgcttcgacggcagaagcattgcaagaaccgtttaacgccgcattggtcgtgagtgaccgtttattggagccggaggaagaggagcagcttctttctaatggcgtgctgtaccgtccgaaaagcttggtgctcggcatcggctgcaaccgtggaactgcattagaggaactggaggcgggtgtgctggacaccttgcaagagctgcgtttgtctgtgaaaagcgtacggaatattgccaccattgatctgaaaaaggacgaagagggcttacttgccctttgcgccaaatacggttgggaactggtgacgtatactccgtcagagctgaataaggtgcagcttcccaatccatcggaaaccgtcttcaaatacactggcgcatatggggtaagtgaaccttcagccttgttgtcttctggtgcagaccattggctgctggagaagaaaaaaagcggcaatatgacgctgtctgtagcgcgggtttcctatgactgacatcatgaagcaggctgtacagtctgatccgtctgccgctacgcgcagaagccgtattgttgttgccggaacaggcagcggcgcaggcaaaacgactgttaccctcgggctgatgaaggcgttcgccgacagcggcctgcgagtgcaagggtttaagtgcgggccggattatatcgatccgacctatcatactgccgcgaccgggacttcttcccgtaatctggattcatggatgacctcaccggatacggtgcgtgaaacctttatccatgcttccgaaggcgcggatatttccgtgattgaaggcgtcatggggctgtatgacggcaaggacccgctcagcaacaccggctcgaccgctgagatcgccatgctgacggacagccctgtattgctggtggtcgacgtgcgcagtatggcacgaagcgccgccgctattgtgctcggctttcagcgcttggagcccaagctgcgcattgtgggcgtaatggtgaatcgctgcggtagccaagggcactatggcatcgtcaaaaaggcgattgagcaggagtgcggcatccccgtgctcggctggttaaagcgtgatgacaggctggatattcctgagcgtcatctgggtttagtacccgctgtggaacgcggcgagctggagccgcttttccaacgggcggcagagctgatccgcgcgggtacggatctggatgcactgcgggcattggcggattcggctccaccgttgtctctgcccgcacaaccgttgtttcccccggattggcttccatcagcagggcatgaagctgataccggggaacgtcccgtcatcgccgtcgccagagatgcggcgttcaatttttactacccggagaatatggatttgctacgtcaggcgggagcagagattgtctatttcagtccgctggcgggagaacgcgtacctgagcaggcaagcggcctatacctgggcggcggtttccccgaagagtttgccgcagatatcgctgcaaatacgggctttttggaagatatccgcaacgcggtaagccgggatatgccagtattcgcggaatgcggcggttatatggtactggcacggacacttacggatcgtatggggaatgcctatcacatggccggggttattccgtcggacgtccgcatgcaggagaaacgggctgcactgggataccgggaagcaaccgctttgcaggattgcttgctgctggaggctggagagaccattcggggacatgaatttcattattctgtcatgcactatgatgaatcatccgccccctactcctacgcctatcaaaccaaggggatgcgtggtctccagagcgagggttatgcgaaagggaaccttttggcagcctacacgcatgttcatcttgcatctcttcccaaggcggcagcacgctgggtggaacaatgccgggcttacggtcaataggtttgcagacgagtccactacttcatataaacgaaaaaagccgagtcccctaaagggtccggcttttctaaatttcaatagatttaaaccttacatagtatggaagcgtatacattacttttttggtgactcgcttacatgagctttttcagctgggaaatccttccctggctcacgccaagcatggaggcaagttgcttttgtgaagatgctggatgttcttccataagctctctcattttttccaaaataacgtctgtgcgctgataaatttttttcatatgcatattttgcttaagtgggggtgaatgggtttcagtcgctgtgaccggaactaaatcttccgttttcatcgaggctgcacattcatcgcagataaactgatctttaaagtaggtgttggtatcaaccgcaccgcaaaatatacagttggttgatttgtacttacggagcatgagtgtctggtcttcaataaaaaactctaatggatcgccgatgtcaatctccatcgtcatgcgcaactctttaggaagcacaattcgccccaagctgtccaagggccgggtcattccagtccttttcattcatgcaacctccccggttttttaagatttatagaatgtataaggtttgaggcaattcttatcaattctataaccgcaagcataaattcttacaaaaagcggcccttcattgttaatcaagcatggacgcactttttttcttacgagtataccataaacaggccgaatcgccatcgttcagatttataaattttgaataagttttaataagtttattgcgagcgaacatatatgctataatcgtctgctaaaggatttaataggtcgtctgtagaattatttatatatgccgtagctcggacaatgatggcggtgttatgggaaatggataagggccaaacggaattttctgagcgttttgaccccacaaacaagaataaatgacacgggccccgcctttaaagtccttatatacaagtcaggcaaggaggatttatcatggaaaaaagaaaagcattgttgttaggagattattcgtatccggagtttcacccgctgcaaggggtggacgaagagattagccatattttacaggattggatgacggtacagtgcagtgagaatcgtaaaatgctgctcaaggaaaatctaacctcatttgatctatgtatctcgtactgcgatagccgcaaggaggttctgtcacctcaacaaacagcaggattgctgtcttatgttagcggcgggggtggattgcttgtgctgcataacggaatcacattgcaaggacggtatgaaattgcacagttaatgggtgcacgtttcttgcgacacccggctgcgggtccactttccttcaaagtaacggagccggatcatccgattatggaaggaatcgagccgttcgaaatgcaagaggagccgtatcgttttgattttgatccattcactgaaaaaacactactgatggaatatgaacacgaaggccagtggtggccggctgcatggtcactgtcctatggcttgggtcgggtcgtctatttgatgcctggacataatcagccaagcttccagcacgagggataccgcaagctgctgcttcaggctgccaagtgggctggacgctttccgggttaaacatagatcattccattcattgaggaaggggagctgcgaactttatgcggctccccttttcaggttatactataggtaatcacaggtaggggaggatatattatgagcgatttgttcaaaaaagccatctcattggggtggggcctcaccgttgtcagcaaagaaaaggtggagaaagccgtcgaggatcttgtaaaccggggagaacttgcgccctcggaatccaaagcgctggtcgatcgtctgatcgaacgaggggcagaggaacagggacaattcaaaacagtgatccgcgaacaggttagccgcattttgcaggagctggaagtacctaccgaaaatgatgttacaagtttggagcagcgtgtggcattgttggaaaaacaggtagcggagctggaaaaagaaaaggcggcgcttacgggttcgagcgacgctgaagaagcgaaccggctggattaaaatggcggttcgtatgaagcacgccggtcgttaccgggaaattgccatggcgctggcgcgtcatggctttggctatatggtggaagaaatgggactgttccagctgctgtcattgcctcgcaagtggctgacgagagaaactcccgagtccaaaacgctaggtgaacggattcgacttgtgctggaggatctggggcctgcattcatcaagcttggacagttggcaagcacacgtgctgacctgctgccggagcctattatccgtgagctggttaagcttcaggatcaggtaccgccgttttcatctgaaacggcgcgtggcattctggagcaagagctggacacgtcattagaggacatactggttcgttttgacgatgttccgctggccgctgcttcgatcgggcaagtgcatctgggcaagctgcacagcggcgaaatggtcgccattaaaatccagcgtcctggcgttaatcgcatcattcggcgagatttggacattttgcgggaattgaccgctatggcagccaagcgctgggagtgggtagagcggtatcagcttcgccagatggtagaggagctggggagatcgctcattcaggagctggattacaaccatgaagcccgtaacacagagaagattgcgctccaatttgagcaggacccacatatctatattccgaaaatatactgggatcatacctcttcccgtatactgactatggagtttctagacggaactcacttgggtagtcgtgaagagctattacgccgtggatataacttgaaagaactggcgcagcggctggtgaacagcatgctgcatcaaatttttatagagggattttttcatgccgatccccatccggggaatttactcgttttgaaaaatggcagtcttgcttatttggactttggcatgacgggaaggttgagcgaagagatgaagaatcatctcgcttccctcattattgccctgatgcgcaaaaataccgatgccatggttcggtctatcgaacgtttgggtctggtcgaaccggacaccgacctgaatgcgctgcgtgccgatctggacaagatacgcgaagattactcagacgttcctttctcacaggtcagtattggtgatgctttgaacgacctatttggcgcagcgcagcgccatcggattggtttgccgtcggacgtcctgttgctaggcaaggcgttgctgacactggagggggtcgtggagcacctggaccccgatctcagtattattgctttggctgagccctttggtaacaagctgttgaaggaacgcttcagcggtcgtcgtatccgaggcaagctgctgggtggtgcgactgagctggtggagacgctgatggaactaccaggacatgcgaggcatttggcctcgattatcagcaagggcaagcttaagctggaggttactgtgccggagctggaaatgcttctgcgcaggctggatcagatcagtaaccgcctgtcattcagtatcgtgctgttagcgttcagcattattatggtcggattgattatcggttcatcgctgaatcatcaggcgaccatgctatggaatgtacctgccattgaaatcggctttgttgttgctctcttaatggttgcctttttactatattccatttttaaatcgggaagattctagatactgaccagaaaggaaaacttatggatacacataagatgaataatctccaaattgcagatgtgccatggcaccgcctgactactccttatggtaggggcacgaagttgccacaattgatatccaacggggagtacgcagccattgctgatctgatagagcatcaaggcacattgtggcaggttacgccatgggtgttacttttcttattgcgtaatatgcatatgagaaattcggatgatatcacgcggagtgagttggaactgtaccatgcggttgttggaacattggacatggaaaacgcacaagaggattcacagaagtctgtagaatccctaaccatgctgctggacgaaaaatatctatggccggcagacagcgatccagaagaagatgaactggagtgggaagaggaagaagcacgcggttatgatccggtagctttttggagttattatgactatagttatcgattattgaagcaagcactgcctgactttgaaagcttactccagcagcatgcggactctgagattgctgaatccctatcggagcttgtacagaaattgcgaaaattttaaacataagaaaacgaatcaaatgagctatgacaggaaactaatcttttgctaaggagtgattttagtggcaaaaaaattaactgatctacatcgaatacgtctcttaaatctccttcgtgatattgggtttgaaccatcaaaagttactatagaaaataaacagggggaaactgaggttattgatttagagtccccgttaccgaaagggttgcaagctgttttaaattcccgaggcagcctaagtaaggagcaattacttgagatcgaagagagtgttaaacaatccagagaggattgggattagatggggtatttatttgatacgaatgcagctattgcccttcatagacttgactcatctttggatagagtaatacgacaagctgagaaagacaaagagaatattttcttttctgttataactcagtccgagtttatagccgggttgcccactgatactgccttagattcaataccttttcttggcggggaatttattgcagttaattcagatatcgcagttaaagcggggcgtatcagaagagaacaaaaagataagtttgcaagaaagctcaagactccagatgcattgattcttgcgacagctattataaaccaattggtactggttacggcggatcaagatctacagttcgcggagtctgagtatgaagttaaggtgataaactttagcaggttagaatcttagaaattgcgaaaattttaattataagaaaacgaaataagatgaagataatgatcgatatttcaaggaaatagatgatttctttctgtaaacagccttttaactcattcgtctctgcgaatcccttacgttataatgatggactgaatgtaacggaccgggttcgtttgagagagacgagctgaatgataggagagccttggcgattggtcgctggacggagacccgaaacacacggggtgcgagtcaacacgctactctccgtaaatataggaggctggaacgagacagtatgaatcttagacaacaatggttcggtaatatccgggccgatatacttgcgggcatgaccgtggcgctagcactaattcccgaggcgattgccttctcgatcattgcgggggtcaatcccatggtcggactgtacgcctccatatcgatggcaattgtcatctcttttgcaggtggacgtccggcgatgatctcggcagcgaccggggccgtagctgtactggtcgttggcctagtgaaggatcatggcgtggagtatctgtttgcagctaccattttggcaggaatcattcaagtgctgctgggtgttttgaaaataggtcgctttatcagctttatttcgcagccggttatgaccggatttgtgaatgcgctggcgatccttgtctttatggcgcaactcacccactttcatggagctaattggatcatgtacgcgatggtagcggggacgctgctcattgtgtatattttaccgagatttgtgaaaagcattcctgctccattgacggcaatcatcatcatgacgatcattacgtatgtatttggattgaatgtgaaaacggtaggagatatcggtacgctaaccagctcgctgccttcattccatttgccgcaaattgagtggtcgtggcatactttgcggattttgttgccgtattcctttacgatggcactggttggactgctggaatcgctgctgacagccagtattttggatgaaatgaccgaaacgaagagcaataaaaaccgggaagcccgcgggcaagggattgccaactttgtaaatggcttttttggtggtatgggtggttgtgccatgatcggacaatccgtcattaatgtcagctcaggtggaagagggcgtttgtccacttttacggctggggtattcctggcctttctgctgctcgtgcttggcggggttgtaaaggaagtgccaatgggtgcattggtaggagtcatgtttatggtgtgtatcggaaccgtagactggaaatcgctccgaaacattgctaaggtacccaaggcggatacttttattatggtggtcacggtgatcattgtggtggctacgcatgatttgtccaagggcgtgatcgtaggcgtactgctgagtgctctgcattttggctggaaaatggctaaaattcgcatcagcgcaacggagaacaacgacgaaaaggtgtaccatgtcaggggtccgatgttttttgcttcaacgactcattttgtcgatcatttcgaaccttcggatgatccagaacgtgtcgtggtggacttcagtcattctcatatttgggatcactccgcagttactgccatcggcaaggtgttgcaaaagtatacgaaatccggaaaatccatcaccctgcggggattaaatgaggagagccgtttaattgtagagaagctcggcggccctcttgttaccgagccgctcgtatgatgaatcgtatagcataaatcaaagcttgaaatgaaatttattcatttcaagctttttttatttatttctgaaataaaacaacacttttcttcctgaatcatagataaatatgacaaattttcatcaaagtattgacgtaataattgggcaggaatacaatcattgttattaagcagagcaagtacataggaataattgaaaatcgaaaggtatacacatatgaacttagactgggagtttattgtagagagcttgccgttatatggagaagctatgtggttgacgttgaagatcgccttttttgctattctattttcattagtcgtcggtttgctgtgcagcacagtactatattacaaggtaaggggagttagcggcatcgttgttgcctatattgagctttcccgaaatacgccgctgcttgtacagttatattttttgtattacgggtttacgaaaataggtctgcatatgagcgaaatgacgtgtgccattgtgggcatgacctttttgggcgggggttatatggctgaggcgttccgtgggggaatggaagcagtgagtaaaacccagacggaatccgggctgagtctcggactgtccaagatacaactggcgagatatgttattttgccacaggcttttgccatcagtgttccgtctctgggagcgaatgcgatttttttgctcaaggagacttccattgttggcgccattgctttattagatctgatgaatgtggcaaaagacctgatcggcatgtactacaaaacgacagaatcgctaattctgctggtattggcatatctcgttctgcttttacctttgtcgatactgctgacgtgggtggaaaggaaggtgagatatgctgaattcggggattaatgtactttttgaaggttccaatttcgagcgtctattagggggattactcgttacgctggagattgcgctactttccattattatcggtactctattaggcattttgatggggttgctgcgcaccttaaaatcaagaccgattcggtttgtgctgaaattatatttggagacattccgcattattccaattctggtgtggttgtatgttgtatattttggatttactcctttgttgaatgtgaatatcagcggggaattgacagcaattatcgtattcagcctgtggggagcggccgagattggtgacatcgttcgtggtgcattggaatcactgcccaagcatcaggtggaatccgggcaagcattgggactgacatatggacagttataccgctatgtgctcattccccaggcggtgcgccgaatgcttcccggttctattaatctggcgacacggatgatcaaaactacttcattagtggtgctgatcggtgtagtggaagtggtcaaggtcgggcagcagattattgagcttggtgtaatcaaggcgccctcggcatccttctgggtgtacggctttattttcatattgtattttctcgtatgctatccgttatccagactttccaaaagatttgaacgcagatggcaaaattagcaggatggggtggatgtcatgggagaggctgtggaggttttactcgaaattcgagggctgcacaaaagcttcgaagaccgaaaagtactgcaacagattaatctggacgtaacgaaaggggaagtcgtggtcgttctcggtccttcgggatgtggaaaaagcacgctcctccgatgtctcaatggtctggagccggtccagagtggagatatccgttatagagggcaggacctgacggataagaaagtgaattggcgtgaggtgcggcagcatatcggaatggtgttccagaactacgagctgtttccacatatgacggtcttagaaaatatattactcggcccgcttaaagttcagcggagaaacaagcaggaggcacttgagcaagcggagcagctattggagcgagtgggtctgctggatcgcaaagatgcgtattcgagacaattatcaggcgggcaaaagcaacggattgcgattgtgcgcgccctgtgtatgaacccggaaattatgctctttgatgaagtcaccgcatccttggacccggagatggtcagagaggtgctggatgtcatgcgagagctggcacagcagggcatgaccatgattatcgtgacgcatgaaatgggatttgccaagtcggtaggagatcgtatcgtttttatggatcaaggacagatatgcgaaatgactacgccacagcaattttttacccaaccggaaacagagcgtgcccagcactttctggatatatttcagtacgaaacgatataaacagggggatgaatacagatgagaaaaggaatgaagttcacgacgttattactggctttgagcttgctgattgttggtttggccggatgtgcaggaggcggaaataccaacggtagttcaggctcggctaaatttgcttcgattgaggatattaaaaagaatggcaagattcgaataggtgtatttgcagataagccgccttttggctacgtggattcggaagggaagaatcaaggctttgatgtgtatattgcgaaacggtttgccaaagatctcttgggcgacgagtccaaggtggaattcgttctggtggatgccgccagccgggttgcctatttggaatccaacaaggtagatatcatcatggctaactttacggtgacggaagagcgtaaggaaaaagtcgattttgccaacccgtatatgaaattatcctttggcattgtgtcgcctgatagcgctccaatcaccacgattgaccaattgaagaattcggatcagaagctgattgtcgcaaagggaacaacggctgaaacctatttcacgaaaaattaccctgacatcaagttgcttaaattcgatcaatatacagaaatcttctcagccctcaaagacaaacgcggcgccgccattgccaacgataatacagagttgatcgcctgggcaaaggccaaccctggctttaccgtaaccatcccggcctttggtggtcaagatacgattgcacccgcagtagcaaagggaaataaggagttattagactggatcaacaatgagctggctacattaggcaaggaaaactttgtgcatcaagcctacaaggacacactgacctctgtttacggagaaggctttacagatcaactggtcgtagagggcggaaaagtggattaatctggggtgagtaaaagagtgtttgacacgtttatatgatcattttggaatgtaattaagttctgagtgctgtaaatctatatatttgcataatggattcctttaaagcaaaaagacccgaatttctaaaaaaatgggtctttttgctttgtataggattattgaaaataatgccacactctacgcagaattaatattcatggacctcatcttcaggtatgtactcgagaacatcgtgcagggttaacgggcgaccagaaaggcgaattaacgtttccatcactgtattaaacgttttaaactcgatccgcttggatgtattgttacacatttcgtagatagtatttggtctgattttagcctcacgagcgagggcatttttagtaatcccgatttctcgaagcaattcttcaagtttgaaagcaattccctgtgcgtttgacattttcatgttgaacagaacccccatgttctaacgaattacaaaaataattgaggtcatgccttggtagtctcaatgtccctcaattccatcttcgggaatgtactctacaatatcagcaagagtaatagtccttgtaaatctacgctggcgggcgaatctattcaaagcatcaaggatatggacaagtgtttctaattcaagtcttttggttttgccatttaccatatctattacagttgccggacgtatttttgcttctacggccagtttatttcgggaaatatcaagttcttctaaaatatcgccaagtttaaaatgatatctattttgaatctccataatttagattctccttttgtttcatagtacaagaaaatcataaaatctattgaagttttactatagaagtaataaaatagaactacaggagtaaaacttgtggtttgaattccgctttttcgagtgaatagttgttagttttcttgctttgaataattaaaatcataagagggagctaaatctaaatgaacaaaggcaattttgaaaaagtaagtgtcattcttggtccctgtgatcttccgcatatgtatgagctttttgaaggctatctgatcaaggaccgttacgtcatgatgatcgacaatagcgtgcttactcttcgacatgtaaaaaaggaaaggcattattcgcatctatatgttgatggtgacacgggaggaatcactcttgcaagacatgtacaacgtgaagacatagatgtgattactgagttggtcgaacgattgcgcaacatggatgcattaagttttcttacagatgaactgttatggaacacatgtcgggaagatatagactttgacttagttcggaataaaggactatgaaaaatggcgaacgtaaattctgattcgaatttttgttctcgttttacttatataatgtaacacagaagcctaaaagggtgaaatggacactgccgtaataaagatacatacttcccccaaagctcttgcatgctagtagatttcattatataatcttaaatgataatgagaatcataatcattaataacagtctttaggtgcatgctcccaatatgagcctaagtgaataggatggtgatgtacacatggctaaagcagatgtggcaactgccagaagacagcttcggagtccgaacaaggtaactcgcagacgagctttgagaacgatcaaagctgcgaaacgcgcgaagtagcaggttccaagttaactgcaaatggcaataccagtgtcaaatttttcagtctcctcgttttgatattgcacctgccttcctgatggtggtacacaggaaagtaggtgcctttttttgaataataaaaaagagccaggcgggtatcgaaccgttctggcgctttattttggagatataaaaaaccaaactcaaaatgaacataaaaatggagtagacggaatagtgctgtacaagcgaagcgatcgctttaaaagctttccgtaggaaagcgcgcttcggaagcatcacctccccggattactactctataaaaggctttgttcaagaaatccgggggcggtggcgatgggaagcactatccgactgcgtagtggcacaatatgaaacttttaagttcggttttaatataaaaactacatttatttcttttgtgcaaacagccattcaatcatatcctgattttgcagagccggaacccaggagaagtgtcccgtaggtttgataatccctgcttcgtattcagtgaagtgaatgaggtttccgttttgtactttaatggcagcgaccatttcttgcgagtttttaggacttactgtggtatcgtctgcagcatggaaggcccaaataggaacgtttttcaatgcctcgacgtgtgtaggttcaacaggcgcatacatgttaacggctttttcatagttggtcaaaccggcaatcggcacacctgcggcgaacaagtccagatttttttccaacaatctccacgttcccatggctccttgagaaataccaacaatatagattcggttggtatcgatcgggtattttaacgccgtatcacgtaccaaatcggctacagcgctgttgcgtggctcatccgcccaaatgaatttatgctccaggtcaatcgggctttgtggagcgatgacgaaggatgggtgtttggcttgctgctcaggagaagcccaagtgacagcaccagcattcgctaacaggttgactccgtttccatcaccgcgttcgccgtttccgtgcaggaatacaaccaacgggtaggttttgtcaggctctaccttaggctcaaacgtaaagtagttcagcttgaagccttctttattttcaaaggtgtttttttggaaatcgtccacgattggtgtaattttatccgttgcttttacagtctgtgtagaggctgggatgactgttttctttgaagttgcaatatctttcttttgactaatcgtataattcaacgtgttgatgcggttaactgcgcttgttgcatcgtaagtaagggtacttgcatttttatcttgcgtatccagctcaatcacgacatatttgccatgagtactgcggttggtgatggctccagtatcattggtatatacatcggttacggttctgtctgtatatacatcattgagtacagattgaacctgaaagctggacgtagataaggatgccccgtcaatattggtgctgtatttcagtacgacagcagaaacgacttcacccaaaggctgtacctgagtaagcagggtagcctgtggcgctgggacatcggctgctacggcagagctggcggatgggaaaaagatcgttagcatgaacacgaaagataataaaacaagggcaaaacgtcttctttgcatgagattaatctcctttggtgtcattttttaaagcgcttactacatgttcgggatggttgactgtatgctgtggaattcatacaaatcaaaaaaaggcaaactccgggtacacgtgtgcactcgggttttgccttttcagtaacaatcccacttgaaggatagcaccttcattggaatctgacaagtgaaagcgctacatttttgggtgtttttttaaaaaaagttttactttcgttacggatgattctacaaaaatccttaaagcagcttgcaattagaagtggatatgtcgaactcatggtattcatctatagcgggcaaccaagataccgggcttttcaacggtaatattgtggtatataatctccttaacttaacagtgttaacttatataacgatgttaacaaaaggggatgaaatcatgaaccaatacgatgttattgtcatcggtgcaggactgggtggcttgtcctgtgcagcaagactttccgcgctcggttaccgaacagctgtttttgaaagccatactttagctggcggtttcgcaactgaatttacaagaaagggatatacctttgatgtctccttgcacggtgtcggcggactcgaggagggcagcttcggtcggctgttaaaggactgcaatgcggaccagcgaattgttcctctctgcaaaaagcacccttactccattcgttgggaaggacagaccattgatattccgtccgatgttcaggagtatgtgcagctcctcaaaaatatgtttcctgctgaggtgtcgggcattgtcagtttattcgcgggcattcgccgttttgaaacaggcttttctgctttttctactctcacttcctggcgcaaggcggttggcctactcaaagcaggaaccttcttccgttggacgcaaatgacgacctgggaagctgtaagccagttcggtttgtctgaccgcttcatagaattctttaccgcgctgtgggcctattatggattgcctccaaagcggcttgcggccttgtattttttcattccctggatcggctatcatttggaggggacgtactacattgagggaggcgcacaggctttatccaatgcattggttgacgctattaagtcagcgggaggagaagttcacctgcgcagtcaagtatctgagattatactcgaacgcagtaaagcagttggagtccgtctgaaaaaaggcgatgtatataaagccaactggattgtgtctggtatcagtccccatcatacgtatggccgcctactggaaaaccatgatgctgcccgtcgtgagctggaagctgtcagcagtctggagactggcacgtctctcacccagctatatctgggattatcatgtgagcctcatgagcttggcatcaccgaagaagacttaatcctgtgcaatgagccggattcggaaacagattatgaagttatgatgagcggccagtataccaaaggcaactggatgctcacgaattataacgccatggaccctaagcttaatgaaccgggaaagggtgtcattgcaattacatttttggacagattggagaactggccagccgcacgtccccaatataaagccaaaaaagaagctgtgacacagcagatactaggatgtctagaacagctgtatccgggttttcgcagcaaggtagtcgtggccgagttgggcacaccgcgcacgatgcagcgttataccgctaatcccgacggggccgtttatggatacgcacaaacggtccggcagtccggtataaaaagactgaagcacaaatcagctgtgaatcgtctgtcattggtaggggcctggacacagcctgggggcgggtttcaaggggttatgaactcgggtataatggaagctgatcgtatcgccgccaaattggggtaggcagaaagggcaagtacatctactcatgaaacatatcaaacgccgagaacgtgaaagcagtgagatccgccggaaaatcattgaggccgcccggtcgcttttcctgaatcaaggatatgccgaagtctccatgcgcaaaattgcggatcagatcgaatattcaccaacaactatttatcattattttgccaataaggaagccgtggtccgtgaactgctggtagaaggaaataccttgttcctgcaggctcttcagcagcgtgtggatgaagcacaggcagcgggattgaacgctctggacacactgaaaacggtatctgatgcgtatgttcgttttggaacggctaacccggaatattacaacatcctgtttatcagcaacctggaatctgtaagcttggtcagccttatagacagtgggcgttttaaaggctttgagctgcttgaagctgggctcaaagccgctatggaggaaggctgcatcatgcaaggagatgagcgcctgatcgccagatccgtatggagcatgctgcacggattgacttctttgctcctgaattttgaacttcctatggcaaaatccaatgatgaattgatcgcattcactatagatactttcctcagagggttaagccgctgacgcagcggctaactttctttacctcgcatcactgtacatgcgaatccgcatctgaaagctgcttaagcacggcctcaatacgacgtttatcttttttgagcataacgagctgcaaagaagcaagaagcagatctgagatattggcccaagcgtctgcttccagagcgggaagaagatcccgatgaatcatgatatccagcgcctccgttgcaattttctgatgaagctcgctatcggatagccattcaatcaactgctcagctgtaggacgggagtgagcgaaaagtattgcccagccatccaccggatgattgactttatcccgcatccagttaatgatctgtggtgaacgaaaatgctgtagctgcccattagcggtgtatccttctaatttgtcttctgcagccgaatcctgtagcaggtgattgcaaacacataccaagccttcctgctcgggtaggcaacgggcgctcagataggcacgtgtggacacaaatgcacccttagcatgtaggggattgttttgagctaaagatgtccatgcttgcgcggtttctggttcccacaaggagcgaacccaatcagcagcccccatccccgcggtctcccctaccaaaacggcccaagtagagaatggaacctggctatattgaatgttctgccagtgctgctcccaggcaagaaaaatatcctttggatcataggcttgaaaagcctgcaacacagcaggatgatctacgccatgcatggtggtgtaatggatcagcgtctccaacgattgcgcatcctccagtttcatcgtgcaaaacatgttcaaccagcgtagccagagttgcagtggtgggctgtttagctgaatgccatgctcatcggccactttaaaccaatcccatagccatagcccatgcaaggtgagcatggtgtctatataggcaggtagatttcccgcaagcaacgtgaactggtccaactcgtgatgatagcagaacaccgctggctctgtagtggatgtcgccatatcaagcagtatcggatcacccgcaccattataattaaggatcagatatcgttgctcgtccgctaccgagttggtatcttccccataggatgtaaaatagccaacatactcatgattccagccaaactctcctgtgatatcgtctaggatactctgctcttgttcaagatcattgctgtttttatatgaacactccggtccatccgctacaatacagtgtggggggaggcaccatagtaaatttaagctaccacaccgctgtattaattcagacagggaggcaggcaaaggcatccgcagccgttcctccagctcagttagttcacctgtagaaatcccctcctccattggtataccacatcaggcatcccactttgtctcagacgatcaacgacttgttccagtttttctaaggtttgtgcaaagtgtactgtcattcgtattcgtcctcctcttactctacaatccgacaatgctctttttgcaagaatgctagaatttcatcacgaagtgctatcgctttcggttcataaatgattgccacttcgcgtccatatgcatagttaaaacgcacgtatccgcctagagtctgaagaaaagccatgcagatatgctcattttcaatccataggtttgaggcaaaatgctgtttaaaccgctgagccaatgcttgtatggatgccggagcgaaatccagggcttgctcgttcggatgggctggattgtaggcctcggtcgtatccgggggattaaacagtaggactgttgcggctttgtctgggctgacaggttcgaaataacggggaaatggttccatctttccgaattcatcccgtaaaatatgttccagtgtttctgtgaatgggacttgagcatctaaagtcttcgtagtaatgatctccgagtgtcgtggcagccaccgtcgtatgttgtgtgaaaacccaatacatgtaggatgcacctgctttccggcactctatctatagggatagagatcaaaagtaaatgagagatatgctataattaggaaataaaatagttatagattagtctatcttaattccataggaactacaatttgtgaggggacgaaggaggaacacatcttttgacaacatcaggggtacaagcctacatagatccaatttttgaggcgattgatgaggcgtacgcttctgagcaaaagcgcatcgccgaaatccaaatcaaaagtgtccttcacgaaggaattcatgaatatttaaaagttacctgtaagaaggatgggttgtgggtggatacctacgaaccgtttgattgggatcatcgtagaccggacatggagatttctggttttacggagggggtaacactgcagcaggttcaggacgaatggatgcctgtgtttagggaatggatagaggcgctatttaattcggaagaattcagttccgtgttctttcgttatcgactgaattttcatctggaagtggtcttggagaataaggccaatcattttacattctcactcctaaatgaagataaacggcagcaactgttagccactatccagcagtttgtggagcagaagctcaacccctccagtaaagctatcccgaaggaagaggacgatttcttcttagtgagacacttgcttgatcctcatttgtacgctatagatgcccagcgggtggatgagttgctccatataatggatgccaaagtgaaggtcagccgcaagcgtgaggaagcatggaggtatcagctcagcagtggcttaaagcattgggctgaagataaatttttgctgaagtatgcggatcgggaaaaaagctatgggctggattataaagtgaagcccgatattctcccttcggaaattcccacgccagccatggagatgttcctgcttaccgcgatgcgggtgggttcgacggatgccgatgcacggcagaaatatttggagatcgctgcacagctaggctcggagcaggcttccgtgtggcttgagagcggatcagggagcatcccagcgttacatacaagcgagcgagtcatctgccaagccaatgatattttgcaaacattggaggttcagattcgttcagaggaagaagaaagctatagacaagcacttgtatatttatgcggtattttaaagaagggctttaccaaggaatatcggatgaagttcaaaagcaaggtgaaaaactacctgcctgtacccaagttggctaaatctacgctacatcgtttcttcgccaatgcacttgagtatccgtcgctgcatccgttgctggctgaatatgccgaaaccgtgatggaagaattcaaatggtataacgatgtagagcccggtgaaaagtcggcgatgccgggaacctatgcggtaatgggattaggactgaaaggaacgaactatttcccattagtgaatcgttatatgaagctggtggacagtgaacatcagtccgtacaggacggttacgcggctgcttttgccgaagcgcatgggctaacacctgacacgatccccgtttggacgaggattctactggcaagcaacgagtctgccaaaccactgaagtcatccggaatcgaaactgtagagcaggcacaggtactggtggaggagcttgagaagctggaggactatgaacaagaggtgcttgtttatcgtatatggggtggcgcgaagaaactaaaaaacagcctgaagcaggctgtccctgaggtaaaagagttgctggagacgcttattccataaaagcatcatattcatgataatatcgcagtccctgcgcaatgcgttcaatatcaggctcgcttccgctgtggcgtaacacttcaataacatcctgtacagtcgctacctccagccaagattgcacgtgatagtctggcagagatgcagggatcctttcatcacgatgattggtgacggtgagaccggcatcctccagctcccacaattcttcctcgggaatgatgtagtaggtagaattgagcggattactttgaacacgttccagattggcaaatacccattcattgatttctgtttggtcaacggcatgaactagtgcttcaaggctgtcaaaggttagtatgctcatgtatggaggctcctctcttagctgctgacttatgctgtagcttttgtaatatctttaagatggcctggcgattcttcgcatccttaatgtacttgggaatggaatgggaagccgtacgcatcataccggatgtaggcttttcccgcaactcggcagagatataggagagcaggtaattcaggtgtatccggttaagagcccagacaggtttaccccgatagtaatcaaggaagtacagctggagctggaaaatagggtcttttccgttttggatcacgtccgtatgccattcgcgtgattgaacacgatgcaccggaacctgattgcgtgtctcacagtgcggacagattatattcgtatttttatggagtttcgttcggtcatcatggatttcgatattaaaataccgctcgcaatggttgcatacgccgcgtgcatagaatgtataagattctggctgctgatacgtgtagtaacaatgagagcatcgaacaacgtaataacagtcttttttggatctggaaataaaagcttggccctgacaacggggacagtgaacagctacttgttctcctctccggatcacggcggcaaagtcatatttatatccatgttcatctttgaagcgcttttgctccatattcgttcctccttttcggaaagagcgtaaaaacgtaaattttatgattcgtatgttataatattccttaataacattaacacttgaaaatggccttttcaatgcaccgaagggtgaaaaggtgaataggacgtgcaaaaggagagggcgaacatgagcatttttacagggctgcaacgtccacagtttcaggcttattatgacgagacttttctaatagaacatcgttttgaaaatggtatgagttttccgccttcttatatagattatgtcaaaactcttggttacgggcgactatgcggcttatggaacattcatattcctcttggcgatcaccccgattcatggcttcatcgttatcatgactggcggccctggtttgatgatttactcgaatcggaagaggttttacaagaagcggcgctggagccagatggctttccagaacttttggagcatgcggttccctttgcttccagtgaagggaatgacctgctgatttgggatattcaatcgcctgatgaacggggagaattcccaatctatgctttgaatctacgcacatggggcaattttcggtatgcagcctcggatttgtatagcctcgtcgaagcgtgggtggatgaagagcgcgtaaagtctgtattgggcacagatcgtacaccattcccttatacattcgagcctttttaacaacgcttttttgaatctaccatacagtgcgcaaatcacctgacataccgcaaatcggccgtcatgcgtgggaataacaaaaatatcgccttcccgatgcttgattcttttgaacaccatcgtcaggccagctcttcctgaatgatctctgtttttagacctttagcgctggtaatcgtaatgctgatcgcatcatagccgttccgcttcacatcttcaaaatcgcatcgttcgccgttgatcagctctaactgtccattctcatccacatcgtctgcaaactcgtcatcccaatccacattataaaaagcggtcaagcttacctcgaaagtatcttcaccatcttcgtccagatagggcagcaggggagtgcgattgttctgttgttccttggtataaacttcgcatagcagagcatcgtaaccatggcgggttccgtcaaaaatcacgatctgttcacttgtgactgcatcttctgcaataatgagctggggtgcaaattcagttacagcgataagctcgtccataagctctccataataaaaaatgtggaattttgtatgtccggcctgtgaacggagcttacctgtccactcctgctcaacccatgcctccgggttttcgggtacaatccaaccttccaaataagccggtccccatttaggattatgtatttctgtcatcagtaggcctccctttctgctcgttgagtcgttcaattacctgattaaaaaacgttgtaaagtctgttgccaccagatacaaatgtccacattcgccctgctctgcaatatcatagttcagtttgtcatcataagcatgaagatgtgtgcggtcccagtagtacacatacggggtgtattcattacatatcagaacgtaaaaattgtcgcccgcatctgcaccaattaacaaagcgttctcgacatgattgatttcatccagaaaatcattattaatcgctagcggtgcatcatttgtgagatcatgtcatagataaggtgacgattttgttgttctcatccacatctaccttcacattcactcccagcttgtccttaaacagcttgctgatattaatatagtcatcctttaccgcacggcttgatctaccggttgtgcgagtcatcccagcggtgatgatggaacggacgtatgttttatcgagcttggcttcgggattataggtataaatgatctgttcctgctgattgtaataatgggttaattccgtgtagtcgttagcattctcatactgcttttcctcacgcacatactcaggatggtccatggtgtagtggactcccccgtccagaaaaggattttccttggagggtcggagttcatagtgtccgtaggctagttgaaacagatactctatgtccgagcccttcgcctgatagtagagctgacgattgtccccttttttatctatagcggtatagctgctgattaaaggccaggcatcatactttttatcctttacctcaatggcaagcttgtaatgtacaagcaccttttcattttgaaataatccaaagctactcataataaaataggcaggcacacatataatcccgataatcaatatgaatataaatattcttacacgcataagtagagtgattctcctttggttgtcgatgatgtggacagctcccgtttggcagatggtttctccaactcatctgccagaacttcaatgatggtcatcagctcatggaaattatcctcaagcagttctccctggaaggggcggagcatccctagaaatccgttttgcattttgggatgatccagatcatcgtgaataaaagaatgacaacgtaacagctcgcgagcctcctgtttattcattcagttccttaatctctgcgcggatacctctgcacagaaagctacctgacagtcccgacagggcatcaatatcaacgaccatgtctgcttcttcatagcggaaatcaagctgcaagatgatattttctgtttctacaggagttaatacatgctctttggtttccagaaatgtaaaagtaactacataacgtgggacgtcttctgctggagcttcagggattacaggtgcctcagccgaaggctccagctccggtgatttagggacaagcacgctagcgtaggacagctcaatcgtcagcgtaatttggtctttcgtcatattagcagccgtaattcggtcataatgaaagggagggaaatagccgagcttttcgacaatgctgtctgcaccttgaatagaaacggttggagagaaagccagctccagtccgatggaccctgccagttggtcttcatattctggattgatacgtacaagggcttgttccggctctactttcaaaatcgtgcctataaaatactgtttgccatggatcagaacaatatcatgcggaacgaacggcaacgctcccccggcttgataatgaatgagatattcgttctcttttttttcaaccttttgaacttgaatttgcataaattgcagcctcctagggttaatggtatggcggattgtttaagtgtgtggtaaagggaacggagtccacgattgaaaaacatacttcatatccggggtatcctgttcgagcataaatggaacaatatccataatagcgcgtgctttactgccagtataaaatttacgcgatctgtgtagcagcttgtgtgcctttaaccactggctcagcttcatcataacgtcttcgacgattgcttggtcgatattttcataaacgtcctgacggattgaaacgagcatgccgcaatgattagaagattggtacatggggtcattggacaaaagaatgtacacttccggcattgtgcctttggtatatgacggaattaccaattcttataccataatatatgacatgaagatcgaattcaccttttacattgactgtagtactgttcattaaaatcgtttggaaaccagttcaacttcgcgtatactaggaaagtcatacatggaacgggcctgagccgcatggcggccgtatgttggttacatgaacagattcaacgataacggataagctcccttcctgaaaagggtagaatgagaaccgatacaaaaatgggaattctgaactatggaacgatagatgtcatatggcacatgaacctattttacgtgacacatattgaatacagataagggaagtgaataccacttgaagaattttgcagcattaggcgtagagcagcattgggtagaagccttgaaagaacagggaatttcatccccaactcctgtacagcaggagtcgattccactgttgatggaaggtcaggatgttatcgccgaggcacatacgggaaccgggaagacgcttgcgtttttactgccgattctacaaaagctgaatttggataagcgacacccacaggcgctcgtgattgcacctacgcgtgaactggcgctccagattacggaggaagcaaaatgcttggctgctacggagccgaacctgtcattactggctgtatatggaggacaggacgtagagcgtcagcttcgtaaactgaaaggcggcgcacaactgattattggtacacctgggcgactgctggatcacctgagacgtggcacgctggatctgggtggcattaaaatgctggtcctggacgaagccgaccaaatgttacacatgggctttttgaacgatgtggagacgattcttcaggaggttccttaccggagacagacgatgctgttttccgctacgatgccagccggtattcgcaagctggctcgtgtatatatgaatgaacccgtagatgtcaaagtgaaatccgcttcttccgttccagtgagccaaatccgtcaggtcgttgtgcaaacaacagaccgtggtaagcaacaggcattggtggatatgctgaatacagatcgtccgtacttggctgttattttctgccgtacgaagcgccgggctgccaagctgaacgaagagctgcaagagatgggcttcgagagtggtgagcttcacggagatttgtcccagaacaagcgggagcaagtgatgaaggcattccgggaagcgaaactccaattgctcgtagcgactgatgtagctgcacgcggcttggatgtagaaggcgtcacgcatgtctttaactatgacatgccgcaggatgccgaaagctacatccaccgcatcgggcgtaccggccgtgccggaggcaaaggcgtggcggtgacgctcgctacgccaagggatgttccagagcttcggaacatccaaagagttgctggtgtcacattcaccagcagtgagggcggcggacagcgtagacctgcttccgatacggctgatcggcagggtcgagaacgccgctcgggcagaaacgaccgccgttcctacggcggcaacgactctggcggtggacgccggggcagcggccgcgaacaggcgggccgtcgtgatgccacaggcggcgaacgtcgctctagccgcggcagtagcgagcgtggcgggtatgatcgcagtagcggcggttccgcacgcggaggtcagggccgctcggcaggacaaagcagcgaaaccggcggatatgatcgcagtagcggcggttccgcacgcggaggtcagggtcgctcggcaggacaaagcagcgaacgcggtggatatgatcgcagtagcggcggttccgcacgcggaggtcagggtcgctcggcaggacaaagcagcgagcgtggcgggtatgaccgcagcagcggcggttctgcacgcggaggtcaaggtggccgcggtggacaagccaaaggcggcccgcgtggtggtcaaggacaaggaggccgtcgcggacggtctagatagttaaaacaggagtattctcatagaatactccactatggttatcataatagccccggggaggctcatcttccggggctattgtaatcttcatccataccgctgaaggagcagcaccataagatgacatgagtagcggggctaccttgaaatatacgattagcgtttaggatgcatttttcaaaagataaatttggagggattatacatcatgcaggaacaggatatgggcaagcgcgccatggtctcagcatggatcagcctgattagcaacatcctattaaccggcattaagattattacaggactcatgttcaacagtaaggtgctggtagccgatggtgtgcataatgccggagacgtgattgcctctgcaacggcactgggagcgatgcgcatatccagccagccgccggatgaggatcatccttatggtcacggcaaagcagaagtgattggggcaagcgtggtggcggtcatattgtttggagcgggcatatttatcggctatcattccattgcagcactgttcgaaccgatgccacaggagcatatactggcattggtagccgctattatttccttgctctggaaacagtggctgtatatttacacgattcgtatcgggagagcggccaatagtcagggtcttattgcaacggcaaaagatcatctcgctgatgtgtacgcctctggggctgctgtactgggtatcggcttagggctaattggggagcattggagcatttcaatcttatcttacggcgatcctattgcgggattcgtagtggcattgctagttctgaaattggcgtgggaaatgggccgtgaatccatagatgtacttatggaaaaagcgattgcaacggaggaaattgaaagctacgccgcagccgcactgagtgtagccgaggttcaacgtattgaccgtatccgtgcccgtgagcacggccattatattattgtggacatccgcgcttcggtggatgcctctttgacgattcagcagggacacgatattatccgactgattaagggggctgttatgaagcgggaacctcgggtttatgaggtgcttgtccatttgaatccatggtatgcggacgaccactagaacagacgacacgaattgacagataacttgcaggaagggtatgcttttaaaagccgaacgatgatgaataaaagcgaggttacccgaaaatatgcgaaaatttttaaaatggttaggcatttctgtgactgcggcggttcttttagtgggcggttattatacgtattctatatatcattttacgaatcaaatttcggttgcttccggacaggattcgaaattcaaaccgcaggcacaaactcaaaccaatgtacaacctgtagaggtatctctcccaccggaatgggatgggacagaaagagtgaatattctgctgctaggcggcgactcccgtggagaggattcagggcgttctgactccgttatggttgcttctattgatccggttacgaaaaaggctacacttatgtcgattcttcgtgatacgtacgtcaatatcccaggtcatgggcaaagtcgattaaatgctgctttttcctacggtggaccggatttgaccagacagaccgtgagcgacctgctgggcataccgattcaatattatgtatatactgattttaatggctttattgcgctggttgattctgtgggtggtattgacctggatgtcgaaaaagatatgcactatacctccaaggcagataaacaccagtttgatattgatttgaaaaagggaatgcagcacatggacggtaaaacagccttgcaatatgtacgcttccgtcatgatgctacttccgattttacgcgtacggaacggcaacgcaaattcattaccgagcttggcggtaaaattcagtcaacttcatctctaattaaactgccgagtattctaaatagcatttctccttatattgaaacgaatctcagcactacggaaatgctgcaattggcttcattgggctttaatatcgatgcaacaacagtagcgaagcagcaaatcccgccgaatgaattggtgcgcggggaaaccattaagggtgcgcaggtgttgggtgtagacgaaagaaagctcaagcgcttcatacagaatctttttgaacaggagaacaaacctgtgaccacgacggtggatgctgcaaccacgataaatgatactccataaccctcgaaagcaagcgaagttcgtacgatgacgtacaactttgtttgtttttgtgtttatttgggtataaccttgtatattttgttccaaaaatatatcgtatctatgaagaacgtctactcatttgtgtaaagagaaggggaatgtggtgtggaaataactccggcatggaaagaccgattcaagaagttttttctgaacaacaagtttgtgttattcctgctggtactgctgctgatcggcttgaatatcttggtgcttaccaaaatttcatacatattcacacctgtcatggtgctgttaaaaacgataattctccctgtcattttatccggcgtgttgtactatctgttcaacccgttggttgatgtactggagcgtaacaaggtgaaacgagtatactccattgttgtactgtttttgctcattataggggttattgcgattgtggttacatcggtggtacctgtaatccgcgatcaaatacaaggacttatccagaattttcctggctatagcgagcaagtacaacgacaatttgagaaactgatcggcagcgattttgtaaaccaattccagaacaccattcaaattaatccatctgagctggcctccaaagcttctgaaaagttatctagctttattaataatgcatggacgggtgtgggcagctttttgggcgtggttacagaaacggtacttgcgattgccacggttccatttattctgttctacttgctaaaagatggacacaagctgccacagtttatcctgaaagtgctgccgcctatgtttcgtaaagaaacagatcgcattatgaccgagatgaatcatcaggtcagttcctatattcgtgggcagattattgtcagcttctgtattggggcgctgttgtatattggttacctaatcattggattagactattctctgacgcttgcagtcattgcatcctttacgagcgttgtcccctacttaggtcccgtcattgccattacacctgcgttaattgtagccttggtcacctcaccgattatgctgctcaagatggttatcgtgtggacagtcgtacagctcattgagggtaaattaatttctccacaaattatgggcaaatctcttcgggtacatccgatcacgattatctttgttattctgaccgcaggcaatttgtttggtgtggtgggaattgtactggcggttccggggtatgctgtcttgaaagtaatcgttacacatctgtacagtttctttaaaaagcgttcgcatctctatgaggcggataaagggaacgcaagtctttacgaaaaataaacgtttccactataaaattgatatgggcccctcttgggtaactgtggctacgcgtgctataattaatgcctatccttattcccaaatagaaaggtcagacttttatgataaaactcagcattcttgaccaatctccggtatcggaaggcatgacgcatgcgcaggcattacaaaagaccgctgagcttgctatagaggcggaacgcttgggttatcatcgcttttgggtatcagagcatcattctgccgcaaatctcgcaggctccagtccggaggtactgatttcacatctggccgcacgtacttcaaccattcgagtggggtcgggtggtgtgatgctgccccattacagcgcttataaagtagcggaaaacttccgtgtgctggagggattgtatccgggacgcattgatttaggtctgggacgagcgcccggaggaatgcccattgctaccagagctctgcaagaaggcaaaatgcgaggtggtgtagatctataccctgagcagttggatgacctgttagcttatttacatgacagcacaggcaataatcaccgtttcggttcgctacaggcgatgccgcttatagaaactgtaccggaaatgtggttgctcggctccagtggtgatagcgcaggtctggcagcggagcgtggcgtgggctttgcgtttgcacagttcattaatggtgaaggcggcacaggggctatgaaggaatatcaggaaagcttcgagccttcccagcatagtgaccaaccacgttcgcttgttgccgtatttgcgatctgtgcggatacagaagaggaggcgaatcggttggcttccagtatggacttgtctcttgttctattagagcagggaatgcgctccgctggaacaccttccgtcgaaaaggcactggcgtatccgtatacgccgtttgaccggatgcggattcgtgagaatcgcaaacgtatggtggtcggttcgcccgaacaggtgaagcgtcagattgagcgattaagtaaggactataatgcacaggagatcatggttgcgagcattattcacgactttgatgccaaaatgaattctatacgtctcatggctgaagcatttggactgtcttctgtacagtcataatgcgattcgccggatttaaaagatcacagcttcgaggagctgtgatctttttttgaattttttgagggaatattggatgatatgcactgtatgatataggaaataaaccagttaacacttgataatgattatcaatatctttattatataaagatagaatgaagttttgatgaaagtcgtgcgttaagcccgtgactatatatattggataagggaaagggatgattccaaatgtttcgtctgaaaacggcaaatctggatattgcttatgaagatcgattgattgtagaagatctgaacgtagaaataccgcaagggaaaatcacagccttggtgggcgcaaatggttctggtaagtccaccattctgaagacgatggctcgcatcatgaatcctaagggcggcagtgttctgcttgacggtaaatccattcataagcaatccacccgggaagtagctaagcagttggctattttgccacaaaatccgactgcaccggaaggattaaccgtgacggaactggtatcttacggacgttttccctatcaaaaaggttttggttccatgaaagcggaagatcgcaaaatggtggagtgggccattcaagtaacgggaatgagcgagttccacgatcgtccgattgatcagctttctggcggtcagcgtcagcgtgcctggattgctatggcgcttgcgcaggatacggatattttgtttctggatgagccgacgacatttttagatatggcacatcaattggaagtgctgcatttgctagagtatctaaatacttcggaggagcgcaccattgttatggtcgtgcatgatttgaaccatgccgcccggtatgctcagcatatgattgcgatcaaaaaagggaaggccgaggcggtaggaactccaactgaggttatgtcccctgatgtgctgcgtgaggtgttcgggatcgaggcggatattgtaacagatcctcgtacgggtgtaccgctctgtcttccgtatgctttggctggacagcctgccgtgagccaagcagtaaaagaaatgaatgtggaagataagaaactcgtgggttctgttgctgagcgacgtgatgctagagcacaagtagcggcaagaggttaaagaggacataccatgaaaccactggattacgatcagcttgagcaactagcgaaaatagtgagagtcacgccggaggatgcagtatattccgggccagtggctgaatggcttgaaccagagaagatccgctctgtgatggagtattacggtgatcttctgcgtgctgaagacgatttaaccgcagccgtttattttgtgaaccagttgcgtggtctcgtgtttgcacagcattttatggtgtcactatgtgaacgccgtttggatctgtccgtatctaatctcagatttcatatttgttatgaaggtcaatatccctctattagccttcaggtcatcgacctcacagagctggacaatacgcggaacaatggggatgacccttcttccgaacaggctcagcaagtgttacgtgatttttacagtttgcagatgcggcccatattggaggtaatagctgcagtggggagcgcatctattgggcaaatgtggggacagtttccgttgacattgctgtattttaaggatagagtacagccatcgttgactgatcctcaggatgtggagcgctttgaacaagattatatttatgtgacacgtgaactggagggagaggtattcggacgtaaaagaaacccgtttacggttcgtctcgttgaattggataatccttaccgccccggtgaaaatacctacatgaaaccgtcctgttgccaatattacaagacaggtggaggccagcggtattgttatgcttgcccaaaaatgtccgcttccgaacgtgaagaacgcagactcgaagtgatggcatcacggtaaaggatctgcggatgttggcatgtccgtcaccttttggttaaaataggttatgtaatctaaaccaagctacacgaaggaggatgctgtatgtctgtctattcacataatgtcgtaacaccagccaatcaggaggtttctctggatacttacaccagtaaggtgctggttattgcgaataccgccagtaaatgtggacttaccccgcaatatggggatttgcaaaagctttatgatgaatataaggatcggggattagttgtattaggctttccttgcaaccaatttggcggtcaggagccgggcagcagcgaggaagcggctgaattttgccaactgaattacggggttagtttcccggtattcgccaaagtggacgtcaacggaccggatacagcgcctctgtttgaatatttgaaaaagcaacagcctggagaacaggaagatggaacaattcagtggaatttcacgaaattcattgtgaatcgtgaaggtgtacctgtgggtcgttttgaaccgaaggagtcaccagaagcgatgaaagcagccattgaacaattgctatagtagctttgccttaactccaaagtatatgtttaaaaaggtctgatttcctgcgtgtctccgggaaacggacctttttttgtttctctacatgtgcatttgtttaagggtggtcgcatcatgtgtaagtcgattccaagagcataatcagggggcttacagggaaaactgaatggagcgaaaaaatatttcagcaaaccgttgattttgtatatcctttcttttttaaatgtggacaaattgtgaatatcacgaaaagctattgtaatgtgaaaaatatcacactataataagcgcatgaagtgaaataaatcacaaacgcaaacgagctgtttacgtgaaactattcacaattattatacattttatgcccacacaccaaggaggaatttaacatgaaagtagcagttatcggatgtacacacgcaggcacggcagctatcgtcaacacagctaaatgttatccagatgcagaaattaccgtttacgagcgtaatgataatatttcatttttatcttgtggtattgcgctgtatgtaggtggtgtcgtcaaagatccacacggcctgttttattcgtctccagatcaactgtctgacttgggtgtagtgaccaagatgcttcatgaggtaacgagtgtggatacggcaggcaagacgctgcatgcacgtaatctccaaacaggtgaagaatttacagacacatttgataaattaattgtgactacgggttcgtggcctattattccaaagctggagggcattgaacttgatcatattttgctctgtaaaaactataatcattccaatgatattattgagaaagcccagcacgtacagaacattacagtcgtcggggctggatacattggtgttgaactggtagaagctttccaaatgaacggtaaaaacgtaacactgatcgacagtgctgatcgtatattgaataagtatttggaccatgagtatacagaccggattgaaagttccctgaaggaacatggcattaagctggtacttggcgagacggtgagtcgttttgagggtacgaacggtaaggtgagtaaagtcgtgacctcgaaaggagaatatgaaacagagcttgttattctctgcatcggtttccgacctcaaacggatctgctcaaaggtcaggtagatatgttgcctaacggtgcgatcattgtggataactatatgcaaagtagctgcccggacgtgtttgcagcaggtgatagttgtgcaatccgctataatccgacaggtaaaacggcttatatccctttggcaaccaatgcagttcgtatgggtacactggtagcacgtaatctggtacaaccaacgattgcctacatgggaacccaaggaacttcgggtatcaaaatttacgaagacaatatcgcaggaacaggcttgacggaagcggcggcaacggacgaaggcatgactgtagaagctgtaaccattgaggacagctatcgtcctgaatttatgccaacctccgaaaaggtattactgaaagtggtatatgagcaggagacgcgaagaattttgggggctcaaattatgtcgaaggtggatttgacgcaatccattaacacactatccatagccattcaaaatcatatgaccattgaccagttggcctttgtcgatttcttcttccagccgcattataacaagccttggaatttcctgaatgcagcaggcttgcaagcattgcctacaatatccgaacggaacccagttactgtataattagatttgtctgtgacattgttcataagtttgtcaacaatctgagacgtacggacgaatccttatagtacaatatagagtagcataaggattagggggtaagtagcttatggatttgttttatatcctttttcttgtagtcgtggccctggtaggcctcggtggagttatttggttcttgagagcagttgaaaaggaagaatacaactaaatgtaaagcgcgtagtagcgcagtagatgtaataatacagaaagacagtcctttttccaagggctgttttttttatagttgagaaagtgatttttttcacaaacataatcactgattttaaataaaatatgaaagaagaatattttagtgaaaagatattaaaggagcggggacatatggcgagctataaaccggggcaaattgctgaaaagacggtggaaataggagtggccaaggcgaacaacccgtggactgtggcggtggtactgggatttttggcaggtgcatttattgcactcgggtttttgctggatatacgtgttattgcaagcgcgcctaaagaatggggaagcattgccacctttattggagctgcggtgttccccgtaggtttggtattagttttgatcgccggcggagaattgctgaccggcaatatgatggcggtccctttggcgagatgggcaggacggattaagacaggagccatgcttcgtaatttggcgattattacgctcggtaattttgcaggtgcgttattcgttgcatttttctttgggcatgtactgggtttgacagaaacgggcccttacctggacaaagtggtggatatggcaggacataagctacatgaaagctttttgcagtcttttatatcgggtataggatgtaactggctcgtagcactggctgtatggctggcatatagcacagactctatcggtagcaaaatcatggggatttggttcccgacaatggcctttgtcgctattggatttcagcacgttgttgccaatatgtttctcattccggcggctatttttgcaggccacttttcgtgggcagattatgttatgaacttcattccggtctggctgggaaatttggtaggaggtagcctgtttgtggctggagcctactggttggcctatttgaaaaagcctcaaaccaacgcacatccagtgaatgaatctccaactacttcttcggttgcacatcaaatccgttgagtgatcctgcttaattacggtactttaaacagcaatgaacaaagcaaatccgccatgacaggcccgggggaacgaaacctgtcatggcggatttttttgggagtggtccatgatttggcatggaggatgagtgtgctctcgtcccataatgccttgatctcttttaccctcggtaagatatgatgaaacaggatgttgaaaaaaaatatgattctaaaaaaatccgttttgctctatgcagcagacggatttttttaatgttttggagagcggctgtgtgggaaaatccttctcttgccataggccaaagctgtggatatgataagatcagtgtaatttttggaaacggtaacggaaaggagcatcaacactatggatcatcgtaatagtgcgcctcctgaggccacgcttcaacaagacttacaaagggggcagcggatgacggagcagcaggacggtatttttccggctgtatgcccgttagattgcccggatacgtgtgggctcctgcttcacaaggaaaatggaaagatagtcaaggtgactgggaacccggatcatcctattaccaaaggggctatttgtaacaaagttcgcaatatgacggagcgggtatatgatcctgatcgggtgctctatccgttgaaacgtataggccccaaaggagaaggaaaatttgaacgtattagctgggaggaggcagtcgataccattacaggtcggttcaaggagctgatacgtatggacggatcggaatccattctcccctacagcttttatggcaatatgggcgtattgagtgtggacggaatggaccgccgattttttaatgcgctgggttcaagccaactggatcagacgatatgtagcgtagcagggaatgaaggctgggcgtccgttatgggttttaagggcggcaccagcccggaggacacggaggatgcagacctcattattgtgtggggtggaaatgtcattagcaccaacatgcatcaggtcgttttggctgagaaagcacgtaaaaaaggtgctaaggtggtcgttattgacgttcatcgcaaccggacggcgcaatgggcggattggttcattccgttatatccggggacggatacggcgctcgcgctgggtgttatgaatgtgctgttcgctcagggactgacggacgacgagtttttacatcgctacacggtaggccatgaggaactgcgcgagcatgttaagacatatacaccagagcgagtttcgcggattaccggcgtaccggaagcggatatcatccgtttggcgaaaatgtacggaactgcgcgagcagcgtatatcaatatcggcaatgggcttcagcatcatgataatggcggtatgaacgtacgtgcagttacatgcttgcctgcgctcactggacaatggctgaagcacggcgggggagcgtcacgctctaatggcgcttatggcaagtttaacggcgccaatctggcgcgtcctgatctgcgacagaatccggatgcccgggtgatcaacatgaaccggatcggagaagcgctgctacagaaggaacagccgattaaggcgttattcgtatactgcagtaaccccgtagttgtagcccccgattcggaacgggtgactgaaggatttggacgagaggatttgttcacagtcgttcatgacctgtttcttacggatactgcccgttatgccgatattgtgctgcctgcagcatcttcctttgaaggtacagacctatataaatcctactggcatcactatgttcagatgcaggaacccgtcattgctccactcggggaaagcaaaagcaattatgagctgtttagcctgctcggacgggctatgggctttgacgaagctgcctttacggaaagtgaagaggacatgatcgcaggtgcgcttgataatccaacgaacccttatctcaacggtgtaactttggaagccttaaagaagtcaccttttgtaaagctcgatatgacgccaaaggctacttatttggatcgtttaaccacgccttcgggcaagattgagttgtattcggaaaaaatgaaacaagcaggtctgcccgcgatgccttcttatgtgccgctgattgaagggtacgacggagagcatcgaccgcaagcggacgagcggtatccattaatgtttatttcaccgccaaaccataattttctgaattctacttttgctaacttgcccaagcatcagcgactggagcgggagcccttgctacaaattcacccggaggatgctcagacaagggacatcgcggatggggacccggttaccgtatggaatgatcgggggacgtatgagctgaaagcgaaagtcaccgatctaatgctgcccggtacagtaattagtcagggattatggtgggaaggcaaaggacgcagacagcgtgccaatgtgttaacctctgatcggctgtcggatatgggacagggggctactttcttctcaacggtggtgaatgtgaagcgctaatgagataatgccttttatggcgtcagatgcaaaaggagaaacaaaagatatgaaatggttggagtcttatccgaaagaagtgaaagtgtttctcgttgctagcctgattaattccgctggaagttccctgatgtggccgttggttagcatgtatgtgtttgacgagttaaaccgtagtatgggagatgcagggattgcaattttagtgcaatctctgggcggaatttttggtcaagtgctgggcggagccctctatcaccgtattggagccaaaaaactgattgttggctcactcgcgatgaacgcgctgggacttctcgcgcttccatttaccagtggccattgggtagcgtttgtcatcatgatgggctttatcggcttttttaatgtcgtatctgtgcctgcgattcaggcctttgtaggttttcgttttgctgaccgtcgtggtgagctgtttaatattatttatgtcgctaacaatattggggttgcagtgggtacgggattgagtggcgttctggctgacctttcctatcagctcagctttgtgatgaacggagtgacctctgcggtatttgccgggttcttctggtcttatctaagcagggtggatcgggaagagggagaagtgcagctcagtaagtctgtgaaaaaaagagaggaaataccagctcgattgctgtttcgtgataccagactgtatctctttgtggggttaggttcgctttttttatggttcgggaattcgatctggaatacaggagtgtctccccatattattgagcagggcttgcctaaaacgatgtatggattactatggacactgaatggtatccttatttttgccgcacaacccattattttttggataaaacgactgtacgctcatcacgcttcagcgcaaatgacatgggccggaggattttatttggcggcttatattgtcatgctgggcacacagaactatactggaatgatattcgctatggttctggcgaccctgggagaaatgctgattgcacctgccgttccagcattcctgtctgatcatggaggtcggggtgcacccttttacattgggcttgtggggggcattggcgcagccggacgggtaatggggccttatattatggggaagttgtatgatggcggtgggttaccgcctacactttggctggcatcaggcgtagcggtgttgtcgatcctgtttttcgtcctgcatagctggttgaaccgtttccggcatcattcggatactttggatactacgacgtccaaggtggatgctcccagttcttaagtcctaataaaagtgcagtaatatgctgtgattatggtacaatagtgacggatggttgtagttattgcttcaggaaagccttcacaggaaggattgaaaggaattgtttacaagtcaacccttgacgatacgtcattcggagatgaaggatgctcctgatctgatcgcgctggatgaattggtatggaatgaacgcacggctcccgcttcattgtcttggaagtcgcgcggagagtttctgcgcaatacgcctccaggctctcaactggttgccatcgaacaggaagtactctgcgggtatattggatttcgtcctccaacgctgttggctagtaactgtcatgtactcgaaataaatatagctgtacatccagcttatcatcgcaaaggtattgggacggccctcatgaactccatgaaggacattgcagctgcggagggcatacgtaagttgagtttgcgtgtactctcatgcaacacggaagcccttatgttttatgaaaaaagcggtttcgcgattgaaggacgtttgcatgaggagttttacatagcaggtcaattcgtagatgatgtgttaatggcctatttcttgaaataggcgggaggctacagacagcaattcggttgtatgcccgggcctaaaccaacaacgccgcagacctgatcaggtctgcggcgttgttgtacaatacaatattaccgaagttgcttccattcattttggagcataccgtacactgcgtggttcatgtagccgtcgggcagcaattccgcttcgcgtacaatgccttcgagcacaaagcccaaacgttccggaataccgcggctgcggcggttcgtagttgcgcaacggatttcgacccgatgcaagtccagctccatcaaagcatattcaacgaatacgcggcaggcgctagtcattagaccttgtccttcgtacccgtgtccaagccagtatccgatgctaacggagcggtgagtccaattgatctcatggtagctgatgatgccagcaagctcgttgtctatccaaattccggcggtcagactaccgttctctgcggcttgtttcaaggcgccctgcacgaactgctctgtgtggctgatttccgtggtagagtctacccatggaagccattgacgcaggcggtcacgggacatttcgatcagctcaaacagaggctgcacatgctccttggtgagcggccgaaggactgtgcgttcgtccaacgcatatgtaaacatgattgatcccctctttcactcggaaaatcgctaaaccagccagtctagcatttaatcccatgctaccttattctgcgagagtcgtcaaaagggagaggaagcttcaaattcaataggtcccacccggaaccgttcatgctcgtatacatatttcagatccaaatcccctacaaattcggttggggatacactgccagatacagtggcttgcagaggaagctgttcagcatcatacattacgacagagctaaaatcgagatactttgtaaattgggctggatcatcgtaaaatacagatgctttagggtttatcgtgtgtgtaacaccgtcaatcgtgacagcaatatgaacctggcggttgtggtcacgtagctccactgagctatgtacgcgctgggacacagcatctactgccgattcgaccgcatattcttccatcgtgcgtgcgttaacaatatgcaattcctgcaattcgacacccgttcccgaggcacgcgtgaggatcacgacggcttcacggacaccatccccgttcacatccctataaaataattgtggtgcggtggagatatccgccgagcctgaccatcggaatgtgcggcgttgctggccgatttccagtacagctgattggaataatccctgtgacggattaacggcatataagcggacggatgagtcttctggagcgctggctagcggacgagattgtacggtttcgttcactgggtccgatgaaggatggccggaagtcatgacggaagaggacaaaagcatagacagcaggatcacaatgagcagcttaaacacgggtgggtctccttttccgggcaaaataaaagatatatacactataacgaatttatttgccgaaaatgttaactctttttcataacttgtcactttttttgctgaagagagcataaggattttcattttattgagttatgcggtgtgaaagggtatatttaagggaacaggttttacacagattatacggaagaaaggttgattagcgtggagaagccgatcactccccccaattttattaaaaatgttattgaagaggatctacgtacgggtaaggtaaaggaggtcgttacacgatttccgcctgaacctaacggatatttgcatattggacatgccaaagctatctggatcaatttctcgttgggagatgaattcggaggacgcaccaacctgcgttttgacgacactaatccggcgaaggaagacacggaatacgtgaactccattcaggaggacgtgaagtggctcggttatgaatgggaggaaaaacattttgcctccaattatttcgaagaaatgtacaagcgtgccatcctgctgatccaaaagggtaaagcctacgtggatgaccaaagcgcggaccaaatccgtgaaactcgtggtacactgaccgaaccggggcaaaatagcccttatcgggatcgcagtgtggaagacaatctgaagctgtttgaagagatgcgtgcaggcaaataccaaaatggtgaaaaggtgctgcgtgccaaaattgatatggcttcaggaaatattaatttacgtgatccggttatttaccgcatttcacacacagcacatcacaatacaggcgacacatggtgtatctatccaatgtactcctatgctcatccgctggaagatgcgattgagggagtaacgcactcgctctgttcgctggaattcgaagatcagcgcccgctgtatgattgggttgtagctgaatgtgagatggaaaaggtaccgcaccaatacgaatttggacggctgaacctggctcaaaccgtaaccagcaagcgtaagctcaagcttctggtcgatgaaaagcacgtagatggttgggatgatccgcgtatgccgacgatttccggtttacgtcgtcgcggctacacgccggaagccatccgcagcttcgtatatgagacaggcatttccaaagcctacggagtcatcgatttgcaggtactggagcattttgtacgtgaggatttgaagcttaaggcaccccgcaccatggcagttatagatccgttgaaggtggttatcacaaactatcctgaaggacaagttgaaatgctggaggcggaaaacaatactgaaaatccggaactcggtacacgtcaaattccgttttcccgtgagatttatattgagcgtgaggacttcatggaaaatccgccgagcaaatacttccgtttgttccctggtaatgaagtacgtctcaagcatgcttacttcattaaatgtaacgatgtgattaaggacgcagacggaaatgtaacggaaatccactgtacctatgatatagaaaccaagagcggatcaggctttactggacgtaaagtgaaaggcacgatccactgggtagaggctactcaggctgtacctgccgaattccgtttgtatgagcctttgattaacgcagaggacacggaagagattgaagaggatgcatcggaaaaaacattccttgaccaattgaacccgaactctttggaaattgctcatggctatgtcgagccgaacatgaaagaagctcaatcgcaggacaagttccaatttttccgtcatggttatttcagtgtcgatccgaagctttcccaaccgggtcagcctgtatttaaccgtgttgtatcgttgaaaagctctttccaattgcctaagcaataggctggtggaaagtgtgggagaaatggtagcttcgtgcgaccaagttgaaaaggagtctgccgtcggcagactcctttattttacgcatgcacactctttatacatgatcattgacttgacgatactctattgtctttgctaacgagccagaagggaggatagctcattcctctagtgttgttaaggggcttcttctattcgtttgtgcccgctggcagtcctggctggtaaccgttcttgtacagcatataccacatgatagcgaatcccgcagatccaagtagggcgaagaacacccctgcatggtacatcatttctccaccaaagttctggaatagccatcctcccgcaaaacctgctacgataccggatataccactccaggtcaaggtatatacggcctgtccggatgatcggtatgctgcaggggtaaataggacggtcaactgggtgcctacatagaagtatccaccgaaggtgacgcaatgaagtgcctgaatgaacacaatctgaatcgggtctgtggccagagccatcagttcccaacgtaaggcaaacagcaaactgacgagtgccaaacagccgaccatcacggtcatttttttcttcaagaagcgatcaaacagcaaaaatacaataatttcgaataccgatgacataaaaacagcaaaaccaagcatctgtttggacccacccagctcggtgatgtacagggacataaaggcgctgttgatcgaattcgggatggatacaaggatgcccaataaaataaaggatataaagtatccgttcattaaaacactgccaaagccgcgcaaatggatggtcgctgtctccacagtgcttttcagtggtggaatcgacaaggtgcagatcaatgcagccagaagaagtaccgtaaagatggtggatatgctggatatccccgtttggtcaataactatgccggcaactgctgctgtcactgcccaaccgaaagagccccatatacggaatgcaccaaatttccggtctgtgtcctcaatataactgagaatcaggctgttgctttgcgcaaataaagggctttggaaaaaataaaaaccaatcatcgacacataaatcatgatatacgtatggacatgaaacaaagcttgtagcaataacaaggtacctataatcataaatagcagaatacgtcggaggttacggctccggtcgcttgtatagccccaaaaagggttcgcaaatacggatacaaaaggcccgatggccatcagactcccgatctccagcttgtccatgccgatatcttgcagatacaacgggaagaagctggagaaaatgaccatagctccatatagaaaaaaattatacagttttaaggaatatagaggagtctcttgaatttctctcttttgcaagacaagccattcctttcttagcccgatagagaactgcgcatcgatgccgatctgtggggaggttctttattccaatgtatcatgtgttgaaagggttaacaaaccaataaattaacaattatgtaataattaaattttgttcaaaaattcatatgcatatttgcaattgttttctgaaaaaaaaggaggatttatttgtgaaagtgactggtattatcgtcgcaggaggacgttccagccgaatgggacaggataaggctttgcttgagatcaatggagccactatgcttgaacggacgtatactacattgcagcaggctgcccagcgggttgtaatagtcactcgtgacaaccaaggatatggtctgagtggtatggaaactgtgtctgatgtttttccaggtatgggacccctaagcggtattcatgcgggattatctgcatctactacggagtggggaatggttgtcgcttgtgatatgccttttatacagctagaggtgctgcaagacctgctcgttgtaactgagaaatggacggagttgcatggaacgacggaaccaacattgcaagcagtaataccttctatggatggacgtatacatccgttgctggctgtgtaccatcggagcgtgctgccgtctgccgaggaatgtttgcgcaatagacagcttcgtctcaccgattggttgaacaagctgaacgttcgttatgcgacggtagaggatttgccgcgggtgagtgaagacatgtggcataaggccgcgttcaatatgaataatccgcgggactacgagcttgcgttagagcagttgaagcatagtgtacaacagaacacgcagaacgtgaagaatttaaaggaaatacgagaggattagaaacgtacaagcttcctgcgcgaggactatttaggagagcaaatactagagaaatatgatggactaaaattgggggaatataattatgctggaagctattatccatgctgttttattggcattgggattgattttgcctttgggggtacaaaatgtatttgtatttaatcagggggcgtcccagtcgcggtttcgcaatgcactgcctgctgtcattacagcgggtgtctgtgatacaatcctgatcacgcttgcggttgggggcgtgtcccttattttgcagcaatttctatggctcacgaacgtactttatgcggcgggctgtttgtttctgctgtatatggcctggactttatggagatcgaaggcagcttcctcgggagaaagtcaggcgatgcggccgaaacgccagatgatttttgccgcttcggtatcgctattgaatccacatgccatactcgacacggttggcgtaattggaaccagctccctccaatatgacggcggggaacgctgggcctttggtctggccgctgtgtccgtatcttggatatggtttatcggtctggcaacggcagggcgtctcgtgggacgtatggattcagaagggaagtttgggactgtgctcaacaaaatatcggcactgattattttaggcctggcaatgtatatggcgataaattttattaccagtatgtgatccaagcctggttagaggaaaaacttcaatacagcgaataccccgctcaaagcaaagggaacaccgatcaaaaacagcataaaggccagacagcctgcaccatttacaccgcctgcaattcgggcgtcccgagggttagatggattgtataatactttaatcttgctgccaactcggttaaggcttaggttggtgctatagatgagtagcagtccaatcaagctgaacaatggcatcagcaaatcggaactaaaatgaaaccaatacacattgaaatcaattgagatgataatctactcctttaaacaaagcgataatcaatatatcggatgttttttaggaaccgtttaatagctatgagaattacttattgctcaatagagacatatcaaaatcaacatcctcgataaattcgataacctcaccattggggctgtggactaatgcatttgttacaactagaggaggttcaccaagtgtaagctgattgggttccacaagggttcttgctccgtgggcaagggctttttgatatatttcatccacattaagagttggttgaattttgtagagaggcgaaggaagttaccgatttatttcgcatcagtggggaatttaattatctcattaagatacaaaccgcgtcggtagaggaaattgcagagcttcaggattcattagttaagctggggccttcgaagtcgcatatttgtatgaaaaatatactggaaaacagggttttgctgtaagcaactcgaaaacccacatttggaatatagagcattcggaaactgtatttgtgaaatgaagataagcgaatgcttggatgaaataaaaaaaatgacgctgaattacaacagcgtcaccgtaatgccctgctccagacgcttcacgtcctggagctcgatcttcccggccatggcgtgcagagctgccgctgtgccgcaggccgctccctgccgtagcatggcagggagatccagccccgtagctgcgccggtgaccagcccggcgaccatagcgtcaccgctgccgagcgcgctgacaatgtccgcgtctggcaggctcacgcggtagcgcgcatcgtgcgttaccgccagcgccccgcgcgcgccgagcgagatgacggccagctgcgctccggcttccagcagctttgctgccgccgcttcagcggcatccggacgcgcggcgtcgattcccgcgaagcgagcggcctcgtcctcgttaggcttcacgaggtcgggctttccgcgcaagcccaagcgcagcgccttaccgctcgcatccagcgctacccgcgcgccgcgtgccttcgccagcgtgcacagctcggcgtacagatcgggcgggcagccgggtggcaggctgccggagaatacgacccaagccgaatcctcggcaagggtctcgattttgcgccgcagtgcggctaattcaagcggcccaacggtcggtccgctctcaatcagctcggtctgcgtgcgcgcggacgggtcgagcacggtaatggcgagacgtgtctccccatgtgccgtttcaatgaaatcggtgcttacgccttctgcgctcaacccgtcaatgagcagccgtcccgtgtgtccggcagcaaacccggtcgctcgtacaggctcacctagcgtgcgaatgacgcgggcggcattcacgcccttgccgcccggtaccgtcaggccgccttccatgcggtggacggcattcaaaccgaagcctgcaaccgtgtagattttatccacagccgcgttaagtgttacggtggtaatcacaaggcatcactcctttaagatcagcaattcgcaatatttgatgccattcgctcatgctaagatattagctttaatcccaacgctgcggcaagaatcatggcgatgaataaaacgcgcagtacgcttttttgttcaccgtacaagaacatgcctgtaatcgtgctgccaaccgttccgatgcctgtccatacggcataggaggtgcccataggcaaacttttcatggcatagctgagtagagagaagctaagaacaaaggataggaccataagcactaaggacttccagcctttgcccaccgtaactcccttcataccgatgactcctaacacttccgagcaccccgcgataaccaatgcaatccaagccattatgcgccactcccttcctgaacatcacggtcggtaactaacttcagaccgaccacacctgccagcaaaagggcgattaatagtgttttggaccattgaaacggttctccgaatagcagcatttcgcctacgactgttccccctgtccctagtccggtgaatacagcatacactgtgcctacaggcagtcggttcgcagccttcatgattaaataaaagctggccaccacggccagcacggttacaatccaggcgagtatagagtccgcatgcttcaaacccgatacccatacaacctcaatcaggcctccaacaaaaacgtaaatccaactgcgattcatgatgaatgttctccttaaaaataaattttataagttcgacggcttcacgcttcatgaggtgaggttaacgtaatcccacgccaaaaaataggccatgcagcgttcagtcttcggtggtagttgatgcttccactgtacaggagctccaccatgaccccgtccaccagggtcatgtaagccaaagccacatccactggctccatatgcccaaagggttcccgatcccgtgtattccggaggcggcgagttaatttccgctccattttatccagaaaaggattaacaatattcagcacctcgtgatacaacgatactggcggaaagaaggaaaagcgaagcataaacttggctgagtcgttgctctcatattcctgtcccatccaaaacaagaagtcatgcagggtatgcttaagcggctgatctttacgttccgtaaagtattcgaaaatacgtaaattctgctcttgaaaagcgtacctagccacctgtagaaacagatcctccttgccttggaaatgcgcgtatatagacggttttcggataccaacctcagcggcaatactgctcaaggaggctccctcatacccattggtggcaaattgaaaaagagcggcctttcgaatctcttccatccccattattatcacctacctaacgttcgttagtttattcttgcacgaaaaaaagcaagtgtcaacccagcatcattgcgttttgtataaagcttttctttggattttttttatcaacattttaataaaaaagtgggaagaaataaggggctcatgtacaatataatgaagaatacttgtcaaatgcagtccactggaagtgaggttagttatgaggcgaagcttactggccgtattgatcgcggctatggtgtttattatttattattttggcttgtttaattacatcggcaaaaatgaaggaactgtcatcagtattttttccaccctgacagtgatctccatcagtctaattatttttacggagaatcgtaatccctccactacgatgtcctggattttgctgctggcattgctgccagtcgttggacttcctctttattttctgtttgggcaaaatgtattcaagcgtcgcaagtatgataaaaaggcattgcgtgaccaacaggcttacgaccgcatagaaaaggatgctttgcgagtcaaacgagatctgacctgctttacaggtgagcagcagcagttgatgcgtttggcccgcagactggcccgctccccgatttattttgcgacagaaactcaaattctgaacaatggagatgaaaccttctccactttgctggaagaactgcgcaaggcgcagcatcatatccatatggaatattacattttccggtcggatgatatcggtaccagcattcagaaaattttgatcgaaaaggctaaagcgggtgttaaggttcggtttatgtacgatgcggtgggcagtattcagttgtcgaagtcctttttgaaggaaatgagagatgcaggagtagaggttgttgcgtacggcggcgctcggatcttgttcttctccagccgggtaaactatcgtaatcaccgtaaaattgtagtcatcgacggtaatatcggattaattggcggtctaaatgtgggagatgagtatctcagccgcaacaaagcctacggcttttggcgtgatacgcatatgattgtgaagggcgaagctgtacggacgttgcagcttatatttctacaagattggcttcacatgacgggtgagtcggtgctcgatagcgaatatctgtctcccaatattgaaccaattacggacggaggcgtgcagattattgccagtggcccggataatgagcggagagtactcaaaaatctctttttttccatgatcacgtccgcccgaaaatcagtctggattgccactccttattttatcccggatgaagatatcctgactgccttacggatggctgccttgtccgggttggacgtgcgtattctgtttcccgcaaaaccggataaatggctaccgtttctcgcgtctcattcgtacttccagtcgttactggaggttggagtcaaggtatatgaatatgagaaggggttcctccactccaagctcctcatcattgacggggaagttgcgacgatcgggacagccaatatggatatgcgtagctttcatttgaattttgaagttaacgccctgttaattcaaacgcacagtgtgcagcagatggtaacagactacgaacgagatttgcactctgccagcctgattgtacgtgaagaattcatgaaaaaacgtctgttcaaacgtttgatggaatcgctcgcgcggctgctttcaccgctgctgtaagcataaacgaattcgctacagcagtatcccgtagttaaaatgtagtaaagcctaaaatatcctgtagacggtatataatatctttccaaaatgttgaatgatcctcgtaagctgctagatccaaactgtattcagccccctgattattccatagcttatcaaaataggccgcaacctgtcgggtcagcttgctgtccgccggagcggccacccacaactcattttccagattcaaatcatccagattacggggggtcagattggtagagccaccccaaatgatatgctctccttgcgccttggcgatataaatcagtttggtatggaactgctcatgggtggtatgataccagcgaatttgaatgttcccgcccgatttatcggacaactcctgggcaaccggacgattggggatgccgattttttcctgaccaaacgcgttttgattggggtccagcagcagttggatgtttacaccgcgggcagaggcatccagcaggctgttcaatactttgcggtcagccaaataaaacatgcccatatgaatgctgtcacctttcttcgtctgcgcaatgccatccagaactgaggtgtataccttgccctcagttagatatttgatccgatagctgtccttactcgatggaactttggattcggcctgtggtgtataggcaggaagctgcccaccgcccgaaaagtccaacaccgcctgctctgtttgtaaaatgtctccgatgataggccccttcacctccagcgctacattggagtgataggcgctcgcgtcgtgcacgttgcctgtagaaatgagcgctgtctgttcgttggcaaccaattttcggtgattggccttgacgttcaacagcttaagataggagcgagccgtaacatcaggtccgtcactggccatcaggttgggaatccagcctgtgccctgctgcccgaaccattggaaaaaggtacgccacaccgccgaatagatgggggtggagtcccgcaacgggtctacatcggtctgcacgacttggatccctgctcgcttcatattctccaacaaaggattgggggcagaattatagttggtattgacttcatctgtaatgaaaaagataggcatatccggataagctttctttttggcaataagatgatcggtcatttgtgcgctgacttgggggaagtgctgacctttatgcttatagtcattgaacagaaacaggtcgatgacaataaattgttgggcttcatcaatgatcccgagcatacgattgaaaatttgaccttcatgctgtgcagtgcttccatccccggtgggataggtcaaatctgtccagaagtttacctcatgggtcgaatactcctgactctcataagagacgaacggaggcaatggtttatgggtctgatacagcatgacggcaatcagccagaggataagtaccagaatggcgattttaaaagcccgaccctttttctcagttcttctttgatattccggcacagaatgcagcggatcacgtgtagtcatatgacgatcaactcctcaattgaatgctgcattccattttatcgtgccggaacatgcagttttatgatgggatactgtcaagttattaacgcaagtgtgcaggattgacgcggatgctgaatggaatgaattggaggatgttttactattcgttgaggacatatgtcctttataggaagtctgccctataatttaatatatagaaaagtcatttacatggggagaataacgatttatgagaggaatcttgtttgcttttctgggaggagcgtgtattacgctacagggggtagcgaatacacggattagtcaggatatcggtacatggcaggcggccactgttactcagctaataggctttattttggcagcattagtctggatgtttacaagggatggcaatgtggctgaactgaaacaggtaaagccgatgtatctttggggcggtgcctttgcagcaattattatttttagtgaagtcacggcaatccaacatattggggttacgttcacgatctcggcgttgttgattgcgcagttgtgtttaaccttcctggtagatattaagggatggttcggtatagtgaagcaaaagatgaagctgccacaatttataggtattggtatgatgatcgcgggtgtaattattctgaagctttaaaatagaaatttaacttgtaaagaaagcttagaatgtagagattgaaggtgagcttaggaatgagagaaattcaggatcaagagcagctaaaatattttttgcagctgcatgagttggaatccatactctacgagccactacatccttatttgtcgttgcatcgtttggagcaaggggaaaagctctgtttacagggggaccccatcgagcatctatatatactggtgcagggcaaggtcaagatttataccagctctacagaagggaagaccctgattctttgcttcaaaacaccgatcgaggttataggagatgttgaatatattcggagtagtcacgtcatcaacacagtagaggcagtgtctccgatctatgtgatcggtattcaccaccaatggatgaacaaatacggcagagactatgctcctttgctgcaatttctattggatattgtcacgcgaaagttttgcctggactccgacttttccagtttcaatctcatgtatccggtggaagtcaggctggcgagctacctgctatcggtttcttttgacgaatcgaatacggcttttcatgaggaattacgtgcatccagtctggtagatgtggcgaatttgatcggaaccagctatagacatctcaaccgtgttattcgcaaaatgattgaagatggatgggttgaacggacaaaaggctacattgtcattcgggacagaaaaggtttgagtgaactggcaggacataatatttatgaatcattgtaatatgggcatttatgaaagcagaagaatatcaaggatcatcaagggagagttaacatatgttattaggaattgtattggcgattatcgcaggtgccttggtcagtctgcaaacgatattcaataataaggtgaatgaacggacaggatcgtggactacaacaacattggtgctgggaacagggttcgtggcttccttactcggaagtcttatttttgaagggaaaaatacatttactttacagcatatgcagccgtggtactggttcagtggcatgattggtgtcggtgttgtgttctgtctggtgcaaggaatgaagcgacttggcccgacctatgcgatctccatagtattgacggcgcaattaggcacggccctgttgtgggattcgttaggatggctgggattagaaaagattccgtttacctttaacaagttgatcggagtattggtcattatcggtggtattctggtattcaaatttggacatgggcgtacgaaggaacaagcagaaagcatttcatctgtacctgattcgatgaagggatagaggagattgtaaatggcctttatcttgctggaatagggatcgtcctttcgagtaggcattttgcagaaaagcggcagttcaattaggagcggcttttctgtagagtttccgaaataactggtttattgcaaattttgaacatggccatgggtaagaaaaaatgttcacgatcgtgtatatatttttccatccatgatacaatgaaagtatcttaaaatagccactttaagggctacgatattgaatataagagacgataaatagatcggttaccgtgttcgggaacggtcttatttgtgcttcttgaacttgatgcaataacagagtgactttggatgaggtgggacatagatgagtagtacggataatataaagggagcacctgacggttttaacaaatccggctctttgctgcctgccgcaaggacaggtgaacggaagattgagcacgtccgcctttgtttgcaagaagatgtggccggacaaggcatcaccagcgggctggaacggtatgcctttaagcactgcgctctgccggagttgcattttgacgaggttcgtctggatactacttttttaggacgagctgtacgaacaccgctgcttattagctctatgacaggcggcagcgccgagacaggagcgattaatgagcgactagcagagacagcggagagacgcggctgggcgctgggcgtcggttcggtacgggctgcggtggaaagggaagaactggcctcaacctttgcggttcgcagtctggcacccagtatcccgatccttgccaatctgggtgcggtgcagctgaactacggatttggtgtggatgattgtcgccgtgcagtggaaattgccggagcagatatgttggtgctgcatttgaacggattgcaggagatttttcaacctgaagggaatttggattttagcggtttgcttcaacgcattgaggagttgtgtcgtcagctttcagtgcctgtaggagtgaaggaagtaggttggggcatagatggcgagacggcatcgagactgtatgatgcgggtgcagcctttatagatgtcgctggcgcaggcgggacaagctggagccaagtggagaaatttcgcaatcctgatcctgtgcgtcgcgcggcggcggaggcgtttgcggattggggcaactcgaccgctgattgtatcgtggaagtcagagccgctgagccacatggtgctctgatcggcagcggtggactgagagacggtgtcgatgcagcgaaggcgcttgctttgggagctgacatggcaggcttcgggcgttctttgctcggttctgcggttgcctctagtgaagcgctggaggcacgtatggagcaggtcgaactggaactccgcacggttatgtttggtattggggtagatggaatagaaggactcaaaaatacgactcgactaagaaagaaggtaaacggatgagcggacttattacattggttccgatgaatgcaaagcaatatgatcaatttgaacaacgctcgcttgccgactacgcggatgagaaaatccaagcgggtacatggacggtagaagaagcaccagaacgtgcggcagaaagttttgctcgatacctgccacagagactagacacacctcatgctcacctgtatatgttgatgttttccgatgccggggggcagagtcaggaggaagctggctacatctggttcaatattacggacggcgtgcaaggaaaagaagcttttctactggatattcttgtatacgattcataccaggggaggggtctaggcacgcttgcgatgaaggctttggaacaggaggctcgcaggctgggagctgtacgcatcggtttgcatgtatttgggcataatgagcgagctttgcatgtatatcgcaagtcgggctatcggattacagatatccagatgagcaaagaaatctaaatagggatatagcaatatcctgaatttcataaccgtatgcttgccgcgtgtataggttctcatatataatgtgggttggtaaactaacggatggcataacgcatattttatataaacgggagttgttctgattatggctttaaaagcggggattgtgggcttgccgaacgtgggcaaatcaacactttttaacgcaataacgcaggcgggtgcggaatccgcaaactatccattttgtacgattgaccccaatgtaggcgtcgttgaagtaccagacgagcggctggataagctgaccgaactggttgtgccgaataaaacggtgccaacggcatttgaatttgttgatattgcaggacttgtgcgcggtgcgagcaagggtgagggtctgggtaacaagtttttggctcatattcgtgaagtggatgcgattgtacatgtggtacgttgctttgaagatgagaacattacccacgtggacggcaaaattgacccgatcagcgacattcagaccattaatttggaactgattctggcggatatcgaaagtgtagacaagcgtattgaacgttcccgcaaaaacatgaagggtggcaacaagcagtacacccaagaggtagaagtgttggagcggatcaaggaatcgctgtatgctgataaacctgcgcgtagcttagagttgtcggatgaagaacggttgattgtacgcgatcttcatttgcttacgatgaagcctgtactctacgcagctaatgttagcgaagatggcgtaacggaagcggatagcaatccatatgtgcaaaaggtacgcgattttgccctggcggaaaatgcagaagtggtgccgatcagcgccaaggtagaatctgaaattgctgagctggaaggcgaagacaaggcgatgttcctcgaggagctgggattagctgaatccggattgaaccgtctgattaaagcagcttatcgcttgctgggcctgtatacgtatttcacagcaggtgtgcaggaagtacgcgcttggacgattcacaaaggaacgaaggcaccgggtgctgcgggcgtaattcatacggattttgagcgcggatttattcgtgccgaggttgtatcctacaacgatttggtcgctgctggttcgatgaacggggctaaggaacgtggtcagcttcgtctggaaggtaaggaatatgtagtgcaggacggagacgttatgcatttccgctttaatgtttaatatataatttccagaatacaatacctgattcggatatataaaagacgatgacttcatgtatgtgtgttctgaaaggtgctagattacgtggtcgctgcctatattagggcggcgacttttttattgttttgcatgttgtgtggatttttgcaaaatcctaaattagtcagtatttcttgtagctaattcatgaattagttggtataataaagagctgtagccagtgaaattgaagctggtttcatattaatttaactgaagaggtgaatcgcttgttggaccgattgcaatcattggcggaccgctacgataaactgagcgaactgctctgcgatccggatgtagcgaacgatagcaaaaaacttagagattattccaaagaacagtctgatttacagcctgcttatgaagcatataccgaatataaaaatgtcgttgaagagctggaagctgcaaaaaccatgcagggtgaaaagctggacgacgagatgcgtgaaatggtcaaaatggagattgaagaactgagtgttcgcaagcgggagctggatgaaaaaatccgtattttgctgctgccaaaggacccgaatgatgataagaacgttattattgagattcgtggtgcagcaggtggtgacgaagcggcactgttcgcagctgacttgtatcggatgtatactcgttatgccgatactcaaggctggcgtgtagagctgatggacgcgaacatgaatgatctcgggggctttaaagaggttattttcatgattaacggtcgtggtgcatacagcaagatgaaattcgaaagcggcgcacatcgcgtacagcggataccgacgacggaatcaggtgggcgtattcatacgtcgacatctacagtatccgttatgcctgaggccgaagaagtggatattgaaatttccgataaggatattcgcgtggatacgttctgttccagcggtgcgggcgggcagtccgttaatacgaccaagtcggcggtgcgtgtaacgcatatgccaacaggtattatggcaacctgtcaggacggaaaatcccagaactccaataaggagaaggcgctgcaagttttgcgtgcccgtatttcggatatgttgcgtcaggaagaggaagccaaatatgcaggcgagcgtaagagtaaagtaggcaccggtgaccgcagtgagcgtatacgtacctacaatttcccgcaaagccgtgtaacggatcatcgtattggcctaactatgcataagttggaccaggtgatgaacggggagatcgaagaaatcgtatcggcgctcacgattgcagagcaggctgatttgatggaacaagaggtttaagttttggggaacgaacgcgattgtgtgtatcggatgccgccggaacggaacatgagtgtcagagaagccttagttgaggcttcttcttttttaggaagctgtggcgttctggagccgcagcataatgcccgtttgctgctggagcatgtgctcgggttggaaggtacggcgttttacgccgctttgggtgatccgttcccttccaccgccaaggaggcgtgggaacggatcatagcccgcaaagctgcgggtgaaccggcgcagtatattatcggacggcaggaattctatggccgctcgttcatggtttcgccgtcggtgctgatcccacgcccggagacagaactgctcgtcgaggcgatactccagcacggcgatcggctgtggccaagcggcgctccgcaggcgctcgacatcggcgcgggcagcggtgcgattgccgtgacgctggcggctgagcgaccgagctggcgcgtggcggcaggggatatttcggctgccgcgttaaaagtagcggctcataacgccgctgcgaacggcgcagccgtagaattccgcgagggcgatctgctggcgccgttcgcgggaacggcggtggacattctcgtgtccaacccgccgtacatcccggctgctgacatcgctggcttacagccagaggtccgcgaccatgagccgcggatggcgttggatggtggtcctgacgggctcggcccgtatcgggcaatgctggagcagctcggactccttcaggctccgccccggctaatcgggtttgaattggggatgggacaggccagagacgtggctgacctgctggaacaggcgggtcattggaagaacattataatcgttcctgaccttgctgggatcgaacgacatgtcctaggtgtctcggagtagtgctgcattttctttttgcgagtctttcctttagaataagaggagtatgaccgagaaacggctcagggggaaatcatgcttcagaaattgaaaaaaattgacggtccggttatctttattctgattttgctcatggcgattagtatcgtaacagtatacagcgcaggtagagctcctacgaacctgcctgatcacggcaacgattaccagaggatgattgggtattatatattgggttttgtggcgatcttgggtttagcgatagtcgattttcggatattcattaaaaaagccctgtacgtatatggaggcggaatattcctattgggtctcggattttttggcgggacggttaacaactctcagggctttctgaaaattggtggcttgaatcttcagcctgctgaggtattcaagctggtccttatcatttttctgacttatatgctgatcaaaaagcgcaagagcaagctgtattttattcaggatgttcttccagtcgctctggtgagctttgtcccgtttgccatggttatggcacaaaatgacttgggtaatgcgctcggttacattgtcatcgtcattggtatgctatggattggtaatgtgaaggcatcccatgcgttaatcggattcatcgtatttgcagtcgccgttggtggcgggatcaaggcttatatttcgtttcacgatgagattgattcctttatgaaggggattggccgtagtcactgggttgagcgtttggacccttggttggtaccggaagaggcaaccgcgaaggcgtcttatcataccaaaaatgccaagctggcgatagcctctggcgggatgatgggcaagggctttttgcaaggaacctcggtacagtccgggcgtgttccttatacgtacgcggattctatttttgtggtcgtagcggaggaatttggctttgtaggctcttcagcgctgctattgttatattttattttgattcaccgaatgatcctgatttcgctggaatgccgggatcgcgccggaccgtatattattgtcgggattgtgtccatgttgctgtaccagatttttgagaatattggtgcgtttctgggcattatgccgcttacggggattacgctcccgttcataagttatggaggtacctcgttgcttattaacatggctagtatcggcttggttatgagtattaaggtgcacggccaagagctggaggacgatctgccacagccttccagagtaagcttgaggaaggcgaaaaaagcctaatgcaggtggatttggcttgaaactgattggcatttgtgtgagttgaaacggtgcaacgagagagtccagattgtgaaatctgggcttttttatatgcctcggtgagggtcagaagcttggtgtagcatgatttgagggtgtatggaagaaaatctgtaaagtgttcttgaatcttttacaagatgcataggtttagactctcccaaaccggatagactgatagacatgatagagtttgggtttgggggagacgaagatgagaaattggatcaagcaagctgcaatgatactattttgtatttcgatattaatgatgtcttgggaaggtcaaaagacggatgctgctatgactactggaacaagaggaaccttagcatcaggagtagctacaacagggctgaatgtgattccacatgactccattcgactgcgtattttggccaactcggatcgtccggaggatcagctggttaaacgcgaaatacgggacgctattgtacagcagatgaatgcctgggtgggtgagctggaaaacccgcaaagcttagatcaagctagatcattgattggtgctcatttacctgaaattgaccgtttggtaggtacggaactggctcgtcgcggcattgcatatgatcatcaggtggaactggcgagcgtacctttcccgacgaaaatgtacggtggtctggtctacccagcagggaattatgaagcgcttcgggttacgctggggcaaggaaaagggcaaaattggtggtgcgtgctgtttcctccgctgtgctttattgatgcaggcagtggtgaagcagcggcacaaacagtatcagcaaaaacggatcacggagaaagtcggacgaatgccgctgacaaggagccggaagtacgtttttttctgtgggatgcacttgcgggactgtgtagctgggtgagtggcttgtttgcctaaacgttgaggagtgtaagtttccccatatgctataatggagcttacgatagatatacacatggcagagccaaataaactgatctttcaaagtagccttagaggatcaagcgaaatcactggcctgtatatgacaataagatatgggatgatctgatatgagtgataaatcgaatcaaatgcaagacttgcgcggagattttgtgcaaaaggaaaaatcggagcaaaagctggacgaacaggaaaattgcgagctgaagcaggcattgaggtcttcccatactcaatggtgggatgtaagatgtttggttcctgtgagcaacattgatggggatgtttctgacgaagcttgggctgaacagactcggatcgcggcggaaaagggcatacgggaggccggcgtactcctccaagctggagagacggtagcctttcctacggagaccgtgtacggcctgggggccgatgctcgtagtacaaaagcggtggaggcggtattcgctgccaaaggacgtccctctgataacccgctcattgtacatatttctgatgctgatcaattagaggggttggtagcagaaataaacgatacggcccgagcgctgatgaatatgttctggccgggaccgttgactctcgtattgccggtagtgccgcaggcactgtcatcgcgtgtgacagccgggctggatacagtcggagtgcgcatgccggatcatccgatagcccttcgtttgatcgctgaagcgggttgtccactggctgcgccaagcgccaaccggtcgggaagacccagtcccacccttgcacagcatgtgcgagaggatctggagggccgcatcggcggcattttggacggaggtcccacgggggtggggctggagtccacggtggtgcaggcgggtgacgacggaaccgtcaccatcctgcgccccggcggcgtgacggctgagcaactcgctgcggttgctcgcgccgtcgtgctggacccggcgttggctgttacgcccggggaagacgcggacagcccagcgccgcgctcgccgggcatgaagtacacgcactacgcgccgcgaggccgcttgagcgtggtacaaggcccgtcgtccgttgaggtgacgggctggattcgcgccgcgctggcggaggcttccgcgcgcggggagcgcacggcagtgctcgcgttcgacgagcatgccgccggttacgccggagaacgcgtctacacgctaggcaagctggacgcgctccatgaggcagcgcagcgcctgtacggcgtactgcgtcgctgcgacgaggacggcgtcacctacattttggcggaatcctgtccgccgaagggattaggagacgccgtcatgaaccgcctgcttaaagcggcaggtcaccgaatcgtccgcttgtagcttctgtcgaatcagagcctcttatattaaattttcctccctcctcgtctcggtattgggtactttcagtacatgcttgtactgatttgccccttgtccgcataacgtgtacaagaacagacggataatggagggatggagtatgctggcagcctctgcccatgccgggcaggttgtaacgattctgatcatggcggtagcgctaggaatggatgcgttatcgctgggcgtagggatcggcatgaaggggatacgcctgcgagacgtgctgcgcatcagtactgtcattggcttttttcacattctgatgccattactgggaatgttcacaggccattatatgagttctttattaggtcatgtgacggcctacttcgcagggggtctactcatccttttgggcgggcatatggtgtataattcctttaaaggagacggcgtacaggtattggatcatcgttcgcctttaggccttttgctgtttgcacttggggtgagcgttgactcattttctgtaggagtgtcactgggtatgttccaaagtgatctggtgctgtccgttctggcgtttggtttttgcgggggagcaatggcgatgctgggcctgctgctgggtcgcaaggtcagccgtaatctaggagattatggggaagcagtgggtggtgccattttgttggcattcggctttatgtttatgttttgattttagtgtagacagtgtaaaataagtgcagggttatcgtaaaggattaggattatagtaatcctctgtttatatattttttaacatacggggggtgaaaacgttgaagaatatcttattcgtatgcacaggaaatacctgtcgcagtccaatggctgaaggcatgctgcgtaagttggctgctgagcatgggctagaactggaagtgcgttctgcgggagtagccgcgatggaaggcacaccgatatcccgacatgcagaggcggttctacgtgatcacgatatatccgatcagatcacttcaacccctttgagcgacgggcttgccgggtgggcgcatctgatcttaaccttgacgcaaggacataaacagcacgtaattcaacgctttccccaaacggcgggcaaagtatttacacttaaggaatatgtggagaaccgggatgcggtgttgaatgatgtacaggagttggatggtttatatgcttcacagcagttgatggcttcacttggacaagagctatcggcgcaggagcgtgaacgaatgattgaattacaccaacggattccgggctttgatatttcagatccgtttggcggttcgcgagaagactacgatgtcacagctgcggaaatccgtacggcgctgcataagctgctggacaagctaaaggcttcttccgaataaaattagtattactcatctgttttgtacggaatctgttgattttcggccgctaatccgttaagataaggtggaaaaatgagaatccgatgtaactggcgacaaaagtgggattaaccacgatggagcatcggatatacggccggtcgcctgggcaaaagagcaattccacataggtgtggactgctctttttttcatatacaagttatgccagatttttagctgagagttgattcctttaaaggttcttccattttttctgctcgaaatctgaaacatcggctataatatagtcagattgtgatcaggagagagtgtgttgaatttggggcatgagaccgtgcctagtctctgagaggctgttcaaccaaaggaggttccaatagtgggacaattggatcatgagatttcgctagaagcacagaccacttctgttgtgcgggaaatcgcagaagcagccagtctcaaggctggtcgcctgctggttattggcgttagcacaagtgaagtggctggaagtcggattggtacggcgggagcgctcgatgtggctcagcaactgttgtctggagtagagtccgttcgcagggagtatggctttgatgtggcgtttcaatgctgtgagcatttgaaccgagcgctggtcgttgaacgggctgtgctggagcgattgggactgatggaggttgcagctgttcctgttcgtacagcaggaggctctatggccaccgtcgcctatcgttctatgagtgacgcgtgtttggcggcgaacgtgcaggcccatgccgggatagacatcggcgaaacgctgattggcatgcatctgcgacccattgctgttccatttcgcccaagtcttcgctggattggcgaagcacgtgtgacagcggcattcacccgtccaccacttattggtggacaacgggcagtgtatagtctggagcaagaagtcggcggaaactgcgattagcatttggcatggcggcattcttgtactaatcttttttgcattgatgatgaggtacccaacagaggagcaggcgtttgcttgtatacccaacaattgactatggagagggagtaatcaatcatgatggaacacctgcgtaaaagtgacccggcagtgatggaagcaatgggacttgaactgaaacgacaacgccacaatatcgagctaatcgcatccgagaacattgtcagtgaagcagtaatggaagccatgggctccgtgctgacgaataaatatgctgaaggttatccgaacaaacgctactatggtggctgtgaacatgtagatatcgttgaagacatcgcacgtgaccgcgcaaaagaattgttcggcgccgagcatgctaacgtgcagcctcactctggagcacaagccaacatggcggtgtatctggcagctctcaaacctggagatactgtactgggtatgaatttggcgcatggtggccatttaacacacggaagtccggttaacgcttccggcttgttgtataactttgctgcttacggtgtacgcgaagacaacttccgcatcgactacgatgaagtgcgcaaggcagcctttaagcaccgccctcgtctgattgtagctggcgcgagtgcatatccgcgtactattgattttgaagcttttgcttccattgccaatgatgtaggcgctctgtttatggtggatatggcacatatcgctggtctcgtggcagcgggaattcacccaagtccagttccgcatgcccaatttgtaacaacaacgacacacaaaacgctgcgtggtccgcgcgggggtctgattctgactcgcaaagcatgggcgcaagcgattgataaagctattttccctggtactcaaggggggccactgatgcatgtgatcgcgtccaaagcagttgctttgggtgaagcgctccagccatcgttcaaaacctatgcgcaaaacgtagttcgcaacgcacaggtgctggctgaaacactgttggctgaagggattaacattgtatccggtggtacggataaccatctgatgctgttggatacgcgcaatttgaatattacaggtaaagaagcggagcatgtattggattcggtgggcatcacagtcaataaaaatgcgattccttttgacccgaccagtccattcgtaacaagcggaattcgtattggtacacctgctgcaacatctcgtggtatggatgaagaggctatggtcaaaatcggtaaaatcattgctgaaacccttaaaaacccgaaagatgatactgtattgtccaaagcaagccaagcggttggcgagttgacagataagttcccgatttatccaggaactcaatactaattcatcgacattcataatttttatattataggctgttttccttccgtaagccggaggagaacagtctttttttgcttccgaacgactcgaaacatacatttttgggtaataagcgattacagtaagggtttatgcgcgctttccttcatgatctacgacaaaggagtgattgcattgagtcaaagaaaatccgcgcaattattgcagcaactcgtatttgtgggaccgatggcgttgtttttcgtcttgattatggtcattccgttcctgctgggcctgtattactccatgacgaactgggatggagtatctgaaaatatccgatggctcggactaggaaattatattcatatttttagggatgatccagatttccataatgcgttctggtttacggtccggtttaccgtatgtggtgtcattctgacaaacctgattggctttttcctagcctatgcacttaccaaaccgttgcgtacccgtaatgcactgcgaactgtattttttatgcccaatatgattggcggcttgctgctcggctttatctggcaatttatatttgtacgcggcttttctgcagtaggtgaggcaacagggctttctttttttaaactgccgtggctgggtgatgggccaactgctttttggggaactgtcattgtgtttgtgtggcaatatgcaggttatctcatggttatttacatatcctcgttaaataatgtcccgcatgcccttattgaatcggcacaaatcgacggtgcgagtcgaagacagattctgcgtcatattgtagtgccacttattatgccagcggtgaccgtctgcttgttcctggcgatatcctggtcctttaaagtatttgagttgaatttggctctcacaaaggggggacctttcaagtcgacagagtctgtagcgttggacatatataatgaagcgtttacaaataatcgacttggattagggactgccaaagctatgattttctttgtggtcgttgcaatcataaccagcattcaggtgcgtctcacgaagaaaaaggaggtcgaaatgtaatgggaaaaacgtcaaactatcgtttgggcacatgggctgctgaaataatgctaattgtgatcgggttaatctttctggttccgttttattttttgctcgtaaactccgttaaatcctttggcgacattttggcccattccgcttcgtggccgacaaccttccgttttgaaaactatgctaacgcctggaataaaataaactttcccacagcactggggaattcactgattgtcacgatcgtcagtaatgcgcttttgctactaatcagctcgatggccgcttaccagatggttcggcatgacactcgttttaaccggttcctgttcggtttgcttgtggctgcgatggtagttccctttcaatcgattatgttgccgcttatggaagtgtccaacgtattgagcttgaacaacagtataccgggactgatcttatgttatctgggttttggagcgcctttatccatttttctttttcatggctttattaaaacggtacctattgagatcgagcaggcggcaagggtggacggttcatcccggtacggggtgttctttcgcatcgtttgtccgctgctgctgcctatgttcgtaaccgtgcttatcttgaataccttatggatctggaatgactatctgttgccttcactcattttgaatgatcctgagctgcgtaccattccgattgcaacctatatgttgtttggtcagtacaccaagcaatgggacttggcgctgccagcactagtgttggggatcacgccaattgttgtgttttttctggtgatgcaaaaatacatcgtttctggcattgcagccggcgcggtcaaaggctgatgggagggataatcgatgaaaaaaacaacgttacttgtcatctccttgatggtgctgctcgcatgtacacttgcaggttgtggaaatacgaagcctcaacagagtgagacgaaaacgatacacatttatcaattcaaagtagagatatcggaaccgttaaacaagctgaaggctgaatatgaaaaaacgcaccctggcatcaagctggatatccaatctgtcggtggtggtacggactacggtgcttcgttgaaggctaaattcgcatcaggcgatcagccggacatttttacaaatgagggctaccaggatcgcgatacgtggttggagtacctggaggatttgtcggatcagccatgggtgaaagatctggacgatttcgctcgtaagccgatgacggttaacggtaagatttatggacagcctatgaacctagaaggatttggatttgtttataacaaggatttgtttaaaaaagcgggcataaccaaactgcctcagacgatagatgaactggaggaagcagccaagcgactgaaagcggcagggattataccttttgctaacgggtatgcggaatggtgggttctggggaaccattttatcaatatcccgtttgccagacagccgaacccggaaagttatgttgaggatttaaacaaaggaacggctcgcatccccggtaaccccgtgttcgatcagtgggtgaagttgcttgatctgactataaaatatgggaaccgcaatccgctcacgacggattacaatacacaagtgacactgttttcgacaggcaaggctgctatgatgcaccaggggaactggacgcaaccgcaaatggatggaattaatcctaacttgaatttgggtattctgcctgcgcctatagacaatgattcctccacaggaggtagactcgcggtgggagtggcctcgaactgggtgatcaacaaaaattcgcctgtgaagcaggaggcaaaagaattcctcaattggttggtcacatcagaaacaggcaaacattatatcaccaaggaatttaagtttgttcctgccttcaaaagtatcacgtccagtgacgagacgacaggtgatctaggtgcagaaatatctcgatatgtgagggaagacaagatatggagttggaactttcaacgctttccgaaagggctaaatcaggatttaagcagtagtatgcaagcctatattgcaggggttatcacgaaggacgaaatgcttcagcaatttcagggggcatgggacaatttgaagtatagataaaagaataccgctgcatgaggaagcaaaggctatagcatgggcaggaattttaaagccagcaggctttgacggtcaagtgccgtcagggcctttttgatgtggttttatgtgacgaaagtcacacgtgaagcggtcctattaagtattttacatgtcatatctttcccttgacaaaaggttgcggtggcaggtgttaaatcaatcaagggaatgttataataaacaggatttacaggcacgcattgcatctgtgcttatttggtttgtgcaaataggttacatagatcctttcgactcaggatagttcgatatgctggcgcgaaagaacgtgacgataataccggagggaatatattatggcgaaactggtggtttgcgatcaccctttgatccaacacaagcttacatttatccgcgatgtgcggaccaacaccaaggatttccgcgagctggtggatgaagtagcaacattgatggcttatgaaattacacgggatatcccgctggaaagcattacggtgcagacaccggttgctgagacagaaggaaaagtgatttcaggacgtatgctgggtcttattccgattctgcgtgcaggcttgggtatgctggatggcgtagtaaagctgctgcctgcagcaaaggtaggccatgtgggactgttccgcgatcctgagacgctgcaacccgtagaatactatacgaagctgcctacagatgtaactgagcgcgaattgatcgtgattgatccgatgcttgcaacgggtggctcggcaattgcggcgattgatgtattgaaaaagagaggctgtactcaaattaaaatgatgaatctgattgctgctcctgaaggagtcaaagctgtgcaggatgcgcatcctgatgtagacatctatgtcgctgcactggacgagcgtctggatgatcatggatacatcattccgggtcttggtgacgcgggagaccgcttgtacggaaccaagtagactgcccttggcggttcggcaaaatctatggacgttatgacaggtcgtttttctgaataatggaagatctgtgaagcggacatttattatgaaaaggggttcaacagaaaatgtctaaaatcaaagtgatgacaatttttggtgtgcgtccggaagcgattaagatggctcctcttattttggagcttcagcgtcacccggagcatatcgagtccgtggtatgcgtcacggctcaacatcgccagatgcttgatcaggttctggaagttttcaatattcaccctgactatgatctggatgtaatgaaggatcgccagacactaaatgaaatctcgatgcgggtacttcaaggtcttgaacctgtattgcgtgaggccaagcccgatatcgtgttagttcacggtgatacgctgacgactttcctggccagctatgcagcctttatgcagcagattgaagtagggcatgtggaagcgggtttgcgaacgtggaacaagctttctccatatcctgaagaaatgaaccgtcagctcacaggcgtgctgtctgatctgcatttctcgcctacttctttatcggctggaaatttacggaaggaaaacaagcctgaatcgcgaatatatgttacaggcaatacagtaactgatgtatttcagtatacggttcgccaggattacgagcaccctgtactggattgggctcagggcaaacgcctgattcttatgacagcacatcgccgggaatctcaaggggaaccgcatcgtcagatttttaatgcggttaagcgaattgcggatgagtttgaggatatcgctattgtttatccggttcatccaagtccggcagtgaaggaacctgcatttgagattttaggcaaccatccgcgtattaagctgattgatccgctggatgtcgtggatctgcacaatttttatccacatacacatctgatccttacggattccggtgggcttcaggaagaagcaccttcgttcggagtacctgttctggtgctgcgtgatacgactgaaagaccggaaggaattgaagcgggcaccttggaactggtgggtacgagtgaagagaacgtgtacaatcggactaaggcacttttgacagattccgcgttgtacgaatctatgagtcaggcagcgaatccttacggcgatggacaagcatcagtaagaattgtcaatgcgattttgcaccattatggtgttcaaaacgaacgtcctgaagaatttcacacaatgttcacaaaaggtgttcgtccgatataattattctttacaaggcaagcatacagttaaactgtacggttaccaagggatacagcaatttaagatgctttgtcgtttgattttatactttagggcgctaaaatatctcaattgacaaagcatcttatatttaagtaaaatggactggaattgcaggggtgacatggaaaagtggtcaaaccttccaagcaaaacaacaaccgaaataacaccggaaatgcctttaaggctataggactggtgagcgcgatcggcattgatttggcgatatgcacactgggtggcttctatgcaggaaaatggcttgatgccaaacttggtggctccggaatttggattggcgtaagcgttctcgcaggcttggttgtaggcgcattaagtattgcccttgtgatcggaaaggtactgagggataaccatgaatgagatgacccgtatgcaaaaaatgttatggatcgtagcgcttggtattatggctctgtgtttcctggtctccgccttcatgccccaacatcgtgacattgctcacggaatcattctgggaacgggagtaagctgtctaaatgtgctgtatatggcctacaaaattcgacaggttgcgagtgcggccgccggtgaaagaaagaagagagtgtttggtattggctttggcgttcgattagggacctcaattttggcagtggtgctggcgatagaatttccggcctatttccatgagatcgctgtaatggcaagcctggtgactgggcaatttcttctgttaattataggcatcatattcgcgcttcaggaaaaatgatggctcaactgagaaaggggtgagaaaacatgttgcatgaatcaccgattatccaattgggcgggtttaacattgacttgtccgtcattattatgcttattgtgacttgtgcgattgtatttggactggcatttgctgcaacgcgcaatttgtctgtggacaatccaagcaagctgcaaaattttatggaatgggtcgtagaattcgttcaaggactgattaccagcacgatggatttgaaaaaagggaagccattcctctccttggggatgacgctgatcatgttcattttcgtggggaatatgctgggcttaccgttcgggattgtgaccgaattcgataatgtgcaaagtgcccaagtatttggacatgaaatcattccagtcaaagaagcattagaacaagcacaggcgtctcacccgggcgaagctgcccatgtaggcatcagctggtggaaatcacctactgcagatgcaggggtatctattggactcgctttgatgatctttgtcctggttcatttcctggggatcttccgcaataccaaagcttacttcaagcattacgttcagccatttccattctttttgccaattaacttgattgagcagttctcaaaacttttgacacatggtatgcgtctatttggtaatatttttgccggcgaagttttgatcagtgttctgctgaaattgacagcacttggtgtaggaggctggattgcttccgtattgggactcgttgtttggcaaggattcagtatttttgtcggcagtattcaagcgttcgtcttcacgattctgacgtttgtatacatttcgcagtccattgacacgcatgaagaagagcattagacaagcttgttttccggtttttagttaagttcaggagtacgcttcgctcttaactgcaaatacatgtacaatacaaatacacatcactaaggaggatttttaaaatgggagtttgggcatatatcgcagctgcaatcgcagtaggtttgggcgctttgggcgcaggtattggtaacggtctgatcgtaagtaaaacagttgaaggtatcgctcgtcagcctgaagcaaaagcaacgttgcaaacggtaatgtttatcggtgtaggtctggtcgaagccctgccaatcatcggggtcgttctggcattcattttctacgcaggtgcttaattgaatggaagcaaggtttggcggggaaggcacagccatccgcgccttctttgttcgtttgaacatgaaagatccagaaccgacgttcaccggaaaggagtgacttcaattgagtttaaattggacaagtatcgttttcacaatcattgcatttttgatcttgtactggttactgacgcgttatgcattcggccctctcttttccgttatggagaagcgccgtcagcttgtattacagcaaatgaatgaagcggcacagacgcgtgaacaggctgctgcttatgttgaggagcaaaagcaggctctccagcaggcacgtaaggaagcgtacgacattattgagcagtcaaaacaaacaggtaacaagcaagcggagcaaattattgttcaggctaaagacgaagctgtccgcctgaaagacgaagctgttcgtgaaatcacaagcgagcgtaataaggcggttgccgaactgcgcagcgaagtgggtaaagcttcggtacaaattgcttccaaactgattcaaaaggaaatcaaggaagaccaagtccaaggagagcttgtcgaccaataccttaaagaggtaggaggcaaagcatgagccgggatacggtagttgccaaacggtatgcgaaagctttgtttgaagtggcagagcaagaacagaccattatggaaaccgagcaggagctacgtgcttttgtagaggctgtatcgggggatgctgaaatccgtaaattcattaattctcctaacattacggaaacggtcaagcttcaagttctggctaacagttttgaaggcaagctgtctgcctcgctaattaacacgatcaaactgttgattcagcgtagtagagcagatttgttcgaatctctccttgccggatacctcgatattcaggaatacaagctgggacttgctcatgcaaaggtgtattcgacttatgctttaagtgatcaggaaaaaacagcggtagccgagcaattcggagcccgtgaacataaaacaatccgtgtggaaaatatagtggacccgagtctgctgggcggattgaaagtggttatcggcgatacactgtacgacggcagtctggccggcaagctggatcgtctcgagaaatcctttaacagacgagtatagaagataggggtgaacacacttgagtatcaaacctgaggaaatcagttcattgattaaaagtcagattgaacaatataaaaatgatatcgaggtcgttgaagtcggcactgttgttgaagtcggcgacggtattgcccgcgtctacggactggaaaaagttatggccggtgaattggttgaattcgacactggcgtattgggcttggcgctcaacgtggaagaaagcaatgtcggtgttgttattttgggtcaattctccgacattcgtgaaggcggtcaagtaaaacgtacaggtcagatcatgcaggtccctgtaggggaagcgctgatcggacgtgtagttaacccactgggacaaccggtagacggtaaaggaccgattgctacaacagaattccgtccggttgaaagtcaggctccaggtgttatggcccgtaaatcggtacatgagcctatgcagacggggattaaagctattgatgcaatggttccgattggtcgtggtcaacgtgagttgatcatcggtgaccgtcaaacaggtaaaacttctatcgcaatcgatgcaattttgaaccaaaaaggcaatggcatgaaatgtatttatgtcgctattggtcaaaaacaatccacggtagctcaagttgttgaaacattgcgtcgtcacggtgcgctggaatatacgattgtcgttacggcatctgcttccgaaccatcaccattgctgtacattgctccttactctggctgcgccatgggtgagtatttcatgtacaaaggcgagcatgtccttgttgtttatgatgacttgactaaacaagcgtcagcttaccgggaactgtccctgttgctgcgtcgtccaccgggtcgtgaagcttatccgggtgacgtattctatcttcactctcgcttgctggaacgtgcagcgaagctgaatgatgagttgggcggcggatcacttaccgcattgccgttcatcgagacacaggcttccgacgtttctgcatatatcccaactaacgttatttccatcacggatggacagatcttcctggaagctgacttgttctatgcagggcaacgtccagcgatcaacgtaggtatttccgtatctcgtgtaggtggttctgctcagattaaagcgatgaaaaaggtagcaggttccctgcgtctggatcttgctcaatatcgtgagcttcaagcgttctcccaattcgggtccgacttggataaatccacaaaagcccgtctggatcgcggcgcacgcatgatggaaattctgaaacagggcgttaaccaaccgcttgctgtagagcaacaagtagtgagcttgtatactgctgtaaaaggcttccttgatgatatccctgtagcggatgtaaaacgttttgaaaaagacttcctgtctttcatggtgtctgaccatcaggatgtgcttcaatctatccgcgacacgaaagacttggtggctgataacgaagcggctttgaaggcggctatcgagaaattcaaaaaatcattcgccacgtcggtttaatacattggaattgcctgtttatgatgaaagatgtcctaaggaagcgtgccctccgggttttggcttccttggcatgttttaccctctataacaggccctttaacatatgtccggctggatttgaatcttacgaagtgcttagacttggtccaagctaagctaagggattgcttacgaagttagctttggctttgctagagcttaaaggtggtgaaatcatggcaaaaggtatgcgcgagattaaacgtcagattaaaagtgtgcagagtacgaagcagatcacgaaagcgatggaaatggtcgctgcatccaagctgagaaaagctcaggagaaagcggagtcggctcgtccttactcggaaaagcttaaggaagttgtgagtagcattgcttctggagcgaataacatcaagcatccaatgctggaaacgcgtccggttaaaaagactgcttatctcatcattacatcagatcgtggtctggctggtggttataacgccaatattttgcgacaggttacgcagacgattgctgaacgtcaccgttcacaggatgaatttgtgattttcatcattgggcgaaaaggacgggattatttcagacgtcgtgaatttcctatcgctgaatcggtaacagatctgtcagatacacctgcttttgcagatatcaaaacaattgcaagtaaggctgtacaaggctttgaacttaaagaatttgatgagctttatctatgctataaccgctttgtcaacgcattgactcaaattccaacagttgaccgtctgttaccaatggcaacaccggattcagctacagcttcatcctcaattaactatgagtatgagccttcaccagaaggagtgctggaagtattgctgccgcgttacgcggaaacgctcatttacggcgctttgctggatggtaaagctagtgaactgggagcgaagatgacggcgatgggatctgctacgaagaatgcttccaagttaattggtgagctttccttgacctataaccgtgctcgtcaagcggctattacccaggaaattacggaaatcgttgcaggggcaagcgctcagtcttaatcaggcttgttgcgactgttttatagcatgtctacactattatgataaattgcgggcgcaaaacaaatcagagtggttcggatttgcggctgtgcaagcttgtaggagggaaaccaaaagatgaacaaaggacgcgtagtgagcatcatgggtccggttgtcgacgttgagtttgaacgtggacagcttccagaaatcctgaatgccattcatattgggactgtgctggagagcggagtcaaaattgacctgacgctcgaagcttcaaaacatctaggtgacaaccgtgtgcgttgtattgccatgtcttccacagatggtctggttcgtggagctgaagccatagatctgggagcacctatttcagtacctgtcggcgaagctactcttggacgcgtatttaacgtacttggaacgccaattgataatggtgctgatatgagtgaaacggctagaaatccgattcaccgtcaagctccttcttttgatgagctgacaactcaagcagagatgctcgaaacaggtattaaagttatcgacttgctagctccttatgccaaaggtggtaaagtcggattgtttggtggtgctggtgtaggtaaaaccgtaaccattcaagaattgattaacaatatcgctcaggagcatggtggtatttctgtatttgcgggtgtaggtgaacgcacacgtgaaggaaatgacttgtatcatgaaatgagagattccggcgttatcaacaaaacagcgatggtgtttggacaaatgaacgagcctccaggtgcacgtttgcgtgtagctctcacaggtctgacgatggcggaatacttccgtgaccaagaaggccgtgacgtgttgctctttattgataacattttccgctttactcaagcgggttctgaggtttcggctctgttgggacgtatgccttcagcagtaggttaccagcctacgctggctactgagatgggtcaattgcaagaacggattacttctactaaaaaaggttctgttacttccattcaggcgatctatgtgcctgcggatgactacactgacccggctcctgctacgacgtttgcccatttggatgctacaacgaatctggaacgtaaaatttccgaaatgggtatttacccggcggttgatccactcgcatcaagctcccgtattttggctccagacgttgtgggtgaagagcattacaatgtagcgcaaggggtaaaacaaattttggcccgctacaatgagcttcaggatatcattgcgatcctgggtatggatgagctgagtgaagaagataaaatgttggtagcacgtgcacgtaaaatccagcgtttcctttctcaacctttccacgttgccgaagcatttaacggcttcccaggtaaatatgtgccggttaaagaaactgtacgaagcttcaaagaaattttggaaggcaagtatgaccatcttccagaagcggctttcctttttgtaggagccatcgaagaagcagttgagaaagctaaaacgctgtaaacaacaggcaaagaatagccgagccttacgaagtgagctgtctgtggacagcttccaggagggattcaagtgagcacgtatttactagagattgtgacgccggagcgcctggtctatacagaacaggtaaacagcatcagtgttcgcggctcggaaggcgatcttgggattttacccggacaccttcccttggtcactcccttgaagattgcaccgatacgcattaaaatcggtggtcaaaccgaagtgatcgcggtcaatgggggctttcttgaagtccgcaaggataaagtggtcattttggctgagagtgcggaacgttccgaagaaattgatgtggagcgtgcccgtgcggcaagggagcgggcagaactgcggctccagagcaaacaggagcagatagatcaccatcgggcggaagtagctctgcaacgggcgcttaaccgtttaaatgctacaagcattagaaccaataagaattaatattggattttaagtggaattttaaaagggttcggcatagtatacggatggaacgacaaggagaccacttcataacttctgccaaagaatgtccggtagaaggtgagggagaaccttgcttccttcgatcactgtgatcgggccctttttttagctgttattaccaaaatgtacagtcctatttcttgcccagttgctaggtatttagtaccttttaaattcacaaaacagaagtgattaatcacattttgtcgaaataaatgtcctaaaagcagaaatagcactggcatattaggcgctcgccgagtattataaagaagtctgtgacgcagatgggaggaattatggttgaacgggaaacagcaattggctgaacagctaagtcaatcggcgagtatgaccgcgttgatctccatgatcgtgtcgcttgtctgtatagcgttagcttggtgggctttacagagcttaaagctggatttgttaattcggcaacccaaaggaccgcagggcagattgctgcacttgtttcttgctataatcttgggacagttggtttcggggttcctgttgagctacatctcttggagccagatgctctagaatttgttttaacatgaagtaggcgggttatatgaccttatgactgtgtctctgcgggaattgtcgaataacatcgcgtcatattgttaacaatggtaaacaaaagaaccatacatgtatagctggctgaatcagttagagtacaatggtcgtcaagtacaaaaaacgcttgtatacttgttttaatcagtggtatgatggcagttagggtattagtaaaaccttgtttttttatgtaatgaaaaagcaaggcatgaaaatagcggaatatgttctttttttccagaatggaaaagggaaatgacgcgcggagggaaccatagatgagcaaatttatcgtccgcggtggcaacagattgaccgggagtgtcaaagtcagcggagccaaaaactcagttctgccgatcatcgccgcttctctgctaggagaagaaggagaaagtgttattattgatgcacctcctctagacgatgtgatgaccattagcaaagtgctggagtccttaggagcaggcgttacataccaagatgaggtcattcgtgttgacgcgcggaagataatttcctgtgaagccccttacgagtgggttaggaaaatgcgcgcatcattcttggttatgggaccgctgcttacacgtttgggacgtacaagaatctcgcttccaggcggatgcgcaatcggaacgcgaccaattgatcagcatttaaagggttttgaggcattgggcgcggagattagcctgggccaaggttttattgaagctaaaagtaacgggcgtctgcgtggagctaaagtttatttggatgtagccagcgtaggagcaaccgagaatattatgatggccgctactcttgctgagggcgtaactaccatcgagaatgctgctaaggaacctgagattgttgatctcgcaaatttcctgaatggaatgggtgccaaagtacgcggtgcgggcacgggcgttattcgtattgaaggcgtcgagaagctgcatggtgtaaaacataccgtcattcccgaccgggtagaagcaggtacttatatggttgctgctgcgatcacaggcgggaacgtatatgtagaaggcgcaatatccgatcatttgggaccggttatttccaagatggaagaaatgggtgtaaccattcaacctgatgagaacggaattcgtgtcattgcagataagccgttaaaggccgttgatgttaaaacattgccttatcctggttttcctaccgatatgcagtctcagatgatggcacttcaacttgccgctgaaggaacgagcattattacggaaaccgtgtttgaaaatcgtttcatgcatgtggatgaatttcatcttatgaatgcggaaattaaggtcgaaggtcgttccgccattgtaactggtaatgctaagctgacaggtgcaaaagtaacttcgacagatttgcgtgcaggtgctgcgttaattctgaccggactcattgcggaaggtacaacggaggtatccggcgtacatcacatcgatcgcggttacgttcatttggctgagaagctgactggattgggagcggacatttacagagtgaccgtggatgagtccaaactggatcattcacccagtacagagcgcgtaatgccggaagagacgtcagggaatctgtttaagaagatccagccttccctcgcctaagccttaacgtatgtagcttcatattgcataagtatattcttgaacaataaagaaccaagtccgaaagggcttggttttttgttgtttgcagccagtctttttcattctttcagttctcttaaaatggttctatcaaagtggacgacttcatatgattgaaaatatctgctggagtatatctatacttccagccggacacttagccctttgatggaggtttcagcctatgaaagattcacaggttcgcatccgtatacccattcatcatcctaaggaacattgccaggctttacttgcggaggaacgctctggctctatagctacttcgttacagaaaaataagcttatgcaacagcagccggacacaaaaggtacattgccgactggcgtcaagcccaatcggcgtaccacagccgtgccttccgctgtgaactccgttgaaacggctctgcctattgctggagcagcggcccatgacacacgcgctgcaaccccgctgcaagtgacgctgccgcacctgcgtccatccgccgggcgtaccccgcgctggggcagcagacgcccatggctaccattcgctgccatggcaggggtgctggtgcttgccgtggctgtgcccgcgctaatggcgtggcctcaccagacggcgcagccgttgccgccgagcagtcgcacggcagcaccagccgcgcctagcgtgacggcaaaggacgagacgcccgtcacgcgcttgccgggcgtcccgccgataccggcggtgcccgctgctccagcgcgcagcgtgccggtggcagcagagccggacgtgcgcgtgtacgtcacgtctaccggtcgcacggagacgttaccgctggagcaatacattgtcggcgtagtagccgccgaaatgccgcccagcttcgagggcgaggcactaaaagcacaggctattgccgcgcgtaccttcattgcccgacgtttgctggctgatgacactagcggtgcgccggctggagcagatgtgacggatactgttaaacatcaggcttatatctccaaagccaaacttactagagaatgggggcgttctggtaaatccgcagagctggctaaaattcagcaggctgtacgcgacaccaaggatacgatcatggtatatgaggggaagcccataacggcatcttttttttctactagcaatggctataccgaaaattcagaggatgtatgggcgaaggcagtgccctatttacgaagtgtgtcaagtccatgggacaagcggttggccccacgttatacagaaaccgtcacactgagtcgtcagagtgtgttcgatagattaggattgagtcgtactgcaattgccgcctctactggaggaggaagtatgccagagattcgtatactctccaagacggaaggacatcgcatcaagaagattgaggttggtggctcaatctttacagggccggaaatccgtaacaaactggggttgcgttcggctgagtttacgtggaagcctgaaggggatcggattgctataacaacctatggttatggtcatggtgttggtatgagtcagtggggagccaatggaatggccaaggaaggccatactgccactcaaattctccttcactattatactggcatttcttttgcgcaagcctctcgtattctaagttagtaaatatttcgaaactttgaagtataaaagagttgcacccggtaacactggttactgaggtgatgagcaaatgaatgaacaaaataaaaaccagaaccaaaaccatgaagaaacacccaaaacctttcagggtggaagagcttcacggccgtcttcgtggaaaaagctgttgtccaaaaggtgggcatacccggcagcctacattgccgcagcagccattatactaaccttagtgtgggtctatcaggatgccagccagaagtctttcaaacctgacccagctagtccatcggtacaaagcacaagtgcagtcaataccgatgttaacggacaacagccagaaagcgtggaagtagttgcccagtcggaaaatatcgcatggccagtggcagatgctggcgcagtacaggtcgtaaagccgttctttgatgagaacgcaacagctgatgagcaggcggcagctatggtagagtacgataaaacatttaccgctaacactggaattgatctttcccgggccgacgatcaggcgtttgaagtgagagccgccctgagtggcaaagtatctcgtgtagaacaacatccgctggtaggtaatgtcgtagaaatcacgcatgataataatctcaaaacggtgtaccaaagcttgagtgatctgaaagtaaaagaaggcgatcaagtgaaacaaaacgatgtgattgcttcagcgggtcgtaacgagcttgaaaaggatttgaaaacacatctgcattttgaagtgtatcaggatgacaaaccggtgaatccagcaggtctgcttcctaaaaaataaatttggtcatggctttgcatgcaaagcggggaatccatattccctgcttttttcttgtgtagtttttgtgcataaggtaaacataagctgcttttgccaaataaataggccttccgaagcatgtcttcccgccaaaccgcgaatatataggcacgctcctcatataatgtaccaaactatccacagtagggaggcgggagcgtgcacgattacatcaaggaacggaccatcaaaatcggtcgctgtatcgtggaaacaaggaatacggtccgtacgattgccaaggaatttggtgtctccaagagcacggtgcataaagatctgaccgaacggctgcctgaaatcaacccggatcttgccgatcaggtgaagcacattctcgaataccataaatccatccgccatctgaggggaggagaagcgacgaaaattaagtacaaaaaaacgagtggcaaacgaagggagatcctcgtttccggcaagtcctaaaaatatatagtgaattggctggcaaagccattgaatcaaccccctgaagtatgatatgttaaaagatggtacaagacgaaaaatgacatgtaaccgtaggtttatacatatatttgccgcttcttgtcgaatcttagcttttaaaatatcactttgggggcctttttaatatgttcagtaatgatatcggtatcgacctcggtacggccaacgtgcttatccacgtcaaagggaagggggttgttcttgacgaaccttccgttgtcgcgatagaaagcgatacaaaaagagttctggctgtcggagaggaagcgcgccgtatggtgggacgtactcctggtaatatcatagccatccgtccattacgtgatggtgtcatcgccgattttgaagtaacagaagcgatgttaaaatattttatcaatcgggtagggggaaaaagctggtacagccaccctcgtattttaatttgtgcgccgacgaacattacctcagtggagcaaaaagcgattcgtgaagcggcggagcgtagcggggccaaggaagtatttttggaggaagaaccaaaagcggctgccatcggggcaggaatggatatttttgagcctagcggcaatatggtagtagatattggtggcggaacgactgacgttgcagtcctctctatgggggatgtcgtaacagcttcttccattaaaatggcaggggacaaatttgatacagccatcatgaaatatgtaaaaacgaagtacaagcttttgatcggggaacgtacggctgaggatatcaagattgctatcggaaccgtgcatccgagcggacggcgtgcagagatggacatccgtggacgggatatggtatccggattgccaaaaacgttaagtatttctgcggatgaagtgcaggatgcgcttagagatcctgtgtcggcgattgttgctgcggccaagtttgtattggagcagaccccaccggaactgtcagctgatattattgaccgtggtgttattttgactggtggcggtgcgttgcttagcggattggacgagctgcttgctgaagagttgcgtgttccggtactggttgccgaagatccgatgcattgtgtcgttaaaggtacaggaattatgctggataatttagatcatgtggttaagaaaaagttctaatctgccgatagtgactataagagactcgtgtgcggtcagacaggttgcctagcattttggctttcatgcctccgcgcgagcatatgattttagcagagtataggattggggtgcaccatacatgttgagaggtttatatactgcggccgccggattgatgacacaacaacgacgccatgacaccgtgacgcaaaatattgctaatatgaatacgacgggatacaaacaggagaacagtgttcagcgttctttccccgagatgcttatttccatgacgggtggtaaccctgataacccggaccgtacggtcggcaagctcaatactggcgtttttgctgaggaaagcctctctccttacattcagggagcattaaaggacagtggacaagcgacggatttcgcgatacagtccaatattaatgtgaacgacccagctactggtcaacctatggcttttgatcaggcagggaaattcatcaatgctaacggtgaagtcacctaccgtccagaagcgttttttacggtgcgggacagtaatggtaacgttcgttatacacgtgatggacattttcaagtaaatggagcgggagcattgctttcatcgactggctcagcggttctggatacgaatggaaacccaattcaattgacgggggctgtctcagcgcttaaagtaaatgagcggggcgaattggtagatagccagtccaaccagacgttagggacgacgctcggtattagtgtcattgatcgtccgtaccagctcgttcgtgagggcaatggaaatttccgcctgaatgatacggacggtgctacagctagaatgataaccgctaatgatgctgtatccgttcgtcaaggttatctggaggtatctaatgtagatgcttcacagtcgatggtggatatgatggctgcgttaagagcgtatgaggcgaatcagaaggtaattcaattttatgataaaagcttggacaaggccgttaatgaagtaggccgtgtataacagggggtaagtgatgaacaactccatgattggcgcaatggtatctatggccagtgtgcagcagcgtttggatttaattgccgataatattgctaatatcaatacagttggttataagagtaaacagggttcctttgaagatgtactggccaatgtgcagcaacagccttcaacgtatctccaaaatggacgagccatgccgctcggctataatttgggctacggagttaaaacggccgcaatcatgaaaaatatggagcaaggtccgctcaaagagacgggacttcctaccgatctggcgattcaaggtaatgccatgtttgaagtccaggggaatgggcaaaaagcttggacccgtgacggtagctttcattttgttcctgatccgaatgatagtgcgacgatgatgttgaccactgctgaaggttactccgtgctggataacaatgatgttcctgtgactgctccagcgggttccaaggtggctattaactcggatggcgaattgctgattcgtgctaatggaattggggatccgacagttggtcagagaatcaagttaatggatgtacagcgtccagaaggactggaacagcgggatgataacctattcgtgttgttgaatggtgtaacagaggcaaatgtattcggagcagcaggtgtggcaggtgctgttccagcggacgtatctgtgcgttccggttatcttgaggaatctaatgtggatttagcgggcgaaatgacggatatgatgcaagttcagcggatgtatcaaatggcggcacgggcactaacttctagcgatacgatgatgaacctggccaacaatctgagggcttaaggatttggtgatgaaagaagaacaatctgattcccgtccggtgcctgaaaagacgaagtcccgctggcgtactgctcgttatttcatagttccgttgctgctcctgttatcgctgttaggcggcttaattgcaggatatgtaattgtaggtaagcaagggttgtcaggcgtgttcgagtggaaaacctggcagcatgtcattgatcttatatttgcgccttagtttactttaaatgagtgggggcgggaaaaggtcgctccgcgaatgatttgatcttacgatcgctgttgcagcgggattttcttattttataaattatcagatgtaaaaatcccgttgcaaaggcgaacgctcgcgcttctccagattcaaatccttcgctccgctgctacccgccatagggccacttttattaaaataaaccacccgcaatttgtgtggggagtatagaataacaaaaccctgtgccagtggcgcggggttttgttatgcttttaagggaggggcctccagcgtagcacgcatggattgtggccaatgaaggccatcacagaggccttcggttttctctgcccttcacggcaagcgagcattattgaagcgagctttctttttgagccaaaagtaactcggcggaggggatggaatcgttctgaagaagcgatagcgttcgcctttaacctcggattttacccttgaattcttatacattgaaaaaatccgaggttaacagcgatcggaagaatgatccattcccgcagcccgtccccctttgctcaattgaatctccgcttcaccccataataggagcacccaatatggtacttccgcgtaattttctttttgcatctgataactgtataatgatggggaagtttataacactgcggggtaaaaccaagcacgggcaaaagggcttcttcgcgcctcaggttgcataaccggcggaaaaagccccttatctcaacctccacttctgcagtaggtgaaggatatctaacattgttgccgttatgagctgtttttatgcagcgtaagcggggtaatattatgcttgcagtaactcatgactgatatagagtcaaacctgcaagcgggaggagttattaaggtaaatggacaaattgcaattggatgttaatcaaattcaggagattatcccacatcgagcgccttttttattggtggatcgtattattgagctggaggaagggaaaagagcagtaggcattaaaaatgtaacgatgaatgagcctcatttcattggacattttccggggtatcctgttatgcctggtgtgttgatcaccgaagcactggctcaagttggggctgtcgcattactgcatctagagagcaatcgtggcaaaatcgggttcttggcagggttggatggtttccgtttccgtgggcaggtggttcctggggatacgctgacgcttgaagtggaaatcactcgttccaaaggcgcatttggcaaagggaaagctacggctaaagtaggcgatacggtagtagctgagggcgaaattatgtttgctttatctgaccctccccaataaataaagctctgccgacataagcacgacgtctgaaccgagtgcatgtgtacatagaaatcctgttttgacaacccaaaaatggagaggggaaattccgtatgacgcagttgagtaaaaaagcactagaaggcattgagagctggctgcaagacccttatattgatgaagagaccaaacaggagttgcgcgcattggaaggcaacgagcaggaactggaggatcgcttttacaaagagctggaatttggtacaggcggtctgcgtggagtgatcggggcaggaagtaaccggatgaaccgttacgtcattggacgtgcgactcaagggctggctcgctatattttagaacagcatgctggtaaagaaggcaagccttcggttgtcattgcacatgattcgcgtcatttttcaccagaatttgctctggatgcagctttggtgctggcgggcaatggtatcgtggctaagttgttcccttccttgcgtccaacgccacagctttcgtttagtgtacgtcatttgggagccagtggagggattgttgtgacagcgagtcacaatcctcctgagtataatggatacaaggtatacaacgatgaagggggtcagcttgttccagatcaggctgaacaggtaattggttatatccgcgaggttccttcgtttgccgacattcgcagtctgacacgtgaggaagcagaggcacagggattgttagtttggcttggagaagaggaagatgaagcgtttgtagatacggtagccagtgtgagtgtgaaccgtgagctgattgcagccggaccaggcaaaaacttcaaagttgtgtttacacctctccatggaactggaaatgtaccggttcgccgtgtgctggagaaaatcggttttgaacaggtgcatattgtgcctgagcaagagttgccagatgctgaattttcgactgtcaagtcgccaaacccagaagaacgtgatgcgtttaagctagcgattgcgctgggtgagaacattggtgcagatctgttgatcggaacagaccctgatgctgaccgtatgggtgcagttgtgaaaaaccgtgatggcgaatatgtggtattgtccggtaatcagtctggcgcgatcatggtttactacttgttgaatcaactgaaagaaacaggtaagcttccgaataatggggctgttatcaaaaccatcgtaaccagcgaaatgggtgcagtcattgccgaacattttggagcaaccgtgtttaacacgctaactggcttcaagtatattggcgagaaaatgaaccaatttgaccaaactggcgagtacgcctacctgtttggctatgaagagagctatggttatttggcagggaattatgctcgcgataaggatgctgtcttggcggctatgctgatcgctgaagctgctgcttattacagcacacaaggtaagacgctttatgatgttttgcaagagctgtacgagcagtttggctacttccttgagaagctggagtctcgtacccttaagggtaaggatggagtggcacaaattcagggcaaaatgaccgattggcgtagcaacgcgcttcaagagattgcaggcgtgaaggtagacaaggtactggactactcacaaggtctggacggacttccacaggaaaatgtactcaaattcttactggaggacggttcgtggttttgcctgcgcccttcgggcacagagccgaaaatcaaagtatactttgcggtacgcggttcctcgctggcagacgcggagcaaagaatcagccatctggtcgatgctgttatggctcgcgtagacgcttgagaaaaatccctttataatagaataggttaaggtaattggataagatatagtaatcggtgacctctcacggcaaagggcagtacgccgtggaggtcatttctgtattgcagaataacctggaagaggctttgggaaaataggcttattccggcaacggaggattttgcaaaattcaatgagtgacctaccaaaaggctgagtatggcgaggtgggcagcattgaattttgcaaaatcccgaatattaaggaggttctttggtgtatcagaaatggcagtattggaatacggcttctcgaaaatggttatgggttttggtggctgtcggcttgctggcttccattccagtcatcgccgatcgtgtgaagacagaatcctcgagtaaaaaagtagagattgtattcgattatcgggatttgacagaggcagcctcgtatcaggctcacccgcaggactatctgaatgagcaacttgaccgcttacagcaagcgggtgtgaacagcatggcgatgtatgaaagtacgttggatgatttccgtaaagcgggtcgcgtcgtaacctatacgactcagaacgttgccgatatggaaaaacggctttcacctgcaaatgagaattttacgtatattgttttcgctgataaagaaaatgccgaggcattaaagccgttaattttacgtacgtttacaagcctggacatcaatgtaaaaccttggacttatcaaggacaggaagggttagtggtggaaacatctccagaagatgcgtatctcaagcccatgcagcctgacccgattgcgatgaagcagcttcggagcaaaggattttttattgttccacggatgagcgacagtcttccttataaccaggagttgacggaagagatgcttgcttcctttcaacaaaatggtgtaaaacgtattttgtttgaaggtgattcagtcaaaggcttcaccgataacgagaaagagcatagcttagcggcatttgctaaattgctgaacaaatatgatattggcctagctgctatcgaaaacttaaaaaaaccgcaagcaggcttcaataagctcgcttacgatatccactataatgttgtgcgtttatactcattgagtgataaagattcaacgctcgatgttgaaacgttggccgatcgttttgcattggccaccaaggaccgtaatattcgcatgttgtatctgaataccgcgcctagccgtagtattgctgaagccaaggtgaaggattcggtagataacctaatccacagcttggacaagccgggtaatgctgtacaacggatggagaaaaaggggtttgaactcggacaggctgaaccgttccaagtcgtcgattcgtccattcagcgctatctgaaaatggttgtcgtactaggtgcactggcattcttctccattatggtgtcctatttcgtcccggcattgactttgctggcatttgcacttggtttggtaggttcagcaggactttatgttttgaactctagcttgatggagcaaggcctggccctactcgcagcgattagcggacctacggttgcaatgatcatcgctgtgcgtacgattagaattaaacgtgaacagggtgctgaactttctgtaggtcagcgtttgattcaaacgtttatactgtacgtgcagacggcgattttgtcgctggctgcggtgcctttcgttattgcgctgttgaacagtattgcctacagccttgtgctgaatcaatttagaggtgtaagcttgcttcacattctgccgatcttcttggcagcgatatatattttcttttatcgtggcgtttctatacgggaggaaatttccaagctgctacgtacgccgattactgtattgtgggttatcgcactggctgttatcgcagccgcaggttattactatttgactcgtaccggaaatgcgggtacggtgtcgaacacggagttggtcttccggaacttccttgaaaatgcgtttggtgtacgtccgcgcaataaggaatttttgatggctcacccactgtttattgcaggggcattcctggctttgaaatatcgcaaagcaatctatttgctgattatagctgctattggtcaagcctctatggtggatacctttgctcacattcactctccagcggcattgtcgcttagtcgcgggctgttaggattaggcttgggcctggtgctgggaatcatcgcaattgtcgtgtggcaagtgctggaagggtgttggaagaaatggtcaccacagctcaaacgataatcatctcgggttattacggctttaacaatagtggagatgaggcggtgcttaagtcgattttgacagctttagaggaggagagtcgtcaggcggggattacaatcaagcctgttgttctgtcttctgaccccgcttggacacagaaaatgtacggagtagaagctgtaccacggatgagtctgggggaagttcgtagagcgattaaaaacagcgatgggctactaagtggcggcggtagtttgctccaggatgcaacaagccctaaaagtattccgtattatctggcgattctgaaactggcccaatgggctggaaaaccgacgtttgtatatgctcagggcattggtccggtacaacggaagatattttatcctatgatccgttctgtgtttcagcgttgtgaatatgtttctgtaagagatgagcagtctgccgcactactgggtactatgaaactaaaaaacccggttgtcgaagttgttcctgatccggtaatggggcttccattgccctcgggttccgagcaacataaagcagtaactgagacggataaggataaacttccgatcgttggtgtatctgtacgttactgggataaggagcgtcgcgatttaacggctattgcggacggcttgaaaaaattagctgctgagcgccgtgtacacttacgctttttacctttccatctgcctgatgacgagcaggcttcaaggatggtaatggatttgttgggggatattagggggacgggaagccttgtcagcatgtgcgatcaagtcaccgatcctcaacagatgcttttggaagtcagtcgttgcagtttgatgatcgggatgcgattacacagcttgatctatgcagcatcccaccaagtgcctccgttggggatatcctacgatcccaaaattgatcatttcctcagccgtgtcggtagccagcctgtaggcactacagaggcactggatggacaaaagctggctaatgagtctatacggttgctggatcagcgaagtcaatggatcgagagccagggagcggccattgctttgttaaaaagtgaggctcgcttaccggcacagcatatcgttaattacttgtgtcgcaaaggatgatggatacagtgacagttgataaggttacgaatgtgcctaccgtcccgattttcggtgttccggtatcaaggcttaatatgaaagatacattaaaggtattaattcaagcagtggagtctcgccagccccatcaagtgatcactgccaatccgattatggtaatggctgcattggaagatccagtgtacatgaatgtgatgaaaagggcagagttgattgttccagatgggactggcgtggtctgggctgcaaactatgtaggacatcctgtgcctgagcgggtagcgggctttgacttgttacatgaattacttgcagctggagaaaactatcattggaaggtttatttactgggatcaacatctgaggtgattcaagcgaccgcaaagcgggtacatgagctttatccccggattacggtttgtggcaagcgtgatggcttttttggacctaaagaggatgaagcggtgattgcagccattcgtgaagcaaatcccgatttgttgtttgtagcacgtggagcggacacacaggaaccctggattggtaaatataaggaacaattgggtgtaccggtgatgatgggggttggcggtagcttcgatgttatatcaggcagaaccaaacgcgcacctaaattgttccaaaagctacgggctgaatggttatatagactcctcaaagagccaagccgatacaaaagaatgcttgcgctgccgaaattcgccgcgaaagtgatgcgcgaaaaagaaaacgtcacaaaagtgtgataaatagcttgaatctgccttcaaaacccgctaatttgccagaatatgaagcttggtatttatttttgatcagagtataattcaatgcggttacatctgaaaagggattgctttaaaattgggggtcgaatgatcaaatgttattgatctatattattgggttcatcatggcactgggacttgcgctgttactgacaccgctcgtcaagaaattcgctgtgaaggttggagccgtcgatgtaccgaatgcccgaaaagtacatacccgaattatgccgcgtcttggcggactggggattttcttggcatttctgttgtccttattggcggtgttaccttttgtgcctgacggaatgctgtcctctcgggatattaactttatcgcagcctttctgattggcggcacgctgattacactgattggtgctctcgatgatcgttttgatctcaatgcaaaattgaaatttttggctcaaattgccgttgcgtgtatggtcgtgtttgcttttgatattcgtgtagattttgtaaatgtaccttttcaggatgcatactcatctttggaaagctggatttccattccgcttacgattttctggatcgtaggtgtaacgaatgccatcaatttgattgacggtctggatggactggctgcaggtgtctcaggaattgcgattgggactatctttgtgatgtcggtattgatgggcaattacatggtagctatgctttgtcttgtactgctgggcagtattatcggatttttatttttcaactttcatcctgcgaaaatatttatgggtgatacagggtcattatttttaggtttctgtctggccatgctatccatgcttggtttcaagcaaattgctatcgtatcttttattacgccattgattattatcggtgtacctttgtcagatacattctttgctatcattcgtcgcaagttgcagaaaaaaccgattttctctccggataaaggtcatttgcatcactgcttacgcgaactaggtttcagtcacagacagacggtgttgattatctacggtattgcggcatttttcggtgtattggccgtgattcaatcgtctgctgcgcttaatgaagcgaactgggtcacctttgtcgtgatttgtattatgatgttcttcctacagattggtgcagaggttattggtcttgttggcaaaaccaaacgcccagttataaacacactgattcgcttgctggctaagccagattcccaaacgcgttcgaaattataattttaatttaaaaagtaagccttcaagcttggcggtataccgcgggtttgaaggcttttttgatgtttgctgtaaaaaaactccctccttttttgagattttactaattttttgtatgtttactaccgataaaaaaagtattgaatgattacgtaccccaaggtgcgacagaatcaaaggaggacaatgatttgaaacgattgctatccatgttgctgacggttggtctcatcattggcttggtgccggcggccctggtaggtacggctcatgctgcgacgggaacttattttatttttccaagtgaaaaatatgatgtggattcggctagaatggtaaacactgaccgagttacagttaacggtacgattaacggagtgaacggaagtactatatcttatagtgtattccaactctctaaaaatggaacaaaccttaacgtggttaataagaacgagagtcaaaaaggcggaattacagtcagtggctctacgcttaaagttacagacattaaactgtttcctggtttgaaccggattacatttcaaagtagccaaaattcggctgatatgaaggactccatttacattgagtatcaggatgggcctaagctttatgatctatctgctacgttgaatggtgaaaccgagcagttgcttgagaatcagacagcggtgctgacagacgcacgcaatagcggtacggatgatgtgaaagtagtcattcaaggtacggctcctaatgctgacagtgtaacgctcacgtctgcaaaaagcagtaatacgtatacagttaactcttacactggctataaactaacgggtagtgttgtactgagtccgggtaaaaatatagtgaccattaaagtgaataacggaactcaggctcttacagttacacgtgaaattacgatttatacgggtaaaccggaattttctgatttgaccctgaataaggatgggaatgtttctgccgatttgaccacttcgcctgactttaccgtatcgtctacaagtggtgtggttttaaaaggtaatgttttggtgccaggcggtgcaaccgatccaggagtggccacaatcaatgcacgttttaccgatgtgagtaacaatggtagtgctgtgggtagtgcgactggggttgatgccacaattgatactgcaaatgtagttacttcaaatggttataaagtatatccatttcaggtgactgtaccttcggaagctgtacttgatcatttgaccagagcatccctgggcataacttatacggatagcagtacacctccagctccatcggctgtccaatttacattgcgcagcagcactcagccgtatattgatgatgttaactatcttcctgattttaatacccaattgttgaacagaactaaaggaagcgggtctgatcaggcagctgccctagatgaagctatgaaattaacaggtagctctatgaagaacaagactacagatgctgcatctgtacccgtaggtatggagtttatcgttgttaatggtgcaccttcttcaattagtgagctttccggagtaacggttcatactgtagggtcgcctcaagatgtgattcgtacaattaatggtaagtcaacgcaagtgaagaaaattgttgcttatgtagacactttgcctaaagaaggacaaaatgtactgaatttttatctgaatggtgattcgaccaagttaattaaagctacggtgaatctgttgcagggtccgttcatgaaatacgacacgatttatgatgggcaacaaattccgttgaatacatccagctcaaacttgaatacctataaattgactcagctgggcaactttaaaggtaaattacttgatgtgagcaacgcagcagatattcattacactggaagtaaccgaaatgtatttctgtatattaataatgtattggttgatttggatggttcaggagcggacttcaagcttgctgcttcctcggagacagccgcagccaatgccttggcgaacggaaataatgaaatcaagtttgtatacaagccaggtattgagtacagcaatacggtaaaagtaaactttacacagacgaatattccagtaattcctgttcccaacacacaaggaatcatcccttttacaccagttagcggcttgagcaatacgccgaaatatagcgaaattgctccgaaatcaaaagatgctaatttcaccaaagtggatgacaccaactacaaaacatctctgaaaaatatcaatgtacttggtactttcagtattgctgatttgggtaaagcagatcaggtaaatggttcgttaagtgatattgctaataaagatcaatatattttggagattaagggatcggatgacagtgaagtcaactggacactgagtaacgagtttttctcagcagaagatgctaagacaacatacaattccggttctactacagataaatttacaaataaagatttaaaagacttgcttgtgtactaccatccggacaaaaagtatttcagctttgtgttgaaaaaccaaactatttcgcaagatggaacaccagtagcttataacattaccttgtacaatagcggcaagagcggaccatttgctactttccgactgcaagtatccggtcaatccacatcttttgatattttgcgtccgctccctgaaaagagaatcgtgaatcaaaactttgtgcaagttgttgtaaatgcaggtaatgcagatagtgttacagtaggtaaagaaacagcagttcaagagggtttcgactctgattatgatggcaccattgattatccatcaacttacaaagccatcgttacaggtctaaaagccaacaaagataataaaattgatgtagtggttactgtaggcaaagaaaaactgaaacagaccattactgttaagtatgtgcctactaatatccctggcgagcagtacatggaagcgatgaaaacatcgcacaaagtgttcgatggtaatcttacacttgcttttgcaaagggaacgagtctgattcgtcgggactacgatcaaccgcaacagttcaaaaaccaggttttctctggtcacaatttgtactttgcaatagcaaatagcgaagatggtgtggttgaccgtcatgaatttgaaactgaaaaagcattgtccgatatgcagagcttgattgcagatggaagtagatacttcaacagagacttcccgagtcgttttaacatgtccagtccggtattctggattgacccgggtacagcagatgatatcaaaacagatgcttacgatccggtaactcatggtgccgatccttatcaattggctaacaagtcgcaaaatgacagtagcaagatcaaaaacttctactggcgcgacccatctaacgagttagtaccatccaagcgtgctacattgacgctgacgtatgatagcagtattgctcaggatgcagggaaacaaatgtcggtgttctattttgactctgatcttaaagactggcagaacattggtggtgtggtggatccgaaaaaacacaccattaaagtaccgtttgatcgtttcggttactatgtagttgctaaagttggagaaacgtatagtgatgtcattaagcacaaatacgccagagattacatcgaagccattttggctaaaggtgtcatgaacccaatggatccaattaatagctttggacctgacagctacattaaaagaggcgaattcacgtctatgattgtcaaaggtctgcaaattccgcttaatttcagtggagcgaagcatttcgacgacgtgtctattccaaatacgatatcagcagatgctctatacgattatcgttatattgaaacagctgcgcgtgccggtattgtcaaaggttcacaaccaagaatctttatgccggaagatgtaatcacgcgtcaagatgcagcagtcataattgccaaggcattgaatttgaagctggaaacagatcatgacaaaatcatgaagaacctgtctaagacctttaaagatgcggacaagattgattactatgcgcaagcatctatattggctatcgccaagaaaggttttatcacagggtcacctgtggatgcaagtgatctgaaaaaaggatatatgtttaatcctacttccttgaccttgcgcggagatgcagcgattattgtagctaaagttatggctgataaaaaactgcttcctaaaatctaatcaacaaaacacctgaatttattaaacatccctccatgcgaaatggtaattccctttcatatacatgtgagggatgttttttataaatcagctatttgactgggattaagggcctatgccataatatcaatgagatgaaaactttggctaagcattacaacgttttttattttcgattcacattaaacgtatgtaattaactgtttttttttaagcgtttatctcaaaatgtgtttattatttttttatatgttttttttgcacatttatctgaaactttacgcctatttcatcgtagtagtggatgagtgtgcttaaatattacatagagaagtgagtggggagtgatgagatgtctcagttttcaatacgccgtcctgtaacagtatttatgttaattattgctttgctaatcgggggcggtatttttgcgttaagacttcctgtagagcaaatgccggatatgaagctgccattcgctgcagtggtgactagtattccaaatgcaacgcctacagaagttgaggaattggttactaaacctattgagaaaagtctggcttctattgagaacgtggataaagtcatgtccgagtcttcagaaggaacatctatggtcatgattcaatttaactggggagtagatatcaatcaagcaaccctcgacatgcgagataaagttgatggggttaaaggatctcttcccaaggcggctaattcgccgcgtgtccttaaggtggatctcaacgcaacgccggttattacgctctctcttacaggagaccaggatattaacaagttgaagcctattgctgaagatattattgagccgcggcttgaaagaattgcgggagtagctgcagccaacatgtcaggtgggcaagctcggcttgtgaagattactgtagatcaagccaaacttcaaagctatggcattacgctagatcaaatcagccaagcgctatcgtctaataacgtagcgggttctgctggttcggtgtaccgaggcaatacagaaatccaacttcgggttcaaggtgaatacaaagctgtttcagaaatgggtgaaacgccaattccagtagggaagggaagcattaagctaaaggacattgcgaaagttgaagattccttggatgatgttacaaccatttctacctataacggaaagccaagtatcaatatttctgttactaaggctacaggggggaataccctttcaatcgccgattctgtaaaggatagtttagattcgatacggaaggaattgcctccgggaactcaattggagatggtaacagatgcatccaaacccattagcgactccgtacactcattagtagagcatgctatattgggacttattatcgcagctattgtgttgctattatttttgaatagtatacgttctaccattattgctactatcgttattccaatttccttcgtagctacgtttatgatgatgtatttcaccggacaaaccattaatattatttcactgagcggtttgcttctggggttaggatcctttgtcgattttgcggttgttattattgagaatatttttagacagcgacatgaagggaaaagcatgctacaaggggctattgatggctccaagcaggtgggtaatgccgttatggcatctgcacttgcgcagatcgtagtatttttaccagttgtttttgttgacggaattgcgggagttctatttaaaccgttggcgttaaccgttattttctctcacattgcagccttgcttgtatcccttatgattgtgccgatgctgggctcacgttggctacctaccgtgccagatgaatccatttattcttcaggtacttataagggtgttaaccctattgtgtggtttaatattggcttcgagaaatttaagagtgggtatcgccgtatactgaagtggggaattaaccatagaaaatctgtgttaattattactttattaatgtttgtggcagctggggctctagttcctttcgttaaggctgaatttatcccagcatccgatactggggaattcacaattaacgtgaaacttcctaatggaacggtcttggaagaaacggaaaaggttgttcaagatatagaaaaagaaattttgaaagttccagatctagataaaatgacagtgactgttggttctggtggcaattctggttattcaggggcagctccaaccaactcagcagatctaagtgtaacactgaaggatggacatcaggcaacagatgttatagttgagggtcttcgtaaaaaatttgatagcattccggatgcagagattacaatggcgtctacaacaggcctttcaagcggagcggctgttaatattaacttaaaaggtgacgatattgacgtcctgagagaactctcggacaatctcgttgcggacgtaaaaaacataccaggtacggtcaatgtgaaaagtaccttgagtgctgttcgcgaagaatatgagattaccgttaatcgggagcttgcgagtcgatatggcttatcagcaactcaaattttatcagcagtgaatacttcttttaatggatcagtcgccacaagctatcgtacaggtgaggatcagattgatgtgaagatatcgttgccagagcaaaaccgccatgatttgtcaaatctaaaagccttacggattaccacttcgcaaggtattgatgtacctttgtcttccgtagtaagtattgataaacggactgtacccgatactgttactcgtgaagaccaaacgcgtcaagtgcagattacagctgatattgatggaacaggggatattcttactattaatcaaaaaatagatgctcttttgaagagtactcacttccctgaaggctacagtgcagatacgggtggtggacaaaacgaacaaatgctggagtcctttacgaacttggcgatagctattttactatctgtcgtgctcatttatatggttatggcaggacagttcgaatcgttgctcacaccgtttgttattatgttttccgttccacctacggtaattggtgtgcttatcggtttagctgtaaccggggcgagtctcagcgtttcagctttgacgggttacatcatgctcgtcgggttggttgtcaacaatgccattgttatgattgactttataattcagctccgaaaagacggccaagatcgggatgaagctattattcatggagcgtctgagcggttgcgtccaattttgatgaccacgctggctactgtactagctttgctcccaatggcattcgctacaggagagggtaacgaaacacaagcaccgatggcagtagttgttgtattcgggttatccttcgcagctgttattacattgattctaattccggtagtctacgtcatcatggataatatgatacaaaaacgtaagaatcggaaattaaaaagacaagcgaagagagaattaaaaaaagaagcgaaactacaaaaaagtgttcatatataaggtgaggtggagaaacataatgaataaaaaaagtgctctgattgctacaactttgcttttatcagttgcattagcggggtgcggtgggggggaggcccctgccgcttcaactgcggcgcagcaaaccattccggtccaagtggccaaagtgaccaaaggtagtattaacgattcaacaggtatcattggtagctttgctcctaaagagacggctcaggtgtctccgaaaattagtggcaaaattcaaagcattaaccttacagtggggcaaaaagtaaataagggcgacacattgtttactatagaccaaaaggacttgcgggactccattaagcaatctcaagagtcgtaccaggttgccctggccaatttaaagcaggcagagtcaggtgcagcgcaatcggtgcagcaggcagaatccagcgtggatcaagccaaaagtgcgcttgtccagcaagacaacacgatcactcaagctcagaccagtctggtagatgctcagagttccgtgcgtgatgctcaaaatacgctcaatcgcaaccaacagctgtttagtgcgggtgctctttctcaatccgagttagagcagtctcaaatagcgcatagaagggctgtaactgcggtggagaatgcacagatcacactccataatgcacaaacgtctaaggaaagtgcgcaaacaacatataataatgctcaaaaatcattacgtcttgcacaacagaaaacgggcattgacgtagctcgtgcttctgtcaatcaggctaagtccagtttagacacagctcgtagtcaattggtggatgctgtagttaaagctccaatctctggcacaatatcagtagtaacaggaacccaggggcaaatggttagtgcacaatccgcggttgctacaattgcgaataccaatcctattattgctaaagttaacgtttctgaagctgagcttcttaagttgcaggtgggttcatctgtaactgtaggcgtggactcgttaaataagcggattgaggccagagtatcggctgtcaatccggtaatggataatgatcttaaggcatatcctgtcgagatttcagtccctaatggttctggtgaattaaaatcagggatggttgtaactgtatacatgaaatcagaagctcctaaaaacattttggtatcgcaggatgccattacggagcaggcagggaagaagtatgcttatgtagtggagggaactgttgctaagcgggtagaagtgcagacaggccaggaaagtgccaaacaggttgaggtaaccaaggggcttgctgaaggacaaaatgttgtcgttaagggtgttagtctgcttacggatggcgcgaagattaatgtagtgaagtaatttgtctcggttatatttactgtaaatcattgttactccgtcattcctactacttaaagtgtattagagtattagatttcaagagaatctatagactatatgtgctttatatattctatggataattcttaacgaatatactccattaaagaccgacttaaatgtacgaaaataatccttgtacatttaaggttgagaaggtaaaagttgtaggatgacggaggaacaggttcaatagtataattatgactgtggaaagcggaatacataatcaaaaaaaataaaaatttttttttgaaacggacgcaactttttgaacccatgctacgtctaattgggtgagtatgaaacaaaggggtacaaaagcgtaaagacaaaattcgctaaaaaaaatctttactgcattgttatcacattgtataatactggagtacgtcataaatggacgctttctttcaactagattccaagcttctgtgatattgtcacagatatcattttataagggttctcataaagctcggaaaggaggtgtaacgactgatgagtgacaagatccgacaaaaagacaaaaataatatttctggttatattcaaggaggagaaaaaaaggttatgacaaagtttaataaaaaaatgattaacgtgctggcaacagcaacattggttgctggtgtagcagctccaatcgcagcattgactgcaccaactgcaatccatgcagcttctagctatcaatctctgtttactcctagtattagctccaaccaacaagacaatgctcttttgggtagagcgaaagtgagcattagccaagcttctatttctaaaggcgcttcctttaccgttactttgcctaaaggttttgactttggtaaatctggagatcttcaggttggccgtgctacttccgctactgacgctacttatggcttgggtgtatatcttgatccacaagataactctgattcggacaacattccagctactggctataatgaagctactgcactgaaagttgagaaattgactagtaactctgcgaaagtaacactcgaatttgataactctaaagatactgctgatgtatatctgaactttgccaacatcaatgtaagtggacctagcaatggacctgtaaaagctacaattgatgcttcttccgcaagtggtttgactagcggtgaagttacaattgcaaacgtagtatcttccggtcaagtatctttgtctgctttggataccgtttctaacacagacaatttcactgcaacgttgaaagtgaaagaacaaacagctggtgctttggctaacaataataacatcaaactgaaattgcctagcggttttaaatggaacgctccaggaagtgctagcattctctttggtgatatcgcatctggtgatgtagtttctaaagtagatggtgatactcttacattgtctttgagcaaagtaagtactaaagaaacaactcttcaactgcctttgagcttctacgttgatgatgaaacaaatgctaaagaaggcgatgttacagctagcatctctggtaacacaactactgatgttagcactctcgtagttggtaactatggtcaaatcggtgggggcgtttctgtagctactccaacgacaatccttgctggtcatgacgagcaaaaaatcggtgacatcgtaattaaagaaaaagttgctggttctttcgttaacaaccgtactgtaacattgcgtttgcctgaaggtgctcgttggcagtctactttcgaaagtaacactccaggaagcaactttgctggatctttcgaaaacactaacggcttgggtggagcagacgtatcttacacagattccgacaaacgtactttgagattgactttcaaaaacgttaacagctctaaagatccaggtactttgaaactcaaaaacgttgaagttgcaacgcaaccaggtttctccggcgatctgaacgttgatgttgctggtagccaaggtctgagcggtactgttaaggttgctactgtgaaacaagcagttactctggctgctgcttctaaaccaaccctgacaatcggtctgggcgatcaacaagttggcgatatcacaatcactgaagctgcaaaagaagctttcgttaagaaagacggtagccgtgaagtaatcttggaattgccaacaggcgtacgttttgcttctactccagaagtaaaagttacagctggtgacgttaaagtgaagagcgtatctactgatacttacggcgaaagcaacaaaggccgtctgagcttctacatcgacagcgaatctgctactccaagtacaatcacaatctcggctcctaagctgactgttgaccgtactgtagctcaaggcgacatcgttgctaagctgaaaggtagcgcagtttcttacactgcatacaaaggcgcaactgacaacactcaaaactggaaagacaacaacactgcagctgctgaagtagcaatcgcaactgttggaactccagctccaggtgctactaaaactaaagctgtcttcacactgggaagcacttcctacactgtgaacggcgaaagtaaaacttctgatgtagctgcttatgctgaaaacggacgcacttacttgccagtacgttatgcagctgaagctttgggtgtatccccacaaaacatcctgtttgacaaagcaacttccacagttactctgattaaaggtgaccgcgttgctcaaatcaaactgaacacaaacctgttgactattaacggttctgtggttcgtatggacgttaaagctgtaactaacaaaaaccgtactgtactgcctatcttctgggtgagcagagcgctggatgcatccatcaactatgatgcaactgctaaaacagtaactgttgaaaacaacaactaatttaagagcaactcttttgagttaactgaattagattagaagagggttccttttggagcccttttcttttattagtcttattgacaaaggagagaaattatgaaacgttttggagtggcagtactgtccacattggttctttcttctgcgttcgccagtcttgcaggagctcaaccaggtgatataaaggttattattaacggtgtaactcagcaatatacccagtccccagttgttagtcaaaatacaaccttggtgcctctgcgtggtgtttttgaaagcttgggtgcgaaagtcgattgggacagcaaagctaaaaaagtgacagcatctaaaaatgacgatacgttaactttaaatgttggttctaaacttgcttataaaaatagtaatcctgtacagctcgatgcagcaactcaaattcaaaagggtcaagtactcgttccattacgttttgtgagccaatcattaggcgccaaagtaaattgggatcaaagtacacgtacaattactatttcaaaccaagcagatggaagtacagctggggaagccaatagcttgtccagtaagcctctcacagctcctgtgactcaagttacttatgatacctattataatgattcgttgacctatgatgatgcagttaaactggctatagctgatagtacttcagttaaaacagcagcaacaaatatcgatcaagctgggaaaattatgaaagaagcgggcaagaatattgactttgttccagcagaagcaggtgatgaaggtcaagataaggctttcaaaggttatgctcaaacgaaccttaattatgaggctgctaaaaagaacttggatatgaccaaagaaggcattgagtacaatgtgaaggatctttacaataagcttcttcaaaagcagaatgccgttaaactggctgcattgaatattgaagatgctgagcgcaagctgaaagttgcacaaattaaaagagataaccaaatgtcgagtgattatgaggttacgcaggcaactaatcagttgactcaaaatcaagctgctttagagaaggcaaaaaaagatctagatagtgcatatgtatctttgaaccaagtgattggttataaaccagagcaacgttatgaattaaaggataaacctgtatattctgagtttaaagataatgtggaaactaaagtaagccaagtacttaccagcagcacggctatttggctgagtgagcaaaaagtggatttggctgaattgagcttgaagctctacaattttagtacgccaggtaacacaccttacgaagccgaacagcttaatgttgagaaagctcagtatgcaacagagggtacaaagagacaactcgaagaagcagtaagaacaatctataacaacatcaaagcattggaaagtcaatattcacagattcaagctggtttggtgagtgctagaagtgcggctgatatggctaagaaacaatttgatgttgggttggctacagagcttcaggtttatgaagctaatttgaaagtcactactgctgagcaacaggccgaagatatagttacaaatattgatactttgaagttggcttttgataagccttgggctatgcagggttcttctggagctagcgcacaataattaaaacttaactatacttgctataacctgctgtaggaggacttcatgaaatcacgctataaagtatcgttggctgctgttttacttggaggaggaattgttgctggttccttaatgaacaattcagttaatggtgcctccagttctggacaacctggcacagctgatgatccagtcgtaaccaaaagctatgttgatcaaaaaattgctcaggccatcaaaggtgggggaactgcaagcagtactagtagtaaagcaactagctcgactgctccagcaacaaacgctacttctaacacaacagcgtcaggaacttctggtgcaggaaaaacttccacacaagagcagacagaggctttaaaggtagttgatgtaaagccaggtcaaaaactgattgccaaagcagggtcagagtttattttacgtaatggttatgctgttgtgtatagtatggatgccagtggtgctattgatattacttctggaacggaaattgtccataatcaggctgtcgaaaaaaatcatttattatcctttcctagagaaggaagaggtattcaagtaaaagaaggtcagaagtttggtctggtcgttatggtacgaggcggttatactgttcagtaaactgtttttgtatataagctgctttcggtggctctttttcttaaatactgcttgggatagcaaattgttcttggctaaattgaacctaatcgctgcacactaaccccatgaaagacaatatgtttagtggagggtgtatacgatggcgtcaagaggtcaaagacgattaattcccgaaagccgtgccaggttagatgatttgaagtatgagatcgctgctgagtttgggctaccagtttataaccctcaatatactcatatacatcccaatgctgacagtgaatttgctgcagaattgggggagtttgcggggggccaaaatgtagcatggcgtgatttgacttcaagacagaatggttcagttggtggtgaaattactaagcgactgatacaatctgctgaacgaagcttatctgaatttggtacattgtaaatagcaataattttctaagtttttgattatatagtagcgtataaactaggttatttacatgtgaatcgaaaatgatttgcatgtaaacttacctcaatttcgaatgttgtaattgggctgcatgaattgacaccttgttttaaataggatatcatggcatttgaggcttgtacgcaaccttttcctaccggaaaaggttcattttttattaataaggtaacaagatatctcccgccatttgttggcttgaaggtatctgaataatgccattgccatgtcaggattttttaataaatcctcatgtattttaattgtgggaggttgaaattcatgtctgtaaaaggccgccatttgttcacgtccgagtctgtaacagaaggccatccggataaaatctgtgatcagatttccgatgctgtattggacgcctttctggctaatgaccctaatgcacgggtagcatgtgaagtatcggtagctactggtctcgttctcgtcattggtgaaatcagctccaaatcggaatacgtggatattccatccattgtacgtaatacgattaaggaaattggctatacacgtgcgaaatacggtttcgattataatacttgcgctgtattgacttctttgaatgaacagtcgccggacattgctcaaggggttaatgctgccttggaaagccgtgatcctgctgaagtagataaagaaacggaaaacattggggctggggatcaaggtttgatgtttggttttgctacgaacgagacacctgagttgatgcctttgcctatcgctatgtctcaccgtattgcacgacgcttgtctgaagtgcgtaaggatggaacactgaattaccttcgtccagacggtaaaactcaagtaacggtagagtatgaaaatggtaaacctgttcgtattgatgctattgtggtttctacgcagcatgcggaagatactactttggagcaaattcaagcagacatcaaagaaaaggttattttgccagttgttcctgccgaattactggatgagcaaaccaaatattacattaatccgacaggacgctttgttatcgggggtcctcaaggagatgcaggtctgacaggccgtaaaattattgtggatacgtatggtggttatgcgcgtcacggcgggggagcattctccggtaaagatccgaccaaagtggaccgttccgctgcttacgctgctcgttatgtagcgaaaaacctcgtggcagctggattggcagacaaagtggaaattcagcttgcttatgccattggtgtagctacgcctgtttcgattaacgtcgatacatacggtacgggtaaagtaagcgatgagaagctagttgaattgatccgaaataactttgatctgcgcccaacaggcatcattcgcatgttagatctgcgccgtccaatttataagcaaactgctgcctacggtcactttggccgtacagatttggatgtaccatgggaaagcgtagataaagctgaaattctaaaagaacaagcggggttgtaattcctcgtatattactaaaataaaagcaataacccaaaaagactgtttcatgctttgcatgaaacagtctttttttgatgtgtttcgctgttaagtatgaatttgcaccgaagtaccgaatactgagtgactactcggatatcggtgcatggtccaataaatttttaagtaaacgacaaaccttttgcagttccttgtactgctccaaatacgcaaaaagggctttcaggaggcctttctgagggttcgatttcagagcctcttcctttaaatgaacgtagatttgctgacactcctgtttctcctctgaactccacgaagacagcagtatactgtcttccaaggagtggagaaggctgttaatttgacggccttggtcaaaggggttacttagagcactttcaggtaaccagccttgcttgctccagaacaaatgtggagctgaatcagcattgttcaggctggttgccaaggagctggataagaagataataaactgtgttagatgttcaatcgtttcatcattcatccgatcggcaaagaagcgaatatattcaaacacaatgcttttaagtacaaaggtcatatcccatgcatgatcttcaatgctcggtccaaaaatatcaatcaggcagtcgcgaacccatctgtacaatttgtattcatgattctcgaatgcgtaattgagttgttcattctgaaaaataagcatggaaggctcaggaagatccatcataagatacactttgttttcaacgagatttttcaagtaaagtacaataaaaccgtgcagtttatcatgcttagaaagatcaggtttactgtagagagcccggatgtcttgttcaatgttattttccagaatgatacacatttctagtggaagttcttcttttccttgaaaatatttatagaaggatgctttcgccatcccactttctttggctatttcttcaacagatgttgaataatagccttttctggagaacagccgaatggccgcctgtaaaatatcattttttttactttccatacatacttccccctagggaccggccaactcgacagcatcgaattcacttcatacatcacaaaggttggtcacgtgtgataactgtgtgctgctgttttttgagttgacggcgcatcttgtacttggccatgatcatatacaaggacggcacgacaaacaaggttaacaaggtcgagaataacaaaccgaaaatgacggtaaacgccagtggcttgaagagcaggcttcccaatagtgctaatggaatcatacctacaatagctgccaaagatgtcaataaaatcggtctgaagcgagcagcggccgcctgtattacggcttcctttaattccaatccttcatgtcgtgcatcctcgataaattcaattaacacaatcccattccgcacaacaatgcccgcgagtgcaataattcccatgatgctcataaaaccaataggcataccggtcaagaaaataccaatgatcccgccggctgctgccaggtacacggtcgtcataataataataggaatggagagggaataaaattgcatagtaatcaagagtaaaatgagcaagactacaacgatcgccagctgtcctaagtccttgaatatggttgattggtcagaggtttccccaccaacctcccatttgtagccttctgggaacttcatttgtgccagcttactttcaacatcaaccatcgcttcgcttgcagttcgtccgttcaaatcggcttccaccgtaatcgtccgctccatattgtaatgcttgatttgctgaatagcaaatgacggtttaatctggacaagctggtttaatggaatttgcttacccgctgcattaactacacttaattgttggaaaagcttacttggctcctcgtcgctgtgattcaaatacattttaatatctaccagactgtttccagtatcaaattggctgacttgggctccttcttttaatagaagcagggtgcgagtcaaatctgtgtagcttaccaggtactgatccatcgcttgtttgttgacctcaagctccaatgcatatcgttcaattcctatatcatccacgatgcctgttgtgccctctactgtcgcgatctgctcctttgccttctgggcaagggtttgcagttcattcagatcctgacctgagatacgaatagaaacgggcttacccactggaatcccgagacgaggaacatacatcgtaactgtaactccagggtaggatttcttaacatgttgttcccaagcatcaactgtcgtattgagatcgaatacgttttctttgccgacgacagcaatctgccccaccgtttcgttataactaatatttccacccgaactattaatgtcactaaacagttgtggggcagtccctccagcgctgtagacgaccttggaagtttcaggttgctttttcacccagcctgcaaggtctttaacgacctggtcggtttccgcaattgaagtgcctacaggcatttttacatttagtgcaacatgaggatcttccgactcaggaaaaagttcaactgaggtaaagggaactaatccataggcggctgttccaagcatgagtccgatcatggctgtcaacaagggacgctgaatgaccttaggcatcagtttttgtgaatagagcttgtttaaagaatgaatctgctggccgagcaagcctgctggtttagatttaccctgagggtgacgagcctgtctgcgcttctcataccattctcgaaaaatagggatgatggtgagcgacatgatcatagaggcaagcatggtcagggagacaatagcaggaatgggtttaataaaggcacctacatttccaggaagaaacaacaatggcgcgaaagcggagatggtggccagagttgcaaccaaaatagaaagcatgacctctttggtaccttttacagctgcgactgagggtgattctcctaattccgtaagtctacgctcaatattatcatttacaactacggcatcatccacgagtatgccgagtacgatgatcagaccgacaacggaaatctgatttagagtgataccgaacataggcaaaaagataatggcaatcgaaaccgaaataggaatggccagtgcaacaaatgcagaggtgagcaaattcagccccaacatacaaacgagaataacggccgcaatcgcaagaatcgtttcacgctttaagtcgtcaaagatatggcttacctgatccttttgtgcaaaaagagtttgaaagtgaacacctgcgggaagtgttttctccagttctttgagcttggtattgaccttttcgctcatagaagggatgtctgtgcctgtttctgctccaatacttagcgtaatagccggtttaccctctacataggcaaagtattctgtattaggatgtgccagctccgttgtgccgacatctctcaaatatacaggattaccttctttggtgcgtgtcaaaaggacctgattcaattcatcagctttttcggtctcgcgaacaataagttgataggtacgtccgttgtattcaatattaccagttggaacccgatcaatttgagactggattgcttgagctacttgtccccatgacagctggtattcctgaagcttctggttgtcaatatgaacacgtacttcttgatcagggagaccattgaatttgacgctagatacgccagaaatggtgttgagctgatctttccaagttgttgttaaatcatttagtttatacagtggtgcggaagagtcagctgttagggcataggagccgataaaagagctggttagcttgtcatttacaacaggcacttcagcgccttgaggaagatcagcttgtgcatcctgcacttttttacgcatattatcccaaaccgtttgaggatcaactccgtttttggattcgattaaaatagaggagaatccgttaccagaagtcgaactaatcgttttaacaccttcaacttccttaatgcgtttctccagctctttagttacggtttgttctactttttgtggtgaagcaccagggtagactgttgttactgtggcattttgtatggtgacatccggcatttcctgctgtggtaactggaaaaagccgaagattccgaccaaaatcagcatgacaaaaaacagcaatgtaatttttcgtttttttacgatgtactcaatcatgggcgtccgccttcctccgactgaatcgcatttccatcaaacaggttttctgcccctttaacgataatacgttcgccttcacgaagtcccgatacgatttgcaactgattatctacaacctgattaccaagctccacagggattttaacagcttttccttgaatgtctttgaaaataaaaggcttgcttcccgtgttaatgactgcttcggcaggaacgagaatcccattcttgtcagtcacctgttgagcagctttaatgacctgaccgggtaaccagtctcgctgtggattgtttataacaatctctacgttaacccttcccgtgtcggtgctggtcgaaggatagatattagacaccgtaccttgacgagtctcttcatagagcgccacttctacttgttgaccctttttccaatccttaatttcactgtctggtacaggaagcagtactttgaggcggtcgatggagcctatgcgatagacggcttgccctgacgcgaccaaatcacctgtattcacgattttgtctaagattacaccgttcacaggagagattagacgtgtacgtgaaagtgcaagttctgcctgccccttggcaacaagggctttttcgtagttggcatgggcttgtttttgggaagctgcagcctgttcactggccgcaagggctttgcttttacctgcaagcgcatcttgaaaggaagcttgggcggattgatgatcttcggctgtggctccttccagcaaaagggacagggattccttggcttgttccaggtctttcagggctgcggtagcattcaggcgagcattttcattatctgatgcggtagcagcgcctgcctcaaacagcttctgtgtacgctcgctatccgtcttggccttgttataagcgctttgtgccttatctacagtagcttgcgcttgttgtttctcttgagcacgtgcgcctttattgaccttattaacattcgcgcgagctcctgtaatgccggcatcggcggattgaatcgcggaggtagcagcctgtaaattagcctgtgcgttatcaataccagcctgtgcctccaagatggaggctgtcgcctgtgccacttgaagcttgtagtcagcgtcatccagactagcaataacggcgcccttctgtacagcagtaccgacagtgagatatgcactggctacagtgcccccattttgaaaagccagtgtgttctcctcataagcctgaagagtgcctgacaagttataggccgtatgaagtggcgtggatttgacgattgcagtgcgcacaacggttggctgtgcagatgaacctagagcggcatcttctttttctgtagaacatccggtcattgcgatgctcagggataaagtgaatatgatgatggcccgttgtttattcatgattatcaatccttccgatagggtcataattggagttgtgaactaatcagtattatttgaactaataagttcaaatgtattatagtgcgccgatattgcattcgtcaattcatcgttttagattttatgaattagttgacgggattttcgtaacttttgcctatataataagtctattaacataagaggatttttttgtttattgatagagtacacgtgcggaataaagccgtttgaatacactggagatgggagctattatccaaatgtttttaagtaataagaaacagggtgaagtgaaagtaaatggcagaggaattgctaaaagatgggccgtgttaacactggcaggggtattatgggtcggtccggttgctggaactggggctctaatccccttgaatggttggatgtctgctccaatcgcaagtgcagcctctggttcaactgtaaaattgggcgaagagatcattacttcgggtgcaacattattgaaatatcgttttaaagggtccaaaggaacagcgctggctgatatcattcgagtggacttacaaaatccgtacgtcaagctggatgtcatgacggggaagaatggacagtttacgacccgtcagagtacaggtggcatggcaaaagagaccggggcggttgctggtgtaaacggagattattttaatacctccagcgagggagcgccgatcggtggacaagtatccaagggtgtgttgatgtctactccatctgatttaacgggtatgtatgcctttgctgtaaccaaggatggttctcccatggtagagcagtttacttttgaaggtacagtaaaagctggagatgggtcgtccttctctttggcggggatgaacaaggcttcgtattcgcctgagacgagtgggggcggctatagccactctaatgctatgtatatttatacatctgcttggaaagcgattgagcggcccaaaaacagttcgacaacgcccaccgagatattggtacaaaatggtgtggttacacaagtctccgacaatgctacgttgaatatgaccgttccgcaggatggctatattttacgtactcatggtaaagctgctgattatgccaaagcgcatctgaccgtgggacagacggtagaaacaagctatcaccttcgtgttaaatcgacagggagcgaagtagatccttctaaccttcaaatgatgattggtggacataccatattagtaaatgacggtcagaaaacctctttttctcggagcacaacaagcataggcgggacgcgtgcgcgtacagctctgggatattctcgtgacaagcgttacgcttatgtcattgctgttgagaagaatgggaacagcgttggtgtatccctgagcgagttgcaaacgctgatgaaagatattggcgtctggaagggtatgaaccttgacgggggcggctctaccactatggtgactcgtgatttgggagatacgacagcggggcttacgttcaatacagaatatggcacagagcaacgtagtattgtaaatggagtgggggtatataccaatgctcctaaaggaacgctcaaaggcttcaccatcaagggcaataaaacgttgctgattggtcagaccggaagctattccttcaaaggttatgacaattactacaatccattcgatacctcgaaagtacaagtgacgtggaaatccagcaatccggctgttatttcagtgagcggcggcgctgtaaagggagccaaaccgggaactgctactttaacggcgtccagtggctcagccagcgctacaaccaaggttacggtgcttggagcagatgaaatttcatcacttaccgctggtactggaagtggctcgcttaccgctggagctaaaatcgctgtaccggtaacggcaaagacaaaagatggacagagtgtcagcattacgtcagatgcgctcaaatgggagttcatcggctttaagggaagtgtcaaggacaaacagcttacggtaaatacggtggatgcaggcgtaaaaacgggctatgccatcggtcgctatgatggtttcagcgctgtcgtcttcctgtctgctggcggagcaagtacaaacaactgggagaactttgaaaatgtctcgtatccggttgattttacttcgaatgtggaaggtgttactggcacagcggctgttgtacaaggagatggcgaccatgccagttccaaagtgctagagctgaactacgatatgacgaacggcagtggtaaaatgtatgcttacgctcaattgaacggcacatccgggaaaacacttgaacaggcggctacttccatctcgattgatgtcagaggggataagagtctgaactggctgcgtgcggagttagaggatgctcaaggcaaaacagcatatattgatctcgctaaagtgatcgactggaacggctggaaaaccattaacgcagatatgagcggtttgaatatttcgtatccggcgaagctgaagcgtctttatgtggtcaatgtggcggagggtcaggacgagcgtgctaaaacaggtaatattgcttttgataatatttcttttaatacaccgggaacggtcggtacagaaggactcaaaaaaggaacagctcaaatgacgattggacaaaaatcaatgacggtgaacggaacgccgaccacgattgatgccgctccgatgactcgcgatggttcaacgtatgttccgatcaagtatgtactggacgcatttggcggacaagccaaatggaatgcgggcgatcagcggatcaccattatgcgcggcggtgtgctgatggatttgaccgtagggaaaaaagaagttgttctgaacgggaagcgtcaaagcactgatgttgcacccattgtgctaggaggtaggactttagtcccattaagactcgtttctgagcagttaggaatgactgtaaaatgggaacaagaaacgaagaccatcaccctccagtcatgatatggtatgatatatacttgaaatgctaggattggagtagaacatttgtggactttcaagccgatatcatagaccgagtcattaaaaatgccatccaggtgatggagaacagcaaatatcagatgttcgaaatattggacacggcccggaccgagctggtcacgttaaatcaggagctccagagcgtcttgaaggaaacagcagaaacgatcgaaaaggtggaccagctggaaatgaactatcggcggtcccgcattcggttgactgaggtcagccgcgacttcgttcgctattcggaagaggatatcaagcaggcttatgagaaggcaacacagcttcaactcgatgtgatgattttccgcgagaaggaaatgtatctcaaagccagaagagatgatcttcaaaagcgggccaaaagtgtcgaggcttctgtcgagcgcgctgaaaccatcggttcgcagatgggggtcgtgctggaatatttgtcgggtgaattgggacaagtgacgcggatcatcgaatcggccaaaaaccggcagtttattggtctgaaaattattttggctcaggaagaggagcgcaaacgtatatcccgtgaaattcacgatggacctgcgcagctccttgcgcatctagtgcttaggacggaaattgtggaaagaatgatcgccaagcaggaatttaagatggttcaggacgaaatagtagacttgaagaaacaggttcgctccagtcttgaggaaatgcgaaaggtcattttcaatttgcgtcctatggccctggatgacctgggacttattccgacgctccggaaatatgtgcaggattttgaagaaaaaacgaaaattagatcgctttttgaaacaaggggcaaggaacaccgtctctcttccgcgatggaagcagccatttaccgtctgatccaggaagctttgaccaacgctgccaagcatgcttatcctacctatgtgcttgtggagattacctatcaggcgcagcttgtaaaaatcgtggtgcaggataatggtttgggctttaagccagagctttttcagcaaaaaagcaaagatcatgggcattttggtctgattggtatgcgggaaagggttgaactgctcgaggggagaatggagatcgaatcagctgagaatcaaggcaccaagatagtgattcatatcccaaccaacgtggaaaagggaaaggagtaacaacatggaaaatcaggaaattagcaatgcacccattaaagttctcttagcggacgatcatcagttgttccgtgaaggacttaaacgtattttgaatatggaggacgacattgaggtcatcggagaatgtggcgatggtattcaagtgttggaattctgtaacgtagagaaaccagatattgttctgatggacattaatatgccaattgaaaatggtgtagaggcaaccgaaaaactgcgtgagatgttcccggatgtcaaagttatcatattatccattcatgatgatgaaagctatgtattcgagacgttgcgcaagggagccaatggttatctgttaaaagatatggaggccgagtccctcattaatgcaattcgttcggttcatgaaggatatgcgtttatccatccgaaggtaacgggtaagctcattcagcagcttcgccggatgacctacctgaatgaaacaggggctatggctgaaggtcatacgaaggaagccggcgtgaagtttgtcgcaggtgaaaataatccattgacccgtcgtgaagctgaagtgctgcgtctgatggctgaaggtaagagcaacaagatgatcggtgaatatttattcattagtgagaaaacggtcaaaaaccatgtcagcagcattctgcaaaaaatggaagttgatgaccgtacacaagcagttattaactcaattaaatatggatgggttacgctgtaaagtgtagtctttccatgcattagacgatgcagctgctaatagatatgaatgctgtaccgcctttctttgggagcgatatgtccgctcatacggaaacccagtacataaccgtgacacctcttcctgttatacggcatatattgtcgctataggaggaggtggaaccctcgtgacggctcacttggtttggatattgcttatatacggtgtgggagccgcagtcgttcatcttatgtatatacgacaggcggttcaggcttatcacaatggtgaagattcacgcgcaatatctccgggtcatcgcgcgactcgctatattgtgattacgtccaatgacggagatcgtgtggaatgggtgatgcgttcgctgaacatacttgcctggctacaccggaggccgctacatgtgacggtactggatgatgaatctatggacgatacgctaccgattctgacacggctactacgctatagtcatatggatgtttcagtcatttcaagtcgtttttcaccggggaacccggtcttaccgaagtcaggcggtgaaaagcaggttgttattgatcttagaacggtcaagtcgttggcggacgccccatttgttccttagcgataggggattgtggacatcgtggttaaaatcggatataaatgttttaaaacagttgcataggcaagacgacagggatttcgttgagatctacttgatgtgaagcacacttcaggctattagccataggagtgtgcttttttgctgttctctggggtaacaagaaccgcaaaaatcatgaatgggaggagtaggggaaggtgaagatttcagtatatgcagtgaggtataaagggaattggactctccgattatctgtggatattcgagtagatatgacatggtggatgaatcaagatgagggacaggagaatgttgtcgaaagatgggtgttattaggagatgagcttcccttgtcctgggggacaaagttgtgcgaaatatttaaggaattggcagatatggagcgatggggaaaagggcagtggtgggcttatattctcgcacagctaaaaagtgaactggctcttgagccttttgatggtgaacgaattttatctggaggagtagaaaatatatgcatttgggatcatgtacaagggtggacttcctgcacaaaaggtggggatgagggacgggaaacagacggagttttacgttctattcaaaaaaggagtctcatcacgggaattgatggattggatagggagtgtttaatacgacaagcgaatgaactggctaatttgttgtcaggacgccagttactcgtttcggaagtcgaagcgctgctggcagaggcagcgccaggtttggagcatgcttggcgatccgctgcacaacttgcatatctgcaaggccgactcagctttgctgctggcctcgctccagcaccacgtacgcgctggtctgccgcgcgtacgcatgaacttcgctgcaatcgttgtggcagcggggtagtgcaccgtacgagctgcgcatcgtgcggacgtaaggcgtgcgcttactgcgagacatgtctcgcactggggcgcagccgtgaatgctcgctgctgcttcgtggcgtagcgaaacccgtcctgccgtgcacagcaggcaggaccccggcgacggaactcgaccgctgggggctgagccctgcacaacgtgccgccgctgaagcggcgctgcgctttttggccgcaccgcacggcgaagtgcggggacgttttcgcccggaaggccgtgagctccgggcgttgttccggcgcgatagggttgcgcgccggggatcagatgctgccgcttcgcatggcagcaaccttgcccacagcaagcagtcttcgccaaaacctggcgaaggtgcgaggcataacgctgatcggcaggtgcctgataccacggtagagcgttttctgctctgggctgtaacaggcgcgggtaagacggaaatgatgtttccgcttttgcaatatgtgttggaccacggaggaacggcacttgtggcaaccccgcgccgtgatgtggtactggagttagcgcctcgtttggccattgcttttcccgatgtgagcatggtgacgctctacgggggaagcgcagaacggtggcaaaggggacagcttacactggcaacgacacatcagctattgcgttatcgtcaagcttttgatttggttgtgattgatgagatagatgcgttcccttatcacaatgatcctatgcttgcctttgcagcacgagcagtatgtaagccgaagggcaagtttatctatttgtctgctacaccaccgcaaaccttgcagaaagaggctgcacgcggtctactgccacacgccaaggttcccgttcgctttcatcgttaccctctacctgtcccatttcgtctggggactgcttcagtgcaacattggctgcaaaaaggtcggcttcccgcatcctttattcagcgcctacgcgtatccatacaacgtggggcacaggttttcctgtttgtgacacgaatctcacatattcagggacttgtgaagctgctgattaaacaattacctgatgtacctattgcaggcacctcctcacaagatgaagaaagaaccgctaaagtgcgcttatttcgaactactgaaatacgtgtgctggttacaacgactattttggagcgaggggtaactgttccacggagtgatgtgtacgtattagacgcggacagcagtctttttgatgaagcctctcttgtccaaatggcgggtcgcgcaggaaggtccaaggatgacccatgtggaggtgttatttttacatccccccaatggactcgaggtcaaaagagagcaattagacagattaaacgtatgaatgcactggctcggaaaagaggatacctgaaggaggcgaagcactaaatgcattaattaaaaaaagtttttttggaaatgtgaaacctgaaacaaagtcggtacgtaaactaccaagaaaggtgcattctggtatgaggatgattccaacaacccgtctatttttgaattggttattccatcgccagtctcaaacatgtatggcttgcggcactctcacagggcgtttttccgaatttcccggaatttgtacttcttgttcgcttcaaattccttgggtttacaatattcgttgtgtttattgtggacgtctgacgtcttgcccggattgcgtaaggcttgaccgattagtacgttactatgtgtgcaatcggagtgcaaccagctatacaccgatgatgagagaatggattgggcagttcaaatatcgtggaaatgaaaagtatggttccttgctgggcgagatcatgaatcgagcctatcaggcgatgaggtatgagtttgcaagtcttaaacattctcgtttcaagcaatctttgtggagtgtggatgtagtgacctgtgtcccggtaagtgagaagaggctgacagagcgaggtttcaatcaggctcagatcttggcagaagagattgctaggaggaataagctccccttcctatctttacttgctcgtccacaagatacaggcaaacaaagctttaaatccaaaaaggaacgcatgaacaccatgaataacgcgttttctgtccaccccaatatgggaaatttgctgaagtcgtttattttaaaagctgaatctcatcgtgctacggagaacaagccttctgttaccgttttgcttgtagatgatatttatacaacgggaagcaccttgcaggcgtgtgcacgtgttttgagagaaaaggcattagagcaaggaatacatgtgactattttttgcctgaccttagcaagatcataagtctaaatatctagtattttccatgaaatttcgcttgaaactatgaaaaagaggttataactctcttgaaagaaggattaaatgatggagtaaaagccttttaagccgtacaatcagcaggatttgacaacgagctagagagaggtatataataaaaatatagagacaaacaaaaagtaaggaagtgagggatgaaaacagaatatttcaatttagaggttgatttttttggaaaagaggagtacaatttctatctgttgatagctaacatgattggtaataagtgattagctaatgactaaagagcggacattgggagtgtctcgctcggtagtaaagcagttaattaaaatttaaagctaaaaagaggagagaaaaaatcatgaaaaacgtaatgaaaaaagtagtaatatctagcatgttggcagctagtttaggtgcagtatctttgttgagtccgcttgcaacaggtcaagtattggctaaatcccactccgatgacgaaaagcaacaattggaagatcaaatcatgagagaacaacaagaagcagcacaaaaagcatttgaagcaaaagtttttggaactgtaactactgaaaatgcagcaactacaacaccagctcaaccagctactgagaacaacaatcaagcaacaaccacaaaaccagcaacgactacaactgaaacaccagctgctgtaaatacaatcacagtaaatgttcaagagggcgacacattggcttctatcgctgcaaaatacggtgtaactgttgaagaactggttaaaatcaacaacctggttaaagtaggccaagaactgcaagtaccgcaaacaaacacaaataaataaatatcattataaatgtataatgaagtgtgttttttaaaccaagcgtttgactatagtatacgggaaggcctctattaaaacaatgcttttttgaataattatttgtgaaatagcttgtttttttgggctgcaaatttccacagatgcatctagcttgatttcagatatgttataagttgagatgatgttaggtccatgagatttatgaatacccacactccatgtgcggagcattcgtatgggcgccgttcccccggatttacaggatttccttgatgtcattcggggcacaggtgaacatgaattcttctgaggattgtttcgcccggtttttccctcatcttgatagtttctacatttactcatattcatatatagctattttaattgtatgatgaagcgctattcccgaaaataactggaatggcgcttattttattttctatctaaagtacggtgtaatgtttgacgataaatagatacatgcactaggctgactattagctttcatgggctttctttattttttatgacattgaatataaatatagagaaacttttgctgatggatcattttcccttatgcttttaatatgataacttataagatgtgcaattgtgtaaaatccgaaaatcttttttttgaaatatttgctagacgaggctcttcattataagttaatgtaaggataaaagtaattaaagatcggaaattggaaaggggcgctacagaggatgaatttggataactgtcctcgctgtggaaagctgtttattaagaacgtcaggggaatctgtcagaactgtattaaagaaattgaaattgaatacgaacgctgtgtcaaacatatacgtgaaaataagggcattcatatgcatgagctttcagaggctactgaggtatctgtaaagcaaatcacgacgtttatacgtgagggacgtatttccattgctaatgcgcccaatatgacgtatccttgcgaggtatgcgggataccgattcgtgaagggcatatgtgcgattcttgtcgaacacgtctgactaaagacctgcatcaggctgtacgcgaaagtagtaatcaggatcaaagtaataatatgggctcaggtacctacagcgcgattgataaacttcgtggaaagtagtacaggggaattaaaaacgcattcagctattcaaaaagtttcaaataccgccgataatctttatagagcttatcggtttttttatttttagcaacatgcacaaaataaagaagtgaggcataatacgaaccatgttcgacgctatgtcgtctgatacattctgaccatatcaaataactaaggaaggtggaagttatgaaaattaacgagaccaaccgcatcggagctattaatccatatcagcgaaatattgaaacaggacgtcaagaggagcttaagaagtcccgccgcaaggatgaggtttcgatttctccggaagcaatggaaatgctgaaccgcagcagtgatgcagaccgtgttaagaaaattcaggagcttaagcagcaagtagcttctggaacctatcgtgtggatgccgataaaattgcagagaagctgttaccttacttcaagcagtcttccgaaagctaggtgaaggaatatgcctttagatcgattgattgatgtgctggaacagctagaccaaaagcatcttatcttgttagaactagcaaaaagcaaaaaaaagattgttatggaaaatgatatggatagcctggttcagcatttgaatcaggaatccagactccttaaacaggtggaacagctggaggaagctcgtatggaggtttcgtatgagcttcttcgtgaacgtggtattaagtctcagcttaacttgactataaccgagctggcacgccttgtttttgatcctgaagataagaacaaactcctcagtgtccagagccgcttatcccacaccctttcagaattaaaggaaattaatgcaatcaatcaaaagctcatcgagcaatcgttggtgtttattgattactcgttagatctacttgtaggtcgtcctaatcaggagatgacttatatgcatccagatcagaaaagtaatcaacttgcacgacctggattgttcgacactaaggcttgatccgaggaggaaaatagagtgccatccacatttcattccatagaaacagccaaaagaagcctttttacacaaacggcagctttaaatacaacaggacacaacatagctaacgctaacacagaaggctacacacggcagacggtcaaaatgaaggcttccatccccatggaggcttatggtattaatcgttctaatgtacctggtcaattgggaacaggtgttgaatttgacgctattgaacgtattcgtgagaagttcttggatagccagtatcgcggagaaaataccgaactgggcagttggacaattcgaagtaatacccttgataagctacaacagattatgaatgagccatccgatacagggattcggaaggttttggataacttttataaatcttggtctgatttaagcaaagacccagaaagtgtaactgcacgaactattgtaaaggaaaacgcacttgcattgactgatgcaatgaatcatatgagtaaacagttaagcaatctatctgcggatttaacctcaaatgtggaggctaagtctagcgagctacaaagttatgtgaattccatagcggacctgaatcaatcaattactaaaattgaaggcttgggagataacgctaatgaccttcgtgaccagcgggatttgatcgtcgataaaatttcaaaaatcgttaatgtcacggtaactgatactgatcaaggctacaacgttaatatgggtggtcaagcattagtaactgggtttgcaccgactactggaattaacggcgcttttttacaagccgcttttgcctccaatgatttacaaggtggagaagtacatggaatgatcatctccagagatcaatttgtagcagattatactgcacaaatggataacctcgccaacacattggcaaacggtgatatttctgtaacgctacctaaaggctcagtattgccagaaggcactgtactgaatggagtgacttatactgggaccagccgaacacttcaatcggatttaacagttacagttaaaggtcttaatggtttgcatcaactgggttatacccaagaagataaagatgctaacggtaatatggttgcgggtaaacctttttttgtaacttcaaataatggtgggacaataacagcaggtaatatcacgttaaacactgctatagtagataatcctaacgctattgcagcatcccttcgggtaacaggcactgctcctactgaggaattggttaagggaaataacacattggcatccttgatgtccaatttgaaattaagcaatttcacttcagtttctacggggaatacggctactattgatagctttttcagttctatggttggtcagttgggtatagaggctcaagaggcaacaagacagacacaaaactcgacagccctcgtatctcaggtggaaactatgcgccagtctgtgagtggtgtttcactggatgaagaaatgtccaatatgatcaagtttcagcatgcctatagcgccgctgctcggtttatgaccacattcgatcaattattggataaattaattaactccacaggtgtagtgggaagataagaatggggattaaatatcttgtgttttatacaagggtatttaattacggagggatataattatgcgagttactaacaatatgctaagctcacagcttttgctgaatttgaatcgaaattctgagcgtatgaataatacgcagaaccagatgtcgactggtcgtaagctgaacaagccctctgatgatcctgtaggcattacgtattccttaaggtaccgatctgaattgtcttcaaatgaacaataccaacggaatgtggacagcgcagtgtcttggcttgattttaatgatacggtcatggatcaggcaggccaaattatgcaaagagtacgtgaacttacagtacaggcctctacgggaactaatccacaatctgcgctggacagtatcaacaaagaaattggtcagcttaaggaacaaatgattgatgttgtgaacagccaattgaacggaaaatatatattcaatggtcagacctacgacaagaagccttatgacttccctttgaatgctgataatacgcatgatacgtctggagcagcattaattgctacggatacaggcaatgttaattttatagtaggtgaaaatgtagctttgcccattaatgttactggtaatgaagtcgttggaacaagcgtggataccgataatttatttactatttttaatcagctatctgcggctttggcaagtggtgatattaaagcaagtggggatcaactggccaatattgatacgcgtatggacaaaatgctgaaggtccggtcggaaatgggggctaaatccaaccgcgttgagctaatgcaaaaccgtttaagcgatctggaagtaaacttaacggacttgcagtctaaaacggaagatgcggattacgctgagcttttaatgaattccaagatccaagagaatatttacaatgcttctttgtcagctggagctaaaataatatccgcatcattagttgatttcttaagatagtctaaggagggggaaagatgtccatcattccgatgcttcagatccggcaaactccggctatcctgcacattgatgcagatccagggcagtattcgattcgacagccctcggcagatatggaattaacgacacgacgtgctcaactggaaattcaccagtataagcctcagctgaccatagatcaaagtgcagccttctctgcctataacggtgggaattaccttgagatgaataatcgaatttattcaggggtgccacagatttttttacaagctcttgcgcataaagtggagcaaggcaaccgaatggcggatattcacattcctgggaatactgtagccattgtttatggagaggatacagaaacgcatgtgcttcctgaatttaggggtccagcatctatggataatgtcgatattcgtgttgaaacgcgtgcacctgatattacatatacacctgctgtatcggaaatgcatgttaccgttaatcgtccagagattgagtatacccgagggaaactggagatttatatgcagcagtatccatcagtggcctatattccacctgaaattgatgtcgcgatgtaaaataagttaaggttatagaggttattcaagccgactatagccttttttttataataaaatgtatatatctgattaaatattggaggaatattagtgattatatccacatctatttggggtgacattgaagttaatgaaaaagaagtatatcgatttgaaaaaggaattccgggatttgaggagacgactgagtttgtgttgcttgatcatgatgaggcacccttttactatctccagtcccttcagcagaaagaactatcttttgtcttagtggacccttttattttttatcctaactatgagttcgaattacctgatagtgaaactgaagaactggagattgaatctaatttagtcgtacgcagcatattaacattacatgagcaggtagagaactcgacgattaatctattggcacctttggtattcaaccctgataataggcaagccaagcaggttgttttgcaccagtctccgtattcgaccaagcattcactgcaacctactaaggaagacgaaaccatccgttcaaaggaaggtgaataatcatgctggtactttcgcgtaagaaaggcgaatctattatcattcaggatcatattgaggtgacggtgctcggagtagagggagatacagtgcgtataggaatttcagctcccaaacagatggacatctttcgcaaagaaatctatttatccattcaagagtccaatcgtgaatctgctgcccatacgcagtcaaatttagatgctttgcgcaagatgataaataaaaataacgaaaaataaaaaaaatcctaaaatgctattaaaagttcgacgagaatgtcgatatatatagtacaagctattgcggaggggcggccgacttcaacggatagctgtaacaacaataaaccacatggatgtgggacatttaccttcagggaggaaatttaaaatgattatcaatcacaatatcgctgcaatgaacactcaccgtcaattgaacacaaatacttccaacacaaacaaagcaattgaaaaattgtcttccggtcttcgtatcaaccgtgctggtgacgatgctgctggtttggcaatttccgaaaaaatgcgtggtcaaatccgcggtttggacatggcttccaaaaatgctcaagatggcatttctttgatccaaacagctgaaggcgcactgaacgaaacacacagcattctgcaacgtgttcgtgagctggctgtacaatctgcgaatgatacgaatactaatgacgatcgtcttgagctgcaaaaagaagtagatgagttgactaaagaagtaacacgtatttccacagatactgaattcaatactaaaaaattgctgaatggcgatatcagtagtgcagtattccatattggtgctaatacaaaccaatccatttctttggctattggtaatatgagtgccacatcgttaggaatcaatgctgttagcattggaactcaatctggtgctaatgctgcaatttcaactttggatgcggcaattaaatcggtatcttctgaacgtgctaaactgggtgcaaaccaaaaccgtttggagcacacaatcaacaacctgggaaccacttccgagaacctgtccgctgctgaatcccgtgttcgtgacgtagacatggctaaagaaatgatgaatcaaacgaaaaacaacatccttgctcaagcttcccaagctatgttggcccaagcaaaccaacaaccgcaagctgttcttcaattgcttcgttaatcgcttttcttataaaactgctgagatttttctcggcagtttttttggtttattttacatataaaggaacaatctaatctttacattttatcaactatgtctaatttatgattataaagtagccgatatatatactaaactgattcgtaaatgcgaaatgagaggaatacatgatgaagactatcgcgctatgtatgattgtaaaaaacgagcaagagtatctaagaagatgtcttgatagtgtaaataataaagtagatcagattgtaattatcgatacaggctcaacagatgaaactgttaatattgctaaagagtatactaatgatgtatatcatatggaatggatcaatgattttgcagctgcccgaaatgagtctattaaatatgcgactacagattacattcttgtacttgacgcggatgaatatcttgagaaatccgctgatctacaaaaagaaatctcatcaggagcagactattatttcacaaaaatacacaacattatgtcatttgatcgtgctctaaaccatttggctatccgaattttttcgaataataaagaattatactatcagaatcgtcttcacgaacatttgaatactatggaagaagagtttgattttaaaagcggacaagctgaacttgttattatgcacactggctatacggatgaaatgatggagggaagagaaaaagccaaaagaaatctccctcttatgctgaaggaagttgaagaaaatccgacagtgtatagcctgtttaacatgggtagaacttacatgtgggttggaaaatatgaaaaagcaatccctttcttacaaagagcttatccgatgagtaaaagcttaacaattgctccggatttaattataactttatgtcgttgcttaggggaaatgcagagatacgatgaagctctacaaattctacaagaagcaactattgtttatccgaatgaagtagacttacttcacctacaagggctctattttatggaaattgggtactacagagatgcgatagtgacgatgactaaatgtcttgaaattggtgatcaaggtatcaccttcacagaaggaaatggcagctatattgcacatttcagactcgctgaatggtatgaatcgcgtaacgatttggtgaagagctatgaacatattttagaagcttttaaacttaaaaatgactttgcgccgattatgggtaaatattttaaaattattgagaaagcaaatgttccattagaagaagtattcgtaagtacaaaccagttgtatccgatatcaaatagtggtcagctggaaaaaatgttagaagtaatgtatcagttgagaaatcccctcttgcaaagatatctgacacagtataacgtgactgttcaagataatgtaatggcaactgcacggcaatatgctagggactatgatggagcacgaaccttgtggttacaaatggaaagtgttgatgagcaaaacggagaggatcttttattattatctatgattctcaaagatgaaactctatttggaaggggcaaggcactacttaatctaagtcaaaaggaacaaaaaaatctatataaaatcattatggatgatccttctggagatgttaagttaacaccatatttagagaatatattagaaaaagcactgatgcatttaattcgattgcaagaatttgagacatttgagaagatattgaattatttgtggcaaggtagtgttgatatgaaggttaaaatctgtgagcaccttgtgggctatgggtttagcgagatagccattgatctcttaattaaaatgtttgaacaatatccaagggataaaaatgttattaagatgttaggtgaagtttgccttgatcttaattatctacaagatgcacagcttttttatactaaattgcttgaagttagtgaagaatatatggcgtatgagagaacttacgagttatatgaaaaagtgaatgatgaagttgcaaagaattatgttctaactcaaataaaacgtaaatttccactatgtgcatggtctaaacagaattttaattaataatataatgctcaaaataaggagtttattatgggaaatatcacagtagaaaataaacctcgtttggtagccctatggccagaatgtttaaatgttcttctcactaaagatctcgggatgataccgtttatccttcataaatatcataattataactctgtaattgcgtgttatggcattgaggattttccttatgtagacgcagaagtgaagggtttgaaaattgattctattgaaaatggaggagacatcttagttgatggtaataattatcttgcaaaaaaggcgaaagagatcgatatattattcttaatgggaatttatccgtttacgcttagttggattgagaaatacaagattttaaatccgaagggaaaaatttatttaaagctggacgcgaatatatattggatgaacaatattgatttaacgaatgatctatttgagacgcttaaaaagtgtgatgtaatcagcgttgaaagcaagagactgtactattatttaaataaaaagtggcccttgaaaatagagtatatcccaaatggattttatgattttcactcaagtcctaaggtaaagtacgaagagaaagagaatgttattttaacagtcggtagaataggaactcatcaaaaagctaatgaagtacttttagaagcgtttaagttggttgcttcgaaaatttcgggctggaaacttaaacttgtgggcaatgttgaagataattttatccaatatgttcatgagtttcttactgaaaatccagatcttagagaaaggatagagtttctcggttcaatagaggataggagagaactggaaaaacaatatcggagagctaaaattttttgtttaacttcaaggtacgaagggtttccgttggtttttacagaagcatcccaaaatggatgttttatagtttcaactgaaatagacccagcttatgatattaccaatgatattacattaggggaggttttccctgtagatgattatcatagactgtctgaaatattattagaggtttgcaacgataacttaaggctagaacagataagttatgaaattcaaaacttcgcagagactaatttcagttggactaatatatgtaagaagcttgatcttttattacatttaaattaatgggggaattctagtgattgaaataacattccaaaataatgaagtgaagttaatgaatacacaaaataatgtttcagaaactgttttgcatttcggtggaattcataataacttgacaacgataagttcgccaaagttgctacaagaatacattcatatgctggaaaactattcaactatacaaaagtatacttatggcgaaactaccatgattgatatcgtggcacttacaagccttgtatacaatgaattaatggctgggaagcattctgggatcagggctttagaggtgggaagttggttcgggtgttcgagttatttctttgccaatagtctcaaaacgttctcagatagtaatttcctattctgtatggatacatggcagggtagtccggatacagcaagccataatattgcaaattatgaaaatgcatttgaacattttaaaagtgttatgagatatgccggtgtttacgataatataaagcctattgtatgtgattcaatggtgggtatggacattctgcaggatgattattttgatattatttttgtggatgctaaccatacgtatgactatgtttatcaagatatagtcaaaggaatcagaaaaattaaagtgggcggactattaatggggcatgattgcgagtgttatgcagatgaacttcctcctcatcttttgcaaggtgacaataaacatttagatggtgttgaaggttatcatacaggagtaattaaagccttgaatgatatttttggtagatcttatagtcggtttaatcatagtcttgtctggtataagagaataactcaagaagacaaagatatgtttgaaaaaaaaacttctaagtacaactacgatagggaaggtcttgtagaattagctgaaacaatgaaagaagctattcagtatatatacaataatatttcagaggggaaatcagatacacttcaaactcttaccgttgatacggtgcaggcagcaaatcaactagagaaagaaatgctcccactttgcgagactttttataacaaggaattgaaaattaatactaatatgttgaagagtgctctattggattttcaaataacatataataatgattttccacaagcgctttctgtactggaatcgaaagttattgagagatttaatgtatggttggattgttttctggaaagtgaaatctagcattgcataattagagaagcagatgtgcaacctggtgatggaggcctattcctaaaattataacgaaaaagcttttttgattaagtggggaataaaataaaaaacctctttttggatttttggaattatcacttaatcattccaaagagagggagccatattctcagaaactactgctcatcgattcgaccacaataacggtagggaattactcgtccggtctaggctccttagcatgaaagttgtcctcagcgcttatcgtatacgtttagttaaaaacggtgtagatcacgcgtaagtcttagtgttccaagtatgaagaactggagcttggtcattttacgcgcctgctcttgccaaataagctcctattcgttaaaaataacatccattgggtataaaggatatcttcccttcttatattcacaattatagttgttccggttataaatctttcaaatgaacacagtatacattataaattctaattggaggaagtgatgaggtgctaagcagtatcataatattaacgtataataaattagattatacgaaagaatgcatagaaagtattcgcagttatacagatcaagggacttatgagattattgtagtcgataatgcatcgaatgatgggacacaagaatggattcaaagccaagatgatatttttgatatatgtaatgaaagtaatttaggttttccaaagggttgtaatcaaggtattgatgttgcaaatggaaacaatattgttcttttaaataacgatgtggtggtaacgccaggatggctagatattttactaaatgctttatacagttctgaggataatggggcagtaggccctgtcaccaatagtgcatctaattatcaaactgtgcccgttgcttatcaatcaaaaaatgaaatgttagcttttgctactaggtataaccgccctgataacactaaatgggagcaaagactaagactcattgggttctgcatggtgattaaacgagaagtggttgacaaagtgggtttattggacgaaatgttttcaccaggtaattatgaggatgatgattattcttgtaggattatccaatctgggtataaattaattttatgtaaggatgtatttattcaccattatggttctatatcttttggagaagctaatggatcgtatacaaagctgttagaaaaaaataagtgtaagtttgaagggaaatggaattttaaatctgaagatttgagtaacataaggcgtgaattaagtagtttgatagaacagccaaaagaagggcagattattagggttttagaagtgaattgtggatgtggcggaactcttttggaaattaaaaataaaatagaaaatatagaattatttggaatagaggaaaatgagtttgcagcagcttttgcatgtgaaatagcagaggttcgggttgcaggtgtagaagaggcattgaattatcctgaaaattattttgattatattattctttcaaatacgttcgagaagttaagagatccatgggagtttttgagaaaattaaaaatgcagctaaaacagaacgggaagatcttagctagtatttataacgtaatgcactttagcgcaattagatctatgttaaatggtcagtggagctatacagataatggtttacttgctcactctcatattagattttttagcctctatgaaattgataagatgttcacaaaagcaggatttgaacatatggaataccaaagtattaggctaccaatatctgatagagatcaaaattatattgaaaatttaagcaaattaggaaaccatccggtagaacagtacaagacgtatcaatacgttgtaaaggccttaaataacaatgaaaaggatatgttgcaaaaaatcattctcagattggaaaacgaaaattatccgaaagaacttttaactgaatttataaatttgattactataaataacataacttacgtagatatcattaacgagatagaaaagttggtgactataaataagcaaacgatgtataacacattgggaactgcgctatataaggctgaattatttgagcatgtctttcctcttttttatgcctcgtatgaattgaataaatttgataaagaaaccttatacaatataggttttttattgtataaggctggggataataatttagcattacactatcttcgacaaatagaagattacgacccagagaccgctgaacttgttgagttaatacaaccttgctgaattatttgaaacaagaaagttttagatacacacttcagcagtttaggaattaaaagaagtaagtagatagaaatcgcaactgttataggctcatttttactgttatcattgtttacgtttattatgattcagttaattagcatttgaaaattactcgtaatctggattggttcttaaaaacctccttttaaaggagcgatgcttgataaattagcctttgcatgaaaacttatagagagcgggtttccttatgacgttagctgaacaaaaagaattgattaatactctgttagaacttgataatgggttaataacagatgataaagttgcgaaactactcagcgatatacaaaaaaatgatgtattagaaaaagtccttaataccatctcgaatgaaataactaataaaatagatattctaaactatctagctgttgaaggtttcaacaatggtatgtttgaccatataatacctttacttcaaacatctcttgaaatcaatccttttcataaggaaactttatttaatttaagtagcgttctatctcatttcggtgaaatagatcttgccttagactatgcaaaaaagatacaggacaatagtgatgacactttggccctaatgaaagaattaacgaatgcaattgccgtagagaaaaaaagcggttctcaaaatattttgaacatggaacagaatgctatcagctttacaggagaacgcttggtcattaatcaagatgtaaaagacaactttaaaaatgtgcttgaagaacatttgcgcagatatgaattagcttgtgaatattctaaagataaaataatacttgatgctgcttgtggaaccggatatggttctaaaatgatgcaatctgctggagcagcaatggttgtaggtgtggatattgatcaagatagtgtgaataatgcaaaaaagacttatcatgctgacaatatcaactttatgtatggtgatgtgaataaattaccatttaaagatgggaccttcgatatggtcgtttcttttgaaaccatagagcacattgctagtggagccgattggattaaggaatctgctaggttgcttaaggaagatggccttttcctagtatcgactcctaatcgctctattaccaaccccggtaactactttgaagaacaacccatgaatcaacaccactgttttgaatataacataccggaatttatcggtgaattaatgaacgagtatgatatattagatatttttggccaaagctatataaatgaccatgatagttactactatcatgttatgagagatgctcttcagctcaatagggaatttgtacctgataaggtagtcaagcaaactgaaacacatgagttgatctcatttaaagatgtgaagaatgcgcaaccaatgtatatagttgcagtatgcagaaggaaaagaaaaacacctaaaagattatcagagtacaaccagatttcaaatccggaacctttaaaaacatcttcattccatggaatgggtgaaaatgtttttgtcggagaaggatgtgaaattgttggtgctgaaaaaatttctattggtaataatgtcatgattagaaaagattgttggctaaatatcgctattaatcaaaataagaaggacccccaaattatcattgatgatggttgccagattggaaaaaactttactatctcggtttccaatagagcgcacatcgaacaaaatgttctgattggcgctaatgtatacatctcggattgtggacatgcatacgaaaatattgacattcctattatgcttcaaggggtctcttccgaaacaaacgaagttactatcggtgagggatcatggttagggattaatagcgttattgttggaaatgtccgagtgggtaaagggtccgtagtggcagcaaactcttttattaataaagatgtacccgattacagtgttgtagctgggaatccagggaaaatcatcaaaatgtttgatagtgtaagcaaatcgtggagaaaagtatacaatgatgaagatattcaatttatattaaaaaatcgagttgactcatccgagttaagtctataaaaggagttttgttatctgtactcaaaaaaagtgcaattcaggtgattttcggagattggaagagtaagcaaactgttttgagtgaacatcgccaataggagcaagtttcttttgactgttaaagtgagtttgagatcccgtagagtttttctgacctcaatcattctctaagtaaaaaagaactgttttacttaaactagtttaagattttttgtatatctgatctttgcttttgttatgggaaatattctttacttctctatggtacgtaactctaaactctatttttccttgcattcttcataatatactttaaacaaccgataaaataataaacaggccatcggaggttggaagaatgaatctacaattttcggtttcaacgaatcagatgaatggacaggcaaacggtgtgtctcaaagtagtgaaggtttcactgctggaaacaaaacaactgactcattagtaacttctattaaaagtggatctgctttaactaagttggagcagcagggggttgctattcctcttggagaagagcaacttattcgtgctatagaccgagcagtgaaagcccttcagggacctacaactacgttggaaatgagtgtgcatgaaaaaacacatcagatcttggtcaaagttctcaataaagacaccggggaattgattcgagagattcctcctgaaaagacccttgatttagtagcaaagatgatggaaattgcagggattcttatcgatgaaaaagtataaggaggtaatgaaatgcgtataaacggtttctcgggaatggatatagatagtatggtcacctcgttaatgaccgcgaagaagtctccattaaataagctgaaccagcagaagcagacattagagtggacgcgtgatagttaccgtgaattaaatactaagatcgttcagtttagcgataagttgttcgatttaatgactaagtctgacaaaatgaacactcagaaatcgacgttaactggtaatacaacggctattaaagcggaagctaatgctgatgctagctctacacctatgtctgtagttgttaacaagttagcaacaaagtccaatatgcaaacctctacaggcctacgtacagcgggcagcagtacggcagatgccactaaaaataccacattggagcaaattgcaggtggcagtgcgtcagatacttatgagttaaatatcaatgacaaaacaatcacgtttcttaaaaccgatacaatatctgcagttatgggccgtatcaattcagaaggggcgaatgtaacagcgacttttgatgaaatcagtggtaagttctccattacagctaaagattatggggatagcaataatattaaattaactggtgctgataagcaggttaaaagcagtacgcttatggatttattccaaattagttctacagatgtaaaggcggctgaaaaaggggaagttatagtaacgaatactgcggattcgagttctaaaacttataatcctgataacaactccctggtcgttaatggagtgtcactgactctgttagagaccacgggaagcactggaccggctaaaattacaacccaatcagatccaacaaaagctatggagaccattaaatcttttgtggatacttataatgacctattaagtacatttaatacaaaattaagtgaacaaaagtatcgcgattttcctccactgacagccgatcaaaggaaagacatgaaggaagatgaaattaagcagtgggaagaaaaggcgaaaagtggtcttcttaaaaatgattccatagtaagttctgctgtgtcttctatgcgtatggttatttccagtaaattaggcgatttaagttcggttggtattactacaggtcaatatttcgaaaatggtaaattacaaattaatgaagagaagctgaaagctgctttgacgacaaatccggataaggttatgaatatattcaaagggtcgtctgatgttgtaaacagcaagcctctctttagcgaattaagaagtaagcttgatactacgttagacatgtttgtaaaaaaagcaggtacatcaaaattcgatacaaatgctagtatgaccttaaaggctgacagtataatgggaaagcagcttaaaaactataacagcgatattacagagatgaccagaaaacttgctgatgctgaaaaacggtattacaagcagttttcggctatggaatcggctatgaacaagtaccagtcgcagtcgtccagtttgacaagctttttacaatagtctagaaaagggtgattcgtttgatctcatctccttatgaaaaatataaacagtcttcggtgcagacctctactccggggcagctcattattatgttatatgatggtgccattcgctttgtaaaggccggtcttgaaggaatatcatctaatgatattgctaaagcaaacataaacctgggcaaagcacaaaccattattagtgagctaatgtccacgttaaactactcgtatgacatttccaaaaatttatatgctttatatgagtatatgaactatttattgattcaaacgaatatcaagaaaaggattgagtcaggtgaagaagtcctgggttatctgcaagaattacgtgaaacttggattgcagtgaacaagctaacggtaggtatgtcattgtcaacggaacagtaagctatgataaatgacgctttatctcaattagagcaactaacccaacaattcatacttcgactgaatgagacaaattacgaggaagttgagatttttgtcgaagttcgtcaaatgaaggtggataaactgctgagtgtcttgaaaaatacgcctatgacagcggagcaaaaacagaaattagagtctattctaagccacgatgcaataattgatcagcatatgcaatcgctaaaacaggaagcccaaaattggcttgtccaaagaaatatggccaaatcgcaacgcagtgcttatgaatctaactatacgcctgatagttttctgatggatcgtaggaaataatgttaaaaagctctcgtccaacacgttttattgtgtggatgagagctttttaacatttgtaaagccactaattgagtttaaacgaaaaaaagacctatacaaaaaaatctatcaatttattgtttcaggcactaaaatgtagtttaaaatatgactagtaagtctactttagttcaagttttgatgtttcaatgaacaaagttgttgactatttacccattgtattatatatggaataactatacatgaaaacattatcaattccaattgacaatggataactttgggtggtatagtcggaaatgtgggcgagagcttcacttcatttgatgacgaagggaatgttagtgcatgcaaggtaaagtaaaatggtttaacgcagaaaaaggttatggtttcattgaaacatctgacggcggcgacgtatttgtacatttttccgcaattcaaacagaaggcttcaaaacacttgaagaaggacaagacgtggagttcgacattgtcgaaggcgcacgtggaccacaagccgctaacgtaaccaaattataatcatccccggcatagccgacctacataattggtaagatggttagcaatggataacgcgctagcaactgccctggaatatattccagggcttttttatgttatctaattacataaaaaagccccttacccagtggtaaggagcttaacacaatagaacatctactctagagaaccgtcaaagtcagccatctccacgaaaatggtattggaggaggcagattgtttctctacgcttccgtctggataacggaattgatagcgcaggataacctgagcgatcagatacgcgcggagcgcagattcgatgtcgaaagagaatacgatgactgctttgtggtttggatcaagccgacctaacggaataccttggagcaggttaggatgcggaagtggcacagaattcacggtgaccgttcgtagcaaaatgaaatcttcggctgcaaatggtgcagtgagcaagagctcttccagtggggtatttccgatgtttcccacatggacggtaaaggacagggtatcttcttggccgacacgcaaagcgctggagctaagcgtaagtttagggatggctgcaataacggtcacgccgacggtgttggtctgggaggtttcctgaatggtctctcctccactacgacgtgaggtatattcgatggtggcctggttgctgaatgttccatctgcaggtgcttcacggatttgtgcctgtaatgtaagggtgagcgtctcccctggtgcaatatccgggagcgtgatacctgcagcgagattagcgcctggctgtgcttcttcttgaatagtcaggctgttgggtacataaatgagtccatgcggcaacgggtctgtgaacagcggatactgcgctgtgatcccccctttgttagttatctgtatggtgaaggtgagtgtgtcgcctacagaggcatccgtggtactcacctttttaactaattcaagcagtgggaatacaactgggatcgtaacggtattggtattcaatgcccccgatacgactcttcctccaggtaacgtaaacgagtaggcaaaggcagcttgatttacgatgtagccggatggaggcgtctctaatacggtcacttgataagtcagtgtcaatgactgtccgggttccacagacccaaggctaacaccgacagcagaatcgactcccgacagtgactgaccattcaactgtatgctgtcaggaatcaatagagtcccagcaggaatgaaatgttgcagtgtaacttcggatgttacgttgccaaagttgttgagcagtaccgtataagtaaggctttctcctgcgatggcctctgtattttccgtagagatacttgcggcaagctgtggatcaaaaacagttatagtcacggtgttgctggtaacctcgctcgcaccgtcactgccagcatattgaagccgtacgctattgtttagacgtcctccgagaggcagagactgaacgttcacgctgtaggatatatccattgtctgtcccgcctgtaagctgccgataaataatggttcaccctgcttgctagaagcaggtggagaaccgttaattctcaagctatccgggtttatgatggttccattcggtacgtaatcggctaatactacatcggtaatgaccgagcctccatcgttaacaagagtcagctgataaggtacaacatcccctaatgcgacagtagacactgttgtgcgtagcacggctgacaaggctcctctagcagtaggggctacttttaccgagacagaaggtgaagcagttaccagattcgtgcttcgtccgtccggcagctggtaggagtaagccagcgaagcttgattcaccagtgtgccagactcggaggcacgaatgacaagcgcggagaagacggtagtcgttttttctcctggtgcgatggtgcctagggcaatgccttgccctggactgaccccatattgaggaattccattaaccgaaacagagccaggaacaaaagaaagctccgatggcaatgagtccgttaacaagccaaacgcaccgatatttcccgtattttctgtgacgatagaataggtgatgctttggcctggctgtacgctctccgtgctggctgttttcgtcagtttcaccacaggctgaagtaaggcaatggtgacagcattggacaaaacggcactcgcttcttcaccatttgtgagtaacaagcgcgcctgattcgtacgtggtcctggctgttctgtcgctgtgatacggacatcaaaggatatgacagtcttggtattcgcttctaacggtggcaaaggtatgccagtgccgggatcgttttctgccaccgtagatccattaatctgaactgaacctgtaataaactcgatgtcctctggcaaagtgtccagcaaacgggcatcttgcacggtattcgtatcctcgttgaggatcacgagttcatacgttaaggtatcgccagtagtggcgaaaggtgagcttacgcttttacttaatgtgatgtctagcggtgacacggctacctcaacaatgttggataagtggaaaccgcccgcctctcgcccatctggtacattaaagagatagtctacctcagcctgatcgactagtagtacggttgcagggatggaggataccagcacttggaaagtgacggttgccgattgtcctggtggtatggctggagtcgggatgccagaaaccgggcttgcaccgggagctgcaatgccgttaatcgagactgtgttgggaaggaatacagagccgtctggaatattgtcacttacagtaatcgaggctgcaatgttacccgtgttggatacgacaatcgtgtaagtgatgatgtctccgactgtggcattattggtattgcttgttttgactgctgtcaggatcggctggaagaccgaaatggttatcacattggatgttgagctgccagtaaatactccgctggtaaagctaacggatgcctgattagttaattgtgccggtgttggcaagaagtcgactcgaacctggaacgtaacggtagtaacagctcctggagcgagcgtaccgatggcaataccaaagccagggtttccatcagggaaggaagttccgtttatggtaacactgccattcacaaaggagcttcccgccgcaatcatatctgaaaccactatattactggctgtactgatcccattgttggagacagccagtgtgtaggtgatgatatcgccaataatggcgtcggtagccgtcgttcctttgacgatgctaacgtctggtgaggatacagagatactaactgaattggataccgcagatccagatacagttctgccatctggtggttggaaagtgaatgagcctgatgcctgatcgaccagtacctgtggattgggcagagtattgataacggtttggaacgttacggataccgttccgcctggcagcacggatccaactggaacgccagtttcgatggacaatccaggttgtggactgccagcaatgctgacactgttggcaaggaaagtcgatccggctgggatgttatcgctgatggtaagcgctgctgcaatattgccgttattcacggccgtaatcgtgtaggtcagtgtatcgccgacggaggcgttaagagtgctggatgccttagtaattgcaattaacggttggaacacaggtacgatgagtggatcggaaaaggcagtgccagtgaacgttccgctagtaaatgtgacagctgcaatatctgtgagcagtggtggctgcggcaaagactggacagttgtctggaaactgacgacgaatgtatttccaggtgcgacgtttccaatggcaattccagcaaccggagaggcattagggaaggctactccgtcgattaggacactgcccggaacgaaggaggtacctgcaggaattgtatcggttacaacagtatctgtgactgaatccacaccgctattcgtgatgctcagtgtatatctgatcgtatctccgactacagcggctgccagactggatgttttaatcacctgaatattaggtgcagacacagcaacattgactgtattggatgtgacggaatcactcagcaccctaccatctggcggtgagtacgtaaagtttgcttgcccttggtcggtcaatacaggcggagttggcagagacgagacgatagtttggaagctcactgtaatactgcctgaaggggccagtgatccgagcgttatgcctgtaactggcgaagctcctggtacaaggatgccgttaacgactacgctgttaggcagtagttcagagccagcaggaatgttatccgacagcacaggtataacggcaatatttccggtattggtgagcgtcagggtgtagaccaatgttgatccgatctgtgtgttgacggtattcacggttttggtcaggcctatgatcggttgatagacgggcaaggtgaccggatcggattgcgaagacgaggtcaacgcgcctgaagtaaagctgacggtcgcttgattggttatttgcggcggctgcggcagattaacgacggagacctggaatgtaactgctgccgaaccacctactgcaatggtgcctacagggataccggagcttggcgacgcagcaggcaccgaagttccattcacggttacactacccggaacaaagctggtaccgggtggcagttgatcagatacaacggcattgacgacttgactgattccgttattcgtagcaatcacagtatacgtaatggtatctccgactacggcatctgtagcggaggctgttttgataacgtccacatctggcgaagagaccgagatggtcacagacggagatactgtacttccagtcaggacacgaccatctggaggttgatagctgtaagctgcggtcgcctgattgaccaatgtacctgatgcgggcagtgaggtaatgactgcctgaaaggtcagagtgacagtcgtagctgcacctatgatacctaatggaatcccaacacttggatctgaaccaggtgcggcggtaccattgattactacactattaggtataaaagcagcccctgccggaatgggatcactaagcacggtatctgcgccgatgtttccagagttcgtaacggagaatgtataggttacagtatctccaaccgtagctcttcccgttcccgcgcttttagttacagtgacgatcggttgatacacagggatggtaacgggattggataccgaaaatccgttaaatacacctgaagtaaagctgacggtcgcttcattggtaatggacgctggcgaaggcagtgattgtacgttaagcaaaaagcgaatggtggctccgcccccagctccaagcgttccgacaggaatgccgttttgcggattggctgtaacaacaggtgtaccattgattgtaacgctgcccgggacaaaggcagttccaaaaggaatggtatctgtgacgattacgttagtaaccggatcgagtccgttattgaacgcagttatgacataggggacagaatcacctacgacagcgacagccacatcagctgccttcgtggctgtaacattcggtgatgagatcggaatggatacaggtagggctgcaccatttccggtcagcgttcgtccatctggtagctggaacgtgtagttcacagtggcctggttggttagtatggagccgggtggtactgatatgaccacagcgctaaacgagacgattaccgtcgcacctggggcgaccgaaccgatattaatgcctgtaatcgggtctgctccgggaatgggcgaaccgttgaccagtacgctattttgattcaggctaagcgagctggacaacagatcaagcacgaccgtttctgcaggcgcgttgccggtattggttacagtgatgaaaaagccaagtgtattccctacagttgcacgatctgcactgagggtattggtcacattcaagattggctgaaatacaggcagactgacctgattcgaggcggattgacctgcgaaagccccggaattaaaagagaccgttgcctgatccgttgacaaacctgacgctggcaaggatgttaccgtggtctggaaggtgaccgttactgagccggcagcagggacagtgcctacggatacgcctgtggcgatgttggctcccggtatagtgacaccattgacttgtacggagttaggtataaaagtagtgccatcagcaatcgggtcgataaagacagttcccgtcacgggtgtaatgccgctatttactgcattaatggtatacgtaatggtatcgccgaaggcaacagaagtctgattgaccgttttggtcacggtgacatctggattggatacgggaataaacaccggattcgattgtgcgcttccatttaatgtgcggccgtcaggtggctggaaggtgaatgtggccgaaccttgatttaacaggcccaggccagtggggacagcgttaatgaccgcttgaaaggtaagggcgacggaagcccctgctgcaatgtttccgaccactacccctgattggggattggctccggcaacaggcagaccgttcacggtgacgctattcggtataaaggaggagcctgatggaatggcatcggtgaaggtggcggttgctgctagattacctgtattttgggcagtgagtgtatagactacggtgtcgcctaccgttgcttgactcgtatttgcgattttaacaagactgataataggctggtaaacagggacgacaacggtgttagagagtgatgtgaagttcagtgtaccgctggtaaaagaaactgtagcctgatcactcagctgaggtggctcaggcaggctgttgacagacacggaaaaggtgacggttgttgacgctccagcagcgatggagccgattggaatccccgttaagggactggctgacggcaatgtcgttccatttacaataaccgagccaggaacaaaagtggagcccgacgagatcgtatcgtttacccgaacatccgtcacggtttggactccgctattggtagctgtaatggtataagttattgtatcgccgggaactgcgtcagctaccgaagcacttttacttacctgcacattgggtgatgatacaggaattgtgacaatattggacgaaacattgccgttaacaatccggccatccggcggttgaaaggaaaagctgatattcgcctggtcggtgagttggggaggtaaaggcacggaagtaatcaccacctgaaaagttgtttgagtcacggctccaggtgcaatggagccaatagacagacctgtttcgggactggcaccgggaataggaacaccgttgacaaccacactgttcggtaccagtgctgagcctacggggatattgtctatcaatgtggcagcagctgcaatattaccgctgttggttactgccacagagtacgttacgatgttcccgacaatggctgatataggctcagcggttttgcttacgcttaacaccggagcgttcaaagccactgtcaccgggttagatacggatacgcctgaaaaagcaccgctggtgtagctgacacgcgattgattggtgagctgcggcggacttggcaatggagaggataccattgctctgaaagtgatcgtagctccccctccagcggcaatgctcccgattacgatacctaaagacggatctccactggctattgtggagccattcagcgttacgctacccgcagtgaatcgagagccggccgggataggatcggaaacgaccacattgctcacggtctggattccgttgttgagtacggtcagggtgtataacaccgaatcacccggaatggcggtggaacggtctgcagtcttcgaaatggacacattcggcgctgacagaggaatggataatacgttggacgatgtgctatctgttcgcactcgcccatcgggcaacgtaaaggaaatggcggcggtggcctggtctgtcagttgggatggtgttggaagagaagccactacagtttggaatgtcaatgtgatagggctttgcggcgacacggttccgatgaaaatacctgctgctggactggctccgggctgactaacaccattgattaccacgctgttctccataaatgtggacccggcaggaataacatctgtcagcgttacagaagcgttatagttgccgctgttcgtgaccaacaatgtgtacagaatcgtgtcgcctatcgtagcggctgttgtatttgcagatttggccacactgatgcgaggctgataaaccggcacagagacggtatttgtctgggatgttccggtaaaagcaccgctggtgaagctgacactggctgtgttttgcagcggctgtacggacggaacggcattgaccagcacagcgtaggacacctgcacggatgcgcctgcgccaatggtgccgactggaatcccacttcttggatcggctgtgctcacaggtgatccaccgacggttacgcttccgggcacaaatgacacgctgccggggagtggatcggtaatcacggtgtttgtgatggggtcaattccgttattaacggcgttcacgctgtaggtcagtgtttcgccaacactaacggatgtgaaccccgcagacttggttacggctacgttgggaagcgaaatcgatacggaaacaatattggaaagaagtgagcccgacagggttcttccgtcttgcaactgatatgaatattggagcaggccctgatcgtttaacccacccccgggtggtagggaatccactgtcgtccggaatgagactgtaatttgtgcaccagggcttacggtgcccactgaaattcccgtattaggattggcgcctggcactgaggacccgccgacaatgacgcttccgggaataaaggtggagcctgtcggtacagtttccgtcaaagtcgtgtttaataccgctgttccggtattagcgatgaggaatgaataagtaatcgtcccgccaacgctggcacggttggagctggcgcttttggtaatcgtcggcgctgcaataacgacaggtatggttacaagattggacaaagatgatccggtaaaggccccggaagtgaagttgacagttgcacgattgttgatctgtgtaggagaaggcagagaattaatggctgcccgaaatacaaccgtaaccgatgcgcctggagctaaagtgccgatcggaatgccgttcacaggtgtagcagtcgcagaaacagttccgttcacggcgacgctaccaagtacaaaggcaactccgcttggcagcggatcggtaacgactacattggtcacattggcgattccgttgtttgtggcggttatggtaaattgaacagtctctccgactgcggctgctgccagggaagaggcttttgtcacggtcacatttggtgaggatacggaaatggtgagcgtgttggatgtcccgcttccgttcaatacacgtccgtcaggcggtgtgaaggtatacgtgtaagccgcctgatcggtcagattaccagaggcggggaccacattgacgagggtctggaaggtcacgggtatagtagcacctgtattaatcgttcctactgaaaaaccagtagcgggattggcagcaggcacggaagaaccaccaatggtcacactgcccggtatgaaggatgatccggcgggaatgctctccgaaaagctgagatttgcagcaatgctgcctgtgttggatatctgaaacgtgtacgtaatcgtatctccaactgtagcagccgttgtattggcacttttaacaatcccaataacaggctgatagattggtgtactggcagtgttggacggaacgttgccagaaatgacaggtcctccaggcacggtttgaaaggaaaaggatgccgatgcctgattgcccagctgggtgtttgctggcaatgaagtgacggttgcacggaatgtaatggtcaccgtggaagcaggagctacactgcccactgtgatacctgtagcgggattggctgttggctgcgctgtgcccgcgacaacaacactgccgggtacgaaggtagccccggctggtatggtatcggtaagcactgtgttggaagcactgacgagccccgtattcgaaatgttaaccgtataggtaactgtatcgccaataaccaagcctgtagagctggcagttttggtcagggtcaccagcggagcattgatatcaatttgaatggcattggcatttacagtgtaaatgtcgccatttgttgtcagctggaggacacctgtagtttggctgttgagcagcgtggaggaaatatcgacattggtaatgtcccaaccttgccttccgcccgtcacctgcgttccaggtgccccattcacggcattaattgtaccgaaggtcccggtcgtgaccaatgtaccgtcgtctccgtttatttgagaagcgaaaaaattagttgaaaaattattaggcccagacagcgcagtcaaactggatgtggtaggtccaaacaatgcacggtcaccagtgatgtccacgtcaccctcttgggcgctaatcagcgccctaccacgcaaagtcccctgtacgggcgtggcaaagccactcaccaccacattgaccgagcctgtagcggtactgaccccttcaccaccaacgcgtagcgataggttacggaagggaagagatgggttattgtacaccacagccagcgtccagccggcatggttggtgttggtggaatcgggaaccgtgatggtgcccgtcacatttccgaccgtgtatgcccctgcaccgccttgaatgactagatttgtgacattcgctgttctcacataggtactgagactggtgacgttgactgatgttgcagattcaggactgaccgtagtagataaagcaggtgtctgaaatgtgaccgggttgttggtgctggataatacattggtactcccgttcgcataacttcctccccaaataagctcagcgtacagcaccgtactgcccacaggaagcacaaggaatgctgtcgatgagttactggtaaaggcagaagtcgtaccgaatggatacgtgccgaagcgagaggctgtattggttgtgatgaacgcgccaatgctggtcgctgttcccggcactcctaccgaattagagcgtgccagcccaagtgtattccctataaaggtaacagcccccgtctggttcgttacgtaacgctgaataaaagccatggattagcttcctactttccatctcttccaaatccgttatcttgggatctccgtaataggaagagccagctaggctgggtgtaataatcctttcgtataaatggcctgcgttgtaaccaggccttgcataccgcacaagtccatgttcctgtccagcgggaaaaggacaccctttttcggtaaaatcgcttagcatgaagcccaaaatagatgattgtcaggacgtcagcggagcaatttttatatatgcactcattattcacatatgtatgcaagtcaaatttaaacagacctgttttcaaagaatgacgttatgggaagcgttttagcgaaaaaagaataattttgtaaaaaagctttgaaatgttggtctctttttttacttggcgttaacatatgtgctatactgaaggggcaaaggaggcgtgccctatgaacttaacagtacgaggtcaacagatcgaggttaccgacgctttgaaggactacgttgataagaaattcagcagacttgaaaagtatttcgatgcacccccgacgtctgatggaagtgtaacgttaagcacaaccagagatttgcacactgtagaagtaaccattcctttgccggggcttgtactccgtgccgaagacgagagcgatgacatgtatgcatccattgatgccgtggtagacaagcttgaacggcaaattcgcaagcacaaaaccaagctaaaccgaaaattccgtcaggaaggcagtttgaaaaccctttttgtagaagatccggcaggtggcgtggctgttgctgaagatgaggatgtagaactggatgagctggaagttgtccgcaccaagcgtttcttattgaaacctatggatgtggaagaagctattcttcaaatgaacatggttggacataatttctttgtattttccaatattgataatgaagaagttaacgtagtttacaagcgcaatgatggtaaatacggtctgatcgaacgggaatagcctgtaagtaggaacttttcacattttaaaatgaatagaacgatttcgattgaagcatgcttcatggatattaggaaaatgaaaacaaacacgagccttatccttgcgaacctggcgggataaggctcttttatatgtttttttgtaaatgtaaggaaaattcaacttggataagtgtaaccaagttgtgtatttcgtacgtcaattgttttggtatctttaaccggatgcaaatctggaggctgcttgtgttgcggcatgtcctacaaactgttacaatttatgcaaagaacatcgcacgatgggctggtacagccgggcctgtcaaacatatcgggaatcaatttcatcatggaccctttctaattgtgaaattgattctattaattgttttgcgcgaaaggggtaaaccatgctaggaattgttaagaaaatcttcggagataccaatgaacgtgacgtcaagcgtttaatgaagacggttgaactgatcaataagatagagccggattttgaaaagctctcggatgaggaattgcaagcgaagacggcggaatttaaagctcgggtcgaacaggggactacggctgaagaaatcttgccggaagcttttgcaactgttcgtgaagcgtccaagcgggtgctgggcaaacgtcactatgacgtacagttgctcggcggtattgcgctgcatgaaggtaaaattgccgaaatgaaaaccggtgaaggtaaaacactggtaggaacactgccggtttatttgaatgctctgttgggcaaaggcgtgcacgtggttacggtcaatgactatttggcgcaacgtgacagcggagaaatgggacagatttataacttcctgggaatgtccgtagggctgaatttggccaatatggatcatgccgccaagcaggaagcgtatgcttgtgatatcacgtacggtacaaacaacgagtttgggttcgattatctgcgcgataatatggtgctttataaagagcagatggtacaacgtccgttgtacttctgtatcattgatgaagtggattccattctcgtagatgaagctcgtacaccattgatcatttcaggacaagctcagaaatcgaccgagctgtattttgcggctgaccgttttgtgaagagcctgaatgttgaagaagattacacgctggatattaaggtgaagtcagttgcattgactgaaaatggcgtatccaaggctgagaatttctttggtcttgaaaacttgtacgatcaggaaagtgttacaatcaatcaccacatcgtacaagccttgaaagctaacgctattatgcgtttggatgtggactatgtcgtagctgatggtgaagtcctgattgtcgatgagtttacaggtcgtttgatggctggacgtcgttacagtgatggtttgcaccaagctattgaagcgaaggaaaacatcattgtacaaaatgaaagcatgacacttgcaacaattacattccaaaactatttccgtatgtatcgcaaattggcggggatgacgggtacagcgaaaacagaagaagaagaattcaaaaaaatatatggtctggaagtgctccaaattccgacgaatcgccccaaccagcgtgtggatatgcctgacgtagtgtacaagagcgtaaaaggcaaattccatgcagtggtagatgaaatcctggagcgtaacaaaaagaaccagccgatattagtaggtacggtttctattgaaaactcggagcttctttctgaaatgctgaaacgcaaaggcgttcgtcacaaagtgcttaacgccaagtatcatgctgaggaagctgagattatttcccgtgcaggtgaagctggcgcagttaccatcgctaccaacatggctggacgcggtactgacatcgtactgggcgaaggcgtatcagaacttggtggtttgcacatcatcggtacagaacgtcatgaatcccgtcgtattgataatcagcttcgcggacgtgcaggacgtcagggtgatccgggttccacacagttttacttatcgctgggcgatgagttaatgaagcgttttggtgcggacaacgtactgaatatgatggagcggttgggtttcgaggaagaccaacctatcgagagtcgtatgattacacgtgctatcgaatcagctcaaaaacgtgtcgaaggcaacaactttgatcaacgtaaagtcgttctccagtatgatgatgtaatgaaccagcagcgtgctattatttacaagcaacgccgtgatgtgctggaatcagagaacatcaaggaaattgtgtttgacatgatcaagcctgtcattgagcgtgtggtggaagctcattgcggtgatgacattcctgaaaactgggaacttgaagaagtagcagagtatgtgaacaacaacctgcttgaggaaaatacacttacacgtgacgacctgtggggcaaggaaaaagaggagatcgtggatatgatcttcgaaaaagttaccaacagataccacagccgtgaagaaatgattggcgaagatatggtacgcgagttcgagaaagttatcgtactgcgtgcagtcgatagcaaatggatggaccatattgatgctatggatcaattgcgtcaaggtattcacttgcgtgcttacggcggtaccgatccgctgcgcgaatatcaatttgaaggcttcgaaatgttccatgctatgatcgctagcatccaagaggaagtagcgacatacatcatgaaagcacaaattgaatccaatcaagagcgtcaagctgtcatcgacgaagacaaaatctcgacgagtggtgaacccgcggctcctaaaaagaaatccgctccttcgcgtccgcgtagaaaataacggattgaaattaagggagagatcttgagatacactattccctgcagtgcatataatggcaggcggcagttcaaccactgaccgtcggccattttgtgccatacaggggtgagactgatgtgttcaacttatagctcttctgttggaggatcagtttgaatattgatgaatggctagattgctctcaattcttttaaaacaattatgacaagcaagcaggtatctgcttgtttgtcagttaattcagcagttaatctggctcacataaccagagccagttatttaaaaagcagtttgactttacggcgtttacggcggtcggtagcgaagcggaggatttgaatctggagaagcgtcagcgttcgcctttgcagtgagatgcccacctttgaatgtgttaatccaatcaagggcatctcactgcaacagcgatcgtaagatcaaatcattcgcgcagcgcctacccaccagcccgtaactcataacgcttttactccccctaaccatatattaaaaggagaatgacatcatgattgatccaagtgtaaagcatgatttacgagaaataggcaagaaactaacaaaccttagggggtctctttgacttagatctcaaacaggaaatgatcgcaaactttgaagtaaagatggctgcacctgacttttgggatgataatgataaggctcaaggtgtaattgcagaaatgaacgctgttaagtcatcagtagacagctatgaacagcttcgtcaggaatatgaagacgctggtatgatggctgagctggctgatgaggaaggcgatgaaacactggctggagagatcgagaacagtgtcacttctctgctgagcaagcttcaggagtttgaattgcaattgcttttgaatcagccgtatgacaaacttaatgccattttggagttgcatccgggagcaggcggaactgagtcccaagactggggacaaatgttgctacggatgtatacacgttgggctgaaaaacggggctttaaggtagagaccctggattatctagcgggtgatgaagcagggattaagagcgtaacactattgatcaaaggttataatgcctacggctatttgaaagcggagaaaggcgtgcatcggctggttcgtatctctccatttgattcctccggccgtcggcatacatcgttcgtatcctgtgatgtggtgcctgaaattgcggatgatgtggacgttgagatccgcacggaagatcttaaaattgatacgtaccgagccagtggtgcgggcggtcagcatattaatacgaccgattcagccgttcggattacgcatttaccttccggtattgtcgtgacctgtcagaatgaacgttcccagatcaagaaccgagagcgtgccatgacgatgctccgttccaagctctacgagcgtaagatcgaagagcagcgtcagcaattggacgaaatccgcggagaacagtctgatattgcatggggtagccaaattcgctcctacgtgttccatccatacagcatggttaaggatcaccgtactagcgtggagactggcaacgtaggagctgtcatggatggcgatctcgatccattcatcgatggttacctgcgcagccaaattaagctggacgcagaataatagcctgtacgttttcctacagtccgcagaccatgtgcctgcggactgtaggaatttttgtgtaacggtattttttaactaaaggagaacacgaatgatgtttcaattgaatcctcccgctgcccgccgaagacgacgcaagcctctgattgccgccagtggacccgcacgcaacgtgaccgatattttgctgattatactcggctctttcattacagcgctgacctttaacatgttcttgctcccaaaccggattgcatccgggggtgtatcgggcttgtcaatcttgggcgaggacctgtttggcctggaaccagcctatacgcagtggggaatgaatattccgttatttatcgcaggggtactgctgttagggaaaaaatacggtttgcgttctttgctgggaagtattatgctcccgctgttcgtttatgtgacgaaggactgggcagtaccgacaacaaatccgttgctggcttcgctatatggtggaatcggagtaggattgggtttaggtaccgtgtttcggggcaggggctcgacgggtggactggctattttggcgcagattattcaaaagtatacgggttttagtctttctctctgtgtcatgttgatggatggcacggtgattacactggctggtttcgccctctcgccggaacgggcgctgtatgcattgatcggcttgtttgtaacgggcaaggtcattgatgccgtggaaatgggactgagctactccaaagtggcttacatcatatccaatcagaaagaaacgatcacgcaggctattttgcaggatttggaccggggattgacagagctggcgggacggggcggttacacgaacgaagaacgtcctgtgcttatggttgtagtcggacaaaacgaggtaactcgccttaaaacgctcgtccgcttggtagacccagaagcctttgtgattattagtaatactcgtgaggtattgggtgaagggtttaagaaggaaagctgaaaccaagagagccttctggaggcatgctcttaactgaatccatgcaggagagcccactaatgtagtgggctcttctctcttcagaatggctttactagctagattctttttactaatcgttcaagccaatttgccgtttgtccttgattgaaatacgaggttggcgtcccttttacgcctgttttcaccatgaatagaccgcctgctaagggttgatcggaactatcatcatcttgagcagtcgtaatatataactcatccagatgttcaccgccaaaagcgcacgaagtcacacaattgacggggagtgacacctcagcaatcacttctccatgagcaggatggatacgggagacacgtttaccgccccatctcgcgatccacaacatgccctccgcatcgattgtcatgccatctggatacccttcactttcatccaatctagccaccagttgcttattcctaatcgtaccttgtgccacatcgtaatcgaaggagacaacctccaatgttggagtatcaatgtaatacatcatacgatgatctgcgctccaggctaatccattagatatggaggctttatcaaccagtaaggagacatggccttttgtgctcaaactatacaatgccccttgcgcgtgttcgtcatttaggctcattgttcctgctaaaaaacgccctgcaggatcgcattttccatcattaaaacgattacctagtctaccttcctcaggatcatgaatcaatactttggcccctgtctcaatatccaaacaatatagaccactaatcagcgctacgatcactttatttttgagataaggtacaactgcaccaatatgttcaccaacatctattgtacgatctgtacacgtagagggatcatagatatgcaattgaaaaccttcaatatcgacccaaaataaacgctgaaaccgctgatcccagctgggcccctcgcctaactttgcttttgcatctataacgatattcgcagtatatgtttcgatgtgaagcactcctaacgttttggtttattttcgacctcaattatccgcttcagcggctcctctgcgcagattcactagatgcaacccatgtgatttgctcttgtgtgtagtgctacgtgtactcccttcatgttcaacaagttcataaagtgcagcaaatgaccaatcgagatgaataccaatatgtgaaataatttaaagggaatatcccccttttctttatgcaaaacggcagactgtattcaagaggccctctgtttattttttatttcctttattatagcctgtactgcctgcccgtcaaaagaataggtaagagcgcatattttaaatttggaggaataacatgacatgaggtgttgtatttatatgaatagagtcgtataataatacatatttcatagggacggaatggaggaaggtctgtgagcagcaagttaaaagtggcaattgtcggttccaccgggtatggcggggtggagctgattcgttttttggttcatcatccgcaagtagagattgtatctgttatttcttcatccagcgcaggtgtcccaatcagtgacgggtttccacatctgacggacattgtggtgcaggatttggacggtgtcgaagtccacgaaattgctgccaaggccgatctggttttcactgctacgccatcgggcgttagtaccaagttagtgccgcagcttcttgatgccggactgaaagtcattgacctttccggggacttcaggcttcgaagcggggaaacgtatgaagcatggtataaaaagcctgcggcttcacccgagtatctcaagcaagcagtatacggactcagtgaggtgtatgcagaaaagctggcgggcgtttcttttatttctaatccaggctgttatccgacagcaacattgctgggcattattcctgcgctgaaagcggattggattgaccatcggtcgctgattgtagatgccaaatccggggtatccggctcaggtaggggcacaagtctcgtttcgcattatgcggaaatgaacgagaattttaaggcttataaggtgaataagcaccagcacatccctgagatcgaacaggtactgggtgatattgcgggcgaggacgttacggttacgtttacgacacaacttgttcccatgacccgaggaattatgagtacaatttatgtcacgctgaagggtgaccatacagatcaggatcttatcgggttataccgggattattataaagggcatccttttgtccgcgtacgtggtgaaggtatatggccagcaacgaaggaagtattgggttcgaattactgcgacatcggttttgcagcagatgctcgaaccgggcgccttacgattatttccgtcattgataatgttgtgaagggtgccgctggacaggcgattcagaatttaaatttgatgatgggatgggaggagaacctcgggctgggcttcataccggtatatccgtaagtagcaagtaaccgcaacatggatacggaaacgtcagcgagcggaatttcgaatacaggcagctgtcattcatcgaatatgttgcgaacgagggcacataattatgggcaaagtagagtttacagtagtaaacggaggcaacatcgtaactccgcgtggctttacagccgggggattacactgcggactgaaaaattcgaaccgcaacgatatgggcgcgattcgttgcgaggtagaagcgacagctgctgcggtgtacaccaccaatgtgtttcaggctgcaccgttgaaggtgacgcgcgagagcttggcagatggccgattgcaggcagtagtggtgaacagcgggaacgccaacgcctgcacgggacaacaaggagagcaggatgcctacgctatgcgttcggctgcggctcatgaactgggtgttgctgagagcaatgtagccgtcgcctcgacgggcgtgatcggcgagcatttgaaaatggattgtgtgcttgacggtatatcctccttacctgaccgtatgaacggggcaaacgatggagcagagcaatttacgcaagccattctgacaacggatttagttaaaaaggaagcgtgtgtggcggttgaagtggacggtgtgaccgtacacatcgccggggcggccaagggatctggcatgatacatccgaatatggcaacaatgctcgcttttatgacctgtgatgcagcgatcggacagacggcgcttcatcaactattaaagcaggcaacggataccagctttaatatgattacggtggatggggatacgagcacgaacgatatgctaatcgccatggcgagcggactggctggcaatcgtgaactgcacgtagggcatcccgattgggatgcttttgccgaggcgttcacctatatctgccgagagttggcgaaggcaattgctcgcgatggagagggtgctacgaagctggtagaggtgtctgtaagcggagcggtaagcgatgcgtccgctcaagcgatagctaagacggtggttgggtccagtctggtcaagtcagccgtcttcggagcagatgcgaattggggacggattattgcggccgtagggcgtgctggagagcccgttaatccagatacggtagatattcgcttgggtgatattgttgtgctaagccaatcgagtccggtcgcttttgacgaagaagaggcgctagcctatttgaggggagatacggtgcaaattattgttgatttgcatcacgggaacggaaccgctacagcatggggttgtgacttaacctatgattatgtgcggataaacgctgcttatcggacatagagaccagaataaaatacggattgaataaggatagtagataatagaaacaacgagcggatggaagtccagtatcatttgaaaattgcacggatatgcagagaagaaaaggagagatgatatgcaatcggcagtggaacacgcggatcaagcgaatcatgcgggagtggcacgtcgtaattttgtgatgaaatgcggaggaagtacgctggctgcgttacctgattccttttttgaagacttggcgcgtttgcagtcggaaggtcttcaacctgtcattgtacatggcggtggccctgcgatttccgacaacttggcgaagctggggatcgaaacagagtttattcatggattacgcaaaacgaccgaacctgtgctggatgtcgtggaaatggtactggcaggcagcattaacaagcagattgtacgtagaatagggatgcatgggggccgagcgttggggttgtcaggcagtgatggctatttaatcgaagccaagcctgtgtcgaacgccgctgaggtcggttgggtcggagaggtaacgtccgttcaagcctcgattattacaggtgtactggatatggactatatgcctgttattgcacccatcgggatagatcgatctggtcagcgttacaacattaatgcagatacagcggcgggtgcggtagcctctcatctgggggtcagtcggatgatcgtcgttacagatgtaccaggcatattgaagaagtatggaggagaaaagaaggtgttggactctatcaccgtacaggagattgaggatatgatcagcacaggtgaaatatacggtggtatgatcccgaaagtgagagcggctattgcctgtatccatggcaaagtgaaggaagtcgtcattgtgaacggtagcgaaccgcaggtactaagccgtgtgctgggcggagaatcgattggaacacgcatcgtgcgtatgcagtaattgcaatatatagctcgacctatataaccaaacgataaaggagcgtgaacataatgagtaaggaaccgaatacgctggtgagcgaggaaatgccaagtacggatggaagcggagtgcaaacggaaaaggtgtcggcaaaagcgcagacagaaagctccctttttccaacctacgcaaggtacccgcttacactggtgaagggacaaggaagctggctgtgggacgatcagggcaagcgttatctggatttcatgtcaggcattgccgttaccaatctcggccatgcgcctcaagcagtagctgaacgattgaaaaaacagatcgatgaattgtggcatgtatccaatctgtttcatattccggggcaagaacgggctgctgccttgctgacagccaatagcagcgcagatgccgtgtttttctgcaacagcggggccgaagctaacgaagctgcaattaagctggcgcgtcgttaccaccagaaggtaaagcagaccggtcgctacgaaatcattacgttcacgcaatccttccatggccggacgctggcaaccttgactgctacgggtcaggacaaagtaaaagagggttttttaccgcttcctgctgggttcaaaagtgttccgcttcatgatcagacggcgcttgaagcagccatcagtgagcacacagcggcaattatgctggaaatggtgcaggccgaaggtggtatgtatccggtagaccctgctttcgtagatgtgattacaaagctgtgccgcgagcatggtttgctgctgatcattgacgaggtacaaacaggtatgggacggacgggcaagctgttttcctttgagcattatggtatagagccggatatctttacattggcgaaaggactgggcagtggtttctctgtgggtgcgatgctaggcaaaggatatttgcgtgaagcgttcacagcgggcagtcatggttctacctttggaggtacgccacttgctatggcagcggttcaagctactattgaaacgattattgatgacaagctaccagaacgtgcagctgagatgggagattacctttaccatagtctgcaaaagcagcttggagatagtccttttgtaaaggatatccgtggaaaaggtctgatggttggtattgagtgtgcggaaccggtagcggagcttgttttggcaggacagaaaaagggcattctgttcattacagcaggaccaaacgtgattcgtctgttgcctaacttgtatgtaacgaaagacgaaatagatcaggctgtaaccttgattgctgaattgattcgggagcatgtggcttagtgtaaaggccaaattatcatagactagagtgtaaaaggagacgatagcatgagccagagcggcgcactgcagcagatgaatttgaaaggacgggacttcctggagctggacgattattctccagaggaaatccagtatttaattgatctcgccattgaaattaagcgtaagcacaaaaacggggaaacttatcagccgctaaaagggaaaacgctcggactgattttcgaaaaatcctctacacgtacacgggtatctttcgaagtcggtatgtatcaattgggcgggcatgcccttttcctcagcaaaaatgacattcaactgggacgcggcgaaccgattagcgacatggctcaagtcatgtcacgttatctggatggcattatgattcgtacctttggacacgataatgtggtagagttggcacgttatgcgtccgttcctgtgattaatggattgagtgatttggcgcatccatgccaagtactagccgattatcaaaccttgtatgagcaaaagggtaagctaaaagggctcaaattggcttacatcggagacggtaacaatatggctcattccctcttaattgggggagcaaagcttggagtgcatgtgtccattgcaagtccagttggttacgagcccgacccgaatgtggtcgcagcttcccgtgaaattgtcaaacagacagggagtgagatcgttataactcagagtccgcaggaagcagtacaagatgcggatgcgatctacacagatgtgtgggcgagcatggggtttgaggaagagcagaaggagcgggagcttgcttttgccgactttcaggtgaatgaggagctggtcaagctggcgaagccggattatttattcttgcattgtctgcctgcgcatcgtggggaagaagtaagtgcaggtgtaatcgatggtccgaattcggtcatctttgatgaagcagagaatcgtctgcatgcgcaaaaagcgctgttagttgctttaatggcataagatttaagattgataggtattgataggtaaagaagataaaggctagaagcattcggggaggacttcaacaatggcaaaagaaaaaatcgtactcgcatattccggcggtctggatacgtcggtcattctgaaatggctcaaagaaacttatgatgctgaaatcatcgcattcaccgcagatatcggtcaaaaggaagaactggacggtttggaggaaaaagcactcgctacaggggcttccaaagtgtacattgatgatctgcgtgatgaattcgccaaggattttatctatccgatgtttcaggcgggtgctttatatgaaggacaatatttgctcggaacgagtattgcacgtccattgatcgctaagcggatggtcgatattgcgattgccgagggagcaacagccattgctcacggggcaacaggcaaaggtaacgatcaggtacgattcgagctgaacgcggcggcgttgacgccggatatcaaggtgatcgcaccttggcggctggaagagttccgcaatcagttcccgggccgtgcggaaatgattgcctatgcggaaaaacacgacattccggtaactgcttctgcagccaagccatactccatggaccgtaatctgctgcatatcagctatgaaagcggcgtgctggaggacccttggtttgatccaagtgctcctgaaaataaaggaatgttcttgctcagcaacgcgcctgaggacgctcctgatgaagcagaatatttggagttggaatttgaagcaggtaactgcgtcgctttgaatggagaacagctaagtccattgcaagtgatggaaaaattgaatgagctcggcggcaagcatggtatcggacgtgtggatatggtagagaaccgttttgtcggcatgaaaagtcggggagtctatgagacgccaggcggtacgatcctgttcacagctcaccgcaaaatggaatccatcacgatggatcgcgaggttatgaatctgcgtgatagtctgattacccgttatgctaccttggtttataacggtttctggttcgcaccggaacgtgtcgctttgcaggccctggttcatgagagtcagaaaaatgtcagtggtaccgtgcgcgtgaagctgtacaaaggcaacgttatcggcgcaggcgttaaaagtccggttagcttgtacaacccggacattgctaccatggaagccgatccgacacaagcctacgatcaaggcgatgcaacaggctttatccgcttgaatgctctgcgtttaaaggtcaacgcgggcgtaacacaaaatcataaataatgatgtaacctaaaaaatgtacgggatgcgggccgttcttgtccaaacgacgagggcggcttgtattgcagagaggggatcatgcaatgagtaagctatggggcggacgctttacgaagcaaacgaacaagttggtagaggaatatacggcttctatcgggtttgatcaggtattggcggaagaagatattcaaggcagtttggctcatgtggccatgctggggaaatgcggaattattccgcaggaggatgcagacacgatcaaggaaggattgcacacggtcctggagcgtatccgccgtggggaaattgaattttccgtttcggatgaggatattcacatgaatatcgaaaaaaatctaatcgaggccattggtccggtcggaggtaagctgcacacggggcgcagtcgtaacgatcaggtagcaacggatatgcacttgtatttgcgaggacgtgtggtatcgctggtgggtatgctgcatgacgtacaagctgcattaatcggccaggcaaaggataatctggacacgattgtacctggatatacacacttgcagcgtgcgcagcctattttatttgcccatcatctgctggcgtatgtgtctatgctggagcgtgatattgaccgactcaaagacagctataagcggattaacgtgttgccgctcggtgctggcgctttggcggggaccacttttccgatcgaccgtcactttgtagccgagcaactggggtttgatggcgtatatgaaaatagcctagatgccgtcagcgaccgggattttatcgtagagttcctggctggcgcctcgctgattatgacgcatttgtctcgtctgagcgaagaattggtgctatggagtagcacggagtttggttttgtcgagctggatgatgctttttgcacaggcagcagtattatgccgcagaagaaaaacccggacgtaccggagctggtacgtggtaaaaccggacgtgtctatggaaacctcgtgggcttgttgaccgtactgaaatccttgccgctggcatacaacaaggatatgcaggaggacaaggaagggatgttcgataccgttgccacgctggaaggagccttgcaactgttcgcaccgatgatcgccacgatgaaggtgaacaaggatcgtatgcgtcaagcggtcaaccaggatttttccaacgcaacggatattgcggacttcctggtcggcaaagggcttccattccgtcaggcgcatgaagtcattggcaaaaccgtactgtattgcatccagcatggaaaatacttgcttgatctgacactggacgaattccagcagttttcggatctgtttgacgagcgtatctatgaggtacttcaaccagaagcggtggttaatgcacggaatgtatatggcggaaccgctaccggacaggtacaggcagctattgggcgcagtgaacagctcctggcgaatacatcaacatggtttgaagggcacaagccgaaaaattaatcagtaaagaaagatattattctcttgcatagcagcgggatgctgtgtaaaatcaaattttaaggaattagcaatctaagtttcaaaggcaccgttcgcggtgtcttttgtgttttttggggcattaattcatagttccaaatacctattaatacactggtgtgaaagtttctagaatttacatttttgtatactacacctatgatgattatggtagaatagcactaagtttttcatcgaattaccaattcaataggacaagaactatattcaataaataaatgtcaagttactaggggctcttttgatcaggcgaatttcataaatgtgtaaatgaagggcttgaatgagaacataggtatgtcctggttttgggagaacggtaagtaaaagctctaaagtagcgacgtagctgaaggcagagtcgggatgatccagggaggtattatgagaactaaaaggacagcgcgtcagttaaagagcgcttggatcggttatcgcgcttctgaagccgatcaactgatatcttcattgcatgaggaacgggtgcaagcggaggagttactgcgtgaggagcgggaacttttccacgcggcgctggaacggaaaaagcagcgggatggggagttaaagcagctgcttgcggatgcgcttgcggaagagcggcgctggattgaaagggcgggaattcatgggtgacaagcttagatggcaggttggaggagtttcaattcgccaaaccaagagaagaataaaagaagagcgtcagcgaatcgaacaactgcaacaacagctagaggctcagcggttagagcaggccccggaactgtacaagcttgattttcatatcgaagagttggaacggcgacttcaggatacagaacttcgtatccaggcgatacagaacgccaatgatacagcagcagctgtggaacaattgctggatgaagggttacaggatggacaggtgcaggaggctcaagtccaatatgcatctgggcaggaacaggtagcgacaggaaccgctatgggcgctgcttccagtatccctggtacggaaggcgaagaggcagtaagaggaacgaagagtggacgaaacggcaaggcccgtctgggggatcaactggtggagaacgggatgatcacccgcgatcagctgacagatgccatccgcaaccagaagcgttacggtggcaggctgggcgatattcttgtagaaatgggcttcattacagccgagcagctacaggaacaggttggcggcgatgagtccaaggagcgcctaggcgatatgctagttcgttccggctatatattaccggaacaactggagcgtgcactggagttccaggcgaagagcggcggactactgggagacatcttgctgtcattgcaaatgctagaacctgcggatttgtaccgcgcgattgctacacagaaccgaatcgggcgtattggtgaggaactcgcgctggatgcggcgtacaaactacccgagcaagtggcaatggcttatggcgtggtcgtcatccatcaatatatgaaccgttatattgtggcggtcagcgatccactgccagaagagcgacgcttgaagctggaggaaattttgggtatgccggtagagcaggtgcttgctacgaaggaagagatggagcagctctggggtaaaatctacggtgaagaaatgatgcaggagagcacgaccgggctattggaaaaagaaccacacaattcagcacggacgacctttacaaagggacagctctgggtgttcgcggccatgggtatgattacactgctcggtctcctctggaacagttggaaaacggtgttgatcatcaatatgatgattcagctgttttattttgcgatgacgctatttaaatttggcatcatttatctcggttcccggcgtggggcgcagcttcgttttacgaaggaagaggttgacgccatggatgaaaagaaactgccgatctataccattcttgtacctatgtataaggaagcgggcgtgcttccgatgttattgcggaatttggagcaactggattatccaaagtccaagctggatgtgcggctgctgattgaagaggacgacatagagacgattgagctacttcgggaaatgaagctgccggcctattacacgacactggtcgttccagacggtttgccgaaaaccaagccgaaggcatgtaattatggacttattcgggcacgtggcgagtttgtcgtgatttacgatgctgaggatcgtcccgacgctgatcagcttaaaaaggtcattgcagcgttcgattcactccctgagcattatgcgtgtattcaggcgaaactcaactattttaatagtacacaaaatctgctgacccgctggttcactcaagaatacagtatgtggttcgagttactgctgccgggtattatgcagttagataccccaattccgttaggcgggacatccaatcattttcgggtatctgtattaaaagatattaatgcgtgggacccctacaatgtaaccgaggatgccgatctgggcatacgtctgtataaaggcggctacaaaactgctattgtcgattcccgcacatgggaggaagctaacagccgcgtgggcaactggattcgtcagcggtcacgctggatcaaggggtatatgcagacatggctggttcatatgcgaaatccggttaagctggtgcgcgaagtgggctggaaaggctttttcggctttcaggtgatgattctggcaactccgatgttgccgttgctgaatccgattttttgggggttgcttattttatggtttggctgggagttgtcctttattcccaagctattcccaggttatgtgtattacctggccagcgcggagttttatatcggtaactttctgttcgtattcagtaatgtggccggaatgtattgggtcatcggggaactggaagagcgcggtgaacgaacattttcatacgcgatggtcaaatacgggctactctcgccgttatattgggtacttatgagtatagctgcggtgaaagccgcttggcagctcattaccaagccgttctattgggagaagaccacgcatggtctgaccgatatgcacgacttggatgataccccggcacagtcctcctgaatatgaagaaagaaggagcaagaatggagactaaaacaccttttttatccgtcgtcattcccatgtacaatgaaagctcgcatctcgagcggtcgcttaaggtaattgatggggtattgtctgttgtcacctcacgctatgagctcatcatagtagatgatggttccaaagacgatacgtggctcaagctgtccgaattgtcccgtcgtatgccctctttgctcgcgctccggctgagtcggaatttcggcaaggagctggcgttgtgcgcaggtctggaaaatgcctctggcgacgcgattattgtcatggacggtgatttgcagcatcctcctgaaatgattggagaaatggtgcgtttatggcaaaatgaaggttatgatttggtcgaatgtgtgaaagaatttcggggagaagagtcggtgggcaaaaagctcggtgcttcattgttctacacgaccctgaaccgcttgacgggctttaatctcaaggatgcctccgattataagctactggatcgacgagtggtggatgcctggatggcgatgccagagcggatgccgtttttccgcgggatgacagcctggctaggtttccgcaaaacccagatttcattccgggtggctccacgcgaagaggggccaagccgctggagtccgttagggctgattcgacttgcagcagaagcgatcgtttcgttttcaacagtaccgttgcgggtagtaagtctgatgggcctcatttttatgctgatttcagtcgtattggggattcagaccttaatgcgcaaattaacgggtgacgctgtgaccggttttaccactgtgattttgctgctcttgattattggcagtgtactcatgctgtcgattggagtggtaggagaatatattgccgccatatatcacgaagtcaaagctaggcctcgctatctgatagcagataaacgggcgaatgctgaccgattgtgggtggacagggagtttaatcaacatgatcagacgttcatatctaaagtatccaatcattaaatacggtattgtggggttgctaggtacaggtatccatgtgggtgtgcttgtgctgctggtggagttgtttacggtaccagcagtaacggctactacaatcggattcgtggttacattgctcgtttcgtatgtgctgaaccgaaactggacgttcgagcctaccggcgagggaagtcgcacccagtttcttaaatatttattggtctgtacctgtggcttgctcttaaatgctgctctgatgtacgtgaccattcactggatcggttggtcgtatctgatcggtgaagtactaactaccatcatcgtgcctgttcataattatttctggaaccgctactggatcttctccgttccgcaacagcgtcagaaagaggtttcatgattttaagaaaacacggaaaatttctatcattgtttgcttgtattactgctcttgaactggccgtgggcgtgtattttgcatggtatcttggttatatgcataccgatgcgctcagtcgagtggctaacgcattttatgtgctatacagtcgtgacccacacttgggtgctatcgggtttgtatggaatcccctgcccagtttgatggaactgattgtgctgttgttttatcctttatttccagcactcgcttcccacgggctggcggcagtgattgtgagcagcctgtttgcaggggcgagcggggcattattgtatgcgacgggcaaacagttggggcttcacggtgcaaccagcttgctgattgcgctattattttcactgaatccatttatgtttctgtttggcttcaacggtttaagtgactcgccatatatctttttcatcctgttgacagtgagtcgattttgtatgtggttgaaggaccgcaaggcggcgaatttgatcgtatccggttttgcgcttgcactggctttttgggtacgctatgaagcggttccgcttggcgttgcgatggctttgggtgtattgctgacgatcttttttctgcataggtggcgtacaaacagagagagggttagaacggaattgtctttaaaagagcgcctgtacaaggtggaagcgacatggcttctattgttgttgccacttgttttttccggtctgctgtggctcttttttaactggattatcatgggcgatccgctttactttttacgctcgcaatattccaattccacacaatcagcggctttgttagaggatcaacgctttgtggccatgtttgcccaccctgtgctgatgctaaagtttatcgggcaacgaaccttatggtatgctgctccgttgattgccattttgctcatacgtttgttggacaaacgtctgttgagttggagcacgcttacgctattagcaatctttttatcggtgcctggacttcagcttttgctgatgctcaagcattcttcttttgggtggttccgatattttatgtatgtgttcccgattacggtggcctggttgccgtatgagctaagtttattgaagggaaaaatgagggggatcggaatctcgctggtaacagcaggaatgttggtaacagcaggcttgttatcctacgcactgacgaaccccgcgattgcagcagatgaacacagctatttgacgcatagtggtaatgaaagctacgaacgtcaaattattgagcggaaaatagcgccgtggctggatgagcattatggtacatctctcattttgacagattcttatgccgcctatccgatcattttgagcagcaaaattccgaagaagtttatgattacgagtgattttgattttggggaatctttaatggatctgcctgcttccaaggtggattatgtgttggtcacgcgcttggtggatggggtaccgctggatcaggtaaatcggaactatcctgatttgttcgaaaagggagcgtcgtgggcctcactggtacatgactttgacgggcagtggcgactgtacaaaataaagcatgaagaatcgaaataattattatattttagtgcatcgtagcggagggaagcatacagctgtagggtgtgagtgggctacagctgtatcaccgcaagaagtttgagggggaacgagaggaatgtcctttcgcaaatggtctgcaagcagatggatggctataggtctgtttgtatttatacttacattggagttgtctgcgggcatctattttagctatgttctgggatatatgcacacagacgcgctcagtcgcgtagctaatgcattttatgtgttgtacagccgtgacccgcatctgggcgcaatcggatttatctggaatccactacctagtcttctggaaatggtgattctactgctgtatccaatctttccggcattagccacctatggattggctgctgtcattcttagtgctacctttgccgctttgactgctatgctgctgtatcgggcgggggtcagaacagggcttagctcagggatgagcatcatgctggcactgctgtatgcactgaatccgtttattttactgtttggtgccaatgggctgagcgattcgctatacatatatttcattatgatgacggtgattgagtttgcattgtggctcaaggatcgcatgacggcaagtctgattgtttctggattagcgcttgccatggcgttctggactcgttatgaagcggttcctctgggcgtggcaatggcgggtggagtggtattggcgatcctgtttctacatcgaaacatgggcagacgtgagctggccttgcgagaaaaattgcacaaggtcgaggcaacttggttactgcttctgctccccgtggtcttttccgggctgttgtggattttcttcaactatctcattatggggaatgctttttacttcctgaattcggagtattcgaacacagcccaatcggcagagcttctgaatgatgataagtttgtagagattttctccaatccgctggtggccttgaaatttattgcttccaaaacactctggtattcggtaccgttgtttgctattctgttcattcgtctgttaagtggacgcttgttccgatggggaacactgattattttgctgctgttcctgtcagtgccggggttgcagtttttactcatgatgaagcaatcttcgtatgggtggtttcgttattttatgtacgtgttcccaattactgtagcttggttgccctatgagctgagccagcttcagggacgatggcggagggcagcctttggcctggtatccgtcagtctgctgcttaccgctggattactttcctatgcgttgactcgcccggatattgcaccggatgagaacagctttctcacacgaacgggtaatgtgaactatgtgagacaggagtcagatcgtaagattgccgtctggttggatgagcatctgccgaagtctaccattatgaccgattcggcctcagcctacaccatgattgtctacagccaatatcccaaacgcttcctgatcaccagtgattattcgttcaataaggcattaagttatccgcaggataaccatgtggattatatccttgtacctaagatcatgtcaggcatgccactgagtaaaatcaatatggtatatccgaatttatatgaaaaaggcgctccatgggtccagcttgaacgtgagtttaacggtgagtggcgcttgtacaaggtgctacccaagtcactaactaaagaatctccatcgacggagaccacgacaaatccgtaatgtgcaaaaaaatccccgagcctatcccttcgccatggtgcgatgagggaagctgcggggatttttttaacctgtttagtgctctttgagtggtagccacgccagtacatcctgaattttcgcgtcccagtatccccattcatgagccccaggaccttcttcgtaggtcagcggaactccggtagtattacatgtttcacggaaagcctgatttcccttatataggaaatcctccgtgccgcagcattggtaaagccggggaagcgaggtccccaaggcagcatgacgttgtaacagttccagcaagtcgtgatccgttccacgtatttcatctggaccaaaaatgttaagccattccgctggactcatcgcattttgcataggatcggtgcgtgatgcgtgtaaatccatgactcccgaaaggctcgcagcagctgcaaaacgctctggatgctggagtgccagtttgaaagcaccatatccacccatagaaagcccggctacaaaattgtcttcacgcttgtcggacagaggaaagaatgaacgtgccaaagccggcaattcctcactgacaaaggtccaataagccgctccttgctccatattcgtatagaaactccgatgtacctggggcatgacgacagctaggcccaatgaggcgacatagcgttcaatggaggttcgacgcaaccaggttgaatcatcgtccgacaggccatgcagcaaatatagcgtcggatgtggcccggttccttgcttgccctccagtccaatttgcgaacgggttgcctgaggaagaataacattcatggatgtgctcaggcctagaacttccgaataaaactgacattgaataagagccataagaagacctctttcctagggttttgtgacctcattgcggtgttccagcatatgaccgagtattcattcagtataccttagcctgtctaaatatacatatccaagtgaataactaggtattaagtcccgtttcttatttatcctacattaggtgggggtatggttatatgggacgatttttttaatttgggggttatttgggtttgatttctggtaaagtgtttaaaaaagaatgatgaatccaatcagaggaggaatttatagcatgggaaaaaagttaagaaacacagttacaggtgtattgagtacaggtcttattcttagcgcattcagtgcagcggcagctgctccccaaactacaagtggacattgggcgggagatcaggtgcaacgctggtcagccacagggcaattggacggggcggtaaaaccagatgcggcgatcacacgtgccgaatttattgttcttttgaatcgcagcttgggaacgttcacacaggaaactccagcagtgacagacgtaacatatgcgggtggtgtgaaagtaaatggtaatggaagcagaacgttcacagatgttccagcttcgcactgggcatacaacgagctgacaagtgccgtgaatgcaggctacataagcggctatgcagataacaagctcaaaccaaatggtaaggtaacacgtcaagaggctgcggctatcgtaggcaaagctattggactgactgcgggtaacgcagcagatgttactaaattcattgactccaacaaaattgggtcttgggcgaagaaaagtgtagcggcagctgcggagcaaaaaatcatcaacggttatccagatggtaaattccagccactgaagtcgctgactcgtgcagaggcgattgctattctggacgctgcctccggttacaacctgagctctgtcgataatctgacgacgactcctggtggaacggtgacggactccacatacagcaacgtgacagattccacttatggtaacacgtcaactacttctggcagcgaaacaggagataccagcacaagtaccagcacagatagcacgactacggacaactctacaacaatagataccaacacagataccgacacaactacggatacgactacgactacagatagcactacagacacagttgcaactacgggagcactgaaagtcaacaatgtgtatgatggagaaggtacaattacggggacagctaaagcaggttccacagtaaccgcctattccaacgaactgcctatcggtagtgcagtagccaaagatgatggcacatttagtatcagtgtgcttactcaaaaagcaacggttaggctggtaatcaaagctaaagatgcagatggtaacgaaagtgagcctgtagaaatttctgttttgggtaaacgcagcgagtaatttatagctaaaatccccctttcactctgtctggaacaagtccagtcgacagtggaagggggatttttcgtttattcgcttataccgtcctcgacaatagatttctcgggttcacgtgtttgtggctcagacgatgtgccaccgccataactagctgtaatgcgttgctgcgctcgatacgtatcgcggctgattcgggtgcgatctacagtttttccgtctaccttttttacccggaatgtttctaccacatacccttctttgccctgccgaagtacttgatagaagccgggggaaagtgagtcattacggagtctcttctccggtatgggaagtatgcgaactgtatgggattccagttcatacgaaacattggatggaaatgtaccaaaaaatttaacagtaagcgttcggttttggacagcggcacgaagcagtaaatgcttgcctgtattgtttctaaaacgaaaattaatggaccctgtagcaaaagtcgcatcttgacctttgggtaggtagctgactggcaaagaatggttgcggcgctcaacaatgtccaagccgactcgcagcgctgcattatacaccgtgctggatacctgacaaatcccgccgcctatgccggactccaactgaccgttcacgatcactggagcttcacgaaagccatgagtgcgctcagccttggcaatcaattgaccgtagtcgaatatgtcacctggcttgagagttagaccatcaacggtgcttgccgctgaattaacgttatacacgcgtccttccgagctactgccgagactggtggagaactgtacgattttgcgctcaatcccttcgttccgtagactgtccaccgaaatgttcggttccagctgacggaaaggtaattccactcgtattggctcttccgaagcggtaaaatccttgggcagcgccttatctagtgcggcgtccaatctgggccaatccagccgtcgggcagagcgccccggaatataacgaacctggtcattcccgtcaatctgtcgcacagcattgataggcatgccgtatcgttgctcctcccaatcggctccgaattgggcccttaatatctcctcctgtcggaaagatgtgatagaccattccttctcgaagctaaaacgtgtctgaacacgagtccatagatgctccgagctgagcgccttcacggcattccgaaatgcctccgctttataatgaatccctgctgccccgagtgtaagttttatatcctgtgcactgctgtcactgtccgtcagaagcagtggacgttgcttcaatgcatccaattttttatccaccagccgaagagcggctgtgtgatccatgcttcctacgtttattcctccgaccctcactccctccggcagcgtttgtctgtcggcgtacagatgaagtcctccccacaacatggccagcgccaaaacaccagaccatatccaaatgacagataaatgaatttttttcataatgcagatgtctcctgtctgataagcttgatagcgattcgtgtgccataatattcatatatatgtgccaaaagcagaaaactttcggtactatttaggtaacaaatttgttacaatgataaacggtatgatgaaatagagaagtttttaaaggaaatgcatggaatatgtcgaatggatattaggttatgcgtaatatgattaagcaacgggaagtgatcgagtgattgaaatgcaggatgtgtggaagacctatactaacggaacccacgcacttcaaggagtatcggtcagaattgaccgtaatgaatttgtatacgtagtcggcccgtctggagcggggaaatcgacttttatgaagcttatttatagagaagaagtacctaccaaggggcaaatttcagtcaatggttttaatatcgggaagctcaagcagcgtaaaattccctacgttcgtcgtaacatcggagtcatttttcaagatttccggcttttgccgcgtttgacggcttatgagaatgtggcttttgctatggaagttattgaagctcccaagaagctgattcgcaaacgggtaccagaagtgcttgaactggttggcttgaaaacaaaaatgaatcgtgagcctgcccagctttccggtggggagcaacagcgtgtagcaattgcgcgggcgatcgtgaacaatccttccgtgatcattgccgatgaaccaacgggtaatctggaccccgaaacatcgtgggagatcatgcagttgctggacgaaattaattttcggggcacgactattgtaatggcgacccacaataaggacatcgtgaactccatgcgtaaacgtgtcattgccattgaaaatggcaacatcgtaagggatcaggtaagaggggagtacggatatgacttttaacaccttcttacgtcatgtgcgggaaggtttcaaaaacatattccgcaatggctggatgtccgtggcatccgtcacctcgattattgtgtcattacttatattgggcgtatttatcatgctggtgctcaacgtcaattccctggctgatcaggcagatagtcaggtggaggttaacgtatttctggagctaaatgtagagcagaacatgcgtgaaacgctgcaaaaggaaattgcggcgatgccggaaatcagcaaaacgacctttgtgactaaagctcagggtttggaggagctgcgtaaagatttgggagacagcggcaaggagctgctggagggctttgacaaggacagcaatccactcccggacaaaattgtggtagaggtaattgaaccaacaacggttccatttgtggccgaaaagattgagaagctgaatacgttgcatcctgagaagccgattttaaaggtgcgttatggaaaaggcaccgtagagacactctttacgattacgaagctcattcgtaatgtaggctttatattcgtcgccggactggcgatcatgtccatgttcctcatctcgaatacgattcgcgtgaccatattggcacgacgcagagagattggtattatgaagctggtcggtgcaaccaacttttttatacgctggccgttttttatcgaaggcgcgcttattggtctcattggttcccttattacggtaggtattttatttactggctatcagcgtttgctgactgccgttcagggcgatatagctctgaatatgttgaagcttatgccacttgaaggcatttggattcagttgagtgcattgctgattattttggggatgctggtcggaattgttggcagtaccctgtccatgcgcaagttcttaaaagtataaaagaagcgttggctggacgtcgtgttcgatatcaattagaacggggaagcccggtgttattttgcgataaaggatggggagtgcaagttgaaaaaaacaggatctgtgttggccgctaccttggtagccgcattgctaatccagccttctgacggatatgccaaaagcatgagtgaaatcaattcgcagctgaaccaattggaaaagcaggcccaatctgccaagcaacaacagaaaaaggctgctcaagataaacagtatgcccaacattacaaaaataaaaccgtgcaaaacctcaaaattgtgcttgctcagattaacagcgtcagtgatcagctgactcgtgttgcggttcagattgatcaaacggaagataatctgcgtgcgaccaaaaaagatttagccgaggccattgatcgtatccagtcacgggaaaaaatgctggaaacccgtgtgcgcttgatgtatacggatggaaccgtctcatatatggacgtgctgatgtcttcgtccagttttagtgactttctcagccgggtagattccctgaaaacgatcgtggagcaggatcaaatcctgttggacgagcataaaaaggacaaggcactggtcgtaagcaagaagaaacagctggacacggaatataaaaatgctaagaagctgtatgcgctcaagcaggacgccaaagcagaactgaattcgaaggaaaaagagaagcaaagactgatttccaattacgatcatgatattgctgagtcagatgaaatcagcgaagagcaaaatgacatgctggtagcactcgctaacaaacgtgtgggtctggtgcaggagaagaacaagcttagagcggagcaggctgccaaagccgcacgcgctagagcggctgcacgtgcggctgaagccaaacgatatgcatcttcatcctcaggcgccgcctcaaattcaagccatgcggcagccagtacgtatacaggtggaacgggcacattggcttcacctgtatcccattaccgactctcatctacttttggcatgcgggtacatccgattactggcaagcttaaaggccacacaggtgttgatatggcggctccgcagggaaccgatattcatgcagccgaagatggtgttgtcattgttgccgaatggtggagtggctatggaaacacagttgtgattgaccatggagacggactatggaccctatacggacacattcgcaatggcggtacggtggttcataccgggcagactgtgaaacggggtcaaaaaattgcagaagttggttcgacgggcaattccacaggacctcactgtcattttgaggtgcgcgaaaataacaaacctgtaaatccgatgaactatttatagtagataaggtaagccctatttatagccattacggttgtagatagggctttgctgtaatggttaatatccgatgaagaacatgtgcattgagacaccgagtaggatacaattaacatattccgtacaagctagacgtatacttcgtggatggatatgcgttgtaaggcaataggatacaagataatgagaaggcggtggacgattagatgttgaaaaaaagtacagcgatactcttgatggtgatcgggctgcttggcggcagtctgctcacttttgcctatactggaacgactacagtagggaacagcgctctgggcgaaggactgctggcgagtgtgacaggtagcagttctacctccagaagtgatatccgcaaaattgagacggcgatggacttgattcagggacaatattatcaggatgtggatcgtaccaagctggtggatggcgccatcaatggtatgatggagtcgctcggtgacccgtattcctcttatatgggtaaagaaactgcacaacaattcgagcaatccatagaaggttcctttaccgggatcggagccgaagtagcggccgaaaacgggaaagtagttgtagtcacgccaattaaaggctccccggctgaaaaggcagggttacgctctaaggatattattttgtctgttaatggtgaaacactggacggattggatctaaacaaggccgtttccaaaattcgtggacctaaaggcagtcaggcgaaagtcaaaattcagcgcagtggctctcctgatccgctcgaatacacgattacccgtgacaacattgatatggaaactgtaacggctcatatggaaagcgacggtgtaggcgtcatcacgatcacccagttctccttgaatacagcagaacgcttcaaggaagagttagcgaagctcgaaaaacaagggcttaaagggctcgtcattgacgtgcgtaataacccgggcggcgtgctttccgtcgtcattgatattgcacagcaatttgtaccttctggcaaaacgattgtacaagtggaagacaagaatcagaagcgtgaagaagagaaatccaaaggttcacgcaaaaattatcctgtgactttgctaatgaataaaggtagcgcaagtgcatccgaaattctggcaggtgctctccagcaatcagcgggtgccgtgttgatcggggaaaattcctttggtaaaggtactgtacaaaccagctatgacaaacaaatgggtgacggtagcctgctcaaaatcacgattgccaaatggttaacgccaaatggaacgtggattcataaaaaagggattaagccgaatatcgcggtggaacagcctgaatacttcacagcagcaccgttgaacaaggaaaagtccctgaaatacaatatgaatagcagtgatgtgaaaaatgcacaaatcattctacaaggcttgggttacaacccaggtcgcgaggatggctattttgacaaagtaactgaaagctctgttattgcttttcaaaaacaagcgaagctgacggctagcggcatcattgatgcgaagacagcagcagcgatggaagccaagctgattgagaaaattcgtgatccgaaaaatgataatcaactcaagcaggggattgaagagattcggaaggaaatgaagacaagcgtagcgaaataatagtgaggctacaacaagggggctggaaacagcctccttttatattgggatttatttgcagtctgtcggtttgtcttccctacgttggcaatttcatatagaataaatggatatgaaatgtacgtgatccgctatacagcgggccaggggcataaggagtgtgaatggacttggaatgggcattacaatggggatggagcgtcttaaatgcttgcttgtacctgcttttgcagccgttttattatatctcaatactcattgtagcacttggttatcgtcggcaaatgctgctggagcgcaagctatttcataccaaaatgcatagctgggcttcagagacctggcgtgtcgtatggagtggtttgcttgctggaatggcgctatctgctctgggaatgttcgtcagcgtgcatctgaactcggcttccatcgtatgcctgtgggtagcgacattactgctcatgctggtacgcgtccgttacctgtgtctcgcttattcggtaggtctgctaggtgtggttcaatttttcctaaacgtggccagtggctggcaacctggaggagcgctcggaacatcagtagtagctatccgcggattggatattccagcactgttggtgttggtcgccgtgctgcatgtggctgaggcgctgttggttcgctggcaaggggggaaggcggccactccgctgtttgtcgagggcaaacggggaagattggttggcggctatcgtatggaagacctctggcccattccgttgttgttgctggtaccgacccagggaggatttacgcttccctggacacctttgttcggcggcgatgccggaaccgggtatatgctggcagccttgccagtcctgatgggcttcagcagcgtgacgctaggccagctaccacgacagaaggcggtacttacttcgaaccgtttgctcctgtacagtgtggctttacttctgctgagcttgctggctgcatggtggagtccgctgatattgttagcagcgttattctcctttctggctcatgaggcgctgatctggtatggtaatatagaggaaagtcgtcttagcccgttgtttgtccatccggagcaagggatgcgtgttctcgctgtgctgccagacagtccggcgacagccatgggcatactgccgggcgaggccatttaccgcgtgaatgggattgttgtgaatacccgtgccgagttacaccaggccttgcggatcaactctgctttttgtaagctggaggtacgcaatctgcagggcgagagcaagtttgtgcagcgaggcatgtacgatggcgatcatcaccagctaggggttgtgcttgcacctgatgcagacgcgagctgggccgtatccatacagccagcctccatctaccggattgttgccatgcacataggcgcacgccaacgtaaagctggacaggcatcgcaggcagagaaggcacatttggataccgtggacaaatagatgttacaacaagagggtagccattatttgattagagtcgaataaggctacgctctttttatatgccgacagtagcctgcttgaaatcaatattctgatcggtatacaatgaatatgtaataagaagcgttgatgaaccgaatgcctatcatgtgtgtcaagcagggagaggaaaagatgaacgcgatccactttattcgagagtacatcaggcatccacgcagcgtaggcgctgttatacccagctcaagacagttggccaaacaaattgccacaccgatttactttgacaaagcatcgtgcattattgaatatggtgcaggaaccggtgtgtttacgcaagagttgattttgaacaagcgtccagaaacgctacttttagtgattgaagctaatgaatcgttttacaaaacgctacaaagcaagtacggacacttggagagggtacacattattcatggatcggctgagcatgtagctcagtatatacgacagtatgaggtcccaaaggtggattatgtcgtgtcagggctccctttcaccagcttgcccgctgcattatccagcctcattttgggacaaacggctgaggttttgggccaggaaggcaaatttattacgttccagtacagcaaggtcaaacacaatttttttcgcaccttttttgctgacattcagattaaaaaggtaaactgcaatgtcccgcccgcttatgtgttcacttgcagcctgtaaccttgcagctatgtagaggattagaataaatacgaatgtgaatatacggatgattatgagaagacttggtcagcgtcattaaaatgctgaaacggtctttttttgttgtacactttcatagatatataagataaggggatatgttaaaaagcaaaattcatttaaggaatcatattttaaaatggggcttaacctatatattacataagatggaacccgctagatttttgtaagattcatgataaatctgaacttttgttaaaggagatttatatatggtaaaaccgttgatattcatgcgttggtgtgagtactatgagttaagtgaccgtgagacggattttgtatctttttttatgatgaatttctcggctgcccgttcaggcaatcaaccgaagcttagggagcagtttgttgaaattcagaaaaaaacctttcctgaatacccgtttgatattaccccggaagaactggattactccaaattcgaaggcttgatgaagcaagtgttaaaaattcattttgacacggccgagctgctatactccttttatctccaaaaactgtgcgcacctttggcagaatacattttatccaccggagaatcagagcctgcacgcatctattataagcttattcaaaaggataaagtgcgctagggaagacgagtgtggatgagcaagagctattgggatacctcaagctatatggttatttaagaaattaatactagctaattaaaacaatagttaaaaatgtcaatatacctttgtgttaaggtaatattataaatccagtttcaaagaaagagggtgttgttttcggctggaacatttcaagcacggatatgacgctgcaacggaacgataagctcgtttggggacagggaaggggccttaaagcctcaaggaggggcattcgtatgggtgccgctctttttaaattgaagggaggaagcggcatgaaggcgaaaaatagtagtagtatttggtccaaacgttccaaatggctgcctgtcgtcatggcatgcacgattatagtagggggtgctctaccgactccaactgtagttcacggtcaaacggcaaagactgttaccattaaagtcgatacatccaaggatcgtaagcctattagcccttatatttacggtacgaatcaggagttgtcaggcgatgagaatctgactgccagacgacttggtggcaatcgaatgaccggatataactgggaaaacaatatgtccaatgcaggaagcgactggatgcagtccagcgatagctatttatgcgacaacgccggattgacaaaagccgaatgtgaaaagccaggtgcggtggcaacctcgtttcacgatcaatcgctgaagcagggcacatattctttagtcacactgccgatggccggttatgtggccaaggatggaaacggaagtgtgcaggaaagcgaaaaggctccttccgctcggtggaatgaggtcgtaaacgctaaaaatgcaccgtttcaattgcagcctgatctgaaagacaatcaggtttatgcggatgaattcgtcaactttttagtgaaaaagtatggctctgcttcaacaaaaacaggtgtgaaaggatactcgctcgacaatgaacccgctctctggtcgcatacgcatccgcgcattcatggtgaaaaggtcggagcgaaagagttggtagagcggtcggtaagtttatccaaagccgttaaggcggttgacgcgagtgcggaaatttttgggcccgttctttacggttttggcgcctataaagatcttcaaactgcacctgattggaactctgtaaaaggcaactacagctggttcgtggactattacctcgatcagatgcgcctcagctcgcaagccgaaggcaagagattgctggatgttttcgatgtgcactggtatcccgaagcgatgggtggaggcatacgaattacgaatgaagtaggcaatgacgaaacgaagaaagccagaatgcaggcgcctcgtaccttgtgggacccgacctacaaggaagatagctggatcgctcaatggaacagtgaattcttgcctctactgcctcgattaaagcagtcggtgaatcagtattacccgggaaccaagctggccttgaccgagtatagctacggtggcgaaaatgatatttccggcggtatcgctatgaccgatgtgttgggcatcttgggcaaaaacgacgtttatatggcaaactactggaagttaaaggatggtgccaacaactacgttagtgccgcttacaagctttaccgcaattatgacggaaaaagctctactttcggtgataccagcgttaatgcgcaaacgtcggatattgttaatagctcggtgcatgcttccgtaacggatgcatcctacaaagaactgcacctcgttgtcatgaataaaagcatggacagtgcattcaacgcccaatttgatctttccggtgagacgacttacggttccggtaaagtatggggcttcgacaaaaatagctcgcaaattaaagaagcagcgccaattacgcaaatttcaggcaaccgctttacctatacagtaccgcctttgacggcttatcacatcgtcttgactgctggcaatgatacgtctgtgccacctgtggaaggtcctgaaagctttgcgctgagggctgaggctggcgatgggaaagtcgatttatcctgggacgcttccagcggagttgtaagttacagtgtacagcgggcaacgtatgaaaacggtccttttgctgctgtagcatccaacttggccgaaacgtcttatacggatacgaacgtaacgaacggcacttcttattattataaaataaccgcacaaacaaaggcgggaacgagcgaatccaatgttttgaaagcggttccgcgaacgcctgtagacggaccggatcgctatgaagccgaagatggcacgctgaagggaaccattgtggaatccagcgggaccggcttctccggtactggttatgtaaccaatttccacaatgcaggggattccctgacgatgacgattcaggcagaggcggcaggcttgtacaatcttacaatcggctaccgttctcctcatgatgacaaacgcaccaacttctctttaaacggcaaagcgtttggcgagctgatactttcgaaatcggctgattttaaagaaacttccggaggcaagcttctgttgaatgcaggggcgaacacgatcggttttgaaacaggctggggctggtatgatatcgactacgtcaagctggagccagctgctgaccgtccaccacatgcggtaaccaaaacgctcaccaatccgaatgcgacgatagaagcaagagcattgatgaactatctggttgatcaatacgggaagaatatgctttccggtcaagaggaaataaccgaaattgattggcttcaagccaatgtaggtaaaaagccggctattgcagcgcttgacctgatcgactattcgccaagtagagcggaacacggtcttagttccacagagacggaaaaggcgattgaatgggataagcaagggggaattgttacctttgcatggcactggaacgcgccgaaaggtctgatcgatacgcagggaaaagaatggtggagaggcttctatgccgattcgactacattcgatatagaatatgcgatgaatcatccagagtccgaagattataaattgcttattcgcgacatcgatgtgattgcagggcaattgaagaagttgcaggatgcgaaagttcctgtgctgttccgtcctttgcacgaagcggaagggaaatggttctggtggggcgctaaaggtcctgagcctgttaaaaaattatatattttgatgcacgatcgtttgactaatgtgcacaaattgaacaatctgatatgggtctggaactctgttgctcccgactggtatccgggagatgagtatgtggatattttgagcttcgactcttatccgcaagcaggcgactacaacccgcaaattgcaaaatacgaagaccttgttacgttgggtaaggacaaaaagttagttgccatgagcgaaaacggacctatcccggaccctgacctgatgaaggcgtatcaaacccattggagctggttcgctacatggtatggggatttcttgagagacggcaaacaaaacagtcttgagcatctgaaaaaagtgtataatcatccgaacgtcattacgcttgacaagctcccgaccaacttaaaaacgtatggtattaccgagcagccatcagtaccgggcagcttcacgctgaacgcagcgggcgaaacggcgaaagtaaagctgagctggacagcatcagcgaatgcagcaagctatgaagtgaagcgttcgacggctgagaacggcgctttcgccacagtagcgagcgatgtatacggaagcagctacaccgacatagccgtaacggcagacacgatgtactattaccaagtcgtagcgaagaacgatgcaggtcaaacggtttcgaacacggctagcgcagcgccaaaagcggatactcagcagccgacaacgggactggtgctccagtatcgcacagcggatacaaatgtgaacgacaatcacttgaacccgcatttccaaattgtaaacaaaggtacaacctccgtaccgatcaacgagttgaaaattcgctactactacacgatcgacggcgagcgcgcgcagacattcaactgcgactatgcgacgctgagctgctcaaagctgaatggtaagttggttaaaatggataaagctgcaaccggagttgattattatttggaagtcagcttcaactcggatgcaggcgtgttagcacctggaggaagcacgggcggaattcaaacccgtattcataagacagactggtcgaactataacgaaagtgacgattactcgtacaaaggcacgcaaacttcattcgccgatcatgcgaaagctacgttgtatcataatggcgtacttgtttggggagccgaaccggcagctaattaagacaggcgtccatcgttgaaatgagcaggggatttagtatcccacctgctcatttttttgtacaaaaaccctccaagagatatgtttgattattatattcaggtttaagaaatcatgaactaaaattaccttataatgttagaggagacgaaaaatataattcttcaagttaaagagggggattgaaatggaacatacacctacgatccgctcgaagatagagacagaactaaagcaaagggggcatacatttagcagcttcagtaaagtatctggaattaaccgtggtatatttagcaccatgcttaacagcaacccacccaagccgatctcggttcggcagatggacttgattaccaaggcattgggatatcccgaaggctggctgtatgagttatacatagatgaatgcttttatgagggaaaaggacactggaaacggattaagccttttttattacgttgtgtagagttagggagggaagactgtattcaaaaggtactgtcaagactaaccgaggacttgtcctatgtaccgacgatatttgagcttgcagaagaactacacgaagcaggaaagaaaaaggagtctatccccttttacgagtgtgtaatagagaatgagagatattaccactcggagcggttggcaatttgccagtatcgtttgttttgttgttctctgaatactgacttggataataatcggcaagcaactataaagtttgcaccgtttcggaggaatcttcccgagaattaccaattagacgcgttgttaaaattgactaatgcatatttccaattttacgattatgaggcggctatatactatgcgaaggaacttgaggtactagtcacaagcatttattggcatcatgctcaagcgagggcgaagaatcgtgaagttatacgtttaaatacagaaagacatctaatcgtttattatggacaagcctatttaatgcagggaaattccttagaaaaacaaggactatatgaagcagctatgaagttcataccttactatgaaaatttaactgaatttgaaggtctagatgagattggaatgatagaggcacagaaattcgaaatatggggaatagcaaaccgtttgaatttagaaattctgatgggggatacggctagtttgcctgcctatgtcgaacttattagaaataatcctcaggaaatattacttgggctattgactattatagaatcggccaatcattacagttactcagtagacgaaattctggctctttttgctgagaatattaatgaatttagggagctacgtacaaatatttcgtattatcatacaaataatgatctgctgacatattctcgtttttttcttgagcttagtcgatactatttcagtaaaggaagctataccgaggcaatagacagtatgctgattagtttaaaagcctcctcagagttaaacgataagaattactatatcaagtccatcacgctattatttgagaaatataaggatcattcgaccgaagaacaacggacagaatataaaaaagtgttacaagcagtggaaattagtatgaggcaaatgacctcttagaacaaaaagggctgtgtttctctatctagagtagggagatcacacagctcttttaatttttcgtacatgttaattgagtgaaatttactattcctcatgtgtatcaggggtgtcggagttactctccaaaagctcgctttgtgaagaagtgaacagttcctttaaaatgcgataagctttattctgatccgcttcactctgctgagaaaggatatgaacgcattcccatatccagggctggcctttgagttcttcatatggattatagtcaaaaagtgcgaatacgtttgtgttcagtgcctcggctattttctccagtgttttgatctgcacattgacctcaccgcgctccaacttgccgatataggaacctgttgaatcggatgcttctgctaactgttcttgtgtaataccacgcaattttcgaaattgacggattttcgttcctaatagtttcgttgtttccatagacacccacactcctatagtatgagtgtagacaaaggtagattaagcgtggaggtaattaaattgccttaattattcgatatttagttcttgtaagaactattttaataaacatcaaattccataatataataaaacagtgtagaaaaggggttgaccgtcatccaatttattcatataatttctagtatattgtaattgattgtcgaggagggtgattttttaaaatcatctgaatacgccgggggtgtttttattggaaaatgcaaccacgatccgttcggaaattgagaaagaactaaaacttggtggctacacttttaatagttttggacaagctacgggtcttaatcggggcatatttagtgctatgcttaatgggaatccgcctaaacctatctccgtaagacaaatggacttgattactaaagcgtttaattatccagaaggctggttgtatgacctgtatgtggatgaatgtttttatgatggaagaccacattggaaaagggtcaagccgttcctgattcgttgtgttgaagtagggaatctgaggtgtgtggagaaagtgctctcacgcttaatggaggatcttaatcatattcctacaattttcactttagcagaagagttgtacgaggaaggaaagctaaaggaagctattcctttctatgaatgtgttattgaaaatgaaaagtaccaacattctgagagattggcaatcagtcattataaattatttgtagcttcgataggtaaagatttagaaaggaacttggaagcggttttaagattcatcccctatcgtaaccgacttcctgaaaattatcatttagatgctttgttgaagttggctaatatctactttagtcttcaccaatggaaagaggtggaaaggtatgctgacgagctacgaaacttagcaactactgtatataaaaatgaaattcagaagcgaaaaaacataaataagtatagacaattagagaccgaaaggccgcttgttgtttactatggacaaggttatttacttaaaggcaatgctttggaactacaaggaatgtatgaaaaagcaatggaatacattgaaggttactctgatttaggctggtttgaaggactagatgaattagggttagaagaagttgaacttctcaaattatgggcagaagcaaataaacttaacttaaaggttctaatgggtgaaaaggggagtttaccttcgtatgttaattttcttaagaaaaatccccttgaagtattgcctggtttgcttactattgttgagtctgctattaaatataaatttagtattgatgcgatactttccgatttctcagaggaaattagagattttaatgatagtttctttttggatagtggatattatcagctagcgccaactgtggacagatatgctgatttacattataaactggcaatttactattttggtaatgaaaaaatcgatcaaggtcttgattctattttagaaagtctgaaattttataaaaatattaataataaaacaaagtttgtagaatgtgttgctttgttcgaaaagttcagaaaagactccacatctcagcatagaaagaattatgaatttataatggaggagatattaaatgatgaaaaaattaacgatgttctccttgttggcactaagtctaattagttttgttagttttggaaaaacgcttaatactaatttggatatattcgggcatggaaatgggaactatagcacttatgggcatggaaatggacattagtagaattagaaattatgcttctaagccaattcttttgaattggcttttttgattcatcctgttaaaggaatgaactgggttttattatatttttaacctgtagggaaggtatcagcttgtaaactaatgtaaataccacaccgaacaggaggtttattgatgtgaaatggaaacaattggaggaatgcatcgaagaaaagcggaaggaactaaatgatttggcgaatgaggtgggattgaaggatcggcgggtgttaatcaagtccatggagttggatcgactccttaataaatacagtgactggaaatatagctatcgtagacaacagagcataccccaaagttcacaaatacaagagaagcaacacgagcttgtcctatcttattaatctccaagtatcatgacaagataaacctaacttcaccagggcttctaatacatagtgggatatagaataaacaaaataatctctattgcatctcgtacgccgctcttatccacgttgttcgtacagtttattgttctgcgtctacatcagaggggaagccatgtaacatgaagatatgtatcaaaaaaacctcccgattcacgttactgcgtgactcaggaggtttttgggttttactgttgaagctggcgtaatacggtgatttcgacacggcggtttttttgtcgtccagcttcggtactattgtcaccaaccggtcgggtatctgcataacccgcatactgaaatcctgagggtgaaagttgctctttgtcgagaaagaatcggagtacagatagtgcccgtgcgccggaaagctcccagttgtccttatacgtcgatgagttcgaggagcgcgtgaacggaatgttgtccgtatggccctcaatgctaatcggtgttttcaaatctcgaaacagactggccaacttggatagcgtgttggcagagccttgcttgagtgcagctctaccttgatcgaataaaaagcggtcattcagtgtaatgacaataccacgcggctgatctgacacgaaaatctggttttccagtttgttgtccgtaatatattcttgaatgacacccattaaattttgcagctctttttcctgcgtgcggaatgcttgttcacgttcggtgagctttgtcgatccagcttcctttttatcggttgctggttgcttggtcgtgggtggattcttgctggtgtaacgatcggcagtacctgtaatacccgagccttgctccaaaatagaatctcccttgtggaacgtatcctggagggattgaacaacgacatcgtattttttagcatccagactactcatggcatacatcacaacgaaaaatatgagcagcagggtgatcagatcggcataggtaatcatccagcggtcacgatggtctccgccgcctccttgacccccacggcgcttaccgcgcgctctcatggaagtcctcctttggagaagcgtcatctgtgcgtgagcgacgaggcggtttgtgatctatattttgctctgagcggataaagaactccaactttttgcgtacaagctttggattctctccgttttggatagccaaaataccttgcagcagcaaatccatagtgataatttcactctcactggcagctcttattttggatgcgatgggcaggaagatcagattagcgctagcaacgccatatagtgttgcgataaaagcaacagcaatggacggaccaagcgcagtaggctcggtcaggctgcccagtacatggatcaggcccatgacagtaccgataatccccatcgtaggggcataaccgcctgcggattcaaatattttggcgtatccttcatgtttgtgttcaatggcatctaactcaagctctaaaatctgtttgatctgctcctgctcggtgccgtcgatgaccaactgaagaccttcacgcaaaaatgcattcggatgctctgatgaagtacgctctagcgcaagcacaccggatcggcgtgaggtggtagccatggaaaccaaatcttctatatattgcttcgtaggattgtcctcacggctaaatgccatccgtagggcggtggggatcgtcttcagtttggaagctgggtagctgatcacaactgcggcgaaagttcccccaaatacaatgagagccgatgtaccttgaagcagccctgtaaattcgccgccttcccataagaagccaccgattaatgctatgattccggcgatgatgcccaatacgatggtgatatccaaaatttaattcactcctattcaagacttatcgtttgcatccatggtaagaaagaggtataatacgggaacaaacattcttatctaaccatatttcccaagtatcattgctcgggaaatatcgacatagagttacaggtaaagacgttaaagctcgactggtgtaaaatcatgatgtttccattttagacgataagggtgatgcagggcaatgagtgatatcgttgttagcgataagacttttgaaattcagtcggaattccaacctcaaggcgatcagcctcaggccatttttgaattggtagagggaattgcagaaggaaagaagcatcaaacgctattgggtgctacgggaacaggtaagacgtttaccatcgcacagaccattgccaagttgaatcggcctacgctggttattgcacataataagactttggctgctcaactggcgagtgagtttaaagaattttttccgaataactcagtcgattattttgtcagctactatgattactatcaaccggaagcatacatcccgtcttccgatacgtatattgagaaggattccagcattaatgaggagattgataaacttcgccactcagcgacaagctctctgtttgagcgtcgtgacgttattattgtagcgagtgtctcctgcatttatggtttgggttccccgaaagaatattcaagcctgctgctttcgcttagagtcggcatggagaaaccccgcaatcagattttgtcccgcttggtcgatattcaatatcagcggaacgatatcaacttcgtgcggggtactttccgtgtacggggggatgttgtggagatattcccggcttcccatggggaacacgctatacgtgtagaactgttcggggatgaaattgaacgaattaccgagattaatgtgcttacgggtgaattgatcggtgaacgtgatcatattgccattttcccggcatctcacttcgttactcatgaggatacgatgaaggtagcattggtcaacattgaacgtgagcttgaagagcgattagcggagttgaaggagcaagggaagctgttagaggcgcaacgtttggagcaacgtacccgctatgatatcgagatgatgaaagaggttggcttttgttccggcgtcgagaattattcaggtccactgacattccgcgagcgaggtgcgacaccatatacactgatggattatttcccggatgatatgctgatcgtcattgacgagtcccatgttacgttgccgcagattcgtgccatgtataatggtgaccaagcacgtaagaatgtactggtggaacatggtttccgtttgccatccgcattggataatcgcccgttgaagtttgaagagttcgaggacaaggtaagtcagatcatctatgtatcggctactccaggaccctatgagatggagaaatgcgaaacgatggtacagcagattattcgtcctaccgggcttcttgatccgattattgaggtgcgtccgagcaaggggcagattgacgatctcattagtgagatacggcttcgcatagaacgtgaagaacgggtactggtgaccacacttacgaagaagatgtctgaagatttgactgactatttaaaagaagtaggcatcaaggttcggtatatgcactccgaaattaagacgttggagcggatggctattttgcgggatcttcgtctagggaccttcgacgtgctaatcgggatcaacttgttgcgggaaggcctcgatttgccggaagtatcgctggtcgcgattttggatgcggacaaagaaggcttcctgcgttctgagcgctctctgattcagacgatcggacgggcagcacggaacagtgacggtcgtgttattatgtacggcgataagattaccgattctatggataaagcgataaaggaaacggaacgtcgtcgtgcgatccaaattcagtataatgaagaacatgggattaccccgcaaaccatccgtaaaaagattcgtgatgttattgaagcaaccaaggtggcagagtctaagaatgattaccttcctaatgagacgggtaaactttccaagaaggagcgtcaatcactcattcagcgtctggaagcagagatgaaagacgccgccaagaacctacagttcgagcgggcagccgagctgcgtgacgctttgctggagttacgagctgattaaagattgagaataagctagaagcaaaacatatgaaaataaaatgtttgattgctttgcttttaaaaatagtgagggcggcctatgtggtcgttctctttgcgatatatcacttccatgggataatccaatgcgatatagcatgacgtgaactacggctaaggagatgaaacatttggcgaatgaaagcatcatcatcaaaggcgcacgcgcgcataatctcaaaaatattgacgtgacaattccacgggacaagttcgtcgtcctgacagggcttagcggctcaggtaaatcgtcactggctttcgatacgatctatgcagaagggcagcggcggtatgtggaatctttatctgcgtatgcccgtcaattcctcggacaaatggagaaaccagacgttgattcgattgacggtctgtctcctgccatttccattgaccagaaaacaacaagtcggaatccgcgttctactgtcggaacggttaccgaaatctatgactacctgcggttgctgtttgctcgggtgggtcatcctcattgtcctgaacatggcattgaaattacttcgcagaccgttgaacagatggtagaccgcattttgcaatatcctgaaaagacaagacttcagattctggctccattggtctccggccgcaaaggtgaacataaaacactgtttacggatatagccaagcagggctttgtacgggtacgtgtgaatggagaactacgtgaattatctgagaagattgagctggaaaagaacaagaagcactcgattgaagtggtcgtagaccgcatcgtagttaaagaagatgtgcgtgcgcgtctgtctgactctattgagacggcactgaatctttcaggtgggcagttgcttgtagacattatggggcaagaggagttgcgtttcagctccaactttgcatgtcctatttgtggattcagcatagatgaactgtctccaagaatgttttcctttaatagtccgtttggtgcttgtccagattgtgatgggttaggagttaaaatggtagttgatcctgatctgctcattcccgatcctgaaaaaagtgtggaagatggggcgtttcaggcttggagtggtggaacttccacttattatcctcaatttttacagtcagtatgcgagcactacggtattccgcaggacattcctgttagtcaattgacgacagaacaaatgaacctcattttacatggaacgggtgagcagaagatccgtttccgctatgagaatgattttggtcaacgtaaggaagcctatgtgacctttgagggaattatccccaatctggagcgtcgttatcgtgatacggcttctgaaggtatacgtgaatttattgaaggctttatgagtgcaaagccatgtaacacctgtaagggacaccgactgaaaaaagaaagtctgtcggtaaccattcaagagcgtaatatagcttttgtgacagctttgtctatcggtgaagcttcaaactttttccatacactggagctgagtgagaaggagaagtcgattgccaatctcattttaaaagaaattaacagccgattgggattccttgttaacgttggtttggaatacctgactttaagccgtgctgcaggcacgttgtcaggcggtgaagcacagcgtatccgattggcgacacagatcgggtccagtctgatgggtgtgctttatattttggacgagcctagtatcggtctgcatcagcgagataatgaccgtctaattagtgctttggagcatatgcggaatctcggcaatacgttgattgtggtggagcatgacgaagatacgatgatggcggcggactatatcattgatattgggccaggagctggaatccatggtgggatgatcatgtcgcaggggactccgcaggaagttatggaagacccgaattccttaaccgggcagtatttgagcggacgcaagttcattccggtcaataccgagcggcgcaagcctgctgataagtggctggagattcgcggagccaaggagaacaatctcaaaaatgtgaatgtcaaaattccgttgggtgttttctcagctgttactggtgtatccggctctggaaaatcgacgctggtcaacgaaattttgtacaaaaccttggcgcgtgatctgaaccgagcgagagtacgtcctgggcagcataaagaaattcgcgggttagaacatatcgaaaaggttgttgagatcgatcaatcgccaattggccgtacaccgcgttccaatcctgcaacgtatactggtgtatttgatgatatccgtgatttattctcgcagacgaacgaggccaaagttcgaggctacaagaaaggccgctttagctttaacgttaagggaggccgttgtgaagcttgtagaggcgacggtatcatcaagattgagatgcattttctgccggatgtgtatgttccatgcgaagtgtgcaaaggcaagcgttataaccgggagaccctggaggttaaatacaaagggaaaagtattgccgatgtgctggagatgacggttgaggatgcaacggagttttttgaaaatattccgaagattcatcgcaagatccagacgctgatggatgtaggattggggtatatcaagctgggtcagcctgcgactaccttgtctggcggtgaagcacagcgcgtgaagctggcctccgaattgtatcgtcgtagcacaggcaaaaccatttatattttggacgagccgacaaccggtctgcatgttcacgatattgaccgattattgacggtgctgcatcgtttggttgattcaggagagacggtgctggttattgagcataatctggatgtgattaaaacagccgattatctgattgatttgggaccggaaggcggaagcggcggtggaacgatcttggctaccgggacaccggagcaactcgttagagtcgaagaatcctatacaggtcgatacttaaagccgatccttgaacgggatacccagcgtagtcaatcgcttcagacagtcgatctataaataccatttaacgtatgatttaaaaaccctgcacaggcaggaaggcagaatacgaactagtgtattgatgccttcgtcttgcagggttttattttttttgtaaaaaaagaaaacttttatcaaattcctgcgttaaagcatgtgacacatagtttaccaagcgctggaataataaatctatacgtatattcatcgacagaaagtctctgagtagtctctaaattttggagttttggatgtttaggctcgggcttgaagaggtaaatatataatttatgattacttagcatcatacggagttccgtgcccgcgtgacaaccattacaagttgaagcgaaaccgtctgtagttttatcacatctaaggttcatacaacatctttgaggaagtcatgaagggagctggaacgcttgaagattaagcaaagtagagttttacgtacacgtgtatattcatgggcagcaggagctgctttggcggcatgtttgatgggttatagtgctgcaccgtcctatgcctccgaggtgtctgaggcgtttgcgcccaaacaagccgaaatcgaaacaagtgcagcaattggcagtattaaggatttagaaaacgctcatgattacattcaacccgcagcgaatggtgggtttttaatgctgaacgtcgaggacgatacagaagcaagtgtagtacacgtcacctatggcaagctggacagttctgtggaggctgtatggaaacatcagcaggacctgaacgtaaaacccggaacaagcagcaggggagtccagcgggagacatcggataggggcttgctgtttctgattgattatacaaaaccgaacggaatacgagatttgcaggcttcacgattggacgaggatggaaacaccttgtggtccaaaacattacccacagatggcttgatatctcatgggcaggattctcaggttggtttggagacattggaggatggcggtttcctggtctcctatctaaaccttgctgagcagtccttcactgtactcaaatacactgaaactggcgatctacaatggaatcgaacgacggccggagtgacctcgggttggctggtcggcagtcacaatggatattatgcgcttttgaacagctcagatggtcccgttggggtacaagcagatgtatatggtcgcgatattcgtgacatccatctggacttaggatcaggtaaagaaattgccgcagtacgtgagttgccgagcggtcatattgcagtaacagggcttaaaggaaacagcaagcgtacacaggtgcttagtaatggtctacaattatttagtaatacagaggactatgcggctgaccgggtgtatctgcctgaggagcagttgtatgtccagttcagtgatcaatatgatccactgggtaaaaccacgaagatgcatggcatcaccattacaggcctgaaaggaaacggtacgaaggtgtgggaaacgaggactcattataaggaggataattccttcggcatccgttacgatacgggattgatatacaagataccttcaggctacgtggtggtgacatctacaacaggagctcataagccaacagtactggattttgcgaaaatattgataccggagtaatccggtgtcttttttttgtgaaattgagggaaacgatattgcgaggttgtatgacgataagaaacagcctgcttgtatatgtaatacaaacaggctgttaatagactctatatttaggatgcaacgtggctggattgtaaaatggcagacagcttttcctggaaagtcggaatacctacacgctgtacatatgcgtaaaagctttcgccagcgctcctgttttctttgtagaacagaatgagctctgccagtacaggtccaacctgatccccgcgtactcgacctttgagcgccttgttaaactgggcgcctgctccaagcgctccgccgacagcgatgtcgaacgcgtcgaccaagccttccggtgtcttaataagcgagccttgcagaccaatgtccgcaatatgcttttgaccgcaggaattcgggcaaccgataaaatgaatgcgcaccttttcatccaattgtacgtgctgatccaaatactcggcaacgtcaaccgcccgttttttggtttccacaatcgccaaattgcaaaactcatttcctgtgcacgataccgtacgactcataaaatgcttgggctgtggtgtcaggcgttgcagcacgggggcttccagtagttcatccacctgctcatccggtacgccgctcagcaaaatattttgcgacatcgtggtacgaatctgaccatcgccatagcggtcagccaggtcggccagttcatgtaactcgtcagcactaaggcgaccgacaggaacgttcagaccgacatagttcagacctttttgagcttgaggatgcacgccgtcaaaataggcggcttgccagccaatcgttttgtcctcgcctcgtccgggcatttcaccgatgtactcggtgagcttagccagaaatttgtctgggccccaatcggcaacgaggaatttcaagcgggcatggtgccgcttttcccgatagccgtaatcacggaaaatggtggtgacagcaatagcaaccttcagtacttcctcaggacgaacaaacaaatccagagactgtgccatatgcggcttggcggacaaacctccaccaaccatcgcatggaagccgaccacttcttttccgtcgaggatcttggtggctggagtgaaggacaggtcgttaatttcagcctgtgcattattgtacgtattaccggagatagacattttgtacttgcgcggcaggttggaaaagtctcgattcaataagaaaaatcggttcacttcatctacaatctcctgggtgtccactaattcattgggatcgatgccagccagtggattaccaacaatggtacgcgggcagtctccacaggcttcaaaggaatacaaattgactttttccagtctttcgaaaatatcgggcaagctttcgaccgtcagccagtgaaattgaatcgcctggcgtgtggtgacatccacaagaccgcgtccatatagcgcggatatgtccgccaatgcatgtgcctgtgctgaagtcatgatccctgtgttgatgcggacccgcatcatgaaatgaccatccttgggcttttgctgatataccccagcccatttgaaacggtccatatcgtccgcagagatcgagtcatagccttcgttggcatagttttcgataatggtacggataacgtcgagaccgtccttttccagcttgactaactcgaatttgttaagcttatcgggatgagcgttccagattggttcgtaggccattcttttaacctcctgtaggtgcttatttatactttagtgttttggatagaggattcatgattttattctttatttccgacaataaaactaagatataatgtgatggtatcatagttggttatgcccgtaaacgaaggaatgacctaaacagtataacgattatttatcgtttttgcttatttttttgatataaggatttggaaaatttataatataaatagcatgaggggacagggatgtagcaaacgcgccttttagaaaaagatagggcttaaagcgattgtatacgtgtcccctctatggtagatttggactaactgatagaacagggtcatgtaagagaggaaatggtgagtatatgcgtaagatggggaaaagggcagttgttctagctctgggcagcgctctatgtgtttctggaacggcaggtgcagctagcagtggaactgcgttaaaggccaaagtcattaatggtggggtctatgttaacgtaagcgatatgaataaagcattaggaaccagcggcgcatataacagcgcaaatggtacatatacgttatcggccgatcgtgtgccgcaggtggttaaaaatgtatctccttctgtggtcggtatcattggccgttcagccacgggagagaccgtagcaggaggagatcgatacaacctggctcacggcacgggtgttatcattcgtaccgatggatggattgtgacgaatgcacatgttatcgaaggattaggtgatgccgtggtcgtaacctcggacggaaaatcttatggaatcaccgacagctacagcgatccgatcagtgatttggcattagtcaaaatcaaggcaagcggcctcaaacccgccaccttggcagcttcaacgaacagtctacaggtaggtgagcaggtagtggctattggtacgcctatatccttttcacttcgcaattcggcaacctcaggtgttgttagcgggctgaaccgtggtgtcaacgctgcttatcgtttgatccaaagtgataccgcgatcaatcctggtaacagcggcggtccgctggtcaatcttaagggtgaggtcattgggatcaatacgatgaaattctcggcggtcggcattgaaaatatgggcttttcgattccgtcggatacggtgaaatatgtcatcggccaatttttcaaatacggagaggttcggcgcgccagtcttggtctgagtctggaagagagctggtcagctatcgttggattacctaccgaggaccctctgaaagttacgaaaattacctcagccaatgccattcaggccaaaatcaaggaaggcgatgagctgtatagcattaacggtaagcgtgtggcttcggccattgatgtcaatgagctgcttaaaaactatcaaccaggtcaaacggtgagtgtactaatgcagtcggacggtgatattgtgaagcgcaagctagtactgacacaggataatggtgaaatctatgagtccattcagtctggagaagatggtgaagattcgaacggttcggaggccgctgaagatggcggcgtagcgcttcctaaggaaacatcggagccagctcaaggggcaactactggaaagtgaacaataacggctcttgaatttataaaataaagctaaagggagatttactgtgaagcatattcaaagaaaaatgatgcgtaagctgggggtcggcgctgtcgcattgtcccttctgctttccgctttgccagcagttgcagcagatcaagataaaaccatgctggaattgcggttgcaaagcggcagcaatacagccatcatgaacggccataatgccaatattacgaagccatattcaaaaagtggtgcactgatggttccagctggtatttttaaaaaggcatttaacagcaaaattcgattggctgaagataatgtggttaaaatcactagcggaactcatgttgtatcgctgaccattggtagccgtactgcttgggtgagaggtcacaaggtgacacttccagctccaccggaaatgtcatcaggtattctcatggtgcctctgcgtcaagtagcagaagggcttggcggtaagttggagaagaacggcgccggaatcattattcggatggaagcacaagaagaggcgggcacggtagctgaagagacaccgaacattgataatgatgagggcaagacgcagatcgggaacagttactatggctggtctatgaactatccaacaggtctcgtcatcggtcagggaggtggagatgagagtatctccacttttatggacgagaacagtgcgtactatatggaagtgcacacagcgtcacagccggttccactgaatgcggacgatctgttgcaacaattagtgcaggcagccaaggaaacgggagaaactgtgatcgatcgaaaatccttcccgaaagcgaaggtaccttatgctcgtgtcattacgaaggatggggacggcgtattgtgggaaaatcgtcagtactatgacaacggacgattgtatgtagtttatttttccgatgctaaagcaacgaattataaagatctggcccagtatgcgggactgttaaattccttcaagacctcttttgatgcgcaggataaaagtattaaggacttgtccactgtcgtaggaggcacacgcgaggccggaaatccagactacggcgtgtcactcagcatacccgcaggctggaaaatggacgatcaacggatgcaatatgaaagtaatgatggatcgagcttccgcatgaaaataacctcggctccagcggatggaaagttggagaactggggccagcaactgcaaaaatggctgagcgattcatttgtgtctacggcttatgaggcacagaagacgtatccgctggaagttgcaggcgttcaagggttagtacaggagtaccgttataattttggcgatggatgggtcaaagagtacaatgtgctgatccagcaaaatggataccgctatttggctgaatacgcagtgcctgaaaaagtaagcaaaggaaatgatcagttcaatgcgctcatttcctcgcttcaaatcgattttcaaaccgtagcaagtaactttggacagttggaagaagacgactatttgacggacaaaacgaaaacggtcaaaaagacgtcaaaagcctatgaatatacggtgaatatcccacgatattggaccgcgattagcgatcaatttgaattgggcgatgtagagtaccagtttaccggaggtcgtttttccatcaaaatcgacaacgaccaatcatttgaactaacggtatcccagctcaaggacttctatgataagcaagcaaagaactacaaaaacctcaaagttgaggaagttaaggacgtaacgtttgctggtgttccggcagtgtcctttacattccatcgtatagaggaaggcattggctacacaggccaccaattggttttggaacgtgacggaaaaacgtatactgtgacaacaacattaaatgatgcgaacaacacggctgtacagtctaacgcactggattcgacgttaaattcgtttaattttgtgaagtagaaggtgtaggtaaaagattagcgaggttgtgggggaagcgctacgcgtgccatttgagcctacgatcgctgttgacccgggattcttggattgtttaagtgatttatatgtaagaatcccaggtcaaaggcgagcgctggcgcttcttcggattccaatggcccgcttcactgacgctcgccaaataccaccaatcttataatgagtgaagtaagcactagggaagtctatacgtatttccccgtataggaggaatccaaaatgattacgctaaaagcagtcgacaaacataattgggaagcatgtgccgaacttgaaccgacacctgagcaaaaaagatttatggtatctaaccttttttcgattgcggagtgtcagtttttagatggatttttatctaaagcaatttataatgatgacgaattaattggttttacaatgtatggtttagacccggatgacggaaattactgggtttaccgatttatgattgacgaaagatttcaaggtcaaggttatggctacaatgcgatgttgctggttatcgacgaaataaggaaagccagtgataggacggatgttatcatgattgggtataaaacagacaatgaactagctagaaagctatatagtaaaacaggcttcagagagaagggaatatcaccttggggagaaatgcttgcgaagtataggtttgcctagttaatgataggatgactcacctccaaagaaccgcttgacgggattggaggtgtttttagtattattttttaaaggaatcgcttggaaagtgtagaagcttaggtcgcagtctggtacactagattagttacaagataagaatgattctgccgcagatgtttgtgatgcggattttttaagttggatgtaattcacgcgaggaaccgatggttcagtgtgtggatgatcggacaagatgatagagacggataggatttaaaatatgattcttagtaggcttccattcccctgactaaacatgatcagctttggaatgagtctatggaacatccataagattaccaagtaagcagcatagctgccctgaaaacaacgattattcctcgggggatcattcgttttcagcatatggggagggcaataatgaaatcagcagtacgaagagaagatgttgagcttctggcaccagccggtgactgggattgtatgcgtgcggcggtggcaaacggggctgatgcgatctttttcggggtggaaaagttcaacgcacgagcacgggcgaataatttccgcatggaggaactgcctgaaattatggcgtttttgcatagctatggggttaaaggttttttaacattcaatatattggtatttgaaaacgagttggaggacgctaaggagctggtcgatgcctgtattgatgctggagtcgatgccttaattgtccaggatatgggcctggtgaaaatgatccgcgacatttcaccggattttccgattcatggttctacccaaatgacgattacctcgccggaagcggtagagtttacaaaacccttcaatatggaacgggtcgtgcttggacgcgaaaacaacctgaaacagatccaaaagataggcgatcaggcgaggcttccaatggaggtattcgtacatggagcgttatgcgtatcttattctggtcaatgcctgacttcagaaatgtggggcggccgctctgctaaccgtggtgagtgtgcacaggcatgtcgtttgccttacgatctaatggtggacggagagcagaaaccaatggcagatgtgacgtatctgctgtcacctaaggatctggcagcgattgacttgatgcctgaactgatcgacgcgggtgttgtttcttttaaaattgaagggcgactgaaaacacctgaatatgtggcaaatgtggtcagcaagtaccgcaaggccattgataagtattttgatggcgatacgtccaagaccagcaaagaagatatccgcgagctgcagcagagcttttcacgcggctttacgcacggttttctcgaagggaccaataacaagaagctggttgacggtacattcccgaaaagccggggggtgtatctgggccgagtggaacaaatccttcgtgatggcgtagtgtgccgtattgatgcaccgctcaagcgtggcgatggtattgtattcgatgcgggagatcccacgcaaaaagaagaaggcggacgcgtatacgatatccgccgcaagggcgtgaagattgaaggcgaagccggagaaggctggatcatcgacatcgtagcgggacgcaacgatgtggatctgcgccgtgtgcacgtgggcgaccgcatttggaagaccaacgacccagcgctggacaaacgtctgcgccagtcgtacgacaccgacaagccgtaccgggtcttcccggtacatgtgcgggtcagcggctctccagggcaaccgctgtcgacatggtggaccgacgtgcagaaaggcacaacggtccgcgtggactccgagctggagctcgaaattgcccagaagcgtccgatgacgcatgaactgctcgaagagcagttcggccgactgggcggaacggtgttccagctggaagaactggacgtccatctgcatggggacgtcatcgtgccgatgcgcgagctgaacggtatccgccgtcaggcggtggaactgctcgcgggcgagcgccccaaaccgcccgtgtacacgaaacggacggtcgaggtgtatgacgatgcatcgactccggcatcgtctgttgcacgcggtcaggcagagctgaccgcgttgtgccgcagcctccctcaggtggaggctgcgcttgaggccggcgtggaattcatctacgccgacttcgagttcatcaagcaattcccagcagccgtagaggctgtgcacgctgcaggccgccgaattgcgctggcgaccccgcgtattcacatgccgggtgaaaatggctaccacaacaatatcctgcgcttgaagccggatgctgtgttggtacgcaatccaggggcactgtatttctacttgcgacatcggttggagaacccggacgcacatcacccgcaattgattggtgacttctcgctgaacatagccaaccataaagcggctgatctgttcctggattctggctgcgacctggttacgccttcgtacgatctgaacattcagcaaatggtcgatatgctcagacgtacacgtactgataagctggagatcgtgatccagcagcatatgcccatgttccatactgaacattgcgtatactgcacctttatgagtgaaggcaccgactacactaactgtggacgtccatgtgaggaccatcgcgcatccctgcgtgatcgaattggtatgtctcatccggtccgtgtggacgaaggctgccgcaacacggtgtacaacgcgattgagcaatccggcgcggaatacctatccaacttcctggagctgggcgtgtcccgttaccgcgtggaatttttggaggagacaccggagcaagtgcatgaggttattgatctctataaccgtgccctgcgcggagaaatcagcggaacacaagtatggaaaacgctgaaagcgacgaatcagttgggtgttacacgtgggcagctggtgaagtaaaaggatgctataggttatcacagttatttattttgatatttgaacgtagaaaaagaaaaaatagggtatgtgctttgagagcacataccctatttttatcaataagtccatttgaaatactatgaatctcgtattgttatactttctggactttcgtttttttggaaaaaacaatgaatttttgcccgacataattaattaaagtatagaagatattcccgattaggatggacagattgcctaaaattgcattgtttttaatactcagacttgagatcaagaagtggctgattagatagctgagacaatacgatagtaaatagcatatcaatatgataaagacaaacttccaaatggtctgtccatggcttgcactgtttttgaaagtaaattttttgtttaagaaatagcttacagtggcacctacagaattaccaataaaggtcgataaccagtagttagtccctaaagtattaaagagcaggaacatgacggacatgccgcatattgtatttaggacacctacgacaagaaaacggaaaaagctattctgaaataaagtcaaattagtcacctgttcgcatctgtttattggacagccacagcttccctctcactatttttcactttttttgtgttttcagtatctagggtgctcttggaatctaatagggtctcaataatatatttgggtctttgttttacctctttatatattttaccgatatattcgccaatgagccccagtgctacaagttgcagaccacctatgaaccagatggacaacattaaagaagaccagccccagacagtggttccaaggagcttactaataatggtatacacagctattaataagcttatgccaaacattgcaaaacctaccgctgagataagccggattggggttatactaaatgaagtgattccatcgaaagcaaaagcgagcattttctttaaaggatatttggattctcctgcaaagcgttcatgtcgatcgtaataaacttcagtagacttataacctattaacggaactagaccacgtaaaaagagatttacctctttaaagttgcttaattcctggagaactcttttgctcattaaacggtaatccgcatgattgtatacaatattgactcccattttactcataacacgataaaagccttgggctgttgaacgcttgaagaatgtgtcggtggttctactttttcgaaccccatatacgatgtcataaccttctttgaactttattataaattctcggatggcattgagatcatcctgcaggtcagcgtcaacggatatcacacaatcagatgtctctttagcttccattaacccagataatagggcgttttgatggccggcatttttcgccaatttgagaccactgacaaaaggattttttagattatatgatgctatgatgtcccatgttttatcacggctaccatcgtcaacaaacaacattttactatgtttagaaatgagctggctctctgccaactcctcaagaatgaccgtaagtctgcttatagtttcaggcagtacctcttcttcgttataacagggaataactaacgttaaaacagggttactgattattgaatccaaagaactctctcctcaaattttggcatatctggtactcaaatttctatcctttttagtttataatatggtttacttaaattatataacattgcaatgactaagtgctataataaactattagcaatttacaaacgttaatcgaattattgaataatttagtaagttttgttgaaaaggagttttaacctatgaaaatccgtaaagcgattattcctgctgcgggattagggactcggttccttcctgctacgaaagcgatgcctaaagagatgcttcccattgtagacaaaccaacaattcaatatattattgaagaggctgttgcatctggtatagaggatatcattatcgttactggtaaaggcaaaagggcgattgaggatcattttgactactcctttgagctggagcataatttgactgcaaaggaaaaatgggatctgctcaatgaagtgcgtaaaccatcggagatggcagatatccactatattcgtcaaaaggaacccaaagggttggggcatgccatctggtgtgcacgtaagtttatcggtgacgaaccttttgccgtccttttaggggatgacatcgttgagtctgagaatccgtgcctcaaacagatgatagacgtgttcgatgagtatcagcgttctgttgtaggtgtaaaacaagtggattggaacgaggtacatcgttacggcatagttgaaggtcatgcacttacttccaaaatctctgaagcggaacgattggtagaaaagccaaagaaggaagaagcaacctccaacttggcgatcatgggacgttatatcttgacgcctgatatttttgatatcctgggtcagcaatctgcgggagtaggcggggagattcagttgacagatgcattgtccaaactgggagaaaagaatccgatcctggcctacgaatttgacgggaatcgccatgacgttggcgagaaattgggattcattgaaacaacgatccattatgctctacagcataacgaaatcaaggatgaagtactggcttatatgagacaggttattgaagatattgatcaacaaaaataaacacctcaccaaacctctctttctccaaataaaaaagagactaccggatgatataacatcatctgatagtctctttttctgtactatttctccgattttaactgagcaatttgctccctctccttcggatcagctttaatcagcttatcgtacaatgctttgtcatcctgtccctgctgttgcagagcagcgatatagtagcgggcgacctcacgattcgtagcatcactcaaatcgtccttcagaccgtttttcaggatgctagcagcctctgcgggcttgcctgacatgaattcaattttgccagtgctgagcgcaatacctggagttacctcaaaagtacgtggcaactgaatttcaggtggaaccgtcttaatatgagctaccccatccagaacctgctggtatgcagcaagccctgcttggaaatatttctgctccttggcggtgtccttctgttcacgtgccttatcaccaatagagtaggcttgagtaatcaacatgttgtaccagtcattgtcccatttgaagttggaaatgttattttccaaaatactgaaggcttgctcatgctcaccttttgcttttaaaaggttaactttggagtaatacatgattttattatacggttctgccttcaggcccgtattaagtacctctattgcagcattataaaattcctcttttttcgtttgatcatacacattcttgtacagtgcagccaaacttataaccgaatctgggtgcgtaggacgaagttcaagatccttattaatggcactttggatttcctcaaaagatgtgctgaccgccatgatctgtttggcagatgtggcagcattggccgattgcacgaagcggagacctgcaaaaagcaccacaatgctgagaatgccgatgactgcactatacatgattcggaaaccagaagtactcatggacaagcgtctaagaggtttgctgtccatagcagcggccataccaccaagactcataaatatcagtatgcccatgaacacgtagctcagattaaagtccagcaagctatgaagtaagatcgagagcgccaaaatgagatacagaaagtgagaatcccgttcttcatcattttgtctaatatagttacggatatatttgtagaaaataaataagatgaatgacatgaaaattacaaaaccgagaataccaacctcaaccagatactgcatgaagaagttatgggcctgacggcttgtgtaaggatagtcttggtatttctcatataaagtagcccaaccgccgccgccggtgccaataacaggatgatctttaatcgatttggcagcatcctgatagaatacaagtcgttccagtacactatgctgccggaaattgatattttcaaaccggacctggacgttttctggtagtacgctgcgcaggccagttccaataaacagaaaagccagcaagccaatcacgacaactgatccgacaggcagccataggttggataacttacgggaagtccagcctgtgagggcactttccaacttcggtgccagataacgttcaacaagccacagtacaacagctacagcaagggagaccccaataagtaacccccaagccttggcagcctcaccaccgttgtaggccttattgagttgtaatcccatatttgtaattggcgccaagatagatattgacgctacaccagcaatggcgcaatgcaaaatccatataatttggcgtgcaggtttaaggaaaagcaagagcagcacgaaaacgactggcaacataaccagaccgccccgtgacaaggtcaggaataacgagaccagaataggcaccaacatgaagccgtgaatagccttgccataccatagttttgatttcatcagacagaaaacggcagcgaataggaaagccattagaaaagcggcatatgtattcgcatattgaaacacggatgtcagccggagaccatttgtatctgtcataactgcattggtataacgatattgatacacatattgggtaaaccagcctaccatcttgccggcaattacccactgtccgaaccagttaataaagccaaagccgacaatgacataagcaacagtcataatcaggttgtgaataatcttattgcctaagcgatcttgtagtagatagattgagatgataaacagggcggcatatatgcactgtaccaccaccatattcatggccaagtaatgcgaagctgctgaagtcagtgaaagcacataagacaggggaagcagtagtactaatacagccagccaatccctttgctcttccagcttgaattttttataataggttacaattcctaaaatcaatagaatcgtgctgatgatcaaagcccaatacaaaggcttctcaaagtcgagcatttgaccattaaaaagcgcagcctggaagggggcccaagctaaaaacagaatcatgccaacaattaacacccaaaacatagccggccttttatcgtcacgggtcgacgttttggcctgtttcccgtatactggattcgacaaggtttacaatctccttttcttgtagatacgtcaacattttagcatatcgtagctgttagagccatatcgcaacaaagaccataccaaatttttacaatgtttgcttgtaagagacttaccaaaccatgtttaaggtcgtgacacactcgtatgaatttaactgaaaacttatcaaaaaatttaaagttactctgggaactgtctaaaaaagatattaaatctagataccttggttcgtttatgggggtactctgggcttttatacatcctatggtatctatacttgtttattgggtcgtatttcaggttggttttaaaaatgtacctattggagatactccctttatactttggttattaacaggaatggtgccttggttattcttttctgaaagcttagcaactgcaaccaatagtattatagaaaacaattatttggtaaagaagattgttttccgagttggtttgctgccgatggtgaaaattttgtcagctctgtttgtacatgtattttttatcattgttcttttcattatgtttaaaatctacaatgttgaatttacgatttataacattcaaatcctttattatttattagccacgatttttctttccttgtccatttcttacataacagcgacattagttgtttttgtaaaggatgttggtcaagttgttgcggtatttattcagctattcttttggcttacgccgatcttttggaatttaaatattgttgaagataagtatcagtttttctttaaactaaatcctgttttttatatcgtcgaaggatatcgggatacttttattgatcacaaatggttctgggagcatccatcaatgacgatctacttttgggctattgtgattatcgcaggtactataggaatcaaaattttcaagaaaatgaaatctcattttgcagatgtattgtgaggagaaaatgatgaatcaaacagaatcagttgctgtggaagttaataatgtcactaaaatatataaaatatatgataatcccaatgagcgattaaaagaggccgttcatccctttaaaaaaaagtatcattctgaatttaaggccatcagtgacctgtccttttccataaataaaggacaagcgattggtattattggtaaaaatggttctggaaaatcgactcttttaaagatgatcacaggcgtgattactcccaccaacggaagcattaaagtgaatgggaaagttgctgctcttttggaattgggcgcgggttttaatccggatttaacaggaatggaaaacatatatttgaatggaacccttatggggtatagcaaaatagagatggatggtaaacttgaatctattgtatcctttgcggatatcggggacttcattaatcaaccagtcaaaatgtactccagtggtatgtttgcccgtttagcctttgcagtagctatcaatgttgatccagatattttgattgtagatgaggccttgtctgttggagatatttattttcaggcaaaatgtattaccaaaatgaaggagctctccaaaaaaagtacggttttatttgtctcacattccatggataccattaaaagtttttgtgatacagcgttgctgattgataaaggacacatggtcgaaattggtccagtgaaacgtgtagcacaaatttatgaaaacattgttaaccaggaaattgcagatatgaaacgtgttcaatccttggatgtatttgttaattctgaaacagataaaaagagttcgctgttgctgttagaagaggaccctgcttttgcaaaacgtgccaatgagtttcgttctggaacgggagatgcgcgttttataagagcggacttgttagtcaatggagaagttgtgaaccaggtcccttttggcgaaatggttactttgcgtttattggcacaatattataaagatatagattctgagggaactattggctacatggttagaaaccatactggtgtcgatgtgtttggcatgaatatctataataaagcaaaattagttccgaaaatgcaagcgggaggcattctggaggttaactttaatttccgtaatctgttatctgaaagtggtaaatacaccatttctattggtttgaagcctaagccttttgagcctctttatctggatagcgtaagtatagcagctgtttttgaggttcctaagcccgagaataattacgtaccaggattaatatttgtagataacacaatagatttgcaagtcattaattaaggctggtgataaaatgtgtgggattttgttttctaatgtagccataaataaagaagtatttcttaattctttaaatataatgaaacaccgggggcctacggccccactttgtgtatatcagagtgaaaactttatgctggggcataacagattaagtatcttagatttagatcgaagaagtgatcagccctttttctctgatgacggaagatatgtgattatatttaacggagagatctataattataaagaattagcctccagctattcaattcaaatgagaacaaactcagatactgaacttttattgaagctttatattcaatatggtccccaaatgttgaattggcttaatggaatgttcagttttattgttttagacgtccagcagaaatcattttttgtagcacgagatcgtatgggagtaaagccgctttattacaacagatatggggaagagttcattttcagttctgaaattgctccattgctcccattagtccaccacatttctatagatcaggaagccgtaagacaatataaaaagatgagatgcttttttaatgatcgtactatctataatgaaataaaagagtttccaccaggatattattacgagaatggcgaatttattaaatattgggaaattgattactctgaaaaagaacctccttccgatgaggaacttgaatttttaattcgctctgcagtagagtaccgtaagattgcagatgttgaaattggaagttacctaagcgggggattggacagcacgattattaccgcacttgccaaagtagagcatacttggactgttggttttgaagattataatgagtttcagtggtctgaaatcgcagcaacaagatacaataccattcatcatccaatattgtttgaacctgatcactttttatcattagctcgagagcttataactgtaaaaaaagagcctctgtctgtgcccaatgaagtgttactgtatcatatgactcagcaagcatctgctaaaaatacagtcatattaagtggagaaggcgctgatgagcttttctttgggtatgaccgcattttcagatgggctagtagcactacagacttcgatatccgagcctttagtgaactctacacctacggatctgaagatgatatagagattgtagaagacgctttggcacctttcatgaagttaaagtcgcctcaaaaaatcgtagctgcattctttcagcaagcccatttgagagggttacttaaaagactggatagtgcctcaatgttaaattccgtggaagcaagatctcctttcttggactatagattaattgaaaggcttgcaggtgtaaattctctgtacaaaatgaaggatggggttgttaaggctcctctcaagagaatttttaaagatattgtccctgcagagattgtaaacagaaaaaaggtgggttttcctgttcaacttgaaaaagtcctatcttctgagaaaattgaagggaagacgacattcgacaaatggtttaacttcaatttaactacgttaggagaaatcttatgattatcggctatacttccggggtcttcgatttatttcatattgggcatttgaatttgttgagaaatgctaaatcactctgtgataaactcattgttggtgtgacgacagatgagttagtttcctataagtacaaaaaagcagtaattccttttgaggaaagaattgagattgtcagaaacatcagctttgttgatactgtaattcctcaggactccatggataaatttgaggtttggcaaaaattaaaatatgacgtaatgttcgttggtgatgattggtttcaaaatgaacgttgggaccagtatgagttgcagtttaaggaagttggagtgaaaattatatattttccctatacgaagagtacatcatcgactttactgaatgagacattactgaaattaagaaaataagtataagatttttgcctgaaaggaagaggttttgcagtgaatatgaacagatctatagcttttgtcattcacaatctagttttatatgaaacgattaagcctttaattgaggagtgtgaaagaaagcagatcgtttgtgatatttatgtccctcacattgaagaagaagattggggagacatgtccttagatacctatcattatttgaagaacaatggtataaaagtgactctaacaagctctgtacctgacaaggcatataaaatagccttctatccttatctcccttattatttggaagttaagtccgattataagtttagatatcagtatggaatggctaagccaaactggaatttagacacatggagtcgaaatttcgattttatcttttgtaatgggctgtatgattcctcggttctggcagcgtacactcagactgaaatcgtaggaatgattaaatacgccaaatttcaaaggaagaagcgcgaaacggataaatataatttgctttatttgcctacgtatgggaatgagtcgtctattgagcttgttatgaaccatattgaagaaatgtcagatacctttaatatgaaggtgaaattgcatcatggcacttcttttttggagcatgatcgggttagtctagttaagtctcatattcctgatgtgcttgatcataaggcttctcttgttcatttaatagaggaagctgatgtgatattgtctgacggctctggggctatatttgatgcgctgtttacggacactccaattgtaatattccaacatccccaaacagaatctttcgaggggattttacctttggaagaacaaatagttcagcaaaatattgttccttttgtgagcgataacggcaatattaaacaaaccttacttaatgcaatcttagatgaacaactaatacaacaaagaaggaaatttactttagagatgtttccggttaaaggaagagagacgatagataagtgtatggatgtaattagcagatttctaaaagatgacgtggaccatgcttatagagcagggcatacacgcctgaataatgaatttaatgaattacaagctcataatcatgctcaaagccaagaaatagagcagcaaaaacaacacattgttgagcatatggatcagattaacacattgattcaaacgcgagatcatcaggaaaatgtaataagtagcatgtcagcagattttaaatccctgtctgaaaagaaagacgaattagaacagaaatatgttcaacttacacaggattataataacgaaaaaaacaacttggatatattaaatcatcaatatagacaactatttggtcaatataatgaactgaacacccagttcagtgagttggaagaatataatggaagactgtctacagagattcacaatatttataactctaaaaggtggaaaatggcgaataaacttaaacatatcttacacaagtccaaaatgatatatgttcttaagggatatagagtatggaaaagttatggcaccactatcttactgaaaaagataaaatctaaagtgtcgaataagcttaaaagaacgaacgcgggggatcagccgattgatctacgtaaagatgaagggaattacaatcagttattaacctggtatgagtataaattttacaattataaagtatctaaagataactcattttctctggagcttgataagttcgagattaaatttgagaaggatcttatatcggtcgtccttcctgtatataacggtgaggattatgtatcaaaagctattgatagtattctgcagcaatcttacaagtattttgaactcattattattaacgatggttcaaaagactcaacggcagaaattattgatgagtacgctaaagcagatcatcgtatcagagtagttcatcaggaaaatcgtaaaataccaagaacattatccagaggttttaaactagccaagggtgaatatcatacgtggacaagtgcagataatatcctccctgaaaatttcctggagaagatggtagctgatcttaaaagagatgaaaatattggtatggtatatgcgaacatgaggttaatcgactctgctggtcaagtgatttccaaccatggctggtatgaagaaccacagttcagtggcaatgttatgctgcctaagtctgcattggagttaaacgtatatcctaacaatacgattggtgcagcttttatgtatagggccaaggtaacccagttattgggtgactattctagttataagcatacccttgaggattatgattactggatgagagtgaactctctatttgagctcaaacatgtgacgttcgatgagcctatatatgattatcgctggcacgataagtcactgaccgctttagatcaagaactaggcatcacctctaacagatataaactcatggtacttgatgattttagaagagatttttatctgaccccattagtatggatcattgagggagatgctactgaagttggtgagtttaagaagtatgttcttgctaaaggacatactgtggttggaagaaatgaagtgaatacgattattggtcttaatttggcaacgcctatttgctatttatatataaaaacaggcgaagtccatgattttgaatttattgattctaatgctttatcgtctatgtatgcactgcttatagataaatcagagcatacaacagatacatttgtagctgactattcgtgggatctgaaaataaaggataaaatgaatgatgaaacagatagcaattatgacttttttgcacaggatacggaagttctgttctctcttataaatacgaaggttaagaacgatcacttgtaccgtattgaggcggtcattgaaagtgaacccgtttataataagagattatcagttattatttgtacttaccagcggagtgaaaagctatcgaatgcgattaaatctgtcatagaacagtcgttggataaagcagactatgaaattatcgttgtaaataatgattatttgaatgatgagattcatcatttggttcgtgagttcagagcaacctgtaatattgacgaatccttcctccgatatatggaggctccattaaaaggtctttcctttgcgcgtaatgttggtttatttggggcagaaggagaggtcatactctatattgatgatgacgctattgcaaactctaacttgcttgaggaaaccatcagagggttctcagatcgtcccgatatcggggtcatgggtgggaatatcatactcaatttacacgaggaacggcctgaagtggttaaaccaggtactgaagcatactggagtcagcttatcgtggaaggcgaagaaattatcgattctaattttcagtgggagttcccttatggagccaattttgcagttagacatgctgcgctaatgcgaattgggggctttagaagcgcctatgggcgtaaaggaaacaattacgctggaggagaagaaattgttgtatcttttgctatgagagaaatcggctataaggttggtcttaatcctaaaatgaaagtcattcatgatgtggacacctcccgatatactgttgagcatgttagaaagacaatgcgaaacagtattttaactaattaccaattgcaaaaggatctgtatgcgccgatggaatcggatattgaggcagataagaatcacctcgaaattgttaaagctgaattagatcatttgcagaagattccgactaaaaatcgagacgttgaaattgatattctgtataaacaatacacagttgaagcgtatgaagaattaatacaaatgaaggaaaacgatataaattcccgaaaacagttggcaagagcatatagataattaataaaactttaaaggcgcctcttttataaaaaaataaggggcgcctttattagtatggagcggttaaatgaaaattttatatttctctccaatctattggaatgatttaaaacaacgtccgcaacatatggccgaagagtttgctaaaatgccgggggttcacatcacctttgtagaaccatccattagcatacttaatagtattgtaaggcagaactcagattataagagaagaaatcaaaccataaatgatagtcttcaaatattcaggccttcgggcagtctgagattgcctagaagctttgaaagcctagacatattccatatgaatcaatggtttgaaaaaaggcagttggaagatttagttaccagtgcagatatcatttggttaggtagtccagtcttttatcctcttattaaatcaaataataataagaagattgtgtttgatcgaatggacgactatgtatttctaactaacaatgcattaatgaagaaattactcgaaaagtgggaaattgaattacttgccaaggcggatctggttatttctacaagtaatcatttgcataagcattctcaaacattatgtagacaatcttatttagtgaaaaatgctgtggatacagctatactaaacataaatgtagatagcttggttgctgatgaattgagacgtttaaagcaagagggctactatatttttggctatgtgggagcgattgaccactggtttgatgtagaagcggttaaggctattactgattttgatgagaaatttgttgtatgtttggttgggagaaataacctgaattataattttgaacagcataataggattaaatattatgagactgttcctaaatcagaaattggtgcgattattaatgcttttgatatttccttatacccctttttgaggaattcggatagaattgatacgatcaatccagtaaaagtttatgagtatttgagttttaataaagtgatattagcggtggatagcgaagaaacaaggctcttaaatcaggaagggatttatctatatcatagtttagaggaaataagaaaatatctaatggatatagataccctacaacgccctttttatgatcaagagcaactggaaaacttcgtagtccataataattgggaagctcgtgcaaaaaccattatggagctgcttataaaagagcttcaataggaggaacttagatatgaaagggattatattagctggagggactggatctagattatacccccttactaaagttacaaacaaacatttgttgccgattggtaaatatccgatgatatattactctattgataaactcaaaaaggcgaatataaatgatattttaatcgttactggaaaagaacatatgggagatgtggtcaatctcttaggaagtggtgtcgaccttggagttactctgacttacaaagtgcaagatgaagccggggggattgcacaggctttgcttttagctgagcattttgttggcaatgacaagatggttgttattttgggggacaacgtttttaaagatgatatctcatcgtttgttgaaaaattcaaacttcaagaatcaggagcgaaattattacttcataaagtgcctgatgctaatcgctatggagtaccagaactacaaggcgataacattgtaaatattgaagaaaagccagaggttcctaagagtgattatgcagttacgggcatttatatgttcaatcactctgtattcaatatcatcaagaccttgactccttcagcaagaggagaatatgaaataacagatgttaataacgcttatattcaacgaaaccaacttacatttgatattttagagaactggtggactgatgcgggaacacatagttctttgatgcttgctaacaaattagtaagtgaaatgggttatgagctgttttcttagtattatcatagaactaaagataccttatgctaaataattaagaaagcgagtctatttaaatgcaaattgtaaaagctcttccaactagaataaagtgggtggatgtactaaagggattggcgattatttttttagtattctcacatttggtgccccatggttttaaaggtaatgaaatgatggataagagctttattataggctatttttattccttccatatgcctcttttcttttttgcttctgggtttacttctaattttcagaagtataagtttagtagttttttgtggtctaaaatcaaaacaatccttttaccatatacgactctgtatatatgctcactactgtattttggttggatgcattggatggggattgtcggaacgctcgatccaatggttgttattgaaacttttttatatgcagatggagatcacttaggtattctaaacatgtctctttggttcctaccttgtctattcttagcccagatcatttcgtacttggtcttgaaaatttcgtccaaaagaagttatatgtatatattttggatattgctaaccatacttggtgcattcttaagcaagcttgacacacatgcacttccttggtcatttggcacgtcaattaatgcagcctctttaattatttgtggttatatattcaaattgaatgaacaatattttattgaaaaaattagaattaacaaaccatatgttgcttacgcagcgggctttctgggtcttttattatttttaatgaatgataaaccaggcatgtcaggaaattactatggacataattatgtattattttatctgtcggtattggctagtttaatattttatatatacttatccaaaaaaattgagtcatctagtttactgtcctattttggtaaaaactctttaattatatttggtctgcatggattaatacttagcttctgggagaatataaatttttacgagaagttttctgttacaacaaatatgtatttagatggaatttcatttgttgttatttctaccttgcttgtcttcttaagttgtattctttttattgaactatttaatagattcttacctttcctgattggcaaaaaatttagttctggtagttctaataaaacagcaacaattcccagtaagattgtttaacgattaacttaaaaagccctcgaataaaaatcgagggcttttttgtatgcatcgacatctgtattgaattagaaaagatctggattatcagggtatatttttttgaattgtgaacgtattagttcaactttttccttcgtgatggatgatgtcttttttaagactatggctttaacgttattatccagagcatagctctttaaaggtttataattatttttaagagatccgttcataacctcttctgcgagtatacctacaactttttgaccactttcacctaaatggtattgtgtaggtaatgcgatcacgacataatcggactcaaaaaacgacactggaaaaccatctcttaaatcaacgtgatgggtcagattcataaatggaagagcgttgctattgtcaggcatttcaatctgtctgagtatgtcatcattaagaattccagagctagacagaacatataccttatgctgctctgatgagatttccttaagataagtcgttaattgttttaaaacaggtatatctgttcttactctaggtgtttgtttaaagtcactgaataaagaagaaaaataggtaacaggacgtgcatttacattagtgaatgttaccaagaaattacaagcgactaaataaactagaataactaagaaaacattttttgcatattttatcttggacaaatagtttagaataagaataacgccacaaataaataaaattaatacgttcacggtaagaagataataatgctgagaagctaagctttgaattcttgtaaaaagaaagtacgtaataaacaagtttataactagaaagattgatatatacctagttttaccaataaataacaagcctatgcaaccaacaagagctatcagaaaaatgaaggcaccataatgataaaataaattgtgtaagttacttaagacgtcaccaaaataataagctgagtaggcgtttttaaagttattggtaagggctctttgaataaattcattgaagaatataataagaaataatgcacttgaagatcctataatgaaaaaatttaaaataacctgcaagagctgcttgaagcgaaactctttttctagaatccatttgaacaaaaaagcgatactgatcgagccaaaaagagatacgatccaaaacccataccatcttcttgtaaatgttagtaatactaggcaagcagctaagagtaaaactgcttttaaatttaagcgttcaaagtcattattaaataagataacaagcgacaagcaaataaaaataagtcctatagaatccagatatccacctaacataggagctatcataattggaaaggtaaatgtaagtacaaagatcatgaaaatgttcaattttgtgtttaactggatttgatcagcaatcttgatacataataagaaaagtatcaaacaagaaggatacaagaagcaggtatagattgccaagacatagctcatgtagcttgtacctaagaactttaatggtaaagagagaaagattgttgggaaaacggaataatcatctcttaaaatgcttgcatagatttgtttagaagctgctataaaatctgtacttaaaaggttattaaattgtatggatgtattccaataggctgaaaagtcccaataataaatgaaatgttccctttgaaggaaggcgtaaatgaatattattccaactagataaccgccaaaagctaggtattgcaccattatttctttcttggcatatgttaagataccactaatgtgtaaaatgtatgtagcacctatgacaaacgactgtgcaatatttagaccgaataatatggaaatatagtaagaatcgactttaaacagtattagaatcgggataagtagccacgtcaaaaccaaataggaccaaacaaaatttttattaactctcgataaattcaaaagcatattccctcccaatatagtgtgcttattaattttatagtaatcataaatgaaagtatatactcaagatgttggaggtttcgtgaatgataataaaggaagtactttcaggtgcaaaaatcattgaacccgtggttcatggtgatcaccgtggtttttttatggaaagttacaatgaacagatcatgaaagaaaacggaatagaccatgcttttattcaagataaccaatccttgtctgcagaagctggtgtgattcgtggtttgcattatcagcttaatcctaaagcacagaccaaactcattcgtgtgctttctggagctatctacgatgtgattttggatattcgtaaaagttctctaacattcggtcaatgggtcggggtaatcttaagtgaacataatagacgtcagctactggtgcccaagggttttgctcatgggttctgtacgcttgttcctaacactcaagtgctgtataaggtagacgagtattattcacctgaaaatgatcgtggaattctgtggaatgatccagcactagggattgattggccaacttctcatgctattctttcagagaaggatcagaagcatccggcactggccgacgctgacattaattttgattagaggaataataagatttaggaggtcagtatgaaacttcttgtcaccggcggggccggatttataggcagtaactttgtattgtatatgttaaaacagcatccagattatgaaattgtaaatatagatgctcttacctatgcaggtaacctggaaaatttgaaatccattgaaaataaccccaagcatagcttcatcaaagcagatattaccgacgcacaagcgattgaccaactgatgcagcaggggattgatgtggtggttaattttgcagcggagtcacatgtggatcggagtattctggaaccggaagtgtttgtgaaaacaaacgtattgggtacgcaagtgctactggacgcagccaagaaatataacgtgaccaagtttgtacaggtatcaacagatgaggtgtatggatctttgggagaaacaggcttgtttacggaggaaactccgttgcagcctaatagtccttattctgcatccaaagcaggcggcgatctgttagtgcgtgcatatcatgaaaccttcggtttaccagtgaatatcacgcggtgttctaacaactatggtccataccagtttcctgaaaaattgatcccgttaatgatctcacgtgcattgagcgaccaacagctacctgtatacggggatggcttgaacattcgcgactggttgtatgtagaggatcattgcagtgcaattgatctggtcattcatcagggtaaactgggtgaagtatacaatatcgggggaaataacgagcggacaaatgtgcatatcgtcaaaacagtgttggaggagctgggcaagccagaatctctgatttcgtatgtgcaggatcgtccaggtcatgaccgccgttatggcattgatcctacgaagaccatgaatgagctgggctggaagccaaagcactcttttgaaacaggcattaaagaaacgattcgttggtacttggacaacgaagaatggtggactcgcattcaatctggtgaataccaacaatactatgcaaagcagtacggttcccgcttgggggatgcgtaaaaatgaaggtattggttactggagcttccggtcaacttggtaaagatgtagtaaaggtttttcaggagcaaggacatgatgtcctgggttacgatcgcgaacaattagatatcacggatttgcagcagacggtgaagattgtaggacaatatcaacctaatgccgtaatccactgtgcagcgtatacggctgtggatgcagcagagactgatgtagacggggcttatcaagtcaacgcggcaggtacacgtaatatgacaatggctgcggaaaaggttggagccaagctggtttatatcagcacagattatgtgtttgatggaacggcaaaacagccatatcatgagtacgataataccaatccgcagagtatctacggaaagtccaaacgggcgggagaggtattgacccaaacactttcctctaggtattttattgttcgtacatcttgggtatatggattgcatgggaacaattttgtcaaaacgatgctgaagcttggacaggagaagccgctcctccaggtagtaaatgatcagaagggttcacctacctatacggtggatctggcacgctttttggcggaattgattcaaacggagaagtacggcatataccatgcatccaatagcggctcctgtacctggtatgaatttacgcaagctattttacaggatgcggcggaaatattagatgccaagatcacagcgaaattggaaccatgcagcacagagcaattccccagaccagcagcgcggccacgtaactctgttatggagcatatcgcgatccgaaccaatggattgaatgatttgcgcgactggcgtgagggattgcgtgattttttgcaggagtgtcttagtacatccgagtaaataaaaccttattataaatatcaacaatctcccatcagttcatgagtgggagattttattatattaaggcctatgttgattaaggacaatgagcattataatgtataagcagatgaaacatattgtccctctattgcacattttaaaagaaggaggtcattactctgaacagacctaacgtacaaattttattatctacatataatggagcagcttacttagatgagcaaatagaaagtctcatcaatcaaaaagacgtagagattcagattctaattcgtgatgatggctcgacagatgatacggttgccaagttgagcgcgctgaagcaacgttatcctcaacagatttttttatgcctcgagagcaatgtaggggttattaaaagcttttttgatctgattcaaagatcgtctgagacattcgactattacgctttttgtgatcaggatgatgtgtggatgccgaataaacttgctcaggctgtggctcatctcagggttcaagatgggagccgaccgctgatgtactgttctgctactcaaatggtctctcaaacattggaaccactcaaagtatggccagctgacatcccccgacctatatccttctataatgctctcattgagaatgtatgtgtaggttgtaccatggtgatcaataaagaaacactcaagctcgtgaaaaagagaattccaacttctttggataatattatcatgcatgactggtggatttatttatgcacttcctcttttggtgaggttgtttttgaccccgatccgtacatttggtatcggcagcatcaaaacaatgtgctgggaggttctacggatgggtgggttagcaagtggaggaaaagactaagtagatttgcaaaaggaaaaaatcgctatattttaagcaaacaagcccagcaatttattcagctttatggacaagacatgtctcctcaaatgtataaagatatggatcaattcctggacagctaccaaaagggtgtgttttctcgtatgaaatatatttggcagtctccattttacaggcagtcacggttggacaactggatttataagttggtttttgtattgaggaagttatagaggtatggaaagaaaaaatattgaaacttttttccatatataagcgtcaaatagtcaaaggtgcaaatgaatactagataaaataccatcgaatgcgtgttcctttatggaaaaatatagtataattgaaacgtgcaaccgatagagctgccaagggcggtcggctaactctcccgaggaggggggtgaagcctgtgacagtgtttgaggcgctcagtttaatgctgacgttcggggcgttaatcgtcacactgttagagtttaacaaacgaaaatagaccgcccccgcaaggaagggtctattttcggcctgattgttccaaaaccgtccgctcttggagcgttggttgcgcaggggctggctggcaccagccctttttccatgtatatcttaccacgatgaattttagacctcaaccgaggattttacaaaaatctaataaacgacttccaatgaacaatatatagatcgaaatggtttcgtttgtctatatttgcactttggagcgactggaatcgaattttgtgaaattctactaactatgtaaggctacaagttatgtgcttttttgcgccccgtggtctgagcggtatgctataataggcgatagtagaatagattactgaatttgtcaggagcgttttaaatatggatgtaagcatactggtcgtcaactataatacgtgtcgattgacgctggattgtttgcaatcggtgtatgcgtcaaagtcgcagtaccgatatgaagtgattgtgattgataatcactctagtgacggatctgttgaggctattcgtgctgcatacccggagattacgttgatagccaataagaataatacaggttttgccaaggcgaacaaccaggggatggaagtagccagcgggcgttatgtattgttattgaactccgatacgttggtgcaaccggacacgctggatacaatgattcagtttatggatacgcatccggagatgggagcatcgggctgtaaggtcatcttgccagatggctcgctagataaggcttgtaagcgtggctttccaacgccgtcagcttctttttactacgctttcggctggtcgaagcgttacccggataacccgaagtacaatcaatatcagcttgggcatctaagcccggatgatgagtatccagtagatgtactggtaggtgcttttatgctggtgcgccgggagacgattgaccaggtcggtggcttggatgaaaccttttttatgtatggtgaggatattgactggtgttaccggattaagcaagccgggtggggcatttactactacccgcgcacatatattattcatatcaaagggggcagcgctcgccgtcgtcctttgaaaattatttatgagtttcatagagctatgtgggtatttcatcgtaagcattataaacagcaatacagttggatcaccaatatggctgtatatgcaggaattaccgtgaaatttggaatggcctttctaaaaaatatgttgtccacaccggtcaagccggacggcggggaacaatctcatactgaggtgaaagcatgatacgcagaaatcagcgttttttaacccaattatatattgtggcggatttcgcggtcattcaattgtcctttctgatcgcttggtttttcaaatttgaaagtgaatggatcacctatacagaaccgcttcctattcaagtatatggaggctggagcttaatctacggcctgattgccgtagtgctagggatgttattctcgctctattcgcccaaacgcaaaaaacgatttgcagatgacgtattccgcgtcacccaaattcatattgttggcctgttcgtgctgttgagtgtgatgttcttcgtgaagcaaatcgacatttcgcggtcctatctggcgatctatatggttgggaatgtgctgcttattttgttttaccggttctttttgaagcaagttcttaaagctctccgtcaaaaagggtacaacaagcagttcatgcttattctcggggcgggtactctaggccaacgattttatcataatcttggacagtatcctgatctaggatacgaggtcgtgggttttctggatgataagcggcattggagtgaagaggaagcggcgcattttcgcccgattcttggaggtttagatcaattggaggctacgctgtcgcgtctgatgattgacgaggttattctggcgcttccgctggatgcccatgataagtatcccaagattatcaacatgtgtgaaaaggctggagtgcgcacgcttataatccctgacttttttgattatttgccggctcgtccgtactttgataactttgcaggtatgccgatgattaatgtacgggatattccactggatgtggcggggaatcgattgtttaagcgtctattcgatattttattctctttattcgcgattcttctgacgtctccgatcatgctggcagtggcgattggtgtaatgatcacatccagagggcccatcatttttaagcaagagcgggtgggcttgaatcgtcgcaccttccgaatgtacaaatttcgttcgatgaaggtgctgcctcctggaactgaagatacgggctggacgactgctaatgacccaagacgcacacgttttggtacttttattcgtaaaacgagtctcgacgagctgcctcaatttttcaacgttctgctgggtgatatgagtgtcgttggtccacgcccagaacgcccctattatgtggatcagttccgtgaggaaattccaaaatacatggtgaagcatcatgttcgtcctggaatcacaggctgggcacagagcaacgggttgcgtggagatacatctattgaggaacggattaagcatgacatcttctatattgagaactggtcactcttattcgatattaaaattattttccgcacgattcgcaacggtttcaagaacgcgtattaatacagaagcaccctacggtttagccggagggtgcttttgcgtctggcagttgttttgagcatgcgtatgtggggtattgacctgtacgaaaaggatgtgacctcctatgaaacgactgattgttgcggttattcttttaatgttaatcggcacatttttactggcatacaaaggaaaatctacagaagaatatactggctttaccacgcaccgtgtgatttcgcatgccatgggagccgttgatggtttggcctatactaatgcgcgtgaagcgtttgtggaaaattataaaaaaggcagccgcgtattcgaggtcgacctgatgtttacatcggatggacaattggtggcgcgccatgaatggacagaatcttttacagagcaaatgcaacaggaacatgcagttgctacggaacagggcggaaaaccttggagctatcatcaatttaagaacacccccatacacggttcctacaccccggtagattggaaggatgtattggatttattggaaacatacccggatgcttatattgtgaccgatacgaaagaacaggaccctgtccaaatcaaacagttgtttgcgcaactgacccgtcaggcacaggagaaaaaccccgagcttttgtcccgtattgttcctcaaatttataatgaagaaatgttgcgaacgttacgaagtatttatccttacccatccattatttatacgctctatgccacagaagataagaacgaccagatcattcgatttgtacaacaaaatgatataacggcagtaactttaccagagaatcgggtgagtggtgctttagtggaaagtttgcgtcaggcaggggcagtgtgctacgtaaataccattaatgagttgaaggatgccgctgagtatgaacagatgggtgtgagaggttactatacagatgttttaacggaaaaagaacttagtgaacgcagttggttgtatgcgttacgaccatgagttgtctgaacggggtgttcccatttgatacgaacattgacaccttttaagcactatcatagacttagcatagaacgcttttggatattggaattcggctcgcctggatcatgacaaaagcaatgaatgctggaggaatgtgtgttggcagattcaattcaatcatggaggcatgtgtttaagcttgatcctgacaaggaactggatgatggtgcgcttgacgctgtgtgtatgtctggtacggatgcgattatggtaggaggttcctcaggtattacctatgaaaatacggtggatttgctgtcgagggttcggcgttatgaggtgccgtgcgtgcttgaggtgtccgatctggaggctgtagtgccagggtttgatctatatatgattcctatggtactgaatactactgacagtaattggattctagggcagcaccaacgtgcgattgaacagtttggttatatgatcccgtggtatttgcttgtggcggaaggatatattgttttgaacggtgattctacggtcgctaagcttaccggagcagatacttcgctgggtgctacatcagccgcctcatatgcacagattgctgacaagctcatgcatctgccgattgtatatgtggaatatagcggtgcttttggggatatggagctggtgcagaaaatacatcgcagtacggagcgctctcgtgtcctatacgggggaggtatcgtggataaatctaccgcgttacaagcggctgccgtttgtgacaccattgtagtaggaaacatcatttatcgtgacttggcgaaagcgctggagacggtagctgtgaaattggaagtatagaacgtgaatttatggaagctcagggaaaggagcatgcacgcatgcaatcaatagatatacacgaggcggtagctcgccttaatccgcctcagcgtcaggctgtggaggcggtagatggtccgctgctgattatggctggcgcaggcagtggtaaaacacgggtgctcacgcaccgaatagcctacctcatcgcgacccgcaagacggctccatggggcattttggcgattacctttacgaacaaggccgcgcgtgagatgcaggatcgcgtatccaagctgattggcccacagggaagagatgtatgggtatccaccttccactcgatgtgtgtacgtattttacgtcgggatatcgagcggattggatttacctcgaatttcagcattttggattctacggatcaattgtctgtcattcggagctgcatgaaggatctgaatatagacaccaaaaagtttgaacccaaagcggttcagtctatgatgagtacggctaaaaatgaactggtcactcccgaaatgtatgaacgcaagattggcgactattttgaggggattgtggcgaaggtatataccaagtaccaacaacgactcaaaaataacaactctcttgattttgatgatttgatcatggcaacgattcagctctttaaagaagtacctgaggtactggatttctatcagaaaaaatttcaatacattcatgttgatgaatatcaggatacgaaccgtgcgcagtacatgctgtgcaaaatgctggccgacaagcatcaccggatttgcgtagtaggtgacagtgaccaatccatctatcggtggcggggggcggatattagcaacattttgaattttgaagaggactacccggaggcacgcaccattttgctggagcagaactaccggtccacctcaaatattctcaatgctgccaacgaagttattggccaaaatacaggccgcaagccgaaaaaactatggactgacaaagaaggcggagccaagattaaagtttatcgtgctgactctgagcatgatgagggctactttatcgcctccgaaattcataagaatattaatgcgggcaaaacctatagccatcatgccattttgtaccgtacgaatgctcagtctcgggttgtcgaggaaattttgattaaatcggatattccttaccagatcgtgggcggtatcaagttctatgatcggaaggaaattaaggatttgctggcgtatcttcgcctgctctccaatcctgacgacgacatcagcttgatccgaatcattaatgtgccaaaacgaagcatcggagacacaaccgtcggcaaattgcaggcagctgcagcagaacgtggagtttcaattttccgtgtccttcaagttgtagacgatttgggctttgcaggacgtacgcgcaatgcgttggttgagttttacgatatgatcgaaggtttaagtcggatggtagactacctgtcggttactgagttaacagaaaaaatgctggaaaccacccaatatcgcttggagctgcaaaacgagaatacactcgagtcacgctcacgtttggagaatattgatgagttcctgtcggtaaccatggaatttgaaaaaggagcggaagacaagtcactcgtctccttcctgaccgaccttgctctgattgccgatattgattccatgaatgacgatgaagaagagcaaagcgatgcggttgtattgatgaccatgcatagcgccaaaggattggagtttcccatcgtatttattgtcggtatggaggagggagtattccctcatagtcgtgcctttctggataacgaagagctggaggaagagcgcagattggcgtatgtcgggattacccgtgcagaggagcaactgttccttacatgcgcacagatgcgcactctgtttggccgcaccacagctaacccgccttcccgctttctcgaagagattccggacgagttaaaagaggatacgatcatcaaacgtgaccgctaccgtcgctcaggcaatgtaggcggatcttatggtgggcgcggactgaataaaggtggtggcagcaactttggtggagaacgctcgtttgatacgatgagccgtagtggttcgtccgcttccgcgtcacctcgcgtaacagtaacgacatcttcatccgcgaaacccactccggctgcttcggcaggaggcccctccatttttgctgctggagacaaggtacagcatggtaaatgggggattggaactattgtagctgtaaaagggacgggcaatgatatggagcttcaaattgctttcccggctccagtaggggttaaacgactgttagctggctttgcaccgattacaaaagtagaataaatctcaaacatcattaaatctcgaacctcatgagtggcagcttggtttaggacctctgccctgatgaagttcccggagggatacgcctgcatgaacccaatgcacaggatggagcagcttgttgctgaactgaacacatataactatcattactacacactggatgaacccaaggtcagcgacaaagaatatgatgtgctttatgacgagctggtagcgcttgaacagacgagcggtcttgtgctgccggattcgccgacacagcgtgtgggcggggagttactcaaagggttcacaccgcatcgccaccttgccccattatggagccttgataaagctcagaatatggaacagctgcgtgcatggaacgcgcgtgtcgtgaagctggtcaatgattacaataccaagaacccagcgcaacctttgccatctccaggttatgcgatagaacttaaatttgatggtctaacgctgaacctgacatatactgatggacagctggtacaggcttctacccgcggtaatggtgtggtgggtgaggggatattggcgcaggtaaaaacgattaaatccgtgccacttacaattccttttcgaaatggaactattgaagttcagggagaagggataatgaatctctctgtactgtccaaatataatgagactgccacggaccctcttaaaaacgcacgcaacgccgcagctggcgctttgcgtaacttgaatcccaaagtgacagcagaacggcgattgaatgcatttttctacaatgtgggttatgcagaccggatccagtttaacagccaccaggaaatgatgactttcctgcgtgaaaatcattttaaggtaaacccttacctgacttactttgataattttgaagatgtaatggagcaactgattgagattgaagaatctcgtgccggattggattacctcattgatggggcagtattgaaaattacagatatgcgcacacgtgaggctctcgggtataccgataaattcccacgctgggcggtggcctataagttcgaagccgaggaaacaactacagtgcttaactcggttgagtggaatgtaggacgaacgggtaaaatcaccccacttgcaagggtagagccggtagaactggcgggagtcactgtacaaaattgtacactgaacaatgctggtgacatcgagcgcaaaaacctgaagtttgctttgggtgcacgtgtgtttatccgtcgctcaaacgatgtcattccggagatattaggaaaggtaacatctgagcacgacggagaggaaattgtcgtaccagatcattgtccagcctgcgggtttccgttgcagcagcgaggtgcccatttattttgcgacaataagctgggttgtaaaccacaaattgtagctcgtatttcccattttgcatcacgtgatgctatggatattgagacattcagtgacaaaacggccatacagctgcatgacgaactggaagtgcgcgagcctgcggatctgtatacactccaatatgatgatcttgtgaagctggagcggtttggtgagaaaaaggccagtaacctcttggcggcactagaaaagagtaaagagagagatttggcttctttcctttatgctctaggtataccaaataccggtaaagcaacaacgcgcatgttggctgaacactaccgtgatttgcacaagacgatgtccgctacggtggaagaactgatagaactaccggatgtgggcgggatcgtagccgaaagcattgttgctttctttgcagatccatttactcaggcgggaattgaaaagatgctgtctctaggggtgaaagctcaggcccctgaagctccacaggagaagaagacagacagctttttcagtggcaaaacggtcgtgcttacaggtaccttgcatcagcttacgcgtgacgaagctgcatccaagctggaggcgcttggagccaaagttgcggggtctgtatcgaaaaagacggatctagtcatagctggtgaaaaggctgggagtaagcttgctaaggcccaacagctcggaattgacaccatagaagatgaggatgaatttatcagactgctggaacaagaataatagttttcaatgagtgcagtcattccgctctggggcggggtggctgccttattatctgttgtatagtaggaaataaaatagatataaataaatgcttgctaaataactttaggcatgatatactattagacgttgctttgagagtatcatttcttgaagcgaggttgctgaaaagataatcgaaaaaaagatttgacaagaaagcaatcaacatgatatgatctaattcctggctcgttgaacgaacgagaacagacaagttctttgaaaactgaacaaatggatgatgaaacaaagatttcttcttttataaagaagaatcgctagcattaaaaatgagcttatcgctctttctataaaccaacttcggttggtctttaatggagagtttgatcctggctcaggacgaacgctggcggcgtgcctaatacatgcaagtcgagcggggtt

SEQ ID NO: 2606 - DNA, 87286 bp, Unknown
  Kingdom: Bacteria, Phylum: Firmicutes, Class: Bacilli, Order: Bacillales, Family: Paenibacillaceae, Genus: Paenibacillus
taaggggtcacttcacaacagagcttatctgtactggctgcttttttatatagcctacctattcggaatcttcttccactattgcatttttcgtaacggacgtattgtacaccgttttgagccagttttcactcgaccagttcagcttacctgcacccgctccatccttagcctgcaattgagcaaccagattggcagggtcttcggctgtatagctgtatggcaacgttgtgaacccattccaagaaaagtccttggtcttggcaggataaggggctaacgggctattcgcatcgtcactgcctcctctgaatacggtaccgttgttcgaaaagattacgtcttcggctttgattttacctgtgtaatccgctttgttaggatctttttgattattacgcactggagagaacacatcaatcaaataagacttttctagcaacaccgcgccgttttctgttgaaattgcaccattacccacgacatcaaaatggtatccttttgcggcaattgctttagccatatcagaagtaattctttttttggctctggccaatccggcatcgtccataacgatgttatatgcatgagcattaccaccacgcagacgaggcatgcgatcctgaatatccagatagtaattatgatgcagcgtcacctccaggtctgcattgtcggaagccatttccgtagcaccgattagatgagccttcttttgtcctgctgcaatatcaatgatatcttctttactcatgcctactgcactacttctcagatacgcgtacataggataggaagacttgtctgcttccatcgcgttgacttgttgggttacccagctgttggagctgcggtcatctcctttgaacaaagaccaggaaatcgtaactccgttactaccttttttcacatctaccaaaccatcataggctttgttaaatgtacagtggtcgatccataccttggaacttgtaccttcgatggtaacataatcccagtcattcttatcatagttccctttggttgcttcatcccactcccaaagctcatcaaattcgaggttacggaaaatcaaattagagcttcttttgatgacaaagccagcatgtttgattttcgcaccattggcagagaaaatcgtaaccccattcatattttcgatatagactttgctcacacctgtctttttcagaacaggatgcgtctgtacaggattgttggcactaaaaggcattactttggcagcactaggaatttcattccaaccgagatcaagatcgttcataatctcaatcactttgactttgctgcctttcttcagtgcttcgttgagatctacagcattgtatacctttttgtagttggcatctgtatccgcaatgttgccaccacctgtattaccatacgaaaagccagtcaaattatagttatttttggaggttatatcagggtccaccccaggagtcggttgttctgtacctggtgtcggattcacaggcggtgttcctggatctacctcagaagaagcaccggataccatcacattatcgaattgggcagctgctttggaggttaccaaaccaatggctccagcagtgaggctggtgtctgttgcggacagctccagttgatcattgacatacattttgatttccgaaccggatagttccagcttgactctgtaccatgtattcgtgtccagtttgtattttttatgggtagccaatgtcttcatagagcctttgactttttttcgaatctcaagaactccgtcttttttgttgtacaacgaagctgcatagaagttgttggaatctgtgtatctacctgcaacgtagactcgattggagccattaaaatcatttacgtatacatctgcttgcacgctatagttcgtccatgaggcattacctttaacggaatggctttcgctttgactagattgttggtatgtagatccattcccatccttgaccacagaccagttccccgatcctgcggtccagccttgagcttccccttgttcaaaatcatcacttatctgtaaattcccatccgcatgtgcatgacccagcaacggtaatgataaagacagtaccaacgtactgcttaacattacacttgcacatttttttaacaaactcgacttcatataacagtctccttctccattagattcatgaatactaaagcaaaggttgcaccgtttatcggacatgacatgcccaacggtatataacgtactgatgaagggaataatattccaacaccaatgagggccctaagcgctatactccaataattatagacacttaaataaatattaaaatatgtctaattacttatcttttgtcttaatttctctattaattttgcatcctttttcgtgaacacaccaaatgatgtttcataaaatcacaaaaaacgatatttttttatttttgaataagacatacggttgtcatattgggaatggtacatataaaggggtgagtatcatccatatcatgtaaaggagcgatgagatgtccagttacgaatacgcctccaaaccagagttaaaggaagccattcatgtctcctacttacgatttgacggtgagttccaggagatcgacgaaagccaaaaggatatccgtatccctgaagtagataaaacacccgcagaaatgatcgcctaccagctcggatggcttcatcttgtcatggcatgggacaaggacgaacgggaagggaaaaccgtcatcatgcccgcccccaattataagtggaatagactaggcgaactatatcaatcattttacaagacctattcccaccaatctttacgtgaattacgcgatatgttcaagttgactgagcaaaagtggctggattggatcgacacacttagtcatgaagagctcttcactcagggcgttcacgactggactgggactaatccgaactggcccatggcaagatggattcatatcaactcggtggcaccgtttaaaacattcagagccaagatacggaaatggaagaaatacaaagtccaacagtgatgaaaaaaagtgtgcattgtgctacaatacttgagttgtatcgggatacatttagggaagggtaagtgaaacgccatgcttattattggtattgccggcggtacaggttccggtaaatcgacggtagcacgcgccgtcgttgaacgtctgggatctaataaagtgactttcatatctcaggataactattataaagaccattcacatctgagctatgatgaacgtgctttggtcaattatgatcatccgtttgcctttgacaacgaattgcttattgagcatctccactgtctgaaaaaaggacaagcgacacaagcgccagtgtatgactttacagttcatgcccgctccacggacgagacggtagagcttctgccaaatcatatcgttatgttggaaggtctgcacgtactgtcagacgaaaaactccgcagcctgcttgacatcaaagtatttgtggatactgaccctgatgtgcgcattctccgtcgggttcttcgcgatattgaggaacgcggccgcaccatccattcgatccacgatcactatttgactacggttaagccgatgcatgaggcatttattgagccttccaagaaatacgctgacctgatccttcctgagggaggacacaatgaggttggtattcaactgctgtctattttgactgaaaaatatttggcgggagatcgaacatggggcactgtataaggtaatcccggttgtttaggctgtcgagattttctcggctgccttttttgttgttttatatgccatttggactaaattttttttggaatccccgtgtggtttatgttagcatgtaaagattaaatgctttagatttaagttaagttggaagcgttgtcaaatatgtgcctcagatgatatgacgtccacgtgatggaggtcttttttgaattaggatttttgcaaaatcctcgaataggtataattacggagagtgctaccatgaatgagctatgcaacattttgattgtggatgatgagatattggtacggcaagggattaaacaccacttgtcgtgggaacagtatggatttcgaattgtaggtgaagcttctaacggtaaagaagcattggagctaattgaaaccttgcgccctcatatagtcattacagatatcgtaatgccgatcatggatggcgaggagctgacgcgcatagtcagacagaactatccagatatcgaagtcattgtacttagcagttacggcgagtttaattacgtgcgatccacctttcagcaaggggttgctgactatattttaaagcccaagctagacacggatgagttgctccaggtgctccagagaaccgctcgcaaaattccatccattcaatatcaggcagatgcagggaatagtcaaattacgatagatcatgtgatcgaaaagctgatctccgggtatagcatggactatgacgccgagctgctgaagcaagcatttccttatgcccgttttgcgctcataggtatagaacagctggaacagcaggataaagggcgctccatctctgcctcggacctattttccaagcttacggatcgagtatcctctgcctgtgagtacatcgtactgcgacaactgccatctgatgtctatgcggctgtgtttttagccaatcttgatccacgggaagtagacgcctggatggctgcggttagggaagttgctcaggagacgaagcagttcgatccacagacaggctgggcagttagccatttatttgatgacttcaatcagattagtgacgtctatcaggatgatctgccaaaactgctgagttaccgcttttatttcccaggaacagcgctgctaatagaagacgaactcccttcgcctgtacaggtgaacagctcgttcaacttaaaacaatttacagaagagatgaagcgtgagcattttgatacagcttttcaggatttgagatcctatgtagccgccatgtccggtaactatacctctaccgcttttgaattcaaatcgcttctcggaaatatcgtgttcaacattacgattttgctcgggaatcaggggtatgatatgaaggagctggatgcggcgaaatattcctatttcaaaacaattaatgatgcccctcatgtacatgaagccgtgcgccttctggagacttttctggaggaagcgaacagacagatcatggctaaaacacagcaaggaagtagcgcaagcatgaaaaaactgctggagtatattgaggagcatcatgctgaaacactcaatttgacgacacttgggcaatattttcactttaacccttcctacttgtccagttattttacggcacaccatacagaaggttttagcgagtatctcaacaaaattcgggttgaaaaagccgcggagttactacggtcggggacgatgtccatttcggatattagcagcacggtaggctattcggaccccagctattttaccaaagtgttcaaaaaagtgaagggttactcgcccagtcagtaccgccgggagcatctctattagggagtaagccacatctgccagtagaaaagagattgaatatgaaaagatatatccataagatcaaatatcaaggtctgttcttcaaaatctttattgttatggtggtcagcatcactgcggtgtccttgctgacctctttggtgacgattcggatgtctgaacgactttttgctgagacattcagtattacaaatgccaaggtactcagccagattcaatccagctttgaatccttcaatgattctatcgtgaatgccgtaactcatgcttcggaaaatggaacggtcaagaactatctgactggcggtcaatctgactcgattaactcggcgaggatttacttcggaatggcacagcaaatgaagcaaattaaatcgaacgtcgatgcctatgatgtcggtgtcgctgtaacaggtctgaacgggcggagcttttactccgactcgtcctattggcctgtaactgcggaagagcttaagagcagtgctattacagcccgaagtgtagcacgaccggcacagcttatgtatcaattggatactgaattgttgcagcaacaaatgaatagtaccccgcaaaagccaacaccctatatcatcgcctccaaaccatttatggagcggaccagcggcaccctgtacggcatgatctacatcgctatccgagagcctgaatttcgccgtttctataacaatttcacgagcaatggcaatgatgtgcttattttggacaagtcgggactgattgtatcgagcaatcgtcaggatctgatcggacaacgctccagtgagttgctaggctatgccacaaaaatcaatgaacagggacttaactacatgaatgcggatgtgatgaataaggagagtatcctcctttccaactatatcccttcatttgatttttatctggtgaacatgattgacagacaagccgccattgggcaaattattgacgttaaatccgttgtatggatctgcattgccatcgtactgattgctttggtgatcgtttttctgatatcccgtcgactgattcgttcgctgactcgactggtgaagcaaatgtcgaccatacgcgagaaaaatttcgataattatatcccggtaacgggcagctatgaggttagacaattaagtcatgcttacaactacatgctggatgaactaaatgactatatccgtaagcttttagagacgcaaaagggtcaacggaacgcagagcttgctgcactacaacggcagatcaatccgcattttctgtacaatacactggcttcgatcaaaatgctggtgctcaaaggaaacaaggaaacagccgccgagacgatcaatgcactcatttccttactgcaaaatacaatcagcaatgtgagtgaaacgatcaccatcgagcaggaaatggccaacatgcaaaattatgtgttcattaaccatgtacgctacgggcagcgggtacaagtgaattattttgtatcacccgattgtctggagtaccatgtgcccaagctcatcattcagccttttatcgaaaactcatttttccatgcgtttaatgaaaaaaatgtaggccacatctatatattggtgtccaaaacggaggattcattgatctgtgaggtggtcgatgatggagacggtatggaattggacgggcatacggcgcaggacggactgccgaatcccaagagcaagcgccaactgttcacaggcatcggcatccagaatgtgcacaaccgcattacccttttatatggagaagaatacggcgtgaccatctccagtaaaaaaggcgagggcaccaaagtcagaatgaccctgccattgatcgtaaaacccgcccctcctaccccataaaaaatataggctgaactaaacaaagaaggtggaacaagaacggagtgggcggaatggtgctgtacaagcaacagcgatgggaagcaccatccggccgcgcagtggcgcttcgtgaacaactttagttcaacctaaaaaaagtacctaaaccaaaacaaaatacaaatgtaagcggtgccttttttgataaatcataataataacaccaatccgtataaagatattcctaacgccgacaaagtatggatggtacactagatttataaataaggtaaccgctttcatttaagagatttagaactagcaagcaacatataaaaaaagagtaggggttgaacaaaatgaaaaaaatgactttccttctgctgattgcaagcttgatcttgctatccgcgtgctccagcaattccgagaaagcagctactaccacagattcaggcaaaaaagaaatcaccgtctgggcttgggacccgaactttaatatcgcagctctgaagctggcaaaagatcgctacgttgccaaacatccagatgtaaccgtaaacattgttgaatatgctcaaaacgatatcgtacaaaaaatgaatgccggtcttaactctggttctaccaaaggactgccgaacgtggttctgattgaggattatcgggcacagaacttcctgcaagcctatcccgattctttccatgatatgagcagcacgatcaaagcatccgactttgctgattataaaatcggaccgactagctacaacggcaagcaatacggtgttcctttcgactccggtgttatgggactgtatgtaagaacggattatttggaacaagccggctacaaagtagcagacctgaccaatattgattgggacaaatttattgaaattggtaaagccgtaaaacaaaaaacaggcaaagaaatgctgactcaagatccgaatgacctcggtctgatccgtggtatgatccaagccgcaggttcatggtacctgaaagaagacggtaaaacaccaaacctggctggtaatccagctctgaaagaagcgctcttgacgtacaaatccttgttcgacgctaacattgttaaaatgaatgccgactggagtcagttcctggccgcattcaacagcggtgcagttgcttccgtacctacaggtaactggattacaccttcgatcaaagcagaagcttcgcaatcgggtaaatgggccgttgttcctttccctaagctgaaaaatatacctgaatccgtgaatgcttccagcctcggcggcagctcctggtatgttcttaactcggacggtcaagataccgctgctgatttcctgaaagagacattcggaacagatccagagctgtatcaagatatgctgagcaaaattggaattgttggttcattgaacgcagcttccagtggtaaagcttatgacgtagaagatccgtacttcggtggcgacaaagtatacaagaaatttgcagaatggactaaacaagttccaaaagtcaattatggcctgcacacgtatgccattgaggatatcatgaccgttgaaattcaaaactatctgaacggaaaagatgtagacgcagttctgaaagatgctcaaggacaggcggaagcacagcttaaataagacagtccatctagccaaggctaaacaataaaacgataagcacttaaaaccttgggcttgcgagttcaaggttttattgctgcacagggagttgacatggtatgaagacagccgcgcccaaaataactacaacacgtctcaaagcaggtatgacaggatggttgttcatatccatcgcagtgatcatgattgccgctttttatttctatccgatgattcaggcgcttatcttgtcctttaagacaggtacagggtctaatctgagctttaatggcattgataactacaagcgattgttcaccgataaaatgtttataaccgccgtgaagaatacgtttatctatttgattttccaagtacctttgatggtcattctggctctgttcatttcggtattgttgaatgataaaaacctgaaattcaagggctttttccgcacagctatcttcttgccgtgtatcacatcccttgtagcatactcggttgtcttcaagtacctgttctcgtccgacggtttggtaaactccttattgctaaatctgcacgtgattggcacgcccatccaatggattacagatcctttctgggccaaggttacgattattatcgcgatcacatggcgctggactggttacaatatgatcttttacctgtccggtcttcagaacattgacagttccatctacgaagcggcccgtattgacggagcttctccgatccgacagtttttcagcattacggttccactgcttaagccgattatcctgttcacttcgattacatcaacgattggtacactccagctcttcgatgaaattatgaatattaccaagggtgggccagggaacgcgacatcttcaatttcgcaatatatttacaacctgtccttcaaatattcatccgactttggttatgcggcgaccgtatcttattccatcgtcattatgatcattatcttgtcgattatccagttcaaagtggcaggtgagaaaaaatgatgaaaacaaaaagagcatttacgtacgcctttctgatcattgtgtcgttcgtttcgattttcccgttcctctggatgctatccagctccacgaacctgtcggtcgatgtgaccaaaggcaagcttctgcctggctcccatctgatggataacatgcacaatctgctcgaaaaagtagacatcgttaccgcactaagtaactctgcaaaagtctccatctcaactacgctgctggctatgctaatcgcatcactggccggttatggctttgaaatttacagaagtaaagcgaaagacgttgtcttcaatatcctgctgatgtctatgatgattccgtttgcggcgatcatgatcccgctctaccggatgttcggcagcatttctaatgtcataccgtggatcggtattgatacactctcttctgtcgtcattccgaccgtaactacggcgttcctgatcttctttttccgtcaaagcaccaagatgtttccaaaggatctactggaagcaggtcgtatggatggattatccgagctgggtctgttcttccgggtgtatatgcctacgatgaaaacaacctatgccgctgccgcgatcatcacattcatgtccagctggaacaactacctctggcctctgattgtgctgcaaacgccggagaatcaaacgattccgctgttgatctcgaaccttggctccagctatgcaccggattacggtgtcatcatgatcgccattgttctgtccacactgccgactgcactggtattcttcctgatgcagaaacactttgtagcgggcatggtgggttcggttaaataacagacttctgtgtacaatcttcatttcattttaaaaataaggagtgttcgccttgaccatccaaccccctagtctggactggctgaccgacgtaaccaaatttgctgtgcatcggctgcccgcctattccgatcacaaatattacgctacgcttcaggaagcggagcagcaagctgatatggcttggcgtcatagcctgaatgggagctggaagtttaactatgcaacgaatccagccagccgtccggtagaattctatgcgcccggctttgagtatggcggctggagcgatattcaggtaccgggtcacattcagacgcaaggctttggccaaatgcagtacgtgaatacgatgtatccgtgggacggacattcggacgttcgcccaccccatattccggaggatcacaacccagtcgggagctatatcaaaagctttgttttgccggaaaatatggcttccgacgcgcagcctgtgttcatttctttccaaggcgttgagtcggctttctatgtatggctgaacggacaatttgtcggttacagcgaggacagctttacaccgtctgatttcgaactgacaccgttcctgcaagcaggtgaaaacaagctcgcggttgaagtatatcaaagaagtacgggagcgtggctggaggatcaggacttttggcgtttttccggtattttcagagacgtatatctctataccatccctacggttcacgttcgtgacctgcatgccaaggcggatctggatgcttcctacacgcagggccttctggagctgaaattgaccttggaaaagccggcaacggcctatgcaactgtcgatgtgaaagatgctgccggccatgttgtagcttctttaaaagctgactttactgatggcacagcttcgctgtcagcaaccttggagcaagtgcagcgttggagtgccgagaaaccctatttatacacgttgttcattcaaatttatgatgccagtggatcgctcgtggaagtcattccgcaaaaaattggcttccgtaaatttgagctgatcaacaaggtcatgcatttgaacggcaaacgcatcgtctttaaaggtgtgaaccgccatgaatttaacgctcgcaccggacgtgcgatttctcgtgaagatatgctgtgggatatccggacgctcaagcagaacaatatgaacgctgttcgcacctctcattatccaaatcagactctttggtatgagctatgcgatgagtacggggtctatgtaattgatgaaatgaacttggaaacacacggttcctggcaaaaactcggtgccgtcgagccatcgtggaatattcccgccaatctgcctgagtggcaagatatcgtcatggatcgcgccatttccatgctggaacgggacaaaaaccatgcgtccattctaatctggtcctgcggcaatgagtcgtatgcaggtgaagtgctgcgcaatgtcgccaactatttccgagccaccgacccgagccgtttggtgcactacgaaggcgtgtttcacaaccgtacgtacgatgataccagcgatatggagagccggatgtacgccaaacccgcagatatcgagcaatatctgaacgacaatccgcaaaagccgtatatcagttgcgaatacatgcatgcgatgggtaattccgtaggtggcatgcacaagtatacagagctggagaacaaatacgagctgtatcagggcggttttatttgggattatattgatcaggctgttatgaaaaaagatcgctacggacgcgagtacctcgcaatcggcggcgactttgacgaccgtgctacagactatggcttctgtacggacggaattgtctatgcagaccggaaggtttcgccgaagatgcaggaggtcaaattcctgtatcaaaatctgaagctcaccccggatcgcagcggtgtaaccctgcgcaatgaaaacctgttcgagggaacaggcgactatgagttagtatatagcctgctgcatgaaggccaagaaatcgcacgtaatgccattcatgtagatgtagcggctcagaccgaagcctatattccactaacgttccctaatacggatggaaagcctggtgagtacgttattcacaccgctctggttttgaaggaagcgacgctctgggctgaggctggacacgaagtggcctttggacagcatattttcatcgtggaagatccaaatccactgaaaatcccttcgggtggcgccttacgagtggtgcatggcgatgttaacattggcgttcacggtgcagatttcagtatgatgttctccaaaggggcaggtagcctgacttcacttcgctacgccggacgtgagatgatcgccatccctcctgccccattattctggcgggcgaccacagacaatgatcggggaaccgcactaggctttgaagccgctggctggttcgctgcaagtctgacacgtaaatgtgtgggcatcgaggttacggaagaacaaacagaccatgtaaccgttacattccgctacacgctgagcatccatgcagacgtacaggtaacggtagcctacaccgtcttggcggatggcagtctgaacgtaaaatcgacctatgaaggtgtatcagggctgcctaacctgccgatctttgccctttcgttcaaggttccggcggactatcgccatctggactggtacgcgatgggaccggaagagaattacatcgaccgtgcctttggcgcaagactaggcgtattccacaacgaagctgcggataacgtatccgggtatgtcgtaccgcaggaatccggcaaccgtacaggcgtgcgccgtgtcgatattaccgacgattctcagcgtggtattcgcattactgctcctgccaccgcaccggtggaatgcaatatttcgccgtatacagcgtttgagctggaaagtgcctaccatctgtatgagctgccgaacgtgtattacaccgttgtcaccgtagctggaaagcaaatgggtgtaggcggcgatgacagctggggagctccagtacatgaagaataccaaatcgcagccgatcaaaagctggaattcgaatttaccatgcaacgagtataaataagcacgctcactgtatagacaagtagatataacaaaagcccttccgctgcttcgctcatgagaagctaaagctggaagggcttttgtatttacgtatctgcagaataggcagcgatggccatatctatttcaatataacttcaatatcacgtccaggatcgctgtacttgtagatgccaggatttagttccaatttcccgtctaattcaatgtctttgtaacggtcaacattaactcctgtggataccatacccttcgcaatgatctcaggcactacttctttgccgttaattcgcattgttgtttggttgacgcctttgaagccaggggaaccggatttcgattcgacaatcaaatcttttccctctgtatagtatgtgaaatcaatttgataaccgtccgcattaagctcagcgaactgtttttcttctttaggtttatgaagagtgatccaattcttagacgtatcacgtttctctatgacagcatctttcaatataagtttcattggaacatcagaccagtccttataccactctggggattcaaattgatataagtgttgataattttcaggaccagctcctttaatattccaccctccgttaatttttttatcacctataaccagctgagctgttttataatgaacaattccttttttaagtgaatcacgctctgttactagaatttcaatatccaagggggtaacaatcagttgctctaaggtagtgcctgtattttcttggaattcagcgctgctatgcagcttcttggaataaatcgcttcacttgctttttttccatccgcttcaaattcgaacttccaagtaccttcaattctttttgcttcctcaatgtaacaaaaatgaaggtttgcctttttccaatcttgtgcagtcatgttgaatacctgctcaatatgcaagtctgggctgtcgctaggtagaatagttgggattgcgtctatctctttgtcgcccactttcattaccaaatgcgggttcccacgtcctaaatcggatggagctgcagcaactctaaagcggacaacagtcttgttgttggtttgtcgaacggattctatataaatgttaggatactgcttggtcccggtaaccagggtatccccggcttgatgatccgtctttaaaggaatatcctgattacgataaaaaataagattctgtgcctcaagtgtgtaatcttttttacgatcccttaaagtatcaatagtttcataaatgccaaggagtttctggcttttaggatcgtaatttaaatatccgtgtgcttgttccttggtatcagaattgctagttaccatagttttctctatagcaaaccccatataactggttggatcggttcctggatccagagagataagcattttcattttttctccatccgttacaacaccattcaaattcatcgtaatgcctgcattggatgcttttagatcataccgctggccaataccgttatttagcgcattggttacactacgtccgcctattctatcccaattgatggtcacactagcgaatacagggatggcaacgagcagaaaacatgagaatacgatacttgctggaacaatttttgctctatgcataggtgcttcctgtgactgttgcagagttgcttttcgtttggttgcttcctgttctatatttacccacattgcatcatattcaggttgaggaatgttctgttctttttcaaaataccgactcactgctactcatctcctttacttggggtatcaccattttttttagcagtttaagcccccgatttaatctagatttagctgttccttcgggtatattcataactctagagatctccggcacagtcaattcgtttacataacgaaggaccacgaccattcgaattttatctggaagcttgttatatagcttgtgtaactctgtcttcgtttcttgatgatataagctctcttccaccggattaaatgaatgagggcgtgacaataaaaaagttcgtatttccttcatcagcccagttttccgccttctaagcacattactgcactcattagaagcaattcgcaaaatccatgatttgagatcttgtactttggacctgtcggccaagagtgctttgacaaacacttcctggcaaacatcttctgcatctgcttgattttgcattagataataacaaaaataatatatctgctccttatatagttcaaacagctctcgatcagtcatatacgtgcacctcccttgttgtggtctcatctattaagactaataatggagtacaatcgttcatttacatcgaaaaaaggcagccctatataggaccacctattattgatcgttcgattcccgacactcaggcaaaacaaacctactgtgccacatgctcaattcattgcttttatcaatcaaaaaaccgccctgctgtaaccgccatcatttgccctaaatcagcatgagtctgccgcaccgggctagctcgtagcaagattgacatacgttcgcgtgaaatcaaggttcttcaagtccctttgatctataaaaaactccaaataccccgcgtcccaccagcacatgccgacctcgtccaaagaagataccgagagcagaacatgccaattttccgaagcgtgatcgtgcttttcccgattcgtctgatattcttgcagctgagtcagcacttcggatcgtaaatgcttcgcataatccgtatttcccctatgcatagcttgctcgatttccttatgaatctggctctcactcttatgccagttaaacagaagaccctccagcccgtttcggcgtagataagcatcccgccgggtattcccggcaaaagattgatgttgcccccacaccgtgtcgctatgttcatatagaagctcataaagctcttcgtactgatctacaagaatatctcctagctcaccctccgatggtagcgtcaggatcggatgaaaagaaattgcatacgcggtgaaaccccgttgttccgctgacacctctacgcgcccagcgggcggtaatgttttctgcaaaacgctgctgtcaccgttatagtaaaagattttatggtcaatatcataggcgggctcatccagcccaagaaaaaagtaaagtatgccctgatgaggcaatccctcaaatggtgaaaaaggtagctcccccaaattaatttgagcaataaatgtataatattccccgtctgaactacaaggccactctattgtgtgtggcaggtctggatagccggcgatccgactatttccaacgtgttcgtagttttcctcatgctccacatgaaattgtatagcaacttcagcttcctgatgaatctcttcttttaaatcttcatccagtgaatgcccttccagtattcgagtcagttcatcctttaatggtggttgtagcatctcgctcgcccctttttcatgaagtattatgtattgcttgctctcatttgatctcttatatcagattaccaaattacagtctgacaagctatttctctggtgacaggttggtcagtcctcggtcaaatcatcgatcttcactgcaagtgaatggtggatacatccaactcttcctttacgatccaagcggaaatacactagacattgttcataaatgttttgtgataggcattccggtattgggaaggagtcatatgggctctctttttgaacaaacgcataaaatacttctcatcgctatatccggcctcttcggcaacctgcttaatgctcatatctgtacgggaaatcaactctttggctttgttaatacgaatactatgaatgaattccaggggacgcatgcctgtattttgcttgaacaaacgagagatataatccttgttgtaattgaattttcgagctaaatccgtcacggtcagcggttcttcagcatgaatacgggtccactcaataattttgttaaaactcacattcccctgtgaactggcaggattggaaagcaagcggctgagcgccagttcagatatctcgatcagtagcgaggtgaacaaataatttgcgctgtgatacgtaagataatgtgagttggctacatgcaaaatctgattgacaataatatgaatccgatccccgttatctgcctgtacacattgcggtaaatagatatcccgcatcacaccgtgacgctgcaaacgtcgtccatccaaagcacttgtttcctgcttcatttcctcattagataatacattcggggtcgtgggaacatcgaaatggaaccaataaaatttcacgcccggcaacgattcccggtatcctttatgcgtacgaccggggtaaagcaatagaatatctccctcgcctacttcaaaatcttcccgttcctcccgtatatataccgtctcttggacacccaggatcagctcaaaattctcaatggaacgactcatatgtttccaaggcacctcgttaacaaactcgcctgccgagatcagttggatcggagcatctacatttacttttagataggtcatgttatcgcctctttaaattcatgttcggatttgtccacccattgtatggttaagctactgacataccgcgattgcaatgctaatgtagtggagaaatatacactttcatcttagctaaggagcgatgattttgaaagctaaagcttttgacttgcataaagtaagaattgattccggccctcttttacatgcgatgaaactgaatacggcctacctgctgagtttggaacccgaccgtttattatcacgctttcgtgaatatgcgggactgaagcccaaagcggctcactatgaaggctgggaggcgcgtggcatcagcggacatacactcggtcactacctgtccggctgtgcactgatgtttgcctccacaggcgacgaaagactgttggaacgcgtgaactatgtggtcgacgaactggaaatatgccaagacagtcatggaaacggatacatttccggcattccacgcgggaaagagattttcgaggaagtaaaagccggagatattcgctcccagggctttgatctgaacggcggttgggtgccactatataccatgcacaaactttttgcgggcttgcgtgatgcacatctgctggcgcatcatcccaaggccctgtctatagaaatcaaactcggcaactggctggaggatgtacttcaagggctggacgatgatcaggtgcagcaggtgctgcattgcgagtttggcggtatgaatgaagttctaacggatctggcggaacattcgggagaagaacgctttttgagtctggcggaacgcttttatcacggagaggtgctcaatgatctcgcggatagccaagataccttggcagggcgacatgccaatacgcaaattcccaaaatcattggcgctgcacggcaatttgaaatgacgggcaaaccgcaatatgcagacctgtctcgctttttctgggatcgggttgttcacaagcattcctacgtgatcggcggcaatagctataatgaacattttggtgaacctggcaagctgaatgaccgtttgggcgaaggtacctgtgaaacctgcaacacctacaatatgctgaaattaacaagacatatgttcgagtgggacgcctatgcagcctatgccgactactatgaacgagcgatgttcaatcatatcctggcttcacagcagcctgtagatggacgtgtgtgctattttgtatcgctggaaatgggcggacacaagtcctttaattctcaatatgaggattttacatgctgtgtcgggtccggtatggaaagtcactccatgtacggcactgcgatttattttcacacgccagaaacgatctatgtcaatcaatatgtcccttctaccgtgacatgggacgagatgggcgtacagctcaaacaagacactctctttccgcaaaatggacggggaacgctacgcgtcatcagcgaggagcccaaatccttcgcgatcaagctaagatgcccgcattgggcggagcaagggatgataattaaaatcaacggagaagaatacgtcacaaaggcctgtcctaccagctacgttgtaatggaacgggaatggaataatggggatacgatcgagtacgacattcctatgaccgtgagagtcgaggaaatgccagacaatccgcgccgaattgcatttatgtacggcccgcttgtactggctggagaccttggccctgttgaacaggagtccaacgaggaacgtctgcttgcgtctgttctgatcggatcggccgattccctgacaacgaagctgattgctgacgggaacgagcctaatacgttccatatgaccgacttaggctatatcggagacttgaagcttcgtccgttttatcagatgtatgatcgttcatataccgtctattgggatctcttttcccaggaggaatgggcagcaaccgaggcagaatatcgtaccgcgttagcgtatcagctagagctggaacgacttacagtggacgttgtgcagcctgccgaaatgcagcctgaacgggatcatgcctttactggcgagcatgtaggtctggggtccatctataaccgcaaatatcgcgatacctggccagggggctggttctcttttgtcatgaaggtgcttccggatgagcctgtccaattggcggtcacttatttgaaggacttgagccgtccccatagtgactttgacatcactgcggatggtcagattttaggggaaggcaagctggagtctgaggaaatgaataaattcgaaacattcgcctatgagcttcctctatctttgacgaaccacaagaatgaagttacgattcaattcacagcccatccacaaggtaaagtggcgaaagtagctggattacgagtggttagacactctattgtatgatcaaattatctatataaatctactattccgcctactccgttttaattgttcattttttaaattaagcttatataacaacaagcagacgctcctataagctgtctgcttgttccgcttaccgccttataccttcgaatcatcgttattgcttcatgtacacttcacagcatgttcatttcacggaaactgtctctaatcttgcgtagctcttgctgtgccctgctgtatcgcgaggcgtaggtccaagcaagcacttgatgataatgcgaaggtgtttcaatcgtggtcacgttatacatggccagattcccatctatttctccttttagggtaaactcaatggcaggatatccgttcaccaccatatctgaagcggtccccaattcagggtccgtaattcctgacaccaaatgatcctcaatgattcctttatattcttgaagagtcatactgctgtcaaaatcgcttttcggttcagacaatacaatcagatatctttcggtaaattcatttttaatggagatgtccgcatcctcattaatcatattatctcgtgaccaattccagggagccgtaaccgcaaactggctatccttactggtaaatacctcaggcttcatgatttgcgtaatgagcgtagaaattaaagatacagcatagacaattgaaatgatcgtcgtcaggatgattgctcctgcaataatcccggttttctttctgcccacctttcccaaatcccgtaccttaaccacatatgtattcgcagccatatctccaatccgttgtttccgaggtgtcaccagcacacatataccagcgggcagcccgaagaaaagcagcggattcgtatccaccaaatgtataagggtacggatcaaggatttaaccatgcctggcggccttccttctccatttacgacctgaatgcgaagtacaaacttacccagcgtatagcccgtaagtccttccaataacagataatagcagaaggagccaatcagaaagagtatcactatcatgcccatatttggggtttccgcttcagatacttttttcgctgtaaaataaaccagccctccatacccgaagacgataagaatgaagtcaatcatccaggccgcccatcttctaaaaaaaatagaggcaccgtatgtttctgataatactgccatcttatccggttctcgtcgctgatagccgccattcttcacaaattctcccggagctactgtagatggatttttcaataaattaggttcttccaaatgatacacccctgatgtcaatttaatcccagttaagtataacatcctttttcatccagcggagcaagcctgacagtgcactggagtaaaccgaatcccgccgataaacaaaccacacctctaatttgcgatatttttcaggtaaacgatgcgaagcaatacttcccgcctcctctgcctttgcaatcgacgattgtggcagcatggacactcccaggccagaggctacaccacccaaaatgacttccaatgtcccaaactccataacctgatacgcagccacacctgcttcgctcagaaagctttccgctcttgtacgatgcgtgcaccctacgtcgaagaacagcataggcttggcaagcagctctttcatgtccttttcccctggttccgagatgagcaccaactcctcctcaaaagccgcgacatgctctatatgcggatcatcgacagggccatagacaaacgctccatctaattcgtaattcaataccttttgtacgagattatgtgtgctgcctgtcataagcgatagatggacatcaggatactgtgaatgatactccgtcaataaagaagtcagatgcgtaaccgccgccgtctcaatcgatcccagtcgcaaaggtcccgcaggatggtctgaatattgagtggactttacagcctcgtccagcaaggtcagtatggtatccgcatattccagcagattctctcctgccgacgttagagtcattccccgattagatcgacgaaacagcggtacattcagttgtgcctcaagctgctgaatccgcgaggtcacattggactgtacataattcaaaacttgcgcagccttcgtgatactgccctcgcgagcgacagcctgaaaaatcttcaaatcactgctttccatgtatacgtcacctgcttggtatgatcatttatgatactcacattcgattttgttcattttaccggacgcttgccgctctgtacaattcaatatacatgcaattgcatctaaactcgaaccacgggaggttttaaaatgaaagccgtaattcatgccagcaaaagcggccctgatggcctgacatatacagacatcacggacagacagccgggacacaacgaagtgaaggtaaaactcaaagccgcaggcttgaaccatcgggacctattcctcatggcagatcgaacagccaacgatgctccactcattctggggtcggatggagcaggcgtgattgaggctgtgggtgttggtggcccaacctcgctggtaggcaccgatgtaattatcaatccatgtatcggatgggagaatacgcatcatgttcccttggttccagccattctgggcggaccttcagacgggacattcgctgaatcggttatcatccccgtccaaaatgcggtcagcaagccagcatacctttcatgggaagaagcaggggtgctgcctttgtctgctttgaccgcttaccgcgcgctcttcacaagaggccaattacagcagggtgagcacgtccttattcccggtattggcggtggtgtagccacgtatgccatgcttatggctttagcagcaggcgcgcgggtcaccgtcacgtcacgcagcgaagcaaaaaggcaggctgccctcgctcatggcgctaatcatgcattcgacagccatagcgaatggaaagaaagtatgaacggagacaccgtggatctggtccttgacagtatcggtcctgctacgttcgataaatatttggatatcctcaagccgaacggtgggattgttacatttggcgcaagctcaggagaccgaatagagattccactgcggtctatatttttccctcaaatcagcatcatcggcacctctatgggcagtggcgaggaattcgtagctatgcttcagttcatggagcgccatgcactccatccgattatagatagcgtatttcctctacaagacacagcacaagccttccaccgtatgcagcagggagcgcagttaggcaatatagggatcaggatagggtaagagatctgaacgaagtataggaatagaaaaaaatccactgccgtaaaatgccttcatccagaagtcaattttatggtagtggacctattcagtcgatcaaacgatgctggacccatttgttgccgcggaagcgccaaaggaaaacgagtccccgcacgccccattcaatatccatggccagccagacaccaacaatccccaggttgaacacaatgcccaaaatatacccgagcaccacccggcacaaccacatggacagcattgaggtgagggacgtaaattttgaatcacctgctgccctaagcgcagagggtgtaataaaggcaatggaccagagcggaatctgggccaacgtattaatcagtatgacaacaaaaatgtcatctacgatttcagcaggcggatgaaacagccccaccatcggctcaaacaaaggcatcagtatgagccccattacaataaacgaacaagacgacagccaaataaacgatttggtaaacttccgggcatcctcgacatttcgacgtcccatacattgaccgaccacggttacaatcgtaagagccaaagcattcgcagggatttggaacacgttagctagggatgagcaaatggcattcgtcgccaatgcattggtccccagactcacaatgaaaatttgggtcaaaattttgcccccattgaaaaacatctgttccgctgcaaagggaagcccgataaacagaatctttttaagcatagccagattaaaataaagcatatctctaagctgaacacgcaagtcgtcatctactctgaccaaatagatcaatgcgcacactgcccctgcatatctggacacattgacggcaatcgtcatgcccagcacacccatatctaatacattaatgaataccacattgaggagcacgtacgagaggttcatgatgagcgaaagagccagcgatgccctcgtcttcccgattcctctcagcgctccacacactgcctcaacgattgcaatccccacaaaagacatacagcttcccagcagatataccttaccattggctaatacatcaggcgaggcggaaccaaacagaacacttaaaatcggattgtacaacacgatcataaacaaactgatacataaagccagcaaggaaacggaggaaatggtgccggatgcggctttagagaccatgaggtcgttaccgctccccttatactgtgccacgacaaccgttcccccggtagacactgcaacaaacacattaatcagaaaaatattcaaagaatcgatcatatttacagcactgactgccgccattcctgacgagctaatcattgccgtgttcaccaaattaagacccacgataaaagcctgatcaatcagaagcgggataaacagcgcaataatctgtcgataatcaatagactctcctgaaaaatgcttattcagaaagccatgtgttctcatccttacactcagttgactcatatcatcacattctttttctcaaattgaaaaaaacccttcaacagaagagccttcatggcgaaaaaatgtataaagttgcaaggctagatatgtctagttcttgattctgtacacttttctctacatagaagtattactccaaaagaaaatcctgtcaatggtcttgctcacatttgaatataaaataacagaaaaacctgctcagctcagtgaacaggttttggagcagcattataatgttttaatatgtcattaaaacattgttaagagaatgtctatgatcttctcgcaattaaatcttgttgaatagaagcttcattcttttcgaactttttataaaaaaacataggaatgattccgatcaagaagatgataaacggcagccagataaagctaaactgaatgccagacaacgccgtaggagtttgaacttgcccagcgatgtaaccagtgctgcccatgatccatgctggcaataatccgccgattccgctacccgctttaatacagaatgcgcttccaatcgaggtcaggaaaccacttgcccgaataccatttttccattccccataatcgactgtatctgacaacatcgcaaacggcatagaacatgcaaagcctgatcctaacgcaccaataatccagccgataataatgagggttaagtctgtactgcccattaaaatcacgacttgccccagcgcagctaatatcaatccgataatcataattgcatttttacttaattttctggcaaaaaacggaatcagaaccatcgagatcaactgcaaggaggtcagtccattgattaaaggcactaagtccttactgtccagattgtattgcagataaaagattaaagttgctgaacgaatattcaaaccaatccagtaacacaagttggcagctacaacgagcatccagggccagtttcgtttgatggctgtaaagcttttagcaatgggaacagatttcgttttcactgctgcattttctcgcaaatcggcaaacgctatgaaaaacataataatcgccatgattccaaataaaacgagcgttaaggaaaatcctttttgatcattcccctgtccaaagaaagcgaccaaaggtaatgtaaacgtcgtagcaatgaagaaccctacgttccccccgaccatgcggaaggagttcaagactacgcgttcattagagttggtgctcagattaggcaaaatagacgtaatcggcgtactgatccctgtgtacaggatgccggctataatatacgtaatggcggcatatgcaattttgcccgactcactccaattgggtgtcgtaaacgtaaggaccatgaacacagcgaacgggatcgctaaccatagaaaatagggtctgctctggccgtattttgaattggttcggtcaatcaggatgccccaaatcggggcatcaatggcatcgataaaacgggtgataaatagtaatgtcccggcaatcccgatagaaagtccgaatacatctgtataaaaatataatagataactggaaataacacagtatagtaaattgcctgccgtatccgttaatgaatagctgattttacgatgaaaaggaacggtacttgctgccttttccggtggttccgtactcacaattctcgtactcatgatctttcctctccccatgcgaatgaattatgattcataaacccatacacgcatttcccctttagcccgattgcaccaggcgtagtaaggaatggcggtaatttgttgaggaacaaattcaggaggctccgagctatataatgcattcgaattttttacccggtatccctctatggtcagctttacaatgccacccagcaggttttcgctgaactcttccgtaatgaggctatcctttgtcaatcttaatcctgccaaattcgctccattatccacttcttccaggcaaaacacgactgggccgcgttggagagcaatttgctgctggttcatggagacaagtggattgctccgaatgcgctcaactggcatagccaaatgcagagttaccacatctccgtccttccaagtatgctgaatctcgatatagcctttttccagacggtctaatgatatggtttccccattcaccttcacctctgcctgcttgcaccaacccggaatccgaaatgcccatttgaaggaagtcgactctgttacgtggatcgaaaatgttagatccgcgtcccatggataatgatgagtttgtgtaatttcaacctcatgaccagataaagtcatgttcaccttgctggcaatgtacagatgcgtatacaacgtatcgtccgtttgggtatacatattgtcctcaactgatgcaatcattcgtgccaaattgggcggacagcaggcgcagaaaaaccatttttgccgttctgtttttacatgctcctgatcttttctggatttttgaaaaggattaacctccagcggattcacgtagaaaaaccgtttcccatccagatccatcccactaatcgttccgttgtatagcgcacgctccagaacatcggcgtatttccggtctggcgctaaacgcagcatacgattggcccaaaaggccagccctacagaggcgcaagtctcacagtacatgctgtcattgggaagatcgtgatggcaagtgaacgcttccgcgtttacagtagaaccgatccctgcggtgatgtacattttgtgattcgttacatcatcccacagcgtttcacaggcttgtaacagggaagcatcccctgttttcgcggccaagtccgccatcgcaatatacagatacaccgctcttaccgcatggccgactgcctctttttgttcccgcacaggttggtgtgcttgctggtattcgaagcctaagccaaaattaatgttgttatcatcattccaggtgggctctgtttgaatatgttttctctgttcttgttcctctgcaaagtaaataggatgctgtccccgctgttcaataaaatattgcgctaatttgagatattgatcctttgcagttacgtcgtataatttgatcaaggccaactcaatttcttcatgtcccggatagcctttccgtttaccttcttccgtaccaaaaacctgctgaatcaggtctacgtatttctccataatgtgaagaaacttcgttttgcccgtcgtttcataataagcaacagccgcttctataaaatgccctgcacaatacagctcatgattgtctcttaagttggtccagcgattgttgggttccttaagcagatagtacgtatttagatacccatcctcagcttgagctcttcccaacaattcaatcacttcatcagcccgctcttcaagcgcaggattcggatgatcccttaagctaaaggcaaccgtctccagccatttggcaaggtcactgtcctggaaaacggttccataatactccccactagattccccggctgcaatcctaaagttttcaatcgcatgactgggttctgtatctggtaattcatcatttaatgctttccactgataaggaataacctcttccgccacaacctgcttatactttttccaaaataaatcgtcaacgatgacatgcttaactggctttgccgttttcattggataaacatcccttcctggaaatagaacgctttcatttttgagaaaataaggataaagtaatgataatatcgtacaagctaacctgagttccccttgctacagtccttattttatcaacctgaatttataaaaaaaatcgcgatctttaactaaaacttatacgatttcacacacaaaggagctggcttccatgagcaaaacagactttctatcattccttgttcctccgctgccttatttcattgaggggaattttactacatatcaaaaaggggattggcatccgaataggtataatctgggttattttgacgtaataatcattaaagaaggattgctgcacattggcgaagaggacgaagtgtggaaggtaactaaaaattacgctctcattcttgaaccggataaacatcattttcccattgaggcatgtacagaacaaacctccttttactggttccattttcaaaccaatagcatgtggtgcgcacaatcctcgcccaatcctattatacccagcacccccattcccgagctgcactttcattcagaacatacgaccattcatttgcccaaaattcaaaaagtggtgaatccacatgagctattttcgaaattagactatttactagcctctactttaaaacctagaaaactggcactatgggaggcccaacagacgtttgcgagtgttttccagagtttggagtatgatcagaataataaagacagctcctctaagttggcggaacaaatcgaaatatacctaaaacagaattacaaaaatacaatcaccaataaagatttggagacccattttcacgtacatcagaactatctcgccagatgcatgaaggtcgctttccagcgcacaccgcttgagtatttaatggattatcgcctggatcaaggacgcagtcttttgctgcaaactgactggtctgtccaacaaattacggaggaaacgggattctcccaagcaagctatttctccaaatgctttaaagaaaaattcggaatgtctcccaagaattacagacaacaatactggaaaccagtccattgaatgcttacacctcctttacattctctttacattttcattgtatccttttgatattctcgctttatactgagtcggttatatcattttcacttcagaaaaggggcatacatatgaagtcaactaaactagcattattagccatgttaacggggattctggtatcaccagaactgacccatgcggcagacattcagccatccgggtatgcaccactacgaacacaggcagataaaatgggggcgacaattacatgggacagtgatgaccagtctgttttggtcaaattgaaaaatggcattgtcgggacctttacagtgggtgagaagcaatatcgtttagctggactaagcggaaaagcggaccgggaaattaaaatagtgaatggaaatgtatatcttcctacaaaacttcttacagcgcttgaagcagagaacagcaaatatgcagatcctaaggacgcagttcccacctataaagtaatcccctctgccgaaacagaagctgtggaggatggagaagacgcagccgacgaccctgcaatctggctcaacccggtcgatccggagaaaagtagaattttagcaaccaataaaggcggcgggattttagtctatgatctggaaggcaagcaactgcaaaacatgaaggtcggaaaaatgaataacgtggatcttcgttacggtttcacattgggcggcaaaaaaattgatatcgcaggggcaaccaatcgaaccaacaacacgatcgatatcttttccattgacggtgcatcaggaaagctgaccaacgtggttggcaaacctattaaagcatctatgaaagaagtgtacggattcagcttataccatagcctcaagacagataaattttacgcgctcgtgttgggcaaagagggtgaatttgagcaatatgagctgactgacgacggaagcggcaaaattgcaggtaagcttgtccgccagttcaagctgaatacgcaatccgaaggcatggttgctgatgatgaatatggtacgatctacatcgctgaagaggattacgctatttggaagtatagtgcggagccagacggttcaaccgagccgctgcgacgtgtggatattgcagatgggcgcagacttcacgatgacatagagggacttacattgtattacggtaaagatggcaaagggtatcttatggcctccagccaaggaaacagcagctatgcgatctatgaacgacaaggagacaatgcatatataagcaactttacgatcagcgcgagccctaccgtcgacggtacgtctgtcacagacggtattgatgttcttggctacggattgggcaagaatttcccgcatggtatcttcgttgcacaagatgacgaaaatcttcaaaacggcaaaaagttaaatcagaactttaaaatggtgccttgggagcgaatcgctacgggagcccctaccccgctaacgatagacgatggcatcaacccgcgtgaattggtaaacagaagcacgaagtaatgcccctcggggaaatcaactcaacattccgactctattgatagaaaaaaagaggtgttccaaaagccataaaccggctacttgggacacccctttttgtttttaagcgagaaaaggtttaagatccagcaccagcacatttaccgagttggccggtaagtctaagaggacagaatccgtctgaagcgtgatctgctgttcggtaggcactaccttctcatcattcttcttgttcacgttaggtacataaacaagcgaggaatggccagttagtgtaaccagcttagcgatggactcaacactcaaatcttgtagattcagctgtattaccttatccacgttgtcggcattcaccagcttcacgtatacatgctcagcatcttgggttaccgagttgaacacgtctctgttgtaagcctccagcttgtagtccagcaccttgctggttgtctcgccgtcggtgtatgagcaaatcagattactgcccgtttcaccgccgtagttcactgttatggtgtagtccgtgttgtcagccaactcttcatagctagctgctctcaagttacctgccgctgtactggaagagtagtcacccaatgtgtagccttctatgccctgcttgtaaaccttcacgccggtagccttgccgccatagccgatcgcgtattcaacgacgtcctttttctccgcagaaatattggtgagacccgcacccacataaaagccgtccgtgccggaaatacgggaagcgaccacctctaccttgtaattgctccagctgtcgttcaagatgtacagaccattcagaccgctatcctgagctttgaggacaagccccttgccttcctccactgtagagcccacggaaccgggaatgacctgccaggccgaattcaatccctgggtaaagtcttgatccagcagcacactgccatcctggttggaagtaacagtcacacgcttaatcataacctcggcattgcctgtcgcgatttcaattccaccctgaggaatgagatccgttggcttgccgtttttgtaagtagagaaagaagtgctcaatactttattccccaaatatttagcatacatttgctgtacatagtagttcggcgtaaaccacaccgtttcgtcatcgaaccagatgcagtctggcgtccatctgtaggttccatctgtcagcaccttgttaaacagcggtgcataggcagccaaccgaacgacatcggcattattttcgaagcccgtcatcaccgctgcctctgctacagcgcctgccaatgtatttttatccgttgaggcgtactccccgacaaaaacctttgatgttgctttccaattaatactgccgtccgcattataagctctgtagtagtagttatagcggtccacgttattcagcaggtactcgttagaacgataatagtgctcgtctgcaatggtgtccatatagtcctttttcttctcataccaggttaccgtttcttctgtcacctggttaccatctgcaaaagcaaccttagccgaaccggtcatattaccgcttaagaacttccagccctgctgatatgcatcgtcatctgcttgagcgccaaccgtggagatgatgtgtagctcataacccggatagtttttctccatgtactcatcaatcgatgtcttgaacacttcaaagttggcaaaaaactctgtaccccagttctcgttacctacacccaaataacgcagatcgaacggagcttcatggcccattttttttcgcatagcagcccattcattatgttcaaaatccacactaatcgcaaagtcgatcagatccgtaaagttcttaatatagtattctctcaatgcgcctccagcgggatgagcataatccgagcgggcttggcagagcacgccgcaggccataaccggaagcggagctgcattcaggtcttctgccaactggaaatattccatataaccaagacccatggtcatcatatagccccatacattaaagttttccttgcgcagctcgatatccccaatcgattccttccaatcgtatacattttcccatataaatgaaccctcggaaatacaaccacctggaaaccgcaaaaacttcggatgcatgccaaccagtgcgttcaccaaatcttttctcagtcggtagttaggattaccctggaagttagcatgtgccgatggggattgttcttcctctcctgcgccccatacatcttgtgggaataaagaaaccatatcaaccgaaatgtcccctttaaatgtaagcgccagctgcccgagaaccgtagctgagcctgtcagtacaagcttggaatcgatgccgtacttcttccacgtgttgccgccttccacctgtatcgtaaccgaatcactaatagccttttcatttgagtcttgcagttgcagtgtgattgtgcccgctgaatcggccttcgcccagatggtaaactcatatttggcaccctcttggatggacatggcacaattctggttagagtcggaaaagcccttgttccgaatcgttgcaccatccgctaccgtcacataataagagttcacttctttgtcttttgcgcctaaaaactcatttaatccaccgctatgttgtggagtcatcttatccgtatcaccagaccaggcgaacaacgggttgcggttccgtcctgtagagcagccgcattcaccggaagcatgggaatacgtatcgaactcgaaagattcaaaggagcgattctgaacgagttctgcataaatcccgccatctgctgcgttattgatatcttcatagaacaagccgtacatcacttcactgacatccactacttccttatttccatgaatggtcagcgtatacggaggtagctgttcaggaagaacggatacctcaaagctctcttcaatctggcttaagcccttcgtcaatagagccgtgacggtaaccccttgtgcggaggtaatcgcctgaatctggccattgtcagagagtataccaggctggctggatttccaggttacttctactcttccgcccatcagaaccgttggcagagttatgtccttggttacaatcgtcgtcggaaaggacaaatatttatctctggcaagcttcacgatctcttcatctgtcaacgaatcgcacatgacctcaatgacttcatccgccgtcaggcctgctttataaattcgaaagtctgaaacggagccggcaaagtctacatccgccgcatgctgggagcgaccgataaaattgttgctgtagttggacgagtctgtaaacgtttcgaaccatttacgcaacttggcatagttaccgctggaagtttgactgatggaaccatccgctactacctcaccattgacatataccaccggacccgcactgcttaatgtgccgccttccgtgccgatcacagacagggctatgtgcatccactcatccctgacaaaacctcttcccgggtctacggacaaatctacctcggtgaaaagagttccgcgcagattccgtgtcatgaacatatagggccctgtatgggctttaccaaagtcaaagacacgttcccacatatctgtgaatctgccgaagttgacccaagcagtaaccgtcacaccggtgttatcgcttacatctttgaatagatcggaaggaagctggatatacgatgtaccgttggggcctccctcaagcgtcaaagctgctctaccggtagcatgggaaatcgtaggtgttactgtgcctgaagcaaccccatcgttaccttgccctgagctatctttgccgacgttctctgcatcatcaaacttgtaacgtgcaatgatttgatcttggaatttggtcatcttcgttgctcctatacctatagtttattaatgtaataactaattagttaatataaatgcatactatatagttatagtaccttatcctgagtacctttttcaatccaataaatcggatttatgaagaaaatacttgaacgaactacataaaaaagcagccatcacagaagatactctgcgacaactgccttttggcttacaggattgcttgacccagtaggaacttttccgaaataaagaagcttggtcgtagctatggttatccgttcaatttttgtccacaattcggacagaagttagctccttcgttttttgtaccgcaattcggacaaaaattgggcttattaccgtctccagatggagagggggcagctggtgtaggctgagtctcagccaaaggctttggattcgggttcaaatttttcatcatttcatttgctatattcatccccatcatcatactcgccatatctgaggcagcaccaccgccttttacattacccgatgcaattccgtccgtcatcgtcacttgttggtacttttgcagattaccgatcatttcatgagaggctgtcttcgtaatcatatcttggatttcttgaggataattgaagctcatcacatgaaagccagtaatcgtcataccattgtccatcacttgcatatccagatcttcttgaataccttttgaaatgtcagaagcattcgcctgcagattgaacatgtcctttccttctctgctgatccacttcatcaataactgatccaatactgaagtaatgcgtattttcacatcctcaacgagataactgtccttcactccagcaattttatcgatgagcgtaacataatcgtgcactttaaaattaaatgtaccattggcacggatcggcataccgcctggcagctggggggtcgggatcagcactggattctgcgtcccccatttgacagtaaactccttcgtattaacgaataagacctctaccctcatgccactgttaaaaccaaatttaaacccttttaatgtcgatagaaatggaataatgtcagagtccatgttatacgacccttcattctcaaaaataccctctattttgccgttatttacaaaaatcgcatcttgaccggagcgaatgattaatttactgccttttttaatttcacgattactccacttccagaaaatcatatcatctctaaattcttcccactctacaacatttgcaaattgatttctgaagaatcccatactgtatccatcctttcagttcaggattttgcaaaattcgattccagtcgctccaaagtgcaatatatagacgaactagaccatttcgatctatatattgttcattgaaagtcgcttattggatttttgcaaaatcctcagttaaaatgatcctctgctgccgctatgcgaatgaccgccgctggtagttccgccaccaccacctgagctgctgctactgctgctcttttcaatcttccgtttcgttgtcgttgtgtgaaggtactgatctcgatgctccagaactcctgaggcgtgcgcatcctcgtaggtttgccgatttaccgtaacccgaccgccagaattggaaaccatcttgcccacgatcatcgctgccaatccaagtgcaaccgccaaatgaagccagcctttaaaaaatatactgtctggattcacccctggacggatggccaaatatttgtgcgcgcttagaatatacttttgaaatgccagcccatagttgccgttcgtcagatccgggctaatcccatggcgtattttagtaagcctgtcatcatccagataccgttctgccttataaaatccggccaagtacacctctctatttctcatatccatcgttaaaatgaccgcgttcccatgagatctgtcatacccagggccatggtcatcataaaagtcctgagtcattttcataacatccatattgtcgggattgagagtagtataaataataatgtccgtttctctttccgctccgtattgattagccatagtgttcaacacatcatactcttcctgattgagcagacccgcttcatcataaatcaatggcttcatttctgtcgttgctggttcgcccttcatttccataggaactgccagagaaacagcaaagaacaacaagacggctacaatggctctatgctttttcaatagaattcccctcccatcatcagccaagtgattaatcttaatgagaagagagtaatgccgaaaatgcctgcaaaccaagctgttactttgaacttgctgatcggaggcttaccgactaccttgcccgtctgtccgttcatagcaaacgtatgctccaattgattgtagtcatagtgtatgacccataccgggagtagaacataatccgcttgttttaatgtagtatcaatttgcttttccgtataactcacggacgtatactccgacaccgtagaatgaatataagcatcaatatattccttcactttctctttaactcgcgggaagagctcttcttcgttataactgtacttctccgcaatataacctgctagatatggcgttttaaagggttttagctgatcgtatggaaaaggctccaatttatccatcagctcgtcgttcattttctccgcagcatcaatcggaacctttacataattcaaacggattttccgatatacatcaaaatgcttcgtttccgtatattcgtagtctccgctcgtataggttctcacttgggtaccttcaccttgaacctcaattttattatgtaattcatataaccagaagggcacatacatcccggttattcccttgattcggtctgccatcatgaaccggttcggcgtcagacggccgttcttgcaccattttttgaaagcaactatggcttcttccttactgatcgaaaaaggaataacctgcgccggagccagcttcccggtcagtcggtctccaagaaccacggcagaaccacaaaagctgcacaccgttgcactcgtctccacttcggtcataatcactgctccgcagttattacaatgatactcatgagcctcatcttctgaaaaaatacgatttatcagaggatcaggaatagattcaatattgtcctctcttccgcaactatgacaggataacatccctgtctcaccgtcaaagaccatgccgctgccgcagttggggcatttgtattcgataaccggcatctgctcacctcttcatgtagatactgttattcatcttctgtattcgtactcttctcgtattgtgcaaataaagcatccaggtcgtccttcgttcctacccgaagctcggctatagccatcgcttcatcatacgctctgttcacctgctcttccataacttccaaagcagaattcttgctgcccatagagttcaaggcttgctgtgctttggcaaccgccatcttccctttaagttcagcgtgccgcgcttctagttgccccatatcggacaccaacttctcctgcatttgtttcatatttacggcgtttgtcgaagctaaatcataggatgtttgtaattgttccaatttttctgcctgcaaaccttttctctccagaaactttcgagcttcctcttcattaccagcttccacagacttactggcataatgctggagctttttgatctcggctttgcattcatccagtgctcttttcgtccttctctcatcagccaacactgaagccgtctccgctttcaccttgcctagatcactgttcaaattccgcatataatcgtcaatggttttctccgaatctcccaccttatccattaaggcgttaacattcattttcataatatccctaaaccttgacaaaatccccatgatgacctccttcgaaaggactacattccaccatatcatacatcaaatccggtaaaaaatgttccccagccatatatactggcccattgatcactttcagatgtgtgttcgttttatgataaaagcaaagggtccaaaaacccgcgacagatttttgaacccctttattttattgttcctgattatagttcttcatagcacttggggtcctgcccccatatccgtccatcctcactgctaaatgccgaaatcatgttcatttcctctggagacaactcaaaatcaaaaatatccagattctccgtttggtgttttaaagaagaggccttagggatcggaattgctccaagttggatatgccaacgtaaaattgcttgtgtagtggttttaccatgagcagcagcaattttcccaatctcttcattctccagcatactgtgaccacgccccaaggggctctacgattccgtcacaatgccctgttcagcatcttttgcacgctgatgttcctgattaaacaatggatgcaattcaacttgatttaagctcggcgtaacacctgtttcccgaattaaacgttcattatgctcgggcaagaaattgcagaccccaatggaacggatatagccccttttcttcgcctcaattaacgcctgccaggcttcaacatatcgatcaatttggggattcggccaatggatcagataaagatcataatagtccaggcctcctctatataatgactcttcgatcgttacaatggcttcttggtaagcatgtcggcgacccggtagtttggagcaaatcaacaattcttctctgggcacagagctctgctggaccgctttcccaacagcaccctcattttcatagttgaacgctgtgtcgatcagacggtaacctgcatcaatcgcgccggtaatcgcttttactccatctgcacccttaattccagcagtcccaaatccaatgacgggcactttaatgccatcattcaataccttctccggaatttgttggttcataattacagcctcctttactattctcatataacataacacctcttcaaagctccggcaaaatatagcaatccaatccattccgttctctatatatgtatatacccactagctcgtaacttccctaccaagttctctgtgtactaaatcaaaaagcgcctgatccccattgaaatcatacttgaagtcaagggggcaggcacttgtaccactaccaaatcatatattccacttcatgcttgatggcttggttgtccaacacaaagttgaagtgtctgtatttttatttcaagccattccatacccagttctctacctctggtaggtcaataccctcttcgcgaatgaattgatgatgtttcttaatcgtagcatccatttcatccacaatgttggtgtacttcccagcgtcaggtaagttgagaacagcttccttcactaagtcaaaacgatccatttgattcaatacacgcatatcaaatggtgtcgtaatatcgccattctcacggtaaccatgtacatgcaagttatgattgtgacgatcaaagaacagatctttgatcagaccttcgtaaccatggaaagcgaaaacaacgggcttgtcttttgtgaaaaaatgatcaaactcggcgtcggataatccacgcgggtctagtttttgacttctcagtttcagcaaatctaccacgttgatgtaccgaatcttcaagtcaggcagtttttcatgcaaaatagaaattgcagctaaactttcaatcgttggctctgtacccgcagaagcaatgacaaggtcaggttctccaccttgatctgtacttgcccagtcaatgatcttcaaccctttatccaccaattctttcgcttcatcagcagtaaaccattgtggacgtgggtgtttagacgaaacaatcaagttgatcttttgacggtcgtttaaaatggtgtcgaaaacagccaacaatgaattggcatcagctggcagatactcccgaataaattctggttttttatcagccaaatgacctaacaaacctggatcttggtgtgtatacccattatgatcctgttggaacactgttgaagttgctacgacattcagtgatgggatatctgcacgccatccttgatccgttgctttacgcagccacttaaagtgctgggtgatcatcgagtcaaccacacgcaggaaggcttcgtaacttgcaaagaaaccatggcgacctgttaatacataaccttccagcaatccttcagcttggtgttcggataattgagaatcaattacgcggccataggatgataagaattcatcattaggttcaataacttggtccatccattggcgtttggttacttcaaaaacaggagccaagcggttagacatcgtttcatccggtccgaagattctgaaattacgattttcttcatttaagacaactacatctttaacgtatttccctaaaaccgacatatcttgcgcaatcactttaccaggtacggaattatccagcgcatagttacggaaatccggtaatttcaagtctttaatgaggttacccgcattcgaaactggattcattcccatacgtttatcacctgtaggcagaatttcagcaagctcagagtttaaacgaccgttctcgtcgaacaactcctctggtctatagctattcagccattctaacaaagcaggtgcgtgctgcatatttttttgatcaaccggaattggaacctgatgggcacggaatgaattttcattcggcatgttgtcccattccttcggacctgtccagcctttaggtgaacagaatacaatcatcggccacgccggacgagtaaggtcattattttcacgcgcattcttttgaatagcttcaattttctcgatggccgtatccaatactttcgccatttctggatgcatgtgatcagggttttcaccttcaacaaagtacggctcccaacccaaacctttaaagtatgaggtcaattcttctttcgattgacgagacataatcgttgggttactaatcttgaaaccatttaagtgcaagattggtagcactgcaccatctgtgatggggttgataaatcggttagaaaaccacgaagcggctaatgggcctgtttcagcttcgccatcaccaataacaacagccgaaatcagatcaggattatccagaatggcacctacaccatgagaaagggagtagcctaattctccaccttcatggatagatccaggtgtttcaggagcagcatgtgaagcaataccgccagggaaagagaattgtttgaacaatttcttcatccctgagatatcttgtgtaatttgcggatagatttcagtgtagcttccatccagataagaatttgaaaccataacctggccgccgtgaccaggaccttcaatgtaaagcatgctcaaatcatatttattaataacacgatttagatgtgcataaataaagttttggcccggaattgtgccccagtgtccaataggcttaaccttcacatctgaatcttttaaaggctctctcaacaaaggattatcttttaaatacagctgacctaccgaaatgtagttcgttgcacgccaatatgcatcaagtttttctaaatatgttttagatgaataatctgctaacacgggtgataacgacatggtgtccactccctaagtagttttgtttgtaatttatttccggaaatttcatctacatgtacatcataacgctacgctgattaaattcaacctttttcacaagtgatacggtccaattttgtgaaattttgaacatactatgaaatataaattaaaaagacagtaaaaaagctcttacattaaaatatatagaattattaaccaataaaatttgcaataacgagacaaacgcagactccaatccttttctcaaaaacataaaaaaaagaccggagaattctccagtcttatcattagtgaaccgatacaaaggtattaaatttcaaatatttgtaatgaaatcgcatatgagaaaactcaaatggcgtaccgttatctaaaaagaacacaccttccataatacctacaggctcactttcatttaaatgtagcagcttttgatcattctcttgagacggttctgcaaaaatggataaaaaagatttggtgacggccaagttccgtgagtcttccaaataattaaaaatggacccctcgataatggtctgatttaaattctggacaattttaatggggatatagcccgtttcaatcataaaaggatcatcatcaaacagacgtaagcgaacaattttgtaaacaaaatcatgagtctccaagaacaaatcgcgctgtaactcttctgttggcggaatgacctcaaaactcaatactttgatttttggctttttaccatgcatttgaaaattatcagtgactcctagattagagccttcgtagttaaagatagattcatttcttatgtataatggattaataaatgtcccggaaccttgttttttgaaaataattccgacattctccattttagtcagagcacgtttaattgaactacgactaacctggtaagtctcactaagactacgttcatctggcaatctcatatctgcaaactttccagcaaaaattttcatcttgagatcgtcaataatttgcttatagacaaattgtgtcatatagtactcctctttcaggtcttctataactctatatagtttaccataacttgcccatttcatctcatgtttgtttctgtatgctgagtgggctttcagcggataggaagtaccctcgcttttactttacatctctatgcataataccatgattacacatacataacaccactgaacgtacctgcaaaacagcagaagatacagaacccccaccttaatatcggtaataagaccaagcctgtttcgaacctggagggatgtttgactagaccaggctaaaatccttgaatacattgttattatttatcttgttcaagcgttttctaataaaaatggtgggggggagatcatattggctatccgctacagcatcatcattccaacctataatcgagcacagcaattgttgcttacactcgcttcatttgagacacaaacctatccaaagcaactattcgaagtcattgtagctgatgacggttctacagacggaacaaaagaaatggtcgaaggcttcaaagcatcctatcctcttatctatgtgtcacatcaggaacaacgcggtcgatctgccgttcgaaatttgggactgcgccgtgcaaaagggctgtacatcatcttctgcgacgctgactttgtagtattaccggaattcattaggatcgtgagccgttatcaccgtaaatatcccaagtccgtgctttcaggcattcctcactcgtgggacgatgcttttacccattattaccctgacttttcccctgaagaaaaagaacaatgtcgcaacatacttacgcagtccaacttatggaatgctgactatgaagcagcgaacgaaattactccgatcataaccccagaagatatccttcaccaaacgggtgcactgtctaaagtagttagtcccacaagggttcctcccaatacgcagaaacaatttgcctcaacggacgtagccccctggatgctgctggttactcgttgtgtagccatcagacgcagccacttgattcgtattggaggtttcaatgaacggtttgtgctctatggactcgaggactgggaccttggctatagacttcatcgcttgaaaatccctttttattgcatcaaagaggtggtcggatatcatcaggaacatccaacctatcttagaggtaacgtgttaaatacggaaaatctgagaatcatgtatgaaacctacggattcaatgactcttcgttaaatttattcgcccttatccctccatccgaggattttgagacctacaaaaatacattgcgggtattgcgcaggggattccgctctaggctaacacgctcatcagcactgttattaagaagaacactacgcattgcagccaagcagttctacgatcaaagccatactcatgcatacaaaaaatcattacacttgataaaaaagaaggcagcgaaccggaaaagtcgagtcgctcatgtgttacgagaaatgctagtgaagtctgaaaagctggtagagtagcaagaggccggaaggacacgaaacgcatgaatttttcccgtaataaaaagactcctccatctgagagcaggccaaactcggcaagctgtcttatggaagagtcatatgcaactttttcttacttttgtttttccgttaatgttctcactttaataggatacagattcgcctcgatttgagcccgctgcggttcataccactctggcagcattaattcctgtcccaaagattcagcaggttcatcgttagcaaatcccggtggatctgtagcaatttcaaataggatgccgcccgcttctctgaaatatatcgcattaaaatattggcggtctataatgggagtcggctgatatccataatgctggactgcgtttctccattcttcatgttgttcaaaatcttttgcacgccacgcaatgtgatgtaccgtgcctgctccaccaaagcctaaacccattttggcgagcggaacatctacgatgttgccgatttctcctacggactgataacgggcatattcggcgtcttcagcgattttcgtaaatccgagtatgctctccaatgcatccatcgttctctgtgggttgacgctaaatagcacggcgcctccaaaccccttaattgctttatcagccgaaataccaccgtaagaccaagtactattcgctcccgcttcacgttcaacaagctcaaggcgtaagccctcattatcctcaaattgaagatattgttcagaaaaacggctcattttcgtaacttgaatatcaaagctttccaaacgatgctgccaaaaatcaagtgaacctggtgggaccacatacgaggttatgcccacctggccacctccgattcgtcctttggaagttcctggtgcaggaaaaaaagtaatgatcgttccaggacttcctgcttcgttaccaaagtacaagtggtaaacctcaggagcatcgaagttgattgttttcttcactaaccgaagtcccaggacgccggcatagaagtcgacattttcctgcggattaccggcaaaagctgtaatatgatggatacccgtagtttgcagtgacatatgaaaccctcctttaatcgtaggaacctttattttttgttgttgatgacttttaatgacctacacatcatgttttatctaagtaatgcatcgatggaatatgaacctgcccctgtcaacgcaataccaattacgactgcaataagaactagcggatattcatagccgttagccgttgcccagatcccgtttgggccatgtactttgaaaattgctccgagcatagtcaccgtaatcaacaatgcagccagtggagtgagtagtcctacagcaaatagagctcctcccaacaattccatcaacccagcagacactgccatgaatactccaggcttaatgccgatcgattccatccaaccgcccgtaccttttggaccatagccaccaaaccagccaaaaagtttctgtgctccgtgccccaccaataacaatccaaccaccaaacgtaccagtaacaatccgcttgccaacataaaaatcaccctccacattatatttatttaaagattattaaattagagatattagataaaattaaattcattgtttagcgactcgggcctgttcttttctaagtttttcaggcgtaacatcatctccattcggatcataaatcgtagcattcaagagaatgctctgtacagaacccctaaagatttgaaggtattctttgcgaagatccgtttgttccgttttttcaatttcagttaagccaacttcttttgctttttttgcaagctgattaattctttctaaaatggtgatcatgtatatacctccctattcataattcgctgttgttttatctttaatttatttatcttgatataaagatataacaatttcttatccgtgtcaatacttttcgaaagaaaagaagatgaacgcttgagttgcttttaaaggtgaaagaaaaaacagccggaacacttagaaatatctttaagctacaagttgtgtaaaacctcttcaactcaattactagagccataataaaaagccaccaaccagaatcactggctgatggctttcttgtcttactcaaatggaggcgaggggagtcgaacccctgtccgaagataacgacacataagcttctacgggtgtagtgacagttttgatgtcaccctagaaactccctgtcaccggattcccttcgggtcagcctgattatcttcttcagctcaccgcaggcggagatgagacagcgtattccactatttgttagcccctatcccagtcacatggacgatgctgggtagaagcacgcacacagtttcttaggctgcgaaagcgtagttgttttgttgtttgccgtttaataggctttagcgttgatgaagcggacgcgtccccactacccgctacccatgctcgaactatccccgtcgaatccataaacgcccccttattataaaagggctccacggataaaaccggaaataccggagcataagcatgcataatatcaaaagctgaatcctaggattcaacactcgaacaaagttaaaagctttaaaactgactacttcgttagtataccatattacaggtcattacgaaacgaaatgaagctatttaagccttataaaatagcaccattacaggaacaagtaacttctccaagcaatttgtaccatacccaataatacagcaacttatcttgcaattttctgcttctcgcgcaaagcacgttggatatcacgctgtgcatcgcgtttagcggcagcatcacgtttatcatactgcttcttacctctacccagtccgagtaaaagcttagcataaccattgcgaacataaatctttaacggaacaatcgtgtagccttcctgtttggacaatccgataagcttgcgaatctgttctttatgcaacagtagcttacgcgtacgggtcggatcggtaggattattacgattgccttgctcaaaaggactgatatgcatattgtgaatatgaatttcgccattacggatcgtagcaaatgcatcacttatattggagcgaccattccgtagagacttaatttctgttcccgtaagcaccatgcccgcctcgtaggtgtcctcaataaaatagtcatgggaagcttttttgttctgggcgagcactttcccgtctgccttcttacccatgaataccactccttatgaataacgtaattcactcttgaaatccaagcatcaaaatccggctacaaagagccacctagaaatatattgtaacaaatttcagatggtaaaagcaagaaaggtcaagccttctacatttcaaacggcacttatatcacacttaaaaccaagcggcttccatccaatacagcagacagaaaccgcccgtataacctatgcttcaaagtcagcttcattcactgcaatggaagctccagccttcaaagtaagtaaactctaacttcctacttcttctttttccgcacaaagcccgcggtgctattgccgccacttccgcccttattcttccgcttgcgtcgtgctgcgccttcaccgtttggtctggcatcactacctggtgtagctgctccgccgatgaaaataccgctggcagacgtcttcttccgtcgcttgcttgccccggatgctggcgagttatatccgcccttgccactgccaaagccgaagttgctagctgagccggttccagctccgtttccgccgccgcgcccggaacgacctgcggtgctaatccctccgttaccagcgccagcttcttttggcttcccggtaacatcatgaccgcctttacgctctttgccagtcttgtccttgccgcccttgcggtcacgcccttctcggcctttgcctttaccacggctctcgccacgcgcaaagtctccaccctgtcctgtaccgccagtccgttcacggcgttgccgttgcttcatatcgacaagttcaaagtcaattgtgtaatcttccatattcacacgcgcgacgcgaactttaacctcatccccaatacggaacaccttggaggtgcgttcgccgatcaacgccatatgctgctcgtcaaaatgataatagtcgtccgtaagcgcactcagacgcgtcaggccctccactgtattgtcgagctcaatgaacattccgaagctggttacactgctgatgatcccctcgaattcctcgccgaccttgtccagcatatattcagcctttttcatctgctctgtatcacgctctgcatccacagccacacgctcacgctcggaagattgctgcgcaatatcaggcatacgtgcagtcaaatattcctgacgctcggctgttaaagccccaccattctccaatacctcacgaatgacacggtgaatcaccaagtcagggtaacgacggatcggcgatgtaaaatgagagtaatactccgctgccaatccaaaatgtcctgtcgactccgcatcatactttgcctgcttcatcgaacgcagcatcatcgtgctaagcacggtttgctccttcgtaccctgaatgtcttctagcaacgtttgtagcgcacgcggatgaatggaattccctctacctttgatctgatgcccaaaattagctgcgaaagccataaagttttgcagcttctctggatctgggtcctcatgaatccggtacaagaaaggtactttgagccaatggaaatgttcggctaccgtttcattggccgccaacataaactcttcaataatttgttcagctatcgtacgatctctctttacaatatcgacagctttgccttcatcatccacaatcactttggcttcatcaaagtcaaaatcaaccgcgcctcggcgcattcgattagcacgcagcttcaatgccaattccttcatcgtgctgaatacatcaatgagatccttgtaccgttccatcagttcagcatcttcctcttcgaggattttgcgaacgttagtgtacgtcatccgttccttcgttttaatcacactggtgaaaatatcatgctttacaaccttcatatgctcattgaattccatctcacaggataaagtcagtcgatccacctgtggattcaaagaacatattccgttcgaaagtcgatgtggaagcataggaatgacacggtcaaccaaatacacgctacaaccgcggttatatgcctcctgatccagcttggagttctcacgcacataataccctacgtcggcaatatgaacgcccagacggtagtttccgttcggcaagcgctctacattgacagcatcatccaggtctttggcatcctcaccatcaatggtcacaatgatcttatcacgcagatcgcgccgtccctgacgtacaatctcttcttccgtaatcgcgtcgggagcattctcggcttcctctgtcacttcatctggaaaagcttccggaagctgatgcttacgaataactgacaaaatgtcgacgcccggatcatccttatgacccaaaacctccaacacttcgccttccgctgctgctcgtccttctggatagctcacaatacgcacaacgaccttttgaccgtttacagctccattgaagcttgtttttggaatgaaaatatcccggttaatacgcttatcatccggcaaaacgaaaccgtatgcttcgtggctctgaaacacgcctactacttgaagcactgcgcgcttcacgatccgcacaacttcgccttctaatcggccacccgcaggtcccttcgaagtcactcttaccagtaccgtatctccattcatcgcactctttaagtcgttagcatgaatatatacatccgggtgctcccggtcctctggaatcagaaaagcaaatcccttggcatgagcctgcaaacgcccacgctgcaaatccattcgttccggcacaccataacggtttgtgcgggtcagcagaattttcccctcttcctccaaggcattcaatagcttaagaaattcacggaaatcatcggcatccttaatatcaaagtgctgctccagctcctggtaagtcatgggtttgtatgcggtctcgcgcataaaatcgagtagttgttgctctgttatcataatattgtccacctcgggtgacctttaattttcagtaataaaatccgcatgtccttgttccttgctcctgatacaaggctcttaatatactcataccctagtatacacgaatttaatcgacggcatccctgcctgtccaaaatctaaaaaaagcccccgtttcccgcgaaacgaaggcttaaggtacatatttatcttattttgcaaaaaatgcaactaaaacagaaacgatcatgaaacccgcacccaaaacagcagttgcgcgttgtaaaatcaaatccataccgcgagcttttgtcttgccgaacagatgctcagcaccgccagagatggcaccggacaaacctgcgcttttccccttttgcagtaaaacaaccgcaataacagcaatcgagaacacaacgagcagcactttcaaaaagatttccatgaaaaatcccacctcctgagcttatacatctgttttgcaaaacaacacagcctcttttatgaaaacatgtacatatcatgttataaatagccggaaattaacgcaaaacactatttctattctaccacagcttccagtagataacaacagctatagcaagtcactcagccattaagcctttgcaaagttataaattctcatacacatccataataacaaaaaacagacctgctcgcggtggcgagtaggcctgttttattcatgcgaaaaagctttgagcgttcagacttcatgatcataaaccatgagtcaagagacgccatcagcatttttgcgcaatattattttttcaggttgtagaaagatttcaggccgtggtattgagccagttcacccagttgatcctcaatgcggagcaattggttgtacttcgcaatacggtcagtacgggaaggagcacctgttttaatttggcctgcatttgttgcaacagcgatatcagcgattgtgctgtcttcggattcaccggaacggtgagagataacagctgtgtatcctgcacgtttagccaattcgatagcatcgaatgtttcagtcagcgtaccgatttggtttactttgatcaggatagagttaccgatgttttcatcgatacctttagccagacgctctgtgtttgttacgaacaggtcgtcaccaaccaattggattttgttgcccaatttttcagtgagcaatttccaaccttcccagtcatcttcggagcaaccatcttcaatagtgatgattgggtatttatcaacccaagaagcaagcaggtcaacgaactcagcagaagtgaaggatttgccttcgccttccaaagtgtattttccatctttgaagaactcagtggaggcaacgtccataccgaggaatacgtcaacacctggtttgtaaccagctttttcgatcgcttcgataatagtggacagagcttcttcgttagatttgaagttaggagcaaaaccaccttcatcaccaacagctgtgttcaaacctttggagttcagtacggatttcaggttgtggaagatttctgcgcctacacgcagagcttctttaaatgtaggagcgcctacaggcagaaccatgaactcttgtacgtcaacgttattgtcggcatgagcgccaccgttaacgatgttcatcattggtactggcaattgtttagcattgaatccacccaggtaagtgtacagtggcaagcccagagcttcagcagcagcgcgagctacagccatggatactgccaaaattgcgtttgcacccaatttacctttgttatgtgtaccatccaatttgatcatcagcgtgtcgatttctacttggttcacagcatccaagccgattacttcaggagcaataatttcgttcacgtttttaacagcttgcagaacgcctttacccaggtaacgggatttgtcgttatcacgaagctctacagcttcgtgagctcctgtggaggcaccggaaggaacgatagcactaccgatagcaccggattccagatatacttcaacttcaaccgtagggttaccacgggagtcgaggacttcgcgagcgtacacgtcagaaataatagtcatttgtacttaatctcctttgtgaatcatgatttattggtcaagcctatacttattaaatcaagcttacttgcgggatgcaatcatagattttcctgtcatttccgcaggttgcggaagttgcatcaaatccagaagcgttggagctacgtcagccagtattccatgctcacgcaaaacgatattttcgtcagtcaaaatgaacggaaccggattagttgtgtgagctgtgaacggacgtccctgctcatcaatttccatatccgcgttaccatggtcagcaatgataataaccacgccgcctttggctttaaccgcatctacaacacgtccaacacattcatccgtcgtctctaccgccttaatcgttggctccagcataccggagtgtccaaccatatccggattggcaaagttcaggataatcgcatcatgcttgtcggcttcgatttctttaacagcagcatccgctacttcatacgcactcatttccggctgcaagtcatatgtagccactttaggcgagttgatcaaaatacgagtttcgccaggaagctccacatcgcgtccgccactgaaaaagaaagtaacgtgcggatatttttcagtctcagcaatacgcaattgttttttgttgttttgaaccaacacttcaccaaacgtgttatccaggtttttcggttcgtaagctacaaagccttcaaccgtttcgctgaacaacgtcaggcaaacaaagtgcaaatctttaggccatttcgggccacggtcaaaaccacggaagtccgcgtttgtaaatacctgagacagttgaatcgcacggtcaggacggaaattgaggaagataacagagtcattgctttcgaccagccctacaggacttccgtcagccttcacaataacagttggctccacaaattcgtcgaacactgatttttcatacgattctttcaatgcttccattggatctgtgtattgaggaccttctccgtacacgattgcacggtaggatttctctacacgttcccaacgtttgtcgcggtccatagcataatagcgtccttgtacagtcgcaattttacctacgcccacttcttgaattttagcgatcagctgctgcatgaagcctacgccgctgtcaggcataacatcgcgtccatccatgaaagcatgaatgtacacttctgttaagccttcttttttcgccaagtccagcatagcgaacagatggctgatatggctatgcacgccgccgtcggacagaagtccgtacaggtgaagtttcgtgttgttcttcttggcatgttgcactgctttaaccagtgtttcattgtcgtagaattcaccttcacggatggacttcgaaatacgagtcaagtcttgatatacaattcggcctgcgccgatgttcaagtgacctacttcggagttacccatttgtccttcaggcagacccactgcttcgccagaagccgtcagcgttgtatgaggatactgttgtaaataccggtcgtaattcggtttgttggcctgcgcaaccgcattaccttctacggtgtcacgcaatccgaacccgtccataataattaaagctaccggttttggtgctgtcatcttacttcgccccctcaacaagcgcgatgtacgacgccggttgaagactggcaccgcccacgagcgcgccgtcgatatcgctttgacccaggtactcagtaacattttcaggttttacactgccaccatactgaatacgtacagcatttgctgtattttcatcatacagctctttaatcagactgcggatataggaaatcacttcattcgcgtcctgcgaagtggaggatttgcctgttccgatggcccagatcggctcataagcaacaactacttgtgcagcctgatccttagccaaaccagcaaaagctgctacagtttgcacttttacaacctctttggtttgtccagcttcacgatcttccagcttttcgcctacacacacgattggagtcaggccatgacggaatgccgcatgaacctttttgttcaccgtttcgtctgtttcattaaaatattcacgacgctcggagtgtccgatcacaacgtaatctacgcccagatctttcagcattccaccgctaatttcacctgtaaaggcaccatcttctgcaaagtgcaggttttgtgcgccaattttaatagacgtaccttttactgcttcaaccagggcaggaagattcgtaaatggtgcgcaaatcacgctttccactcctgcaacctctgctttgcctttgatctcttcgatgaaagttttagcttctggtactgttttaaacatcttccagttacccgcgataatcggtgttctcaatggtttcaactcctaactattaggtgccctaaagctttattcacgcatagtgcgtttgattatttatcgttcagtgcaacaacacccggaagtgctttgccttccataaattccagtgatgcgccaccgccagtggagatatgatccattttatcagccaagtggaatttttcagccgcagccgcagaatcaccgccaccaatgatggtgtatgcttcagttgttgcgcaagcttccgctacttcacgagtaccaccagcgaaaggctcgatttcaaatacgcccattggtccgttccatacaaccagtttggagtttttgatcacatctgcatagattttacgtgttttcggtccaatgtccacgccttcccaatctgcaggaatgccgtcgatatccacaatgtccgtgttcgccgtagcgctgaaatcgtcagatactacaatatcaaccggaagatagaagtttttgccgagcttcttcgctttttcaataaatccaagagctacgtccagtttggattcatccagcaaagattgacccacttcatgaccttgagctttgaagaatgtataagtcaaaccgccaccaatgattacgttatctgcaatgttcagcaagttgtcgatcacgtcgattttgtcttttactttggaaccgccaataatggctgtaaaaggacggtctggattcgacagagccttaccaataacagacaattctctttccatcagcaagccagaaacagccggaagaatatgagcgataccttcagtggaagcatgagcacggtgtgctgcaccaaatgcgtcattcacgaaaacgtcggccagttcagcaaattgcttcgccaattcaggatcattcttttcttctcctgcataaaaacgtacattttcaagcaacagcacgtcgccgttttgcagttcagccactttcgctttaacagcttcgcctaccgattcgtccactttaactactggctttttcagcagctcagacaaacgtacgccaacaggagtcagacgcatggattcaacaacctgaccttttggacgtccaaagtgactcgccaaaataacttttgcacctttttcaatcaagtagttaatggttggcaaggtttcacgaatacgcttgtcatccgtaattttaccgtcctcaaccggaacgttaaaatctacacgaacaaacacccgttttccattcagttctatatcacgtacgctctttttgttcatctccatattcctccgcacccttataattttacgaaacaggaatttaaggcacatttgatatataaagagcggaaacaataacctgtttccgctctatgttattgctcaataagactgttcttatttagccagttttgcgaagtattccaacgtgcggatcaattgtgcagtgtaggacatttcgttgtcataccaagctacagttttcaccagttgtttgtcgccaacagtcagaactttagtttgagttgcatcaaataaagaaccgtaagtgatacctttgatgtcggaagaaacgatttgatcttcagtgtatccaaaagtatcagcatcagaagcttctttcattgctgcgttgatttcttcagcagttacgtttttctccagaactgttaccaactcagtcagggaaccagttgctactggaacacgttgagccgcgccatccagtttacctttcagttcaggaattaccagaccgatggcttttgcagcaccagttgtgttaggaatgatgttttcagctgctgcgcgagcacgacggaagtcacctttagcatgtggagcatccaaagtgttttggtcgccagtgtaagcgtgaattgtagtcatcaaaccttcgatgataccgaatttgtcttgcagtgttttagccataggagccaggcagtttgttgtgcaagaagcaccggagattacagtttcagtaccgtccagaatttcatggtttacgttataaacgacagttttcatgtcgccagtagctggagcggaaataacaacttttttagcgccgcctttcaaatgtttctcagcagcttctttagttgtgaagaaacctgtgcattccagaacgatatctacacccaggtctccccaaggcagttcttcagggttgcggttagccaaaactttaacttctttaccgtttactttgaagaagccgtcatgtacttctacttctccttggaaagtaccttgtgttgtatcatatttcaacaaatgtgccaacattttggaatctgtcaagtcattgattgctactacttcaataccttccacgttttgaatccggcggaaagcaaggcgtccaatacgtccgaaaccgttaataccaactttaactgtcatgagtgagttcctcccaaagttcgtttagtttagttttatatattcaagacagacccgaaagcccgtcaagacaacaccattcataaatccatcttaaccatttaaataatgacttacaatctcggcagcagcgccttcgtcggtgactagaatgtcttcttgtccgaaacgcagtaccgcatgaatagcggccgccttgctcttgcctccagctacgcctaaaaccgtatcggtacgcctgatgtcctctaatcgaagtccaagcgtcagcattctgtgaacaacgacgccatcttcgttaaagtaataaccaaacgattcggcaacggccccctcactgctgatctgggcgaaggtttcgggatcaagtttacgtctatgtgccatcgctatggcgttgcctatcccgtgaatgatgatacgactctcgcgaatcaggttcaatatatcctgaatgttcgtatcttcaagcaaggagttgtaagcatgattgctgagcaaatccggtacatggagcagacggtattgagcgcctaccttgcgagccattgtggaagcaattgtgttggcctgcatttccatgctttctcccaaacccccgcgtgccggtacaaaccacccacccttaagtgggccattagaaggtagtgccagttgttccgccacgtcggcaatcgtcgtgccacctgttacagcgaccacatcctcgtcgtccataacactcagcaacgcttttgctccagcgcgccccagctcctgctttgttaacggagaagcatccgaatcccctggaacgacaaccaccttcctcaaaccataggcttgacgaatctggtcctccaattgggacaggccgaacaagttgttcgcaatcggctccagctgttccagcagatccagtcctgctttgctcaccttcatgcctacactctcaatctcaattagcccttgagctttaagaagatcggtttcggcgcgcaacacgcgctcagtcatgttcagtgaagctgccagtgttctgcgtccaactacatcggacagcataatctgatgcaggatcgtgtacctttttttcaaaacatccatgaggtcgggcagaagctgcttctgtatttctaatatctttcgcatgctttccactcccgcacacttcaaagttctgtctataagctatatctctaactggtctcaaaatgtcccgggataactttttaagtcccacgtatatcttaaccaatatttgctccacatgcaagtctatctgaacctatatttctcaactttttatgtgaatatgcgcacgtaataaaagcttgcaattcaatgccgtatatcatataatcatctttgtttccaattagctgtttaattagttggttgtttgcattgattgaactatgcgcccgtggtccaacggatatgacgtaggcctccggagcctgagatcgaggttcgattcctcgcgggcgcgccattttaaatgaacgcataaatgcttctacataatgttttaaccaataagagcgctgagggctcttttttttaatcattagtttgactttctttgactttttgtttgaaattgtttatcatgtggttaatacggtaacagtttataaataagggacgtgtaatcggcatgtccaccaaatccactaacgatatttaagggaggttttttgacgtgagctatgttcctatggtagtagaacaaagtaaccgcggcgaacgcgcctatgacatttattccagactgttgaaggatcgcattattttgttaggctcggacgtcaatgacgttgtagccaactctattattgcgcaaatgctgtttttggctgccgaagatcctgaaaaagatattcacttgtatgttaacagtcctggcggttccattacagctggtatggccattttcgatacgatgcaatacattaaacctgacgtatctacgatttgcgtaggtatggcggcttccatgggcgcgttcttgctaaatgcaggtgccaaaggtaaacgtttcgctttgccaaacagtgaaattatgattcaccaaccactgggtggtgcacaaggccaggcaacggatattgaaatccgtgcacgccgcattctgaaaatgcgtgacaaattgaaccgcattctcgcagatcgcacaggccaaccactggagcgcattgaaaaagacacagaccgtgactacttcatgtccgctgatgatgccaaggaatacggtattattgataaagtgctaactagctcctctccagaaggtgtataagagaagaaattcgcctctcgatagctggtaaatgaaaaagctgccccggatgttcttatccggtaggcagctttttttgctttattgttttttaggttatagacaattggaattgtttactcctactattcatgctgtcccgcaaaaggctttccgccttgaggcagcagttgaccgaacgagtaggtaaactccggaattccatacgcgtatggcgcataatcatacaaatcaaacacaattgttactccactgtttgttacataaaaattctgatctgccgccagctctttaaatttctcgaatccttcgccagcctgaagcgcatcgatttttttcttcaaatcagcattgaggaactttttatagttcggatttgccttcaaaacgtcagacaattgcagcagtttaccatcagcgagcgagaacgtatatcctttacgtgccgtcatgccatgtgcgccacccgtatacgagtaatcctgcataatcacactcagaataccatttttgttataggcaatcgcaaagtcatttccgaactcatacggtctttctgttgtagcctcaccctcagccatcatctttttgcctgctaccaatataccctctgcatgctttttaagcacattgttaatggcctgttgagcctcaggattcagctgactgccgctgatttgcgggtacttaatcttgtaggacaccttcgcattactcgaagctggaagtgtttgagacgcaatggtgatcggatttagctggcttttactcagcgttactgttttctgagcagcattccattgagcatctatgcctagatagtctttcagcagactcataggaatgtatagcttcccagcgatctgtttggcatccatgctacgtgtattgattccattgacgttgacgtaggcatccgaggaagaagccataatgtaaagtttattgtacccgctacctacggtatatgtcgttgttttcgcatcatagcttactggaatccccaggctgtcacgcagtgcggccaccggaatcattgtactcccattcacttgaacacctttagcgggcaacgttttaccattccattggatggtgattcccggttgctgtgttgtcgcttgtttggtcgatgctgcctggatataggaaacgggaacagctgcgactcctgctaaaatccctgctaccagcagtgctgaaccccattttttcgcatgcttactcatattaagtattcctcctgttattgatctgtattgtgtatgtgtgataattacttttcttattatatctataccctattgtatgtagtttacaatccgtacactctccgatttcaatatgtacacctaataacccttagctatgacagactcattacaaaaaggtttcgatatacaaaaagagccagcaagccagcctacgcatgatgcaggccgcttgtggcttcgtttgatgatctgtattagttcatttcgtactgagccgacacctgaactttcactgttacttgtcccgattggatctctgtcccgccacctgctacgtccaagagcgattttgacatggcattttcacgttgtgtaaagacttgtgcttctccgccatctaccgtcacactcacaagggcacctaacccgtgtttggctgctttagctacagcactggctttagattgtgcgcttcccaatgccttagtaatggcttcctcttcataagtcgaaggatcttccacggaaaaacatacattatccacgttgttggctccggacttggtcgcctcatccaataactgaccgattttatccaaatcgcggtatttgacggaaagtgtatggttggcagtgtaccctttgagcttttgcccttctttttcgttataggtgtagttaggctgtacataaaactggctggtctgaatgtcatctgcgctgatgctccaattttctttcagcagttgtgtaaccttgttcaattttgtagcattggctttttgagcagcggctgccgtattcccttctgattgtacaccgatagagagataagcaatattaggcttcgccattacttccccgcttccagtcacattaattacaccgtttaccgtcgaagctgttgacgcagcataggcacgatcttcccctgtccataatcctcctgctactccccctgccattaatgctcctgcgagaactgccgtggctactgtttttgtccaaagtctcattgaattcaacctctttcttgtaaatgtttgtaccttccagacggaaatgacgaaaaaaggttgcagccaagcatacatatttcctaaacagagcatgaccacggaaattttaattatttataacttgaacttaatacggtctctatattcaacaaatccacacatagaacagttaacggaggagcgttcgaagacttttttctggatacaaaaaaagccccaaaggggcttttcactaagagcatacatcatattacaaagcaaatctttgtttattgattttccagctctaccttactaaccaaacttactaaagcgtttacagcctgttcggcgtccgcaccttcagcactaatattgatttcagtacctgtactgatggcaagactcataatacccatgatgctcttggcattaacctttttgtcttctttttccacaaaaatctcagatgaatatttattcgcttcctgtacgaacaacgcagcaggtctggcgtgcagtcctgttttcaagcgtacgactaccggatgttttgacatgtcagcttaccccctcatcaaataaatctggacactacttactccattttatttatcacattataacattaacccgggacagacactagaaaaaaaactaaaaaaaccggggctaaaagccccacggacactctttttacggaatcaggccattttcgcccctaattttgtcagccatctcatcaattttgcgaagccgatgatttacacccgatttactcacgacccctttaagcatttccccgacttctttcaaattcaaatcgggatgagcgagccgaatttctgccacttcacgcagtttatccggcaaggtctccaaaccaacttccctctccagcaacttaatattctcaatttgccggacagcagctccgatcgtcttgttcaaattagccgtttcacaattgacaatgcgatttacggaattgcgcatatcgcgcataatgcgtacatcttcaaatttgaacaaggcttgatgcgccccaatgatgctgagcagctcaatgatcttctcgccttccttgatgtagagaataaaacctttttttcgctcaatacagcgagcatttagatgaaattcattcgcaagatcaacgagtgcctgacaatgctcctcatacatcgaagaaatttcaaggtggtaagacgatccttcaggattgttgacagagccacctgccataaaggcgccccgcaaataagccctcttacaacagtttttccgaacgatatcccgattaatcccgtcagtgaataagaaaccttctgtgacgatataaagatcctttagcagttgctgcacaccattgggaatacggacaatgtacacattattttttttcaagcgcatttttttccgtacaagcagttcgatatgaagttgaaaatgcttcttgatcaaggagtaaatccgccttgcaatcgcggcattttctgtggacacgtccaatatcacccttttattcgacagttgtacggatccgagcatacgtatgagcgcagatagttccgctttctcacagcaggactggctttcaatcatcgtaagctcttttttcgtttgtgccgcaaaggacaagggactcacctccttcttaatatccagttttgtaccaattggtaaatatgctggctcaatttgtcggcatcatgccgtaaatacgtgcggaacagaactaatgtatctgccaccactttatatccccggtcggtcagctcgcccatgtctacttgaactggcttggctccctgctcggcatacatttcctgtacttggggtggaatttctccgttatttacaatgacatagtcgaagagatgatgccctacatgctcaaaaatagcttgcaggtgatctcctaccgtataaccatcggtttcgccaggctgggtcataacgttacagacaaatattttgatagcgtctgattttactacagcttcagcaagtttaggtacaagcaaattcggtaatatgctggtatatagactgccggggccaatcaaaatcgcatcggcttcattaatggcctctacagcctcaggcaacggctccacgtgagtcggttcaagaaagacgcgtttgatgcgtccgcccgcttccgggatcttggactccccggtaatcaccgtaccatcctccatctcggcgcttagcacaacgccttcctcggctgccggtagcacacgtccccggacagcaaatacacggctaagctcacgcaccgccgttacgaaatctcccgatatatcggtcatcgctgctaaaatcagattacccaggctatggcctgacaatcctgatcccgcaccgaaacggtatttcagcatatctgacatcactggttccacgtcagccaaggcagtcagcacattgcgaatatcccctggagggggcatctgcagctcactgcgcaaaatcccggaacttccgccatcgtcagcgactgtaacaatagccgtaatatctagcggcttttgctttaagccccgcagcatgacggacaagccggttccgccgcccataacaacaatacgtgggcgctcccgttgtgatccggtctctttcatgatttcacctcattaatgccggtcccgatcagcatcccgatgcgaaacagaaacagattctgtctcgctggcacccagcatttttcctaaatactccgatattgcaacagaacgatgcttaccgccagtacagccaatgccgataatgacctggcttttgccttctttgcgatattgcggaatcaaaaagtgtaacatatccagcaacttggtcaagaatgcctgagtctcgggccatttcatgacataatcatatacatcgctatcctgtcccgtgtggggacgtagttggtccacatagtggggattaggcaggaagcgcacatcgaatataagatcggcatcaatgggaataccatacttgaagccaaaagaagtaatgttcacggaaagcatactactctccagatgagaaaatcgtgaaataatcctcgcctttaaggttgcaggcttcatcacacttgtatcaataacctgtgtagctgagctttttaattcttccaacatcttgcgctccaaccgaatcccatccaaaggcatgccgtctggagccaacggatgacgtctacggctttccttataccgctgtacgagaacgccatcattcgcatttaagaataaaatttcacaatggatcgtaaaatgatctttaatataattcaaagattccgacaaggcagtgaaaaattctcgtccgcgtaaatcaattacgagtgccaccttgcctattttaccgttcgactgctcaatcaactcggcaaatttgggaatcagtacagggggcaaattatcaacgcagaagaagcccaagtcttccaggctctgaaccgcaatggtcttccctgcgcctgacatccccgtaataataatgagcgttgcccacggcgcagcattttttaggttgtctgtcatatggacttccctctccttttgcttcttcgctctataccagtacccgtattatcaataacctgtggatcaggagcgtagcagcaaccctgcagcccctacgatacctgcgtcattgcctaacaccgctggtacgatatatacacccttttgaagcggttcaggtgccagcttggcgtatacgcgacgcatctcttcaaataaaaagtcgcctgctttagaaacaccgccgcctataataaacaactctggattaagcacagcggcaaccgctgccatggatttccccaaataaaaggcagcccggttcacaatacgcagcgcgacttcatctccagctttagcagcatcaaatacttccttggcagcaatttgatcttccagcgccagagaggtccggtcgccacgttccacagcgtccttggccatacgaatgatgcctgttgcggaagatacagtttccaagcaacccattttgccgcacccacactgaatagcctccagatcaggtacgacactgatatggccaatttctccggccatgcccgaagaaccttggtatattttaccgtttataataataccgccacctacgcctgttcccagggtatagcatacgcagttttctatgcctttgcctgcaccagcccaagcctcacccagcgcagcaacattcgcatcgttgtctattttcacaggcttgccaatccggttctctaggagcgcacggatcggtacgtcacgaaagccaatattaggagcgaggacaataataccatcacgaacattcgtaaaacctgcaacgcctgcaccgacaccctttagttgatcccactcataaggagattgctcaacaatatgccgcacatatttttcgatattaccgatgacaacgtctacacctttatcggtttcggttggtccctcatatgtgtgcaaaagctgtccgttttcattacaaatgccgactttaatcgcggtaccgcccaaatcgacacctacatagatactttcagacatgttccaagccacctttgtgtttacttaaaaacctggtatgaaatatacgattacaattcctacttcataatagtattcctacgttccaactataattgaagcccccgttacggtcaaggacacttccttgttgaaaagtgtacgattagcggaacttttaacctcatgcacccataaaaaggagaaagcctgtgcaaacgcagcaggctttctcttcctgaacaaaagatacggcataacagaggcttccttcgctctcccgttagcctttttgtgtactatagtcactcttttattgatccagtgtttcgctccagtcgtgaacagcactgccttcgagatacttctcgcagtccatagccgccatacagcccgttcccgcagccgtaatagcttgccggtaacggttatcctgtacatccccacaggcaaaaactccggggatattcgtttctgttgtgcctggcttcaccacaatatagccgtgttcatcggtatggatttgtccgttcaggaaacctgtgttcggtgtatgaccgatggctacgaatacgccatctacctcaatcagctcatcctgattggtctcattattgtgtaccttcaaaccctttaaaccagcttctcccgtcacaacttccagaggagtccggtttaatgcccaatgtactttttcgttctcacgcgcgcgatcttgcataattttggacgcccgcaactcatcgcgacgatggaccaaggttacactggaagcaaaacgggtcaagaagctcgcttcctccatggctgaatcgccaccgccaaccacgacaatctttttcccgcggaaaaagaagccatcgcaagttgcgcacgtgctgactccgcgacctacattgtcttgctcgcccggaatgcctagatatttggcggacgcacctgtagcaataatgaccgactccgcctcaatgatgcctttaccctctaccttcactttaaaaggacgtttgctgaaatccacttcctcaacccaaccggaagtaaattcagcgccaaaacgttcagcctgcttgcgcatattatccatcagttcaggcccgaggataccttgctcaaaacccgggaaattttcaatttcggtcgttgtagtaagctgcccaccgggctgcatcccttcaatgatcagcggattcatgttagcgcgtgccaaataaatagcggctgtgtagcctgcaggacctgtaccaataattatggatttatacatacgtttgttgcctcctttaagtgatgtttggagcaggtctcagacctgctttttaaacgtggagagcggctgcttcagcttctgtttgataccacacacgctgtcaatctggcgtgcatagcggcttacggtcgatacggaaataccataacgatcggctacttcctgataggtgactgaatgatgatgcattttagctgtcaaatattccagcgccgctgcccatccctcagtatgctgaaccatcggaacttccggggcaagccgatccaaatactccagccaaagcgatctcaaatcgtgctgcatggccggatctgatggcctgctcatgacggtcagtaccttatccagcactgcctgccattgtggatcgaccggggaagcagatacaccaccttcaattgtatgcggatcgttctcaacctccaactgatcagaatgttccgtttccgggtacattttctgctcaccctgctccgccagttcttgcaatacttgcaaggcacggcgtttcagctcatcctcctggtccgggtcttctacgaaggactccagtgcctgacgcacctcatcatcaccgatcaagcttaacgcctgaatgacctgaagctgagtcgcccgatccccgtggcgcaaggcccagaagaaggatgaccggattagcgggtccttcttcatactgtcaggcacctggtcagcaccaaacttctcccacatgcggaattgctcctcaaacgggagatgataatgatagctgagcacttgcagcggtgtaccctcctgctggagttcctccagtcgggacaggaaaaaccgcggaacttccgaggtagcatcctgtttttgcaaatgactccacaaccgccgagcttccgcatatcttccggtattgctagcagctaccgccgtgtaatggtacaaagaagcatccgcattgttctctccatcgccatgaagcaacctgcggaaatgtctataggcctcctcatggcgtccgagaatccccatagtggtcgccagcttgaatacctgctcctcctgaaacggtatagtaaccgccaaagtctgcaccagacgatccaattccgggccgccgccctcgtgctgataaaagatcgccaagttgcacaatgcgtgtaaattacccggctcatcttccagcacttgaataatggtagccttagcattttggaacaatcccatgtagtaatacgccagcgccagattattccgcgcagcgaacatatccggttgttcctctgaaatttgcttgagcaactgggctgcctgagcaaatttcccctcctccagcaggacacgagcctgatcatgctctactactccctgccgggccttaatgcggttcagcttcgttggacggtccagctcataatagagcagctccatcatttcctccgcttcatcaagaaactggccttcttcgtcctcctccaggtacgtgaccaatgctttctccgcttcttcaaactgctccatattagcgtaattattcgccatatagaaataacactctgtcatcgacgagtctacgtcactcagaacagaggacaggatctcattcgaacctgcataatcccccatctctgataatatacccgccatattgcaatgattcaccggattatccggttcatattcaacggctttgcgaaaatatttcaatgccttgtcataatgattgcgatcaagcgagcgcacagctttctcaaaaaagaaagatgcgtcgaaacgcaaagcaataattttagggctaggttccgatactcgcagatgtttccctttcataaataaccaaggcacctcctttaaaagtaactggcatgttcatacccttcagtataccacaacttcaaaacgacttgacagtcgatcctgcctcattccaaaaatcggatacactcttgtatacctatagatatgtatataagaatacgctaaatagccgagcgctttttccctgtagaaatagggagcgttcggctaaccactggaaatgatacttagacccaataaacgtaataattaaagcgtcagcggcaccagcgagcgctcgcgatgctgaaatacggcaagctcgcgatagccgacttcatatagaagcgcgcgtgccttctccaagtgctcggacagcttcgccggatcatgagcatccgatccgacggtcagcgggatgcctagcgaaaaagcttcttccagcatgcggcggctcgggaacatctcggcacagggcttcgaaagccctgatgcattcagttccatcgcccgaccgctacgggcaacggctgaaattgcggcacgctccagttcacacagctcctccatttcctccggcctcggatgatagccgaagcgcttaatgacatccagatgacccatgatgtcatacaaaccggtagctgccgccttggaaaccgcatcataatacgtgcggtacacctcaagcacatttttgccttcccaatggtgtacctgacggaagtccgtgacatcccattcaccgagaaagtggacggaaccaatcacataatcccagggatacgcggtgatgatgtcttcgatttctcgttcccagccctcgatgtagtcgccttccaagccaacacgaatatcaatttgccctttaaaacgttccttcagttccaaacattcttccacgtatcggggcagctcctccataggcattgccatttccggataatagtcagccggttttacatgcagtagtggcatgtgatcggacaagccgagctgatccagccctagccgaattccctgctgtacatactcttccagactccctatggcatgcccgcagcgggcgtgatgcgtatgatagtcaattttcatgcggctccccccctttcaacactacaacagcactacaacaaaccgtactaatcacgacgaggacgttcatggcggcgattcaactcagccagcacgtcatcgagcggtagcttgcgctcctgcaacagcaccagcaggtgataaatcaaatcgctgacctccaggcgcagttcgtcattatctttatttttggcggcaatgattgtctcggatgcttcttcgccaacctttttcaagattttgtctacacctttatcaaaaagataagtcgtgtaggccccttcaggacgtgtctcttcgcgctccttaataatcgcctccagctgggcaagtacctcaaagcggtctgctgaagcactggaaacatcatttaccaacgtgtggtctcctgcttttcctgcaacaggtgctacagccgttcctggcgcggaaatattacgaaaaaaacagctcgttgctcctgtatgacaggcaggaccgctcggaatgacacgtaccaacagggcatcaccgtcacaatccagctggatggaggtgattttttgcgtattccccgaagtagcccccttgtgccacagctcctgtctggaacgtgaccagaaccaggtctctcccgactccaaagatagtttcagcgactcgcggttcatgtaggccagcgtaagcacctggagcgtagcatcatcctgcacaatcgccgagacaagtcctgcctcattccagcgtacattatccagtatctgctccagagatagctgttggttcaattcgttgctcatcgtatctccactcctctgcgcttcaaatcccgttttagctcagggattcctatttctttataatgaaaaatcgttgctgctaacccagcatccgctttgcccgccgtaaacacgtcatagaaatgctcctgtttgcctgctccgccagaagcgataactggaatcccgacggtatccgataccgcggaagtcagtggcaggtcaaagccgtccttggttccgtccgcattcatgctggtcagcagaatctcaccggctcccaactgttcagcttccttggcccaggccaaggctcggataccagatggcgtgcggcctccgtgcgtatacacttcccactcgccccacgcctcgttgtacttggcatcaatggcaacaacgatacattgtgagccaaagctgcgcgcaccctccgcaatcagctgagggttacggacagctgccgtatttacgccgattttatcagctccggcacgcaaaatgcgtttcatatcatcgacatgagatatcccgccacctacggtgaaaggaatggcaatttccccggctgtctgacgaactacttcttccatggtggcacgcccttcaactgaagcagaaatatccagaaatacgatttcgtccgccccttctcgatcataaagtgccgccaattccaccggatcgcctgcatcgcgtaagttcacaaaattaacgcccttaaccaccctgccatcctttacatccaagcagggaataatacgtttagccagcatgcctactccccctatgcctttgctacagcttgtacggcgacctgtaaatcaatgctgcccgtatacaatgccttacccacaatagcaccgcctacaccctctttcgcataggtgctcagcgtgattagatcgtccatcttgctgacaccgccggaagcgatcacggttcgtccactgcttttcgcaagcgctacgatcgcctccacattcgggccttgcatcattccgtcgcgggaaatgtctgtaaaaatgaacgtttccgctcccttggaggccaactcagcagccaattcgtccgctcgaacctccgaggtttcaagccatccgcgggtggccacatagccattccgtgcatccagaccaatggcgatccgatcaccgtaggtacccaatactgcttccgtaaaagcacggtcctcaatcgctgccgtacccaagatcacacggctcacgcccagcgacaacagtcgctctacatgttcacgtgtacgcaagccgccacccacttgtacaggcacttgcaccgcagaagcaatgcgcccaataagctcatcgttcaccggttgacctgctttagcaccgtccaaatcaactaaatgaatgtaagagccgcccaaacgctcccattcttgggcaacctccaccgggttttcgttgtatatcgtctcctggttataatctccttgtaccagtcgtacacatttgccatctcgaatatcaatcgccgggtatatcgtgaacaaagtatgacccccttgtgagctattcaacatctatatgccattacatcaatcaacgaccaaagttggcgtaccaccaattgcagacccatgaatcgtttacgctcgcttttccgcttccgctagttccaaaaactgacgaagcagtcgcatccccatctccccgcttttctctgggtggaactgcatgccatatacatggcctctgcctacgatagctgttacgggcccaccataatcggtcaccgccagcaggtcactttcgacctccggcttcgcatgataggaatgtacaaaatacacatgtccttcctccaagccctgtaacaacgggtgatccggctgagtcatacacagacgattccaacccatatgcggcactttaacctccagatcaggagcaaatcgaacgacctcgcctggtaaaatattaagcccttcgtgactgccgtattcttcaccacgagtgaacaacagttgcattcctagacaaacaccgagcagtggttgtccagcgctggcaacctcctgaattacccgatccaatccgctggaacgcaaatgctccatagcatccccgaatgcccctacgcctggcaaaatcacaccgctggaggaacgaatcacttgggcatctcctgttactatagcctcatagccaagacgctcaacggccttgctcacactatgcagattgcctctgccgtaatccacaatagcaatggacatggactacagcactcccttcgttgaaggcactcccgtcacccgcggatcaatggatgtcgcttcatccagtgcacgtcccagcgctttgaacaccgcctcaatcatatggtgggtattttgcccgtagtgaacgatgacgtgtagcgtcatgcgagcctccaacgcaaatttccacagaaattcatgcaccagctccgtcgaaaaactccctacctgctgtgacggatactccgcacgatactcaaagtgagggcggttactcagatcaatgacaacctgcgcgagcgcctcatccatcggtacaaagacgctggcgtagcgcttgattccttttttatcacccaacgcttccagcaaggtttgccccagacaaataccaatatcctctacggtatgatgatcgtcgatatcaatatcccctctggcctgtacattcaggtcaaagtgtccgtgcttggtgaacaaatccagcatgtgattcagaaacggaacatccgtttcaatttcagcctgccctgtgccatctactgcaaaagatagctgaatatccgtttcgttcgtctttcggctgacgctgcctgtacgttctgttacgttattttcgttccccatcgccatccaccgccttcttttcattgtccaatcgaacttgtatcgcccgtgcgtgtccttccagtccttcatggcgggcaagctgcataatcgtctctccattgcgcagcagtgcttccttgctgtaatagatcatactcgacttcttgataaaatcatcaatatccactggcgaagaaaaccgcgccgttccattcgtcgggataatgtggttaggtccggcaaaataatcgcctactggctccgagctgtatgctcccaggaaaatagctcccgcgttttcaatcagacccacatgctccatcggctgctctgtcataatttccaaatgttccggcgccagtcggtttacaatatggatgccctcttccaaagtgtcgacgacaatgatagccccatatgcctccaccgatgcagcagcaatatctctgcgcggcagctccgccaattggcgctgtacttcacctgatacatcttcggccaagcgttgcgaaggcgtaaccagtatggctgaggccatttcgtcatgttctgcttgtgaaagcaggtcagctgctacataagaggcatttgctgtatcgtcagccaacacaacaatttcacttggtcccgctatactgtcgatatccaccgcgccatacacctcgcgcttcgccaacgctacataaatgttgccgggaccgcaaattttatcgactggctcaatgctatgtgttccgtaagcgagagaggcgatcgcctgcgctccgccaaccctatatatttccgttacaccagcctctgccgcagctaccagtgtatatggatctatccctgctttgccgcctgtcgccgggggtgtcaccatgacaatctccggtacaccagccacctgagcgggaatgacattcatcagcactgaggatggataggctgctttaccgcccggaacatacacgcctacacgtttcaacggtcggataatttgaccgagcaagctaccatctggctgtaagtccatccacgaattacgtttttgcttcacgtgaaaagcacggatattatccgccgcctctcgaatcgcctgtaaaaaagaaggctctaccttatcatatgccgccttcaattcttcctccgtcacacgaagttgctctgctatcagcgatacactatcaaacgattgcgtataccgcaggacagcctcatccccctcttggcgtaccgactgaataatggtacgcacagcctcattttgctcaggtgtgccgtaatccacctcccgttggagactgaaatcacgggctgatacgatcttcatttgtccattcccccttacttgcagcttgcagaatgcccctttaacccttggcttattcctttagtccatttactcccggggtgccaccgcatttggaatcacctgatgcaatcgatcacacaatgcctgaatcgagctgtttttcatccggtagctgacccgattggcaatcagacgactggtaatatccagtatgctgatttgctcgaccaatccattctcccgcaaggtctgccccgtttctaccatatcaacaatgcggtctgccagaccaattaacggcgccagctcaatggagccattcagcttaataacctccacctgctggccttgctcccgaaaatactgggaagccacattcggatattttgtagcgacccgctgacgaatacctggctgccaatctggcaaagcaatcaccgacatccgacaacgggcaatcccgagatccagcagttcatacacatccttgttttcttccagcaaaacatccttgcccacaatgccgatgtccgccgccccgtactccacatacgtaggaacatcaacgggcttcgccataataaattccatacccagctcgggcagtgggatgaccagcttgcgcgtctcgtccacatccagcggaatgggaacccctgctcggcgaaacagctcagaagcctgcttataaatccgtccctttggcatggctaccttcaatgtttccgtcatggcaattccctcctttgtactggctgtcttccttcagctgtatagctgtatacctctgcgtacaggccctgctgctcacggcgtcggtcttccgggccacccgtgagccctgtcaccacagtaagacctgttgcgcgtagctctgccgctacggataacgcctcttggcgtccctgttcgtcatagcggataagtacaggaagcttcgcctccatttgaataccatccacaccatcgacgatccggttcgttttcaatgcaaatcctgttgcaggtacggatcgaccaaactgctgaagcagattgtcatagcgacctccgttgcatacgggaaacccaatctccgccgcatagccctcaaaagtcattcctgtataatatgaaaaatccccgatcatggtaaggtcgattaacacatgctcagatacgccgtaagcctccagcacttcccatacctcgcacaaatgtgcaatggattgaatcgtttgctgctccacactaagaccggtagcctgttcgcaaatttcttttccaccgcgcagccgcagaatagcctcaagtttatcccggtgttcgggagccaagcccaaagcttcaatcgctgttcggtagcccactacatcacgactgagcaacagttcctttagcgcttgttgttcagcctggcggcctggaatgatttcctcaaacaaaccgttcaggaatcccacatgccccatcgcaattttaaaagaggtcacccctgctgcctgtaatgatgcaattgccaatgctacaacttctgcatcagcctcaggcgaatcatcacccaccagctccacacccgtctgaaaaaactccgcttctcttcctgcctcttcctcaatcgcccgaaatacatttgcgtgataggaaagtcggagtggtacttcctcttcctttagcaacgaagataccacccgtgcaattggagcggtcatatccgatcgcagcaccaacgtggtcccccggttattgagtaatttaaacagcttccgatcggaagtagaactagccactcccaccgtatcgtagtattccatcgtaggcgtcataatctggcggtagccccaacgctccatgcattcgagtacattcagttcaatggcccgcagcttcgacactgcacgcggaagataatctcgaacccctacagggatctcgaatccttttggcttagacatctctatcacctcatgatttcacaatatctttatcatggtaaagtgctaacaaactaaagtatattcgatatattatcatgctctacttgtgaacgtcaaccgaacgacgcagcccttttttacagattagccaagctgctgcccctctctatattttatccaatgcaaaatacatgaatcctatatgaaaaacatctatcaatgtattttcacggagcaagaccgcgcctacgttaatttttttgtgcatattgagttgttcagttctactgaaaatttataaattctatactcaaaaaaaagactgccagctttaagctaacagtccaaattaaaatatttatctattcacctgttcatctttactccggaaaggaaacttcggaaccgtgcccaaaccgatccatgcaaatggaacatatcgaaaacacagcgtcacaatcagccatgagccaaacagcgccaacaaccatccaccggcaacggagaagatatattctatcggtgttccatgcaaatctaacttgcgatacacccgcagtaacgccgggtgaagtaaataaataccgaaagaacatgcccccaaccaactgattaacattcgcagcctatcattagtatgacgatacaataaaaccgagcactgaaacaacactaatgcagatacgagggcatgtgcattacggagtagttcatagatcagtgagtctgcatagatgcctttgcgatatgctataaaccatatttgtacataagctatacccacgagtagccaagccgcccacaacccccaccaactgatcaactgaccacgtctaattactgtacctgacactggaaaaagccactttttaaacccttcatatccaatcgctacagctgcgcccaaggcaaaataactgatatacgtaatcgcaaggcttcctctttcctcttgccaaacgtatttgttcagcaatacaaacccccattgaatgactaaccctactgccaaaatgatacaggctgctctccgtggactcgatatccaatgacataagcgctgcactccccacaacaacagcgggaagaccaaataaaattggatgatgatgatgacataatacaaatgtgtgtacgcctttcccgttaacagcacgagcggaagatcactgagcggcatcaacccgcgtgttaccaaggtcaaataatacacaagagaaaacaaaacgtacggtaacacaataaacatcagtctttttcggaaaaacacaagcatattcttaccacgaagcggcctatcgatataattgtaaaataaaacaaacccgctcacaaaaataaatacgggcactgcaaagctactaaacacatttaaaaataaaaaaggataaaacaatagagaatgacgcgcatcaattaaagccattgaagtcgcatgaatggtaacaacggctgcaattaatattccccggtaaatatcaagctctggtatacgttcttttttgaccaaatcaacacgctcccatatcgccttgcttttaacaatttttaaacataattaacatgcattaccccacttattatacagaaaaacaacacaagaaagaccccttaatacataaggggccttccttatagtgctatttactactcatccataccagaacgtcttaaatcacgcaacggattgccacccacaaatgcacctgcgggcacgtctttatgcacgaccgctccggccgctacgatagctccgtcaccaatggtgacacccggcagaatggttgtgttggcgccgatcagcacatgatcaccaatcaccactttaccgatacgatactcctcaatgagatattcgtgagccagtatcgtcgtgttatatccaatgaccgaattgttccctatcgtaatatgctccggaaaaaaaacatccaccatcaccatcaggccgaaggccgcatgttgccccaccttcatccccagcattctgcggtaaatgacgtttttcagagaaagcacaggacaataccgggcaatctgtataaaaataaagttcttaatgcctttccagcggctcaccgtccgataaatctgccacaacgcattgggaccttctacaggatagcggttcacctttctcacgatacattgacaccttgaagctccagcttcagcaaatcccgcatatcatgcaacatatagtcaggcccatatccgcgcagagtttcctcgccctttagcgaccaagctacaccagcggatttcacacctgctgcctgagctgacaaaatatcaaaagaactgtctccgaccatcaatgtatgctttgcttcagcattcaagccttctaaggccttaaggactggctcagcgtgtggcttaggatgctctacatcgtccaccgtcacaatataatccatagaggaagtcagattgaacagattaagtacacgtatcgtggatggtcgtattttggttgtcacaacccctagcttaattcctctcgcacgcaactcctgaataacctcaatgacatatggaaatggcttcaccatttgatcatgatgaatctgattataagcacggtagtccttaaccagcccagatacatccgttaatcccgaaaaagtacgaagttgatcgtccagcgttccacccatatgaggaataatatgctcccgcgtcagcggatcagcatccggatgattcaaaatgtgtagaaatgtgctgataatcaactcattcgtatccatgatggtgccgtctaaatcaaacaaaatcgtatttatcatagatgctccttcttgtcctcgtccgtgtcttccttaggtagcttatccgccgtagctgttggaggaaccgcatcttgtcctggacgggatacctgttctggcgtcacgtcaggtacctgatcaatccccgctttgctggagataatcggatcgctataccgagcaacagatgtgcccttccggcgacgaaccaaaatgaaaatcacggcagccaccacaatgaaaataggcagcaattgtgatatccgtacgttaccgtaacttgggtccagatgccctggttcaaaccctaaccataccataggagaccacagggcatttacaaaggaagcgagccaatccggtccctgaaaagccaaactgtccgtccgtacacgctcgatgaaaaaacgaccaatcgagtaccaaatgaagtaaaacgcaaacatttcgcctgcacgtacaaatttcatacgacgaatgacgagcagcaaaatcacacctacaatactccacagtgattcatataaaaatgtagggtgatgaaacaccccgttaacgttcatctgattcacaatgaaatccggcagatgcagttgatttcgcaaaaaagtctcttccgtcggtccaccgtaggcttcctgattgacaaaattaccccagcgtccaatcgcttgaccgatcagtaggcctggtgcacaaatatcagcgatacgccagaaattataccctttataccggaaataaatgaccgcacatataatggctccgatcaaggcaccgtatatcgcaataccgccattccaaattttaaaaacatcccatagattatctcggtagtcttcccatttgaaggctacataataaatacgcgctccaattattgctgatggaacacccagaagcagcatatccataaaaaagtcctgcggaataccgaatctttttccttcacggatggcgagatataaacccacaagcgccgccagccccaaaataagcccataccaatggaccttgattgccccgattgaaaaagcgatcggattcagcagtaatgttgccgttaacatatatttctctcactcctcgttcttccttacaaacgaacaaaccttaatccatctcttccatatcttcagaaatcgtagcagtcagcttgtttgtaaattgcagagctgcattaacgcccatttgtttcaaacgatagttcatcgccgccacctcgataataacagccaagtttcggcccggacgaactgggattgtaactagtggaacatctgtatcaataatgcgtgtcgtttcttcatcgagaccaagacggtcatactgcttgtcctgctgccatgcctccagacggacaaccaatgtaatccgtttgttattacgaactgcaccagcaccaaacagcgtcatcacattaataatgcccacgccacgaatttccaacaggtgacggatcagctcaggtgctgtgccatgcagctgaaaatcagacgtttgccgaatttctaccgcatcatctgctaccaagcgatgtccacgtttaaccagttccagtgctgtttcacttttaccaattccactacttcctgtgataagcattcccacgccatacacgtcacatagtacaccatggatagtcgccgtaggagccagctttctttcgagaaagcctgtaatgcggcttgataaaatcgtcgtcgccatattagtacgcagtacaggaatatctcgttctgcgctcgcctccactaactcagccggtacctccagaccacgtgtgatgataatacatggagtcagctctgtacacagacgctccatccgatcccgtcgctcatcaggaggaagcatccccagaaaagccaactcagaccttcccagaagctgtacccgctcctgtgtatgatattcaaaatacccggccatctccagacctgggcgattcaaatcatccactgtgatcagtcttcgcagacctttttcaccagaaataacttccatttgaaactgctgtacaagctcggatacctttacctgtttagccattgtattctccccttcatctgcaacaccggattctatacgtcatttgatttatgtagctttaccctattaaccaacagcccaacgccagtctagctgcactgcatcaatccacactccacttgatttaacactatggttccaggctaactctattccgacagcaggattgatcccatctaggacccttgccaacgaaccttgcctgcatctagacccgtaccattgtacccatcgtatcggaattttccaatgaatgcaatgccgaagctagtagccgtatgcgatatacaaaaagagtcgcagttctccgcttggggaaaactgcgactctcttccagaggcaaattttattcgccaaccagaatactcaattccgattccttatcaaaaatatgaaccttgttcatatcaacagccaacttcgctttaacaccatcacgagtattggaacgtccgtctacacgggcaataatcgtatcatttccggcaccgctcaagtacaacagcatttcatgaccgagattttccgttacatccacagtggatgtaaagatcgtattcggagaagcctccaggaatacaggctcttcatgaatatcctcaggacggatacccaagatcacttctttgccgatatagcccttcgcttttaaaatctgtcctttaccttctggtacgaacagatccagacctggcgcattaaagtgcaatgcaccttctttttcaaccagtttacctgtgatgaagttcatcgtaggagagccgataaaaccagctacgaacagattcactggacggttgtacagttcatctggggatgcagcttgttggataataccatccttcataactacaatccggtcacccatcgtcatggcttcgacttggtcatgggttacgtagataacagtcgtttccagacgcttagccagcttcgtgatttccgcacgcatctgaccacgcagcttggcatccaagttggacagtggctcatccatcaagaacacttgcgggtcacggacaatcgcacgtcccaaggcaacacgctggcgttgaccacctgataacgctttcggcttacgatccagcagatgctcaatatcaaggattttagccgcttcacgtacacgtttatcaatttcttctttcttcaccttacggagcttcagaccaaaagccatgttttggtatacattcatatgcggatacaaggcataggattggaataccatcgcgatatcgcggtcctttggagccacgtcgttcacaacacgatctccaatgtacaatttaccgtctgaaatttcctccagaccagcgatcatacggagcgtagtagatttaccacaaccggaaggaccaaccaatacgagaaactctttatcttgaatgtccaaattgacatcaacaactgtagctttatctgcacccggatatttcttgaaaatatgctctaaacgtacaccagccatagcttttgcctccctaagatcaagttatgaaatcgaatacatttcttacttgtatcttaccctagtccccgtagcatggctattcgcaaactgcacaaaaatgctatttcctttttgtcactttgtacaataggagatagagcttgaccaaaaccgcatcattaaacgtccgcacgtccaatccagtttcctgtttgatcttgtccaaacggtaaatcaacgtatttcgatgcacatataggcgcttagctgtctcactcacattacaatccagttgaaaaaagatatctaatgtagccatcgtttctgagtcttccagtatgacagatgacttcattacctgctctaaaaatagtacgcgttgttccttgggaatgcggtgtaacagcctttctaaatgaagctcccatgaaaagtggatgtgctctgttacatgaaaaatcttgcccagatgtatcgtctcccataacaaattcagctcttggggaagactttgcaaagggatcgaaggcttggaaaccgccaaatggaacacacccacccattcattcgcaataagctcatatagacccaagctaaaagccgtaagaacctcctccaacgattccgtaaaatctgcatccctggactcagtgtctttatcccgttcatcgtcggctcctaataaaagctcctttttagccataatcagccaagactgttcgtccaatggagtaagcagcacatcccctccaaaatagctcgcgaacaatcgatggagctgcgtataagtaatagccccctcctgtgttccctcgccattcagtaaaatcgggaccatgcacgctgatagcgaatcgcgaagctgcaattcatcaggaacctcttcttccctgtttagattggcagcctgctgtatgagccattgtccaaaacgattcatccgctcttcctcgctataaactgggttatccgacaattgtggaccgttctgccagacctgctccatgttccccaatagcgcttctaccagtttccgttctcgatccgtcaaatatctggcctctaccacaaaggcagccagttcacctcccgacgcacgaaacggaaaatatagcttgttgtcatggacaaacgatctatccggtataactgaatcggctgtctctccctctgccatcatttccgggcaccaaggcactatggtaaaaggcgcttgaataatattctgaagctgttgttgaatccattctgtatccagagtcacgcgatcaccacttcacttttttagaatatagaataagcactaagcgaacataatgaactcattataacctgtcgataccgtaaaataaaaaagctatattaaaacatagcttaaaacaatacaaaaaaagccatcaacctatagttgatgacttctgatgagccatgaaggactcgaaccttcgacaccctgattaaaagtcaggtgctctaccaactgagctaatggctcgcaaaactggtggaggatgatggattcgaaccaccgaacccgtaagggagcagatttacagtctgatgcgtttggccacttcgctaatcctccatataaaggtggctcgggacggaatcgaaccgccgacacgaggattttcagtcctctgctctaccgactgagctaccgagccatatccattaacaaaaaaataaagtgcggagggataccccttcccactttagtacggtaaaactattgaattgaaaaatggcggaactgacgggattcgaacccgcgatctcctgcgtgacaggcaggcatgttaggcctctacaccacagttccctatatttttcaaaattcaaaaatggtgccggcgagaggacttgaacccccaacctactgattacaagtcagttgctctaccagttgagctacaccggcacaatggtggaggctgaggggatcgaacccccgaccctctgcttgtaaggcagatgctctcccagctgagctaagcctcctgggtatgtatggtagcggcggaggggatcgaacccccgacctcacgggtatgaaccgtacgctctagccagctgagctacaccgccataacataatatttcgctagcttgtcctaaatggcggagagagagggattcgaaccctcgcaccactttcgcagtctaaccccttagcagagggtccccttatagccacttgggtatctctccatataaatggactcgcttagcaaaactccgcaagttattcttcaactcaccaaagtgatttggaatatcaagcgcaatttcaaggttacaccctgaaaactggatccgaaactcattgcgttttattttaggata

SEQ ID NO: 2607 - DNA, 43304 bp, Unknown
  Kingdom: Bacteria, Phylum: Firmicutes, Class: Bacilli, Order: Bacillales, Family: Paenibacillaceae, Genus: Paenibacillus
agcttatcttaatgacattgtcggatagggtcccttttttgttgatgtaattgttattaaacctttgattcagccaaaatagttgtctaaaccctgtctcaggattcctctcgaacgctaagttgtcctgtacctggttcattcagaataattcgcgctttgacggtcgatccatctttacgcttaaaagacaacaattgcgtctgtccctttgtcaacagagacttgagcatcgtttcggtaatctgcttgccagcatattccttccagacgacaaaaccacagccctgcttgtagtggctgcacccataccctttacgcccttcaataatgcttccgccacaattagagcatgggcagctacccaaagcttgcctttggctcactgaaatgcctgagggtccgtcggaagagctgcgtgcaacggaacctgctgttcccgcagcacgacttgctggtggtgctgcttgctccagcgttgcgcttccagcgttaccaccgcgtcctgatgtagcacgccccacccccttggcgacggtgcgtccactcgcacgtgcgctacgtgcgccttcttttccagccgcacgcttcccccttgcttcctcgccaaaggcatctgccggagctggtggctgctgcctcaccttgtcaatgatggacaacgtaaatcttttaacgttatccataaatttctcctgagccgcctcacccttggaaatttgatgtagacgacgttcccattgacctgtcatctccggcgaggctaatagatcaaccccggcatgacggatcagatcaatagccatctttcccttttccgtaataagaatctttttgcccttcatttcaatatagccaacctttttcaatcgttcaattgtggcagcccgtgtggcaggtgtgcctaagccggcatccttcatgacctcacgtaattcctcattctccatctgtttgcctgcgctttccatcgccttaagcaatgtaccctccgtgtagcttttggggggctgagttgccttttctttcatctcagcacgaacacactccaccggacgtcccgtatcaatctcaaacttcttgtccgtccactcgtccgtttcctcttcatcctcttttttcgatgatttgctctttttacctttatcctggtcaaccttacttaaaaccactttccatcccaaggaaagaagctctttgatatttgttttaaacagatgcttgtccacctgcgtcattacggtatgcattttatattcagcaggcggaaaaaaatgtgacaaaaacctgcgaataaccaggtcatatacattttgctcctccttgcttagcgtacctggtctttttaacgttggcagaatagcatggtgatcctcaacacgagctggattgcagaccgatttattctgtttatggaccaagttggggttggcttgttgtaccagatcagcataaggacctgtccccagcatccgtagcgccttgtgcatgccgtctatattttgctctgtcacatagttagaattggtacgcggataagaaatgaccttgtgacgctcataaagcgcttgtgccacatctagtgtttttttggccgaataaccgtacttggcattcgcctcgcgttgaagcaacgttaaatcgtacaatttaaaaggatactcttttgtctgctttgtgtcatatttggtgattttacccgtttttccgcgaacggccgcagcgatcgcctcagcctcctccggcttcgtcagccgatccccctgccacgcacctttgtacttgatctgatcttgcttgaattcagcccacacatcatagaaggtttgagactgaaatgcctcaatttccttttcccggtcatgaatcaatgccagcacgggagtctgcacccgccctactgacagcagtgtattatgtcgtgttgtgaacgctctggaagcattcattccgatcagccaatccgcttcacttcgtgcccttgcagcttgagtcagaaattcaaactctgaagcatctcgcaatcgttcaaagcctgtcgcaatactctccgctgtcaaatctgaaatccacagtcgcttaactggctgatgcaacttcaattgctgttgaatcaacgcaaaaatatattgcccttcccgtccagcatcacaagcatttacgatggcgttgcagcgtttagccagttcaccaattattttcagctgatcctttgttttcggattcggtacaattttgaactgctcagggataataggaagatccttaatattccatcgtttgtacttagtatcgtatgcatccggctcagccaaacccagcaaatgtccgatcgcccaggttacaatgtatttctccccttccaaataggtacggttattttttgcccgcggctccataacggcggcaatcgtccgtcccatatctggtttctcagcaataatcaacgtcttcattcatactccattccttcctgacggccttctgtttctcctccatgaatcatacatatacatggaatgataatgaaaacacaggtatcccggcctcatgcaaaaggagccttctcccgacgaaagctcctttgtaaattcatttagtcaaacgcttcaacaatatacgtgtattataccatagataccatggttctctcaggtcatgattttatacagtcaacgaaagttatgtatatgttaatttatataacataaaaatcagcttttatctaattttcttgtggaataatccttttttctataaaaaaatctacactaaacacccatttttatgttatgatcaatttagataagaaatatatggtgatacgattgaatttaagttatattatataacatatatttcacaatgtttcacagctcaataatcatttattcatttttcgcttctggcagactcagcttgaaatacaataaagccccatccgaagatggagctttgactgatccgtaacatgaaatttataattacaccaaaacggtagcgcccatgaggtatttatcaacttctcgtgcagcttctcgaccttcattaatagcccacacgacaagactttgtccgcgacgcatatcacctgcagcaaaaaccttatccacattagtaacatattttccataacgtgctttaacgttggaacgacggtccgtctccaaaccaatttgctctacaatcgtttgctcaggaccatcaaatccaatggcaataagagcgatttgtgcagggaatacgcgctccgtacctggaatcggttgatagattttgcgcccagtttcatcaacaatccgttgaatttgaatggtgtgtagctctttcagattaccgttctcatcacctacaaatttggtcgtcatgatggagaactcacgtggatcttctccgaacaacgccttagcttcttcctgtgcataatcgagagaatacacgtttggaaattgtggccaaggattggcaatcgggtcacgctccataggcgctttggtgtgtgtgccaaattgagtgacactccgacatccatgacgcaaagaagtagctacacaatccgaacccgtatcaccgccaccgattacaataacgtccttaccttgggaagacaaatagttgccatcttccagattggagtccaagtaacttttgatagtaccattcagataatccatcgcataatgaacacccttcaaatcgctaccttcaatgttgaattctcttggcttcgtagaaccaccgcataggacaacagcatcatattcagcaattaactgatcggtagggatatctttgccgatttccgtatttgtgatgaattgaataccttctgcctccagcaaatccacacgccgctgaacaacctttttatccaatttcatggacggtatgccatacatcaataatccacccacacgatctgcacgctcatacacagtcacgctgtgccctgctttgttaagctgtgcagctgcagccaaacctgccggacccgaaccgacaacagccactcgtttgcctgtacgcttttctggcggattagggacaacccagccttcctcaaaacccttttcgataatagcttcctcaatggttttaattgtaacagactgtccgatcaggccgactgtacacgaaccttcacatggcgcaggacagacacgacctgtaaattccgggaagttatttgttttgtgcagccgctctagcgcttccttccacaaaccacggtatacgagattattccattccggaatgagattatgaaccgggcagcctaaagttgctcccatgatatccatccccgtatgacaataaggagttccgcagtccatacaacgcgccccttgggtacgcagctcttcttcagacatatgcttatggaattcttcccaatcctttatacgctctgccgggtcccggtctgtaggaagctgtcgtgtgtattccataaatccagttggtgtagacatgttacgttcccccatctcttcgcttatgaaccccgatcatccattcagaatttaagtcaaattcgaatttgtctgcttgtattatgaaagggtctgttctcgttgaatttgatttattgtatcacaatacagcgtaaaagtaatgaaaacttatgcaactttttgcatcaacaccaaaaggattttttatatggtttattaatttttcaaatgagtggggtcggatacagtccattcttattccgttttctcgtaaacaacaaaacggtactcatatggatttctgtcatccttgatacccggagtctcactaactatattccaaccgttccaatccagctcgggcaacgttgtatcgccttcaaaagtctcctcaatccgagtcacaatcaaccgatcggcatgtggccaaaacagtgcataaatttctgctcctccaatgaccattagctcctcctgctttgctaattggagcccttcttccagtgaatgaatcacttccgcaccttccacccgatagcgctgatctcgagtcaagacgacgttacgtcggtttggcaggctttttcctccaaaggattcccacgtcttgcgccccatgagtaccgttttattaatcgtctgctctttgaaaaaggccatgtctctagggaggcgccagggaagtttgttatcctggccaatcacaccattttgtgccatagcccatatcattgaaatgcccatttttccacctcccctaatcagatggcgacaggcgccttaatccctggatgatactcgtaattttcaaaagcaaaatcgtcataggtataatcaaagatcgaatccggtttgcgcagaatttttaactgaggcaacggataaggatcacgttccagctgtgtatgcacttgttgcatatgatttgaataaatatgcacatcgccgcctgaccaaataaattcgccgggctccaaaccacactgctgtgcaaccatatgcgtaagcaatgcataactcgcgatgttgaacggcagccctagaaaggtatccacagaacgcattgttagcatacaggaaagctttcctccagctacatagaactgaaatacaaagtgacatggcggcaacttcatggattcgatttctgccacattccaagcactgacgatgtgtcgacgtgagtccggattgtttttaattgcctctatgacattcgcaatttgatcaatatgttgcccgtctgttgtttcccacgagcgccattgcgatccatatacaggccccagattcccctgctcgtccgcccactcatcccaaatggtaactccgttctccttgagataagaaatgttggtatctccccgcaaaaaccataacagctcatgaataacggatttcaaatgaactcttttggtggtcaccaagggaaagcccttggccagatcaaaacggagttgtcttccgaaaacagatagtgtccccgttcctgtacgatcctctttttttactccattctctaaaatatcctccagcagttccaaatagttgcgcacgttattcctctcctttgagcatgaataaaaacctggcatcgccagattctaatctttaaaattctttttctgcaccaatatctatatttagtttatcatgtacggtgcttcgttgaccatgtactgtgtgaattttcatagtagtcctgaaaatcctaaagtttgaaaaaaaagagacaaagagcgcagatatagcgctccttgcctctctttgtcatgtatgaaaaccaaaaacgagataatgaaaaatggtattagcgacgtggtgccaatgcatggatcggatgacccagcacgacttccgctgcttccataacgatttcgcccaatgtagggtgagcatgaatagtcaaggagatatcttcgagtgtagcacccatttcaatcgccagacccagctcagcaataaggttggaagcttccagacctacgatttgcgtacccagtaccagacctgtgtcagcgtcagctacgattttcacaaaaccttcagcagcgttcagggaaaccgcacgaccgtttgctccataagagaacttgccaactttgacattgtagcctttttctttggcttctgtctctgtgtagcctacgctggagcattctggatctgtgaaaacgacagctggcatacatttgtaatctactacagacggctcgcctgcgattgcttcagcagccactttaccttcgtaagaagctttgtgtgccagagcaagaccagctacgatatcgccgattgcaaagatgtgaggaatgctagtacgtccttggtgatcaactttcaccattccgcgctcatccagttctacgccgatcagatccagacccagttcaccgtctgtgtttggacgacgtccaacagttacaagcagataatcagcagttacttctttactttcgccgttaacggagaatttcaccgttacgtctttatctgtttgctctgcactttccgctttagcaccagtgaagatttcgataccagttttcttcatgcttttcgcaacgatcgaagtcatatctttgtcgaaaccaggaagcactgtatccataccttcaatgatcgttactttggaaccgaatttggagtacatttgtccaagctctgcaccaatgtatccaccaccgattacgatcaggctttttggaatttcaggcaggttcaatgcttctgtagaagacagaatgcgtccgccaaatgggaatggtttcagttcgattggacgggaacctgttgcgataattgcatttttaaaacggtaacgtggtgattcatgttcgttgaatacacgcgcttcgttttcgttgatgaacatgcactcgccattgaaaacttcaactttgttgcctttgagcaagccgcttacgccgcctgtcatttttttaacaacaccgtttttgaattcttgtgttttagcaaagtctacttttacattttcagccgtaataccgaaggactcgccatgtttagctgcttcgtattggtgagctgcagagatcaaagctttggatggaatacatccacggttcagacagacaccgcccagctcagatttgtcaacgatcaatacgctttgtcccaattgtgcggcacggatggcagctacatagccgccaggacccgcaccgataaccaatgtgtcaatatccagagaagcgtctcctactaccattgattacacctccataacaagcaactcagggttagcgagcagctgtttgatatagttcatgaagttttgagcagttgcaccgtcaataatacggtggtcaaagctcaaggaaagagccattactggagcggctacaatttcaccgtttttcacgactgctttttcactgatgcggccagtacccaaaatcgcaacttcagggaagttaatgattggagtaaagaacataccgcctgcagaaccgatgttagtgatggaaattgtacttcctctcatttcgttcgcagccaattttccatcacgaccgcgcacagccagatcacgaatggaatcagcaatcatccagatactcttacgatcagcatctttgataacaggaacgatcaagccgttgtctgtatctgtagcgataccgatgttgtagtattttttgtagacaatttcgtttgcttcttcgtcgattgtggcattcagagccgggaattgacgggaagcagcaaccaaagcttttacgatgaatggcaggtatgttacttttgtgcctttcttctcagcaattggtttgatacgagtacggaaagcaaccagttcagttacatctacttcatccataatcgtaacgtgcggagccgtataagccgatttaaccatagcattggaaatagccttgcggatacctttaaatggtacgcgctcttcctcagcacgtggatctgctgctggtgcggatgctgctgcagctttcgcttctttcttagcaggctcttgtgcttttgcagcttctttcgctactggtgcagccgcttggcctccaccatttttgaaagcttctacatcttctttggtgattttaccatttttgccggagccactcacttgagcgatgtttacaccttgctcacgagcaaatttgcggacgctaggtgtagctaatacatctttgttagaagcagcaggagttgcagctggtttagtgttagctccgccttgtgcagcatcctgttcttgtttagcagcagctggtgcttcttcttgttcaggaagttcaccctctgcagcgattacagctacgacttgacctacgttaaagatgtcaccgtctttggcaaatacttcttgtactgtaccattaaccggacaaggaacttcaactacagctttatcgttttgtacttccatgatgatatcttcatctgttactttgtcgccgggcttgatgtgcatcttgatgatttcgccttcgtgaagaccttcacccagctctgggaatttatattcaaatctagctgtacctgcagctccgctttgtgcagcagcacttggctcagggctagcagctggtgcttctggtgcatcttcttgttcgggaagttcaccttctgcatcaattacagctacgacttgacctacgttaaagatgtcaccgtctttggcaaatacttcttgtactgtaccattaaccggacaaggaacttcaactacagccttatcgttttgtacttccatgatgatatcttcatctgttactttgtcgccgggcttgatgtgcatcttgatgatttcgccttcgtgaagaccttcacctagctccgggaatttatattcaaatttagccacgtttaaaacctcccaaatttacggtgtgctttaattaaaattccaatactttattaaccgcatcaatgatacgtgttggcgttggcaaccaagtatcttcaatttgagcaaaaggataaacggtatccgggcctgctacacgcagaacaggtgcttccagatgcaggattgctttttcgttaatttgtgcaataacttcagcagctacaccggagctcttttgcgcttcttgaaccacgatagcacggttggttttttgaatagaagcaacaacggtatcaatgtcaatcggactaatggtacgcaaatcaatgatttccactttgataccttttgttttttccagctcatcagcagctttaaccgaagtgtgcaccatcataccgtaagtaatgatcgtcacatcggaaccttcacgaactacgttagctttgcccagttcaactgtgtaatcattctcaggaacttcagcgcggaatgcatgatacaagttcaaatgctccatgaaaaatactggatcattgtcgcgaatagacgcgatcataagaccttttgcatcgtaagggttggaaggaacaacaaccttgataccaggtgtttgagccagaaggccttccaaggaatctgtatgcagctcggctgccttaacaccgccaccaaaaggtgtacggaatacgattggagaattgtaacgtccaccggaacggtagcgcatacgggatgcttgaattgccatttgatcgagtgcttcaaagataaagcctacgaactggatttcagctacagggcggaagccttggatacccagacccacagcaagacccccgattgcggattccgccagcggagtatcgaatacacgttcttcgccaaattctttttgcagaccttctgtagcgcggaatacgccacctacatgacctacgtcttcaccgaaaagcaggacgttagggtcgcgtttcaactctacgcgcagtgcgtcacgaatcgcttctttcatgttcatttgtgccatttgcttcatttcctccttaaacattgacagatcaatttcagttcaggtcaatcgaaaagcagaccggatcgggttaccgcccggtctctttcaagttcaattatttaaaatcagctttttgttcttccaagtgcttaggcgttgtttcgaacatgctatcgatcaggccaggaattgtcattttctctgttttctcggcttttttgatctcttcgttcacttttgccttagcttcttcttttacgcgagctgtatcttcttcagtccaaaggccttttttctcaaggtatttcgcaaagcgggcaattggatctttcgcattccattcgccttcttcttctttagaacgatattttgttgcatcatcagaaagggaatgcggacggaaacggtacgttacggcttcaatcaaagtagcaccttcaccattacgtccacgctctgcagcttcttgaacggctttaataactgcaagcacgtccatgccatcaattttcacgcctttaataccagcagctactgctttatgagcgatcgaaagagcagccgtttgttttgaaaatggagtcgtgatcgcgtaaccattgttttgcacaaagaaaataactggcaacttgtatacaccagcatagttcaggccttcgtagaaatcaccttcggaagaaccgccgtcacctgtatatgtaatggcgacttgtttttgctttttcagtttgtaacccatagcaatacccatagcatgcaaaatttgcgcgccaatgatgatttgcggcatcagtacattaacaccgtccggcacttggccgccgtgttgatgaccacgggaatacaagaaagcttggtataatggcaggccatgccaaacgatttgcggaatatcgcggtagcctggagcaataaagtcttctttttggagcgcatattcgctaccaatcatggttgcttcttgtccggataccggagcgtagaaaccgagacgtccttgacgacctaagttaacggcacggtcatcccaagtacgtgtaaataccattcgatacataatttctttcaattgatcatctgtaagtttaggcaacatatctttattgataatttcaccatccggagaaagtacggacagcgcctcaacttcctctgtgtaaacttcataaggaaccttgctcattttcttcacctcaacaaaaaaatttgaatatcaagttccgctgttataggattattatacacctgttatatcgctcgcgtcaaagatttagttattttttttgagtttaccacatttttgtgtatgtaacagggtatgttttttactataacagcttagtacatgattgaaattttaaacatctattgcaatcagggtaatcttaacttattgtgatcccgaatgcaaaataatacccaagaaaggtgacgaaaaatgacggattctcggtatttaaaacgaaccatccttaaagacgaagtaaacagccgctttcttagcgagaccagaactctccggatatatttgccgcccggctataatgaaatattgagctacccggtcgtatactgtcaggacggagaagaatttttcaattttggccgcattgcaactcacgccaaccgcctcattctagatgagggcgtcgaacccttcattattgtaggtgtggaagtgaataccaaaatcagaactcaggagtacgctccctttggcaatcgttttgaggcgtataccacctgttttgcagaagagattattccctatgtggagcaaaagtatcctataagaaaagatgcagcgtcccgcattttggcgggggattcactgggaggcagtgtgtctctgcatttggctttgatgtatcctcagctgttcaaccgcattatcagcctctcaggtgcttactatgaagcttcgcaggaaatcatcgcccgtaagaaagatctgtctcatttgcgggtgtggatgacggttggccttcaggaagatgcatttgagagtgacactggcatttacaactttgtagaacttaaccgtcaatgtgcagatttgctgcgcgaacggaacgctgaagtttcttaccgtgaaaaggatggcaaacatttgtggggcttttggcaaaacgagttgcctgacgcgctaatgtattttttggatcgcgcctgagtaaaaattcttctatagggaatggagcattgacctactaggtcataaagctccttcctcattttttaatgcaatttggttgcgctttcaaaaaagtataacgaaaaacggcaattattgccgtcatctgtcgttcacattatagcttttcttctacgatcttgtccagcaaggcgtcgcagcctgcgtccattaatcgataggtctcttcaaaattccctgtaaaatatggatcgggtacttctcttaatttttctcgaggaagcaaatccataaattttagaatatcagcctccgctccacctgcaatctttcgcatgtttcgttcattagagtcatccatgcacacaatataatcaaacgcatcaaaatcacggcccgttatttgccgcgcctgtatgccttgttcgctgattccatgcagtttaagttgctttaatgttccctcatgcgggggatttccgatgtgccagtcgcctgtcccggccgagtccaccccgatttcttcgcccaatccccgttcctgggctttatgtctcagtattgcctcccccatcggagagcggcaaatattgcccaaacacacaaacaaaacgttaatcatttcgttctccttcctattacccgttacacttcctttttttctgtttcattgtagccatgtcctccaaaattgtgcaagccatatttaacgcggtatacttaaaaacgatggtatatataggatcgtatcagaaagaaaggatgttgattatgacaaaaaaacgagcgattgtattttcaggcggtcgtcttaatgaagaagatttacatcaaatacaacccgatgattttattataggtgcagataaaggtgctcttttcctgatcgagcacggtattacaccacatatctctgtaggagattttgattcgatcacactagaggaaaaagaaaaggtagaatcagcaagccaacgtatgattgcgtgcgatccagtacttaaagacttaacagatactgagcttgctttggaaatcgctatggacgaacaggcagatcatgtactgctgcttggtgtgactggcacccggatggaccacacattggctaatgttcaaatattggtacgtgcaatgcagcatcatattagctgcgctattatggacgcacataattatattgagctcaccggatcaacgcttgagatccagcctatgggttatacatatacatcgctgcttcctatgactgccgaagtaacaggcatacaactggaaggatttatgtatccgctacataatgccaccctcaaaatgggacaatcacgtgctgtcagtaataaactaacggctccaaaaggtacgatttccatcaaaagcggtctactactcgttattcaaagcaaggattaattatgacattgttgtaaccattatttaaattgttttttcactcaaaaccctttattaataagggtttttccgtttgtagagatctatgaatcgatatatttttaacaaattgtaatttttaatcgttttttaataatcactgtgtaagtcttgtccctcaagcatttgagagttctcttccaactattaggcggcttcaaaactgttatactcaacgctgtcagttagttagcaactcagcaaaatattgcacaaatcaatttctggaggtatttacaacatgaatatgcagaaaatcataaaaaaggtaattatcgcaggagtcgcagccactatcggctttggtacttttgcaattgagggaacaaatacggcacaggctgccactactacttctgttggccaaaaagtaattaactacggtgaaaaatatatgggcactccctataagtttggagcttccacaagcacgacgcgcaattttgactgttcttctttcatgaagcacatattcaaaaaatacggagtgaatttgccgcgtacttctgttcaacagtccaaagttggacatgccgtatccaagtccaatttgaaaaaaggggacttagtgttcttttcaagcggtagccgtgccacgggtcgcaacattacccacgtagcagtctatatgggcgggggtaaaattctacacacttacggcggacctggcgtgactatctccgatttgaactctagcaactggaaaagaacatacattaaagcacgccgcgtgctgtagtttgaaactcattatgaaatatgcgagccgggacgaaagttccggcttttttttatgccttatgctattctgatacggttggtgttctgagtgaatagccaattcctcgttccgtacggatcattttaaacttatatcctttatctactttaaccctcaaatgtctgatatagacgtctactacgttcgtatcaacgatataatcatgtttccaaacatccttcagaatttgctgtctgctacaaacttggttaagatgtatcgccaggtgaagcaaaagatcaaattctttcggagttaattccagcttttccccccctctgctcaccattctgcttgcattgtctatatgtaaatcccccgcctcgattgcccttttcacatcacgttcaataccaaaaatccgcaataaattagccaccctagcctgaaaaactctaggataaaagggccgaacgatcacgtcatgtgctccttgttcaaagcaggaaacaatatggtcctcctcatctgatgaagtcataacaaatagcggaacatgaggatggtattgctgcaatgtgcgaagcaagccatgtgaatccgtcggttcatcttctatattgagcagtagcaaatccacaggattatgggctacataagagcttgcatctgtcgtattgctaacatgaaccacctgataacctgcctgctccaatggatgaacaaatacgggagacgcttcatttacatccacaagtaaaattaacgggcccatcttttcacccacctggtttggacatagcattacatattggatacgaacaagtttgttataagccattaaagcatattaatattattgtaacaaaaaagcagaaaatcattctccaaagaatggctttctgcttttatagtttaacccaaatagcgatgatacagacttcttgcttttgccacgtcctttgtcccatgaatcaacgctctgccatctgcaaaaacaactaagcgatgctcgcttgtactaaaggaaaccaaaaacggattccgctctacttttccttcttccaaagaagcaaatctatctgctgtttctgcaagattcagatgtgtcgggtttgctggtctaatttgaacggtatccctaccgcacaaaacatctgtcttctgccgatgagaggccgacaaatagggatatgtcggttggctgccgcaagaaggacagttctcctttttaacgctatctaccgctattgctacatactcatttttccacaaatcaaacgaaagcagctttcctctcaaatcttctggatatccaccaagaagtttgaaagcttccgtagtttggttagccgtgaccatctgtacggcctgcggaataatcccggcggtatcacaggtttctccaccaaacggtacagtttccagcagacagtgaagacaaggcgtttgacccggtaagatggtataggttacaccatagctgcccacacatcccccataaatccaaggtatccgatgcttgagtgccatgtcgttcataagaagtcgggtatcgaaattatcggttgcatccatcatgagatctaccccctggatcaactcttccagctcttccaccccgacatccagtacatgtccatgtataaccgtttccgaattaatatcctttaatcttcgctgagcagctactgctttgggatatctttgcgcagcatcactttcctgaaaaagctgctggcgctgcaaattgctccattccacataatcccggtctacgaggctcactgtacctacgcccccgcgaacgagtgtttccgcaatacctgtacctaacgctccgacacctatgattagtacgtgggaagaagcaagccggcgttgtcctgtcggtccaaagggcgcgaatctttcctgtctggaataacggtcacttggatgtgtttctcctgcaccggatttgtcagttaccttcatgcctgaaccataccttctgtcggactgcttgctgaagcgtaacgttttacaggaatcatccccgcctcaaaaccataccttccagcacgaacagccagtttcatggcctcggccatttttactgggtccttcgctcctgatacggctgtgttcaacaaaacagcatctgcccctaactgcatcgccattgccgcgtcaccgggtgagcgaatacccgcatcgacaataaccggaacctccgcctgttcaataattagctctaatgaaaacggattgagcaaaccatgtcctgtaccaatcggtgaggctccaggcataacggcgtgtactccaagctcttgtagcctctttgctagaatcacatcgtccgatatgtagggcagcacgataaagccttcttctaacagcttatcactagctttcaacgtttcaaaagggtcagggagcagtgtcttgctatccccaatgacttccaccttaatcatatcgcacaggccggaggcttttgccaatttggcaatacgaatcgcctcctctgctgttgtagcccctgctgtgttgggaagaagtgtataccggctcaaatccagcatatcgagaaaatgctgcttatcccgttcctccaagttcaatctccgtacagcaaacgtcaatatttccgtctcagcagcctctacggcttgggattgaatatccagatcagagaattttcctgttcccaacaacaacctcgacgtaaaagatgcttttccaatggttaacatgatcaaccgcctcccacaaaatgtacaatttctaggcaatctccatccttcagtaccgcttcatcatgatcttcacggctcaatatatgccgattcagctccaccactacggttttcacctttacatcaagctcatgtagcaattgattcacatgagtgattcgattagaaaaggtcatgctctggccgttaatcgtcagcttcatatgcttttctccttgaggagctcagaagaaaaactacttatcccaagttctgctgcaccagccccattaagcatagctgccatcgcacgcccggtagcatcactcagcaggacaccgttgcgataatgcccgactgcagcatatacgccctcgaccccaggaacagtgcctataaaagggtgacctgatgcagcctgcggacgtaagcccgcccaagcgcgtataaaagaagcttcacggacgcgcggcagccaggcagaggcacgtgccagcaacccctccaagcctcctacggtcacttcttcgtcatattgatgcggaaggctcgttgccccaatccaaagctcgttattctgtttaggcacgaggtaaatatcatcagcataaatggtgtattctaatgggtgatccttcaaggagaccgctaccgcttcgcccttgaccggataaagtggatattcaaacccaacctgcgccagtaatttcatgctatccaagcctccagcaataatgacctgatcgcaggaaaaaaagccgctatctgttcggacaccgcaaactcgaccatcctgtatgaccagttgctctgcccgtgtaccagaccataccgttgctcccagcaccgcagcagcacctgcataagcacgacaaagctggacaggagccacttgtgtctcctttgaacgatatattgctccgatcgcttgttcatccaaacctggaattcgtcgggccaattccctcgcatcccaccagataggacaatcatcctctcgcgttttagcagctttccagcgtttttggccttcagtttccgtacggaaaggggtcacaaatccttctgtacggaattccaccgaaatacccgacaaacgctccagatcacagacaagctcagggaatgcatctcgacttctgcgagcaaatcgtgccagctcagagtcggtgaactcttcactttccgctgccagcattccaaccgctgctcctgaggctccctcacccgggatcaatcgttccagcatgatcgtacttcttccctccttggccacatgataagcaatggaactgccgatgacacctccacctatgaccaagcattcagcatgtcctatcgctcttgcctctgtgtgtatctttagcatttgttccgtgtctcctctccataaaccattctgctttcagcttgcctctactctcgttttctcgctacaagctatgaactacaagatctgccattcgcctatattccatcgcagctgcaacgggcgactcagcctcccatataccagacattaccgcaattccgcttgctccggccatataaagctccgggatatggtgcggttgtatgccgcccagcgcgatcaccggaatgttcgacagcctgcaaatatgttcaagctgagctaaaccccgcggtacaataccgggcttacaatgggtctcatatacgtgaccataaagtacatagtctgctcctgcctgctcggcagtctgcgcctcctccaaggaatgcacagacactccacagcgtgtactctttgaaagtaggctttttacatccacaacaggtaatccattagctggtagctggacggttccaaccaaagtaagtaaagctacatccacacgatcatttactacaatttgttgcaaaggaacttcctgctccaccatgctgcgagtcaaagaaagcaatgcagaggcaccattctgttttaaacgtgcgtgtacataatgaacatacggacaaatcatagcagccactcgggcggcttgtgcaaaagtgcccttttccatcgaaattgcgtgtaattcgattttgtcttcacctcacattggattaaaggatctaagcttagccagccacgtctaccagcagtaatgaaaggggattgtatgtgaatccgtctacggaagctcgaacaacttaaagtgaacgaaacgcaaaaaaaccacttccccaaggaagtggtttaacgaacgtccaataatcgaacggaccatgatatccgtatacgtgtatcgtcccacgcacaaacaaaataaagatggtgttgccttgtttgtacggcgctcacttccctacgctggcataacccagatcaggtgcaaagggtccgaaatccatttatttcgtctcagccgcatgggcggctcccctagtgtgactattttattgtataagctaaagatagcttagcatattttcctaattctgcaaaccccacttcgtgtgaaatagcagaactggatttaactgattttagttaactttacttgaccactcttccacattccacgttttggttacccaatcctcgtaaaagtccggttcgtgagatacaagcaatacggtccctttgtattccttcaaggcacgtttcagctcatcctttgcttttacatccaagtggttggtaggctcatcgaacaatacccagttgctttcacgcattaacagtttgcaaagacggactttagcctgttctccaccactaagcgcagatagcggacgtgtgatatgctcatttttcaaaccgcagcgcgccaaatgcgctcgtacttcatgctggttcaaatgcggaaattcattccacacatcgtcaatcggtgtaattttctctgcctttacttcctgctcaaaataagcgggctgcaagaaatcaccttgataggtttttccactgattggcggaattttccccaatatggttttgagcaatgtcgatttaccgacaccgttgtagccgacaattgcaattttttcgccacgttcaatcgtcatggacattttaggcaaaagggcatgtgtataaccaatctcaaaatcaataccctcaaataccgtctttccgcttgcacgtgcctctttgaactgaaaggttggttttgcggcttcttcaggcttatcaatacgttcgatccgatcaagctgcttttcacggctctttgctcggcctgaggtagaagcacgcgctttattacgctgaataaaatcttcctgtttcttaataaagtcctgttgcttctcataagcatcaatatgctgagctttgttcagatctgccatttcaagaaacttttcatagttagctgaataacgggtcatcttggcaaattcaagatggtaaataacattaacgacctggttcataaactcagtatcatgtgaaataaggataaaagcatagggataatccttcaaatagcgcgtaagccattcaatatgctctacatccaaatagttggtaggctcatccagcagtaggacattcggtttttccagcagcaacttagcaagaagcacctttgtccgttgcccgccgctaagtgcggatacatcccgatccagtcctatggccgacagacctagtccattcgccatttcttcaaccttcacatcaatgaggtaaaaatcccccatatccagttgctcctgaatttcacccatctgttccagcaacacttccaactcttcaggagaagcatcccccattttgtcagtaatctgcatcatttccttttccaattccaacaaaggaagaaaagcgtcttttaatacatcacgtaccgttttgcccggtgtcagcttggtgtgctgatccaggtaaccgtaacgtacacgtggagtccattccactttaccctcatccttaagcaattttccagtgagaatgttcatgagtgtcgatttaccaacaccgttagctcctaccaaacctacacgttcccccgcaagcaatcgaaaggaaacatttttaaataatgcgcggtccccaaagttgtgggatacattttctacagtcaataaactcataagctgtttttggctccttattgtcatcggcgctgccgactgttcttatttcatatgcatttcgtttctttcaaagctttattgtagcacattctacaaccatatcggaatattgaaaacagtgaattttaaggttttttggtatggatctgcctaaaaaaacaaaaaccacccatgagggtgattattttaagccattataacatttgtactcaaagtatcccgcagctgctgcagatttttcatccgtaaaacgttcactcgctttaaagggagctggacatgaatctctataaaaatatttcattctagtttctggttctatgccaccgataatgtcttgctttctgacgactctcccaccaccaaatccatagttattgtaatacctgtctccgaccggaatgccttggataaacgcgatcagacccacatcatctatcgtgttgtaccactcctcttgcggaatgatcggtagtgtgaatgtataggatatgccgttacgtgcagctttttcgttatggacattaatcattcgcgccaggtcctcttgaacgctgccaacaatagtggaacgacgtatttgctcaaaagcttctgaattattcagtaaagatataggagtctgatcctgaagttccttttgaaagccctccacccacctgtgattccgcgcatcgtatgcgtgcacataattatccaagctgaaccccacactgttgcctactgaatcaacataggcatatggctttttttcgctccatttgtgggcaatagcagcttgtccacgctcgtctgtataggcttctgaagtgaacgcataataaccgtcataatccagaattacaatggctggtatataatccaataatgcacgttgtgctactatatcctcatcaatgcctacattaagaaaaagggtatgcaggaacgtgttcagcgctgcttctttatctacacgaaaaaacttatccgatccgtatccggcctcgcgttcctgacgttcattctgtgagagcacgacccctgcatcctgaactgcggtacggagagccgacgtatatttcatttctagctgctgcacttcacgctgattctgcacccgtaagtcactaactacaccaaagggcaaaaacaaaagtataaatatgactgcaaaatcagtaatcttcattcagaaccatgcccccgtaagaagctgtaactgccggcttgccgctatctgcctcaccgagaagccatgatttgtacaagttcgcaggagtccgattcgtattatgtaaccggaccgtaaaataatccccggccatcaaggtataccgacgtgtctgatctgattttggctgctgattgtcaggaaacagtacaggcaagatttgcggattatagtacccatcatatacagtttcatagttgcctaggaaactgtctggcttcgcggcatctgcatagtctggtacatactttttgtgcatatgctccaagtcaacttcgtacgtattgcctgtcaattccagatcacgcataaaatcgttatacatcgtcggtgtaatgtaacctttggttcttaccatatcaacaaaacgtacagttgaatgatatgtatttaacccggatatatcatcctgccgttcagcagcttgaactgcgggtacgatgtacaaaagcaatacagcgagcagcgtccccaacaacttggatattgtttgaaccacttcagtcttcccccaatttctcaaaacgtacagatgttatgtccccattccctttacgctgtggatacatggaatataaagaggaagcatccagggcagatacatcaggctcaaatggttcagaatacacatcgtactctgtcccgtcgacttgaaccgaaatcccctcctgtaagttcatgcgaatagcctgtatgacctgagttcctttaatccgttccggcaatcccaccccagcagtacgggctattcgcccttcagaatgctcctcttgctgtgatcttaattccagtgcaccatccagctggctggacaagtctgctgccgttacacatgcggttatgaacagaataactgacacaccaagccgcagcatacttgaagcgttatcagacatactctcatcccccttatgattattatctttgctgtagtgcttaggactgggtaaacaacaacccacggacaacgttcgatttgtcctttacgatttcagccttgaatttgccacttggatttacgtattcattctctttctcattaagcgtattcgtgattttcccagtcttatcactgccaccattcactgcgccatactgttcactgtctgggctaatgttcagagcattaccgtaccactggcctgccatatttttaccggttttaatctgaatgccgaattggtccttcccctgaaacttccgtagcgcgttggtcacctgggaaccgctaatcgttgtgccgtcatataccgtaaaagaggcttgagacaattcggtctggatatcagcaaaattgttttgtgccgttttagtcgcctcctgggctgaaataaacagtataactacaatcgtaattagagcgatggtcaaaaatatcccagcggctacctttaaagctgttgatgcgttattcatatttttctctcctcagcttgttattttgtattagtcataatagaactttcttactgaattttttgtatttgctcataatagttatccatttgaacaaaactcatgccgatcaacggaatcaccaaatataaaaagataagaccatacatcggggcaaaaccaatcatccttccccagatagccttgctgtctattattttttcatactcctgttttctttgttcgaaatagtaggacatatgggattccaaatcatcaaaggcctctcgaatcgtaattttacccaaagacaaatggagcttgtccactagacgctgaaactccggcaaaggtgcctcttcttttaataagtcaagagctgcctctggcccatgttcataatgaagcaaacatttttgcagaggtcttttgaatataactgaaaatctgttcagccactccaatatttcctcgacagacattcgttccataacccgcaaaatggaaataactgtttgaaattgatacacctcgtgcctcatatccaaccgacgcatttttcgttgcaaatataataaaagcataggcatttgataggctacatacccaacaatcaaactaatcagcacttcccaccacttgatgtattcatcattccaatctttcagcttttggagaatacgccgagtatttgtggatagctgttcaggagtaacagttccattggcattatgttctaaagcagcgtacgttcgttcgtatgtgctgtccgctctcatgttcagcaaatgcatgattttgcgatcaatcccactctgcttcaaagcttctttttgctccatcggacttaaatgtccaaacatttgacccgattgtaccggggcgtgaaggatatgcgttttctcagcttcatgtaaaaaaaatatcgtactaatactgagcaccaaacctacgataaaaagagctattctgcgtatgtagagccactccagctttatctccgcaccactttcttttaatagacgggttatctggaaataagaagatatatgctgacgcggaattaaagaatccaccacattacggatgatgggaaaacggtatagcttctgttcccaaaccctccgtcctctacccgcacgatatcctgtttcatcggtctgttgaagcttctgtaacagaaaataagatacgattatcacaatataaacggacaatttcgtgatataacccaattttccctgataaaactcatccatggatggaaagctggatctcgcccatgtctcgattggggtggtaaagaaaacaggtgccagtgcgatcacgtttagactttttaatagatagtccagtttatttcttcgcagcaactccaactggatttcgcgtgcgagactgccgagccccttcaaataaatggagcccccctcctcaatccgatcaccaaactccattaccatatacgagataccggcaaatgcttttaaaaatcgattaggagccgactcatagtatctttccaatgcttcgtgcggatcaacatctgttagcgcctcatggatgagtcgtgcgtgtctcccagcctctgcctccgccaaatcggccgcttcggatatggcttcctccaccataccgtgctgatggtaataatgacgtacattggcgaataattcgatcatctgtgcaagtagccttttttccatccggctaatggccatatccaaaataagactgttgattaccactccgcataaaacggccaatatagcaaactctattcctggcttcatcatgaccagtacaacgccactgcaagcaaaagccccccagatgaacagtgtcatcttcatagtctgtaggcgaagcttgtactcatcgtaggcatgctgaccagctagtcgcttacgtacactcgtgatgtagccagataagaaagggaccttcatacatagcgtgtacaacttatgcagtaaggcttgcagctcacgttgcagtaccgcttttcccttacgtccttcctgcacagaataaattcgtcctctgcgaactgcatgactactacgcttatgcaacccccacaaaactatatatagaagcgcaaagctcccacctgatataagtaaaatccataatgaaatttctttaagactcatagtcttcctcccaatagcgggtcaaaaaactgcggaaatctctggcatcctttacattcatctgctcacacatttcttttgcacttttggctgttaagggctccatcggtatatagcttccgttccgatattccataacgtggcgataactgtagctcaatgaagcattggagcctgcatccgtacgatccgggtcacacggcacacattctgtgatccgttcgatgtagcgtcgcccctccgcatcacgtttgagatgcacatcaaagttaatgacatgaactacctgttcctcagcgatgccttcatgctgaaatactcctgttttgagcaatgaattacgaagtgaaaacacgagatcacgaaatgttttagcatgatgagtaaaaatggtgaacagactggcaacctgcgacatttgaatcatccaagcagctacttcatcacttgctacttcgcctaggatattgacggttccatctgtttttttctgcaagtcaagcccttgttgtcctgaaatatggtccgtttctcgaaaggtaagaatgttacggcgactgtaaatgctgcgcagatgcagttcaaaggccatttcctgaacacgaagcgtatacgaagcataaatatgcttgaccatcgccattaacaacgtcgtcttacctgaaccctgcgcgcctgtaatagcagtaatccggctgcctttcattaaataagaaagtagttggattggaaaatcagcattctgtcccttaattaactgttccagcgatgcgctttgaatatcgaatttacgaacaaagaaagcccacgattctgagaaaggagggcgcaccaccactacccgtgacccatccttcatttcgttgaccttataaccattcgcttcggaaagctggcccgggtaattgtatttgtaaatattttggcacacccttttaagttcacgctcagatccgaaggaaaggaacgaaagatggatcgttttacctttataaaaaatccacacgctctcataaccattggcagtagacgcagatgtttgttcaaatgcatacccatccgaaggccagtctgatgatgcaggaatcccaccttccggcataccactgacacccccacttacaccgtcgatccgctggtcacgaatatcatcaatgacggaaaagcctttgtaatgctgataaatgcgctggacaataatatccactttctccaaaaaggaaagagggcggtactcacagtcatagatataacgaatatcctctgcggtaacgagataacttccatcttcttcaccttgctgtgaatacctcatttcggccaagtcataagtatccaataaacgtgatagtgcatcagcgccaaacttctgctggtattggtaaaatataatttcgaattgatcctgtatgctaaacaactcaggtctggagaatggcataacagtatcgacgattttctcgttcaagccgtaaccgttaatcagaagctcagccatcagatttttaacaaaacgtttatctccaatgctgccattggcacagtcctttaacgccctgcgtagttccgccctttgatggatacgccgtctatattcctcttcatgcaatccggcatccgccatctggctatgactcagttcatgaagtgcatttttgatatactctattaatgtttcgaatgtggcatcttcgttctttttttctacccgaagggttgaatgtcgcgagtgaagattccctcgatatttaacaataatcagtacgatgcacatcagtactatgcaggtaagaatcaatccgttgatcatttgagcggacagcatttaagcgcccctctccaaagccttgagccgaagatcggactctgccgcctccagaatagctttgctgatatgtcgtatactctgcgcccatcctacgggcataaaaagcttgcgatgctgctcttttccacttcgtacctcacgttgcacatggccgatcacatccctgcggttccatgcgtccataaatccggtgctataagggactgtatacaaagcacctttgtagccatatctcctgcgaatattcgtttcattcgcttgagaatgcacatcatatttcccaagtactattaataagggcaatgatgagtaggtagataacggagacacggattcaaaataagcatctaattctcgcatattctgagtgagtgaaagaacggccagtttggctcgtgcacatgcttcatgctgtacagccccccaccctgctccacttcctgcatcaatcagcgttaaatcataatattgattcgctgtatctattactgcccgtacaagccttggagatagtaacggcggtgcagctccaaagctggaggttccctcaagtacatccaaagtatgttcgagtacaggtgtcgtataattacgaatattttctttagacagtgtccctcgcagaactaaacgtgcggcagcatcccagcccccttcctgaagctgtagggttggatcgtccataccatactcctgtataggtaatcctgattcaataccggtatatctacgacccaaatgagtcattaatagtcttcctctatatagatttcctatggtaattgctattgctgccgccaaagagctacttccactagcccccttaatggggctccaaaacaaaatggtactcatgctctactcctttccgcacgctttagcgcacgacgactcacttttaattcccaactcatccattccccaatacaacggcataattctttcttatacattctggatagcggttttagtagtagctgttttttatgctcattttccagtttcagagcaagcagcccctcatcccatggcagaacatatggctcttgctgccaagaagccgggaaatggttcatgtattcccacagatacggctcctccacaccacaatccacagcctgtaaaaatagcttgtgaaatacaagatctttggggaattcgggttgactgaataaatgctcaagccaattctgtccgttgtgcattagcatacggctataatcactgacccaaactcgcagttctgcccctttccaaacagaaattggacaaaaatcaggtaactctacatccaaaataacaatgtcataagcctgctccgtcttttgatcagtccccataccgatatgcaggtcttcccatgctgtaaatccaattgctacatcaaaaccactaaactgcgtaatgggaagtggtttgtcgagcatccctatgccatactgataatgtccccgcagcgtagcatccacaagcagtacctgttggccggaagctgctaatatgctgctgatgtataacaaggtatcgcttttgtcacaaagcccggcaaatatccatgttttcatacttccgttccttttctctcatttatttggcatacggatcagagcttccgccctgcgtcagaatctttgtttgttcttgatgatcctgctcgttctcatattcatttcttgtatcatcaatcccgcttgctgggttttctatagtagcacccgcatgctgggctacaatttcctcactcagacttctttccacgggtgttgaaatcacattgtttgacgaattaattgcattttcaagcgaatcccgcagctgcttggacagcttttgttcagccacgcgtatcaaattcggatcactattcattaacgctaacacctgcgcattaggcggataggtcgggattgccttgggctgaaattggggatcgacatatgtcagggcatagatagatgctttatgcagataagcatcaacaatcgcactcgaaagcgataatatttcctgctcattcaaagtgatccagacaattggaccttccagtcgagaaatcttcttcttagataatagaatgtaatcctgccctgttggaaattgaatgcggatatccacttcgtcacccgacttgaggttgttgggcaatactaccacctttagctcacggttgcgtaaatctttaggtgtgggctcatcagcagtaatcatggccgatgtaagcacagatcccttttttagctcaatcttggctgtggtaccggaaacctcacttttatctgtcagcaaatttgatggggcctgagaaccgggaactttaattcccttcaaatcattagatgcaatctgttcgcctggagaaatgtcacggacaaccgcccaaccttttttcgcggttcgttgctcctgttcatacactttccatttctgctctgcctctacttcagcctgtttcctgacatcatccattttatggatattaatcataaggtagccagcaaagatagtgccaacaatccctgcgccaatacaaccggcgtatagcttttgtttactgctttttcttagcttggacacacaacttctcccctgcctctttttgatatataccgttctatttagcgctgtcgtttaaggaatccgaagcgttttttccgggtatctggaatgactccgcgaaacagctcgtccagcacctgatccacctcatcatctcgttcgaaggggtctgagtggaacggtaaagcaaatactttatcgtgatccagctccttacgaagcctgcgaaccgcctccgaggttgccaatggcaagcagtaattccatttatgctgtgggtggcgctgaagagatcgggctagccctgctatatcctgaactctccattcggcccctgagccaacgacaagcggataatcggctctcaagaattcttccagtcgttcattgtcctgcccactccccaggtccagtacgataaatctataggaaccacccaacaaagaaatgacatccgcacgagatgtttgccgccagtaatgtactccatcaacttcaaaacgccgacttgaactcgattgtccaacggatgtgccttctacgacttcttgaagtcgggcaaatgctttggctgtgttgtgcagctcaaccaaagctacggagcgggtccttcgagccagatagtggctcaccgcaattgctgtatgagtagcaccggagccggcagagacacccaatacagccactacccttgtacctgcataatccattgaggcatcattaacggatattccttgttgagcaggctgaaaatccgcactgtgccgcagttctccaatgacctccccggcagattgaaatcgttcctcaggatgctgacgcagcagttttcgaatcaccgggatcaattggcggggcaattctccgcgaatatacccttctactcccgcagtccactcgctatatttgcctcctgtacatagatacaatagcagcgctcccaaactgtataagtctgaacgagcatccgtctgacctgctccatattgctccggggcagcgaagcccaccgtgcccagctttaccgtatcttgatccagttcagccttatagctcctcgctattccaaaatcaatcagtataaattccatttccggtgtcagcataatattcgtcggtttcagatctcggtaaatgactggcggttgacgggtatgcaaataatccaacacatccagtacctgcaaagcgaatgggacgatttgctcctgtggaatatagccttgatagcccttcatgtatgcttccagcgtaattccttcgatgtaatccatgaccaggtataccgcaccagatcgaggatgctcaaaaaaatcaacaattctcggtaaacgtggatgacttagcgaaatcagcacctctgcctccgtacgtacaagcttcatcacttgtggcccggcaaccgactccttcaccgcccattgcttgcctggcagttttaaatcctctgccatgaacacgcggctcattcctcccgaacccaatgtgcgaacaatacggtaacgctcaccgacaatggatccaaattccaactgtgatggttgcttcattattctcctacctcctttctaaagcagacaacgcaaaaaagggaaagctgccgcaaaatcaaatttccatgtcgccatgaaaaccgttttcgcgggatgctttcccttgatttaaacatgattattatttttaaggaacaatttggatttattatatagcacacctgtatctattgtaaagtattattttccatacttgatcatgtacagggtaatttcatctcggttatggaatagctgcttagctcgctgaatctgcatgccggactcctcaaatgaagcaattacatcatgaatgagcgccaagggctttttatgcattagcttgaccgtaacgatagcagtaccaccacttcgcaaactatatagtaaatcagtaacgagccttgccatttgcttaggactccagctcatatcacaaaccagcagatcgaacgaattctctttaaatttgacttcacttgcatttttacgcaaaaaagtcagattggcgtacttcatcagtgatggctccatctttgccggatcaaccgctgtaactttcagtccccgctccagtaagaaggaagtccaaccacccggtgctgccccaatatccagtccctgacggaaagcagcaaaatctatgccgaacgttgcttccgcttccaatagcttgaatttggcacgagaaatttgtccctcttctttttgaaaacgaaccgcgcctccgctccaatccgataggttatcctcaggacgtgatacacctgcataccacgtatctgtatctgcaaaaacggacacaataagatcggcgccttgtactgtctgctccataggtagatcacttatttgttcactcaaagcctgcttgagcgcacctgcgctttcagtccaactgctattagatcctttgcgcacttgtaaagaaacacgttgattcatcagttccttgcggttacggatgaatgcaaccagccgttcctgcacctgaaccaggtccgttccttcttcctgaaaatgaacaggaaataagtgacgtaaaaacatcggcggctgagctgtaattgtcctcactgcctcaatttcttccgcaggtaatgtggccagaaaaatttcaccaggtaaaagcatcgtgctttttacagagccaaataatcttctaagctcctcttgagcatagggtgcaaaaccatgattggccgtacaaacaaatcttgatgatgacaaagtagattcactttgttcatctgtactcatatatagttcctccaaaataacattaccctccagtgcacacccgaatccagggacgttctccatcccaatccagctcaaccggaacttcatatgtgtgcataatcaattctttcgttaaaacttcttttttcggtccagctgctgcgaccttaccatcacgaatcaatgcaacatgcgtaaagagggggacaatctcctcaatgtggtgagtcacataaaccactgataagtctcgcttgcggagccgatcaatctcgaccagcattttttcccgctcaaatagatccaacccggcacaaggttcgtccataattagcagacgaggttctgccatcagtgagcgggccagcatcacctttttacgttctccttgagataacgtccccagtgggtgatgaatcaagtcgcctaaattcataccctccagcaaagatatggccttttcttttgcctctgtcggaatttcctgataaaagcgcaaaaaagcatacgcacctgtagcgaccacttcccaaacgggatcttttagcgccagcttttccaacaaggtctggctgatatatccgatttgtttgcgaacttcccgcacatcacattgaccatacatttgcccaagcacttcaaccgttccatgacttggaaacatatatcctgtcatcatttccagcaatgttgttttaccggaaccattgcgacccagaatagcccaatgttcaccttctcgtatgtccaggcttacatcgtccaaaatccgtctttcttcccgctgcaacgtaatgctcttcatggatatcattccatcacgctccttattttgctcagcaagtgttctacagattccattttgtagatgatttcaggatttttgttttcaccattatatataagaagcgcgggaacgctggatatccggtattcctgtaccagttcaggaatatagttaatgttgctctgcaccactgcttcttcagggagcaaatgctctgctacctccagcattttacgggcagccgcgcatgttccgcacatgggagtgtacacaaacaaagctagcttgcatccctcccatatggcacggcgcgcctctttttgtccgatctctttcatcgttcagacccttttctgatctctcgcatacgctcttcgggtatgggcccgttatgtacggtgactccctctggcttattcgcatacagtagctcatacatggctcgccgcccctctggactggacgaatgcaagtaaatttcacgtggatataaccgtttctctgcgatagcagcagccacatcctttcccgtaggctgacctggacccaaatcataatctagcgatagtatcgaaatagggtattcatgaagcagcagcagacactcatccgcatctcttgccagcttaaagcccggaggacaaggccgataatcgtccataaacaaatacatcaacttctcctccttttccatatatgcaagctcacaagcctcaaagatagttattatcaatcagaccgatttactcccagcttagaatcatttgaatatcctcctgatgtgtcccatcaggtcccgtctcactctccaaaacaataggaatccctcttacagcctcctgttctgtcatccaacgcatgccctcagtaccaatgtagccttgtcccacacgggcatgtctgtcttttttagagccatatgggtatttagaatcgttcaaatgaactccacacagagctgaccaatagccgagacgattccctttttcgatcaaagcctcgtccattccaccgttccacaatcccgctgcatatgcatgacaagtgtctaagcaaaagccgatactgtcaggataccggcacaactgacggatctgcaccatttcctcaagcgtggttcccatgggtccatgatctcccgcctgattttcgatcaatattttagcatatccctgccagccttccagcacatcattaaaacagttaatgatattacggtagccctctagagggtctaacgaatgcatatgaccaaaatgaacgacaatcccttttgacccacaggcttcagcaatatccagatcattgcgtaatgaagcaatcgtcagctcataaagttcctgaccacgctcggacccatgagccggattaacgggatatggtgaatgagcaatggattgaagctggtgctctaaacagtaagcgttgcaagtagcagcatcagtagcactccattccttcagcctaagactacgaggatttttcgggaaatattgaaatgaacgtcccccctgctctcgcgcacgcatagcggctttggaaaagccaccacgcgtactcacatgggagccgatgagcaatttaggcatcatgctgctgtaccgggcaataaaatgcttttttccccgccagttcaacccttacaattttcccgccacttggagattcttctccttcgcggtcatatactcgacactgatgatcaaatccacctgttagcgtgtccccctccattagaggcatttccatgtacccgccttccgctgtagcttcacgtagtacggattgagtggcatgatatagcttttccactttttctggcgactgcacaatgttctgtactttggaacccggtgtaaatccggcgatataagcaatttcgtctgaataacaattgccaatacccgaaaaaatctgctgattcaccagcgttgttttcaaaatcccccggcgtcccttcagccgtgctgtaaacttttccaacgtcatgcgacggtctaacggatcaggtcccaggtctgacaaagcttcttctgtttctttagccgttagcaggtgcagataacctaagcgcagtccgataaaataaagttttactccactaaaatctaattcgatttgaactgtacgatctggacgctgctcctccgttcccagatataacagtcctccgagcatcagatgaagtacgagccgcccgcccgtgtttaaatgaaaaatcaaatgcttgcctcgacgctctaagtatacaacggtcgttcccagcaattgcttctcaaacgtttccacttcagtattaatggacttttcacggctaaccgtaactccagtaatcggaatgtccaaaatttgttttgataataagattctgtagttttccatttcaggaagttccggcataaaacatctttcctttcgtagctacatagcttttaattctcgcaagttttgtaagacatatactttctattatttcagctcttctttcatccagtcctgcagttcagcgagattgtcaaacatcaggtcaggtttcactccaacggtacgcacatgctcgtccatattagcgcgggtcgtcacgcccgacaggatcagagctgttttacaacctgctgctgcacctgccgcaatatctgtaagcatattatcgcccacaaccagagcttcatccgccctaatgtttaagcggttcagcgcatagttcatcaatacgcttgaaggcttgccgatgacaataggctttacctgtgaagccgcttcaattgcagctccaatcgtacctgcacctggcgttagcccatcatgtgaaggcaattggagatccgggtttgtcaaaataaaagttgctccttcccgaatccagcgcatggcagcggccagcgcatcatatgtaaattgacgatctatcccctgcaccacataatcaggatggttctcaacaagctgcaaaccggctcctgtgagtgcatcgcgtaatcctgtttcaccaatacaatatacacgagctccaggactttgctgtgcaacatattgtgcagctgctaacgccgaagtatatacttcatggctggccgcttcaattcccataccaaccaaatgctcagccaccgaatcgggtgtacgtgaagcattgtttgtaacataagcataaggtatctggtctgtacgcaatcgggatatgaacagatccgcacccttgatcatccgatttccatgataaagtgttccatccagatcaattagtaacgattttatcgcaatcccctcccctacttcaaatccattcacatcatagcattaaaaactataattcatcccatgaacgatgttctccttcttatttaaccaccttaattattcaggtcataaaataatcggccgtctctcttcatctcatctatcttaagtcaaaaatgcttatgaagtccatgaattgctggtaaaacgtccaaaatagtgccattcctcgctaaaagccgtcgctttcccatgacataagttcacttcttcgtcgaaatccatcgaaggcgctatttcctcaaacgaattctcctgtatttcctggtcatgctcaagaaatataatcctttaaattcgatatatagaaactcgaataggacacgcctccatatgtggtagaacaaattcatcccccaccaccctgcacgggttctcatctcttgtcgcttcctgcgctttcccggaaaataatttcggtgaaaaacaaaggcaccgaggcaagccccggcacccatgcacatatcttctccaatcgtttattaaccgatatcgggtaccggtaacaacacatgctgctccgcaagcaatgaattaggaaatatgctttgcgcttcctccagcaatggctgaagctgctcctgatctttatacctagaactaaaatgcgtcatgattaactgactcgcacctgcggcttttgcagcttccgctgcctgaagcgctgtactatgatgatactcgtaagctgtatctgccagttcatgcagaaaagtggcttcatgaacgacgacagttgcatcttgagccagcactaccgtattcggacaaggtctcgtatcccctaaaatcgtgatgatacgcccttttttcggcgaacccagtacatcctgaggatgcaaaataactccaccctctacctccacgctttccccacgctttaacttaccgtacaccgggccgggcttaataccatatcgctccaacagctcttggttaagcttaccgggcttatccatctctacaattcggtagccatagctgtcaatccgatgatccagcaaagctgactctacccggaattgtccgtcatcaaacagaaccccgcccgtatgctccacaatatgtagttggtaattgatacgcgattggctgatccctaaagatagctcgatatattgctggattccaggcggcccatatatcgtcagtggtgtcgttcccccttgatacgctctgctcgacagcagtcccggcagaccaaaaagatgatccccatgcaaatgggtgataaatattttttcaagtctgcttagtttgagcggcgaacgcaatacctcttgttgagtgccttcgccgcagtcgaacagccacatgcttcttcgttcttccagcaaacgaagagcgatggacgttacatttcgctgaatcgtaggcacccctgcatttgtaccgagaaaataaaattccataacattgaccttcttcctgctgaccagcaaaaaacctccgaagctcggagggtatttgctatcccatctgataaaggtgttaaaccttttcgacgttaaaatactgcgcctgagggtggctgaacaccatggctgatacagaagcctccggttccatcataaacccttccgtcagctcaacgccaatatcctcaggttttaacaactggaacaacggcccctgatcctctagatctggacatgccggatagccaaaggatacccgaatgccttgatatctggcaccgtgtcgctgtttcattgtcatatcggcagggtccgggaacccccagctatccctgataatatggtgaagccgttccgctaacccttctgctacttcgagtgctaccgcttgaagtgcatgcgagcgcagataatctcctttatctttccactgggtagatatctgctgaatcccatgaccagctgtaacgaccatgaaacctacatagtccataactccggattccactgatttcaagaaatcagccagacatagataaggctctacctgctggcgcgggaatgtaaatgtgtgcagtaccttgctcacatccgagggatcatagatcagaatttgatctccttgggactgcgctggaaagaatcgatacattgcatgtgcctggatgattccgtctgtcacagcttcaaacatgatgctgtccacggtttccttcaactgaatcgctttcggatcttccgaagccagcagctgttcaacattgccttttaaaccaagatgatgccccattagcatctgcatattcacgtaaggcaaaatataattcagtggatagttgcgcagtacatggcgatccgtatctggtggaatataaacgggcaaatcctgagcaatattagagcgcacagctcgagtgagcttagggagcggcttggcttccacgacgattgccgcttccgcctcccgctcagcctccatgtcctcagccatttttttgcgggactcaggattcataagcttattggcaatatccagaccatccatagcatcctttgcataggcaaccagaccatcatactcaggacggatacgatttttagtgaacttacgtgttaaagcagctccacccaccattattggaatatcaatattcgcattttttaaatcttgtgcggtcagcaccatttgttgtgccgatttaacaagcagtccggataagccaatcatatctgccttttcttcacggtaagcttcaataatgcgttctggtggtacttttatacccagattcacgatatggtaaccattgttggatagaataatctccaccagattcttaccaatgtcatgcacatcacctttgactgtagccaacaaaatcttaccttttactgaggattcattcttctccatgaacggctctaaataggctacggacgccttcatcacttcagcgctttgcagcacctccgcaacaatcagttcgttattgttaaatagtcgtcctacttcctccatccccttcatcagcgggccattaataatctccagcgaagaatatttcacgagcgcctgctccagatccggaatgagtccctccttacttccctcgactacataggaagccagtcgttcttcgagcgaaaggtttgatatcttttcttttttctccactttcttgttacggaaagctgctacaaaagcggataaagtatcgtcatttgttttatagatcaagtcttccgcaagtttccgctcatgctctggaatggatgcatagcgttcaagcttctcagtgtttacaatcgcatagtccagacctgctttggtgcattcatataaatagacggaattgagcacttcacgacccgcttccggcaaaccaaaagatacgttactgatacccaggatggtatgaaccccgggaagcgcttctttaataatgcgaatgccctcaatcgtttccttagctgaaccaatatattgctcatcacctgttcctactggaaatacgagcgtatcaaaaattagatcctctgctgccaaaccgtaacggtttaccaacagatcataagaacgtttagctacctcaagcttatcctcacgtgaaatagcctgtccgcgttcatcaatggttccaacaacaacagcggcgccgtacttatgaataagaggagccattttctcaaatttctcttcaccatcctccaaattaatggagttaataatcgccttaccttgcgaatattgaagtgctttatcaatgactttaatatccgtggtatcaatcaccaaaggtacttttaccttgtttacaaccagtttcaaaaacgcttccatatccgtcatttcatcgcgatccgggtcctgcacacaaatatcaatgacatgcgctccgctttttacctgagcgcgggcaatttcagatgcctcttcatatttgccttccacgatcaaacgcttgaatttgcgggagcccagaacattcgttcgctcaccaaccatatacggacgattgtcctgttcaatatatacaggctcaatgcctgatacggcaggaggatgatgacctaccagcggacgcggctcaaactgcgccatactttcactcataactcgaatatgctcaggcgtggtaccacaacaacccccagcaatattcagccagcctttttcagcgaaagcagccattttacgggctaatgaatcaggcgattcatggtattggccattttcatcgggcaagcccgcatttggataacagctaatagctgcagaggacatttcagacagagagcgaatatgatcacgcataaactctggacctgtagcacaattcaacccaatcgaaattggatgtaaatgttccagcgatatgcaaaaggattcaatattttgtccggccaacgttgttcccataggctcaatcgtgcctgaaatcattagcggaagctcgatacctgactgctcaaaagcctgccgaattccgatgcttccagccttgacgttaagcgtatcctgtgaggtctccaaaaggagtacatccacgccgccttcaataagcgccaaagcctgctcttgatagctgtcaatcagctcagcaaatgtaacaccacctgtgacagacaaggttttcgtggttggacccatagctcctactacaaaacgaggcttgtccgcagtgctgtatttatccaccgcgttacgcgccagtttggctgccaccagattaatttcacgggcacgttctggtatatcgtaatccgccaaaacgacggatgttgctccaaatgtattcgtttcaattaggtctgccccagcctccaagtaagcttcatgaatcccttgaatgacatctggtctcgttaagaccagcatttcattacagccctccagctcttccccaccaaaatcaacgggggaaaggtcttcctgttgaatcatggtgcccatggccccatcaagaaggagtattcttcgttgtaatgcatcctgcaagctaactttatccaaatttcttcacccccgcaaaacgttaaatcctagtttagcagaaaccgtatcatttagatagattgaagtaaaaacatacgttttatacaggttgttctttgtaaaaacgacttctctaatccatttttataatttgtagcattacagaacgtacttaaccctgaccttttagctatagtcatttgcattataaaatgttgaagtcctgtattgtacaacgtttcaagacatggtattctttatacatcattaatccaagtggaaaagagggaataagcatatggccgaaatcttaatacgtaatacgaacgagcgaattagcggtgaagcacaagtacgtgaatttctggagagtcacgagatattgtatgaacattgggatacttccaaattgtccggggagctgcaagagaactttaccttaacagatgatcaaaaggccgctgttctccaaacatttgaacccgaaatcaaggatttagccgcacgtcgcggatataaaatatgggacgttatcactttatctgaagcaacgccgaaattagacgagctgctggccaagtttgagcaaattcacacacacaccgaggatgaaatccgtgccattgtcgctggtaaaggcatcttcatcattaaaggccctgaagagattggctattttaacgtagagctttcaccgggggacgttatctccgtacctgaaaatatacctcacttcttcactttaatggagaatcaaaagatcgtcgcaatccgattgttcatcgaagaaaatggctggattgccgaaccgtatgaagacccaaccttcattaaagcataattacgaatttatccttgtgtgaataaaaaaactccctctgctctgtgaagtgcaccccttagaatagacattggaataaacccctggtttatccgatgaatttctagggggtgcattttttatgccagcgaaaaaa

SEQ ID NO: 2608 - DNA, 62260 bp, Unknown
  Kingdom: Bacteria, Phylum: Firmicutes, Class: Bacilli, Order: Bacillales, Family: Paenibacillaceae, Genus: Paenibacillus
tatatagaagcaagcttctatataaccccgctcgacttgcatgtattaggcacgccgccagcgttcgtcctgagccaggatcaaactctccattaaagaccaaccgaagttagtttatagaaagagcgataagctcattttgaaactgacgagataaaatatctcattttcgcttccatttcatacaacctaatggcatgtaccaaaatttctgcgttggattttgtaaacaaaatccgtactcactcgttgttcagttttcaaagatcaaacttgcataatgtcttactttgtttcgtcaccgcgtctcagtgacgacctttataatatatcatctctttttagaatttgcaagagttttttttaatttcttttttcgagcaaatccttcaaaaaggaacgaaaattaatttaccatgaatattgaatagagtcaatactttttttgatatcagaaagtataagctttttaaaatagtttacttcctgatatctctgatatgttttctaacctatctattgtttggtttgtgggactcgccctctgcgagcatattttgatagttccttggcgggtgcaaaacgggcatacatgcggaagactgttttatatcgaagtgcgattgcgtagcgaatatcttgatccaatcgagtatcgctcatatcaagcagcatttcatctagctccttacgaagaacgtagtcaagttccttgcattctttttcgttaaacagcattcccaacatatgaccaaactcccttatcagcagattatatagtacttatatttgctcaactattgttccaatctttacctgtttttaaactcaactgctaaggtttcaaacttcccccgattaatcttcagcttctctttaagctctcccctttgttatgttcaattttcaggaaatatataaataattggccataatattttattgtgacaataaacgataagttatgccactctcaatagcagctgctataagcagtaagatgacagaccatagggataccctcaacgtttgtttcctaaatacattccacgatgggccagttcctttgcgctttagccctatgcttgtacctatagtagacattatgttgattccaaacttcaatccgaaggcacaggcgataatcaaaacaggcaattcaatcacaccgtgaggcagcaacccttttacaacaacttcatacatacttcttcccatatctgtctgcaagtgtactacaaaccctaaaaccataccgttcacaatcaaaaatataaacggtacgattccaaatacagcccccataaatatgatcagcacacatttaatcgcattattgaaaaagataaatacaaaaaaactccattgtggatgctcagaattctgcaagtgctgcgctacttctcccagtccctccatttgttgcgccagcatggattgaattgtgcctgtacttaaccaccccactataatacttgtgcagaaaagaagtgcagagattaaaattaaccgtcttgtcatgtgtaaatcgtgaaaaaatgcgtttagtcccatttgataattcctcctattagcccaatggaataattgacaacccctggcatagctttaagtaaacaagcacttctaggatgaaaggggcgttattaaccatgaattcttttttttatgtattaaacggtaaaaaaatcaaacgattcttaatcgtaatggctgcagccatctttactgtcggagtcatttatgtagaaaccgataatgttacagttttttccgaggaagcaccaaccgctatttatagtgtgcccacggacaaaaagttgatcgctctcacctttgatattagttggggcgataagcgtactgcccccatcttaaaagtccttgaggataaaaaagtgaccaagtccaccttttttctttctgccccttggagtaaaacacatccggaacttgtgaatcagattaaagaaagcggatttgagatcggcagtcatggccataaacacgaaaattacagtagcttaagcgatgaagatattcgtaagcagatttcaattgctcataccacattaaccgaactgacaggacagtccccgaagttgatccgtatgcctaatggcgactttgataaaagagtccttcaggttgccggcactttaggctacaaaaccattcagtgggatacagattccctggactggaaaaaccctggtactcaggtcataatcgaccgtgttgtaaataaagcgcatcctggcgatatcgtccttctgcatgccagtgattcctgtaaacaaacgcatgaagccctgcccgtcattattgacaagttgcgcgcacaaggctatgaattcgtgactgtatccgaactgcttcaacagggtacagtaaaaggcaaagaggtacgcgatcaggcactgggtctttaaggagttattttacatcgttctcagctaaaaaccaaaagcaaatcgacatatttctccccattcatccgcatactatccacattcatgatgaaggaggaatacggccatgaattggactcgtttgcgatttgttagcacggtatgcgtactgggcgttgcactgagtggatgcggctcggatcaaggttctgcgcccccccagaacagttataaagagatgaaaacgatggttgtcgatatcctgaaaagcgatgacggaaaaaaagcggtagaggaggctttaaccggggaaaacagttcatccaaagaaggacaatccggtcaaagcagtgaagagggtgggtctggtggtgggtctggtggtagcatgggaatgaaaatgcttatgcccatgcaatcggctgaacagatgaagatcgcagtcaaagatactttggtatcacctgaatataaaaaagaaatcgaaaaaattatgactgatccacgttttgccggagaatttgccaaagccatcaacagccaaagcaaacagcttcatatgcaacttataaaagacccttcttatcaaaaatcaattgaagcaatgctcaagtcaccagaattaaccaaaatgtatatggacttaactaaaacccctgaatatcgcaaacaatctatgacagtcatgcatgatgccatgcaaaatccgattttccgacttgaggttatgaatttactcaaaaccgtcgtacaagaggagcttcaacccaaggttgagaaaaaaaccggtgagcaaagcggtgcaggcggcgataagcaaggtggtggtggaggtagcgaaggtgggggcgaaggagaacaaggaggaagccaataataaaaaggctggtttaataaaccagccttttttctttattcagattccgtgtgcaaaatcgtaatctgagcagcaatatcattgtaaatggtccccgtggcagactcagatttatatacagatggagaaaagtcggcctctgacggatggttatctggaatacccagcggaatttgagcaagaagttttgtatgaagagtgtctgccagcatagccccccctcctcgcccaaaaacatagtccttttctccagtggaggacacataataagacatgttctccacaacgccgatgaccttatgatccgtttgaagcgccattgcgcctgcacgtgcagctacaaaagccgccgttgcatgtggagtagtgacaatgatttcttcactctgcggaatcatttgatgtacgtcaagcgctacatcgccagtgcctggtggtaaatcgagaatcatatagtccagttttccccattcgacatcactaaaaaactgtctgagcattctccccagcatgggacctctccagatcaccgggttgttttctctaacaaagaagcccatagacatgattttgataccaaatcgctccactggctgaatgataccatcttcgacagtaggcacatcctctactccaatcatatccggcacactgaatccatagatatccgcatcaatcaaacccacacgcttcccctgtctagctaaagcagccgccaaatttacagctactgtcgattttccgacaccaccttttccgcttgcaatggcaataaatcgtacgccagatgctgggctaagcagctcatgttcttccatgccaacagcatgtcctttggtcaaaaccgggtcagccgcttcctcggcctcctctccattttgaagggcagacttttcatgctcagatgcctcacgaatacgaatatgaacgtgacttaatcccgcctcttctaatgtctgccgtatttctcgttccaactctttcagcgtctcttcctggctattcagggtaatggcagtcaaggatacccgatcctctttaaccaccacatcccgaataaaatggagatcgactagacggcgtcctgtatgaggctcccgcacttgttgaagtagctctataacttgctctcttgattgcatgaattatcagcacctctgctttaatgaattacggagtggtaaacacttacagtataccactatctggcttcaggtgctggtgagatccccttttccccggcactgtaacgcaaaatccccttatatatggacgccgccacctgcctttgatagttcacgtcactaagtcgtctagcttcctcaggatgggacaaaaatcctacttctacaagggctgatggcattttgagagctttcaataaataaactgtgttcacggtcttagccactctgtccgtattttccaagttgcgtttgatctcttcctgaattaaagacgccaaattcccgttatctgcatggttaggtacgtaaaaggtttgggctccactccaacggctcgacggaatactgttcatatggatacttagaaagaggtctgctttctgctcctcaattatacgcacacgctgcttcaaatcctccgtttttcttctggaataacctttcgtttcttgctgcgccaggtcgcggtcatcctcacgtgtcatgacaacaacagcacctgcttgctgtaaataatcccgcaaataaaaagcgattgccagattaatatccttttcaataatcccttctttgctaaccgcccccccatcaggccctccgtgtccagcatccagggcaattactttaccagtaaggggtaaactccaatgggtccaagctctggaagcaggtatctcatacaatgccagtgtaataaatagaacggcgagacaacagcccaacagcattttttgcaacgtccgatagcgaatccacagtgtaacctcgtttttacgattatttttttgcataacaaaacgcctccgtcctatacagatactaataatctatatgggacgaggcgtgtagatagtacaactcaggcatgaacaaattctttcataccttcaatcagcacttgagcgacttccggtcgtgtaaattcaggtggcgggcaaaccccagagcgcaacaattcccgtaccttggtgcccgagagcgttaaatgatgctccttgggatgtgggcatgttttacttgaggccatatttccacatcgggtgcaataaaagctgtgttcaaagaacaatggagtaatccccagctcttcaggtgtaaagtgcctgaaaatttcctgtgcttcgtaggtaccataatagtctcctacaccagcatgatcccttccaacaataaaatgggtgcagccatagttttttcgcacaatagcatggaaaatggcctctctaggacccgcgtatcgcatggcagcaggaaatacccccagaaaagtccgatcagccggataataattgtccaacagcaccagatagctcttcatacgcacatctgccggaacgtcatctgacttggtttcaccaacgagtgggtttagaaacaaagcatccacaatctccatcgcgcttttttggatgtactcatgtgcccggtgtaccggatttcgtgtttgaaatcctactactgttttccaacctttttctgcaaaatagtcgcgtgtctgtgatggtgtatagtaaaactcactaaattgtgtgggctcaggccgattcagcacttgcacacatccaccaacatacgtagcaggtcgatctaacagtttttttacgccaggatgagccgggtcatccgtcttgaatactcgtctggcttcctcagcctgatctacctgataaatactttcaatatcaagtacagcataaatagtaccatctgtttcacccaccaaagccgcctgctgacctaatttcaattcactggctacactttctgcaactgcaagagtaatgggaatactccagactgtaccatcggcaagacgcatatctgttaccacagaccgataatcagattcattcataaaccccgtcaaaggagagaatgcccccactccaatcaaatccagatcagaaatggtccatgagtttacacggattgggaacaattcctctgcggcctgcaaaagtgctttttgcttcggtcctgtaatgattttatcaacaagtgttccgccatgcggaagaattgcagtcataatgcacttcccttctcttcataaatatgactcatagctacctgaataccattttattgatggagcccacactccgttttctcattgcctgaccagcgacctgcacgaggatcttcacctggtaggacctcacgggtacattgctcacaaccgatactgggataattgcggtcatgcaatggattatacagcacttcatgagtacggatatagctccatacatcctcggatgtccagcttgccaaggggttaaatttaacgagtccaaacttttcgtcatactctaccttttttgaattcgcacgggtaggggcctgatcccggcgaataccggtaatccatgcatcgtattgtgacaaaatacgtgtcagcggctcaactttgcgtataccacaacatgtgtttggatctgttttccacagttcctctccatgctcagccgcttgctcttcaggagtaattaagggagagaccctaacaaaatccaagttatatctggctttcatctgatctcgcgtatcataagtttcttgaaaatgaaagtcggtgtccaagtaaaaaatgtcggtggaagggctaattttttgaagcatatctactagtactacatcttctgctccgaagctacaagcaaaggtaagattgggaaatgtaagaacagcatactggataatttcctctggcgtagcctcttccagttcaattgccttgactctaatcaacgcttctttctccaataaattcattatcaatgcgcctccatatgaagattcataaataagtgtcactccaataccgactaaactaataagattaaatacagtataaaactttcacaatcattgtcaatccacggcaaaatgccctgatgcaagcatttatccacctaaatttgcaggaatgttgctctgtcagcattctttaatgctttcttgcgtatccaatcaagttcattgactttatataaaatattcttataccaaacatttgaaaaatggcccataggcccagtgcgagcagcaatcggtaatgctgaacagctttgggttgctttgatcaagcaagaaccatctgtagaagaaagcaagcatcgtttctaaatctaagattatcgaaggatgctaagcgagggatttgaaaataactttaggtttcactctactattctggagctctggcgacagcgatgccttcattctgaaaattatagaaggaatgactgcgcgctaaactcttagtatacctctattcaatcctaaagcgctcgtagcggcaattcccaaggaattgatcactgaacacaagcaagactcttatcgctactggaagcctatttaaagcctgtcatcaatgaggggcgatattatgagggtagacagtcggacaatacatggtactcccggttatagtttggagtgattgctgtgtagactatttctattaccagtaacatgtacatcgccgttgcaattgcagtagcctaggaagcggacactgctaggctaaggaccgtctttctgcaccggcatacaaataaaaagaggtattccttgccgtatccctagctaagcccaaaacagctgtacaagaggcatagacagtgccagccagaacatatcaaggaggactttacataaacaagtgaaagcaaagtatcctcgtgaaacagcacttagcagaaaatattaagatgaggctatattgaataaccgaacattatatttttagtcacaggttataaacattacagaataaactgcgttgaaatagcaaactgtatttgtgtataacaatatcatcttcaattccatcgtggataacttttcgtattccgtgcatttgcatgcagttatttatgtattcgctgaaacatgctgaagcttgtaacttttagagtaggtctacttatccacatgtggataatgatcaggaaatgactaaataaaaaagaaccctttccataaggaaaaggctcttctgtattccaaatattaacgtttcgagaactgtggtgcacgacgagcggctttgaggccgtattttttacgttctttcatacgtgggtcacgagtcaagaagcctgcttttttcaaagctggacggaattccggatctgctttcaacagagcacgggaaataccgtggcgaattgcgccggcttgaccagagataccaccaccatgagcgataacgagtacgtcatagctgccaactgtttctgtcaggttcagtggttgttttacgatcagtttgagagtttccaaaccaaaatattcattaatatcacgcttattgatgacaatgcgtccttcacccggtacgagacgaacacgagctaccgaatgtttacgacgacctgtcccatagtattgtacttgtgccatgaaactgtcctcccttttaattatccgcgaagttcgtaaacttcaggtttttgtgctgcatgtggatgctcagtgcctctgtaagctttaagtctcagcttcattttctcgccttgacgagttttaggaagcataccgtgaacagccaattccaacatacgctcaggcttgttcttaaccatttcttgtgcaaccgttactttcagaccacccggatgcagggagtgacggtagtatttcttgttctccatttttttaccggtcaatacgattttttccgcattgattacaacaacaaaatcacctgtgtccacatgtggtgtaaattgtggcttgtgtttgccgcgaatcaacgcagccgcttcgcttgccagacggccgagcgttttgccttcggcatcaatgatgtgccagttgcgctcaacttcatttggcttcgccatatacgtagtacgcatgaaaagtatcctccttaagttcgttaacagaaatcatcatttatcttcgttcgttaagttgctgcattattgatggattagatgttaatttaaagtgattatcttaattggggctgtgggaaagccattaagaaaacacaacttttatattacaggataaccatcaatttcgcaagggtaaaatcaatgttttttgatgttttcgtcgtactctacattccagagcgttaaagcgtgtccaacggccgtaggtccagcctttgagcgatttttcgcctccaaaatggaaggaatatcatccgacgattttttgccttctcccacttccagcaaagtacccataataatccgaaccatgtgctgtaaaaatccgctacctgtaatataagtatggataattccctgatcatccgagcccggacgtgaaaaggaatggtctactgtcatataggcttcgtaaatagtgcgaacatgattcgtcttttgggaacgtcgagatgcgaacgaagtatagtcaaaggtgcccactaaatgagccaacccttcctccatcgctcttacatccagtctcgttggatgatgggcctgtgtacgacggtgaaagatgtccggaaaccggttcgcattaatactgtaccgatatgtcttccgcttcgccatgcggcgtgcatgaaaggacagtggcacctctctcgcatccgtaacgatgatatcacgaggcaaccaggcattaagtgccagacaccagcgctgtaacggaatcggcgattcagtgtgaaaattgaatacctgcccgtatgcatgtacacctgcatctgtacggcctgagcctgtaattttaagacgctcgcccgtcaatgagtaaatagcatgttcaaggcagtcctgaatggtgttaccgtcaggctgcgtctgaaagccatcatagtgggttccgtcatagttcaccttcatgcacaagttccgcatgtttctcacacctttataggggtagtctctggccttacaaggaataaccgaacataacaaaggagaagtccctcaaggactcctccaagagaaaaaaagggttgttcagaatcaagccgattctgtccacccttccctcatcttcccctgtctacgcgcggtcaaccaattccagatataccattggagcggcgtcgccacgacgaggtcccaatttcaagatacgagtgtatccacctggacgctcagtgtaacgtgtagccaattcgctaaacagcttttggattgcatcctgctcaccatccaaagtttcacggcgaacgaacgcagccacttgacgacgtgcgtgcagatctccttttttcgctttggtgatcagtttttcagcaatagaacgaacttctttcgctttagcctcagtagtttggatacgctcatacaagaacagatcggttaccaaatcacgaaacaaagctttacgggcactggagttacggcccaatttttggtatgccatgtaatttcccctccttcacaaaaacgttgctgtactattcttccgtacgaagtcctaaaccaagttcctcaagcttctcttgtacttcttccaaagatttgcgacccaagttacggaccttcatcatatcttcttcagatttagtcgtgagttcttgtaccgtattgataccagcgcgcttaaggcagttataggaacggacggagagatccagctcttcgatcgtcatttcaagaactttttctttcttgtcttcttctttttcaaccataatttcagcatcttttgcctcgtccgtgagacccacgaacaacatcacatgctcggtcaaaattttggctccaaggctcactgcttcctcgggacgaatacttccgtcagtccaaacctcaagtgtcagcttgtcgtaattcgtaacctggccgacacgcgtattttctacgccgtagttcacgcgtgcaatcggagtgtagatggagtcgacgggaatgacgccgatcggctggtcatcacgtttgttccgatcctgcttaacgtaaccgcgaccgcgattggcaaaaatacgcatgtgaagtctcgaacccggtccgagcgtagcaatgtgaagatccggattaagaatttccacatcactatccgcacggatatctcctgccgttacaactccttcgccttccgcatcgatttcgagtactttctcttcatccgagtggattttaagcgataaagctttcaagttcagaatgatctccgttacgtcttccttcacaccgggaaccgttgcaaactcgtgcagaaccccatcgatctgaaccgatgtgactgctgcccccggtaacgaggataacagaatacggcgaagcgagttacccaacgtcgtaccgtatccgcgttccagcggttctactacgaattttccataggtgccatcatcattgacgtcaaccgtctcaattttcggcttttcgatttctatcactgcaatatccctccttcaaaacgtcgctcctatatgaaacattcaccttatccatagtctatcatgcagtatacctaaacatccattcttggcagtttgtgccggatctatactacacgcagaggagaaatctcattagacgcgacgacgttttggaggacggcatccgttatgaggtaccggagttacgtctttaatcaggttaacttctaaaccagcagcttgcaaagagcgaattgctgcttcgcgacctgcaccaggtcctttaaccatgacttcgacagttttcatgccgtgttccatagcagctttagcagcagtttctgcagccatttgtgctgcgaatggagtagatttacgggaaccacggaatcccatgccgcctgagctggcccaagagattgcgttaccgtgtggatctgtgatcgtaacgatcgtgttgttgaacgtggaacggatgtgtgccacgccagtctcgatatttttacggtcacggcgttttgtacgtacaacttttttcggtttagccattgaatgttatcctcccttcttatttctttttgttcgctacagtccgacgaggacctttacgggtacgagcattagttttagtacgttgtccgcgaacaggcaatccacgacggtgacgaacaccacggtagcagccaatctcagtcagacgtttaatattcaaggaaatttcacgacgcagatcgccttctactttaacttctttgtcgatcgtttcacgtaatttgctcacttcatcttcagtcaaatcacgaacacgcgtgtttgcactgatgcctgtttccttcaagattttctgagaagtcgttttaccgattccgaaaatgtaagtcaaggcgatctcaacgcgtttgtcacgtggcaaatccacaccagctatacgagccattttacgctacacccccttctattaaccttgtttttgtttgtgtttcggattttcgcaaataaccattacattccctttgcggcgaatgactttgcatttttcgcaaataggttttacagaaggtcttaccttcatgttgattacctcctccaagctttaccctggtaaaactcgcttcgtgaacattcacatcgttttgccgagcaaaacaagtttttttaaatgacatacgtttaataaaaacctgcatgaattacttgcggtacgttatacggcctttggttaaatcgtaaggcgataactgtacaaccaccttgtcgcctgtcaaaatacggataaagtgcatccgcagctttccggaaacatgagcaagaatttgatgaccgttctccagctctaccttgaacgtagcgttcggtagtggctcgattaccgtaccttcaacctcaatgacatcttctttggccaaagtcagtctcctttctcttcagcttggtattcggacgagtccaggaaagttttcactgcatggcgcagctttccgttcgtcacccgaccgctttcgtttaaactgtttacaatctcgctactaatctttggctgaggcaccaaatgaagaacatttttcttcttcgcttgatcaaactttcgtttatccccatccgcaatatatacaaacctgctatctgctactgaaacgacaaccgcaatctgtccggcacctctgcccttcagaatcttcaccagctgaccgatttgcaggtttccttgctgaatcattccaatcacctacgcactcagtttcgtgaaaatgtccatgccgcccgtttcgcacgtcaccgcttgctcgttatgagcacatgaggttacgttcatcgtaacgaccgtccagttgtcttccagcgtccctacatggtgagaacctatctgaatcatagattcaatagccagcccaatgccggttttcagcctcggcccctgctcaggaataccacggtttggattctcaatatattgccgaatggcatgcgacattgtaaactggcgagttttcgcgatgatatcgcctttgtttaacttgcgtttgccgggaaatccgtgcaccagttgttcgttgactgaagcgcaaatgctagcaggaaaaccgttataacctttaaaagacggcacagctccctgactgcgaatataccgatcagctaaatgatcaagttcaccggtcgtaataccgggctcgatgtgtcctgccaagagatgatccgtctccgtatctattctcttagctttcctcattaagcttgattccgtccccgacttgcaaatgatcattacagctaaccccgcaacaaggacacgatattttgggaaaccacatcaatatcctgttctccgtcaatatgacgcagaagattctggttctcataaaacgtgaggagtggtgctgttttattactatattcttcaagtcgtgttcttacgctatcttcattatcgtcaggacgctgatagagttccccaccgtctttatcgcaaatgccttcaaccttaggaggattaaagacaatatgatagctagttccgcagcttttacaaacccgccgtcctgtgattcgtgccaacaagttgtcactatccactttcaagttgatgacgtcatctagcttcgtattcaaacgacccaaaatttgatccaaggcttcagcttgagccaaagttcttggaaaaccgtccagcaagaaccctttcttgcaatctggctgttgtagccgttcttcaacgataccgattgttacgtcatccggaacaagttcacccttgtcgatatattctttagctttaatgccaataggtgttccctgtttcatcgctaggcgaaaagcatcacctgtcgagatatgaggaatgccgaattccttcacaatgacatctgcttgtgtacctttaccagcccccggagggcccatgatcaaaatattcacaatctgtcactcctcaagacgacccctacacaagaaacagcacaaaaggtgccggtaagcatgcgaacatcctaagccggtacctattgcctatttgttgatgaagcctttgtaatggcgtttgatcagttggctttcgatttgcttcattgtatccagtgctacaccaatgatgatgagcaatgaagtaccgccaatttgcacggaacgaggcaagcccgaaagcgaaccgaagaataccggcaaaacggatatgactgccagaaacaaagctcctgtcattgtcaaacgtgacattactcgtgtcaagtatttctccgtggctttacccgggcgaattcccggaatataaccgccgtttttcttcatattgtcggccatttgctgcggattcatctgtacaaaggtatagaagaatgtgaaaccgataatcattacgacatacaaaaccatgcccagcggcttgtcatagtacaagtaagtggtaatccacttagcccaagcatgatctgcccagaaactcgcaataattgtcgggaattgcagcaatgataccgcaaagattaccggaataacgcctgccgcattaattttcatcggaatatgcgtattctggccaccgtacattttgttgccaactacacgtttcgcgtattgtaccgggattttccgaataccttgctggatgtagataacaccaacaataatcagaacaatcaccagggcaattataattgccttcagaatattcataaacagctgatctgcctgaataaactgagattctacaaccgtccgaatatgtcttggaatacccgccgcaatccctgcgaagataacaatagagataccgttgccgattcccttttcagtaatttgctcaccgagccacataaggaacgtagttcctgctgtaagcacaatggcaataaccagataatctgcaaaagtggctcctggaatcatcgctgcaccgtacagtcgattaaagccaatcgacgttccgaatgcttgaatcaggccaagtattaccgtaccataacgcgtaatttgagccaacttctttttaccatgctctccttgtttagcccattccgcaagtttcggaatcacgtccattgacagcaactgtacaatgatggacgctgtaatatatggcataatcccgagagcgaagatcgaaaactgatacaatgcgccccctgagaaggtgttaaggagtccaaacaactcgcttcctgcctgatcctgagaagtaaagacttgcttattcacgccgggaaccggcacgaaggagccaatacgatatacaaagagtataaacagggtaaacaggattcgggttctaagatcctcaacccgccatatatttttcagggtcttgaacattagatcacctcggttttaccgccggcagcttcaattttctctaccgcagattgagagaacttgttcgctttaactgtcaacttcacagtgatttcaccgttacccagaattttaattccggatttggcgtttttcacaatgccattgttcagcaaaaactcagggcttacttctgtacccgctgcaaaactgttcaaatcttcgatattcaaaaccgcatactctttacgagtaggatttacgaaaccgcgtttaggcaagcgacgatacagtgggttttgaccaccctcgaagcccggacgtacaccaccgccggaacgagcgttttgacctttatgaccacgaccagaagttttacccgtaccgctactaggaccacgacccaaacgtttacgttctttgcgggagcctggagctggggaaagctcatgtaacttcatcgttcgttgcacctccttgattattgttaaaatactttatttcttaagcctcaatttctttaacagaaaccaaatggctaacttgattaatcatcccgcgaatagctgcattgtcgggttgaactactttatggttgattttacgcaagccgagcgttttaacagtcgttctctgattaccaggacggccgatcaacgaacgaacgagggtaatttctaatttcgccatgatattccctccttagcccagcagctcttcgatggatttgccgcgcaattttgcaacttcttcagcgcgtttcaagcgggacaaaccttccaaagtcgcattgaccatattcatggaattcgaagaacccaaagattttgtcaagatatcacctacaccagcaagttccagtacagcacgaaccggaccaccagcgataactccagtaccttccgatgccggtttcaacagaacccggccagcaccgaacttacctgtaacaaggtgaggaattgttgttcctacgagtggaacgtgaaccaggtttttcttagcatcttcaatacctttgcgaattgcatcaggtacttcgccagctttaccgattccagcgcctacccagccgttgccgtcgcccactactaccagagcactgaagctgaaacggcgtccgcctttgacaactttagctacacgattaatatttactactctttcagtcagttccaaagtattcggatctacacgcaagtcgttaacctccttttgagaaatgtcttagaattcaaggcctgcttcgcgagctgcatcagccaaagcttgaatccgtccatgatacaagtatccaccacggtcaaatacgatgttagcatgacctttttctttcgcacgtttagcaacgagttcgccaactttacgagctgcttctacactaccgccgtttttgatttcgctgctcagttctttatccatagtggatgcagataccaatgttacaccagctacatcatcaatcagttgtgcgtagatatgcttggaagaacggaacacgttcaaacgaggacgtacagccgtaccttcgattttcttacgtacacgcagatgtcttctgacacgtgctttatttttatcttgttttgtaatcatctcaagttttcactcccttcagtttgccttttaaaactttatactaagacgcactgggtaaaaaagaagtacgaagtctttccagcagaaagaccgcacaaagtcggtaagaaacttatttcttcttaccggctttaccttctttacgaatgatgcgctcgccttcgtatttaatccctttacctttgtacggttcaggttcacgaacggaacgaattttagcagcgtaggcacctacacgctctttatcaattccgcgaacgatgattttagtgttcgaaggaacttcgaattcgatgcccgcttccggtgtgatttcaaccgggtgagagtatccaacgttcagaacgattttatctccggatttgcttgcacgatatccgaccccaaccagctccagagattttgaaaacccttcagttacaccacttaccatgttgttgacaacgctgcgggttgttccatgcaaagagcggtgaagtttgttgtccgaaggacgaactacattaatttcattgttttccacagtaacggacatgtctttatgaagctcacgagtcaatgttcctttaggacctttaactgtgattgctgtgttgttcaaagtcacgtcaacaccacttggtactgtgattggtttacgaccaatacgggacatatctgttgcacctcctatcttttaaacgttatcttaccaaacgtagcaaacaacttctccgccggctttggactgacgcgcttctttgtcagtcatgatacctttggatgttgaaatgattgcgatcccgagtccacccagtacgcgtggaatctcattgctcttcgtgtaaacgcgaagacctggtttactgattcttttcaaacctgtaataacacgctcgttgttcgcaccgtatttcaagaaaatacggatgatcccttgtttgctatcttcaacaaattccgcatcacgaatgaatccttcacgtttcaggatgtcggcgatttgttttttcattgtagatgcaggcatttctactgtttcgtgacgaactgtgttcgcgttacgaatacgagtaagcatatctgcaattggatcagacatagtcattgtgtataaacctccttcccaaacaggactttttaccagcttgcttttttcacgccaggaatctggcctttataagctaattcacggaagcaaattctgcagatcttaaacttttgcagtaccgaatgtggacgaccacaacgctcgcaacgagtgtaagcacgaactttaaactttggtgcgcgttgttgtttgactttcattgaagtttttgccacttagcctgacacctcctaaatagtttcggagaacagggtgtctttaaaatcagacgcccgaaacgttatgccaacattattttgcgaaaggcatgcccagctgagtcagaagctcacgggactcttcgtcagttttggcagtcgttacgataacgatgtccataccacgaactttatcaacttgatcatactcgatttccgggaagatcaactgttctttcagaccaagcgtgtagttaccacgtccgtcaaaagcttttgtcgatacaccatggaagtcacgtacgcgaggaagagtaatgttgaacaatttgtccaagaaataatacatacgctcgccacgaagtgttacctttacaccgatcggcatgttttcacgcaatttaaaacctgcaatagatttttttgcgcgagtgattactggtttttgaccagcgatcagctgcatgtcgttgagagctgaatcaagcactttggagttttggactgcgtcgccaacacccatgttgattacaactttctcgattttaggcacttgcatcactgttgtatagttgaacttctgcatcaaagcaggagtgatttctttcaagaaacgttctttcattcttattgtagccatgaatcatatacctcctttcttcaaaaaataattagtcgatcacttcgccagaacgttttgcaatgcgcactttttttccgttgtccaaaactttgtaaccaacacgagttacttttccgctcttcggatcaatgtgcataacgttggaaacgtgaatcggagcttctttctcgatgatgccgccttgtggattcagctgattaggcttttggtgttttttaatcatgttaacaccttccacaagcacacggttttgacgagggtaagcagcgataacgcgaccttttttacctttatctttacctgtaatcaccagaacagtgtcgtcttttttgacgtgcagcttgttgttatgggattccagaacttttttcacttttggcatttcgtacacctcctacgggcacattttaaggtgagtttagatcacttccggagccaaggaaacgattttcatgaagtccttgtcacgaagttcgcgagcaactggtccgaaaatacgagtaccacgtgggctcttgtcttctttaacgaccactgctgcgttttcgtcaaatccgatgtaggaaccgtctttacggcggatagaacgtttagtacgaacaacaaccgctcttactacatcaccctttttgacaacgccgcctggtgttgcttgttttacggaacaaacgatcaggtcaccaatttgagctgtacgacgtcccgtaccaccgagcacacggatacacatcagttccttcgcgccggaattgtcagctacagtcaaacgtgtaaatggttgaatcatttatttatcctcctttcggaaaaactacactacattagattataacagctttttcaacgatttcgaccagtctccagtttttgtctttggacaaagggcgagtttccatgattttaacagtatcaccaatttgtgcggtgttgttttcatcatgagctttgaatttcttagttactttaatgcgtttatggtagagatcatgttttttgtaagtttctacagcaatcactatcgttttatccattttgtcgctgactactttaccgactaatactttacgggcattacgttcgctcattgttggcctccttcctaattacaggcggattttccacccggtctgatatcttagctaatcccaagttctctttcacggatcacagttttagcacgagcaatttccttacgcacagcgccgatccgagtcgggttatcaagctgaccggtagcgagttgaaaacgaaggttgaaaagttcttctttaaaaccggagatcttttgttcgatttcagcagtggttaggttgcggaattcactagccttcatttgcttcaccacccaattcttcacgtttcacaaacttagttttgattggcagtttgtgagcggcaagacgcattgcttcacgagcaatctcttccggaacaccagcaagttcgaacataatcttgcctggtttcactactgcaacccatttttctacgttacctttaccactacccatacgaacctcaagaggcttctgagtaataggtttgtcagggaaaattttaatccaaaccttaccaccacgtttgatgtaacgagtcatcgcaatacgagcagcttcgatttgacggttagtaatccatgcaggttcagtagcttgcaaaccgtactcaccaaagttcagtgtagtaccgccttttgcacgacccttcatatgaccacgttgttgtttacgatgttttacgcgttttggtaccaacatgattagttgcctccttcctgaggagcttgtttcttagctggaggaagaacctctccacgatagatccatacttttacgccaagacgaccgtaagtagtatgagcttccgctgtaccatagtcaatgtcggcacgaagcgtatgcagtggaacagttccttcgctgtacccttcggaacgagcgatttcggcaccgccaagacgtccgcctacttgagttttaattccttttgctccggaacgcatagttctttgaattgcttgtttcaaagcacgacggaaagaaacacgacgttccaattgttgtgcaatgctttcagcaaccagaattgcatccagttcaggatttttaatttcagaaatattgatgtgtacctttttaccgcctgcgattttagtaatttcattacgcagattttcaacttcggaaccacccttaccgataaccatacctggtttcgcagtgtgaatcgttacgttgacacggttagctgctctctcgatttcaacacgggatacagcggagtctttcaatctttttttcagatgttcacgaattctaacgtcttccagcaaaagatcaccgaaatctttgcctgcataccatttggattcccaatcacggataataccgattcggagtccgacgggatttaccttttggcccacacgttttccctccttatttttcagataccaccagagtaatatgactggtgcgtttgttgatgcgacttgcacgacccattgcacgcgggcggaatcgtttcattgtaggaccttggtttacaaaaacctgagatactaccaatttatttacgtccaaagagtagttgtgatctgcatttgcaatcgcagaattcaacaatttctcaacgactggagaagcggactttggagtgtgacgaagaattgcgatcgcctcaccaacctgcttaccgcgaatcaaatcgataacaagtttcactttgcgagcagaaatccgtacggacttagcatgtgcttttgcttccattgagtttacctcctctcaaacactacgctgtgttgattatcttcttgttttcttatcgtcatccgtatggcctttgtaggtacgtgttggagcaaattcgcccaatttgtgtccgaccatatcttccgttacgtatactggcacgtgtttacgaccatcatatacaccaaacgtatgtccgataaattgtgggaaaatcgtagagcgacgggaccaagttttgattaccacttttttgtccgactcattcaaaacctctacttttttcaacaggtaaccatcaatgaatggtccttttttgagactgcgacccatttatgaatcctcccttcgttaaaacgtagtcgttctttaatatgttaacgtgcgactcaagcgcacgttttattacttagtacgacgacgaacgatgtacttatcagatgctttaccttttttacgtgtcttgtaaccaagggttggtttaccccatggagacattggagatttacgtccgattggagcgcgaccttcaccaccaccgtgtgggtgatcgttagggttcattacaacaccgcgaacttcaggacgttgtcccaaccagcgactacgaccagctttaccgattttcaccagttcgtggtcttcgttacctacagaaccaattgtagcgcggcaaactttcagaatgcgacgaacttcaccagaagtcaaacgaattgtaacatacttttcttctttaccaagaagttgggcttccgtaccagcggcgcgaacgagttggccacctttacccggtttcaattcgatgttgtggataaccgtacctactggaatgttttccaacggcaaggagttaccgattttgatatcggaacctgcaccggataccacttcgtctcctactttcagacctttaggagcgatgatgtaacgtttttcaccatccacatagtggataagtgcgatgttggacgtacggtttggatcatattcgatcgtagcaacgcggcccggtattccatctttgttacgtttgaagtcaataatacggtatttacgtttgtgtccgccgccttgatgacgaactgtaattttaccttggttattgcgtccagcttgcttgctcagaggtgccagcaacgatttctcgggctgattagttgtaatctcctcgaaagtagatacagacatagcacgtctggccggggacgttggtttatactttttaattggcactgagtttccctccttactttacagtttcaattataccgtttcaaaaaactcaagcggcttactgtctttgctcagcgttacgaacgctttcttccactcgctcgtatagccggaatgacgtccgtagcgttttggttttgcaggaacacgaagcgtatttacgttacttactttcacgttaaaaatggcttcgattgcttttttaacttcgactttgttagaacgaatgtcaacctcgaaaacgtatttcaagtcattcatcataccagccgtacgttcggtgataaccggacgtttgataatatcacgaggatccttcattacgcgagcacctcctctaccttctgaactgcttccttcgtaatgatcagtttgtcgtgtccgagcacatcaagaacattaatgccgtctgcggctacaaacttcacaccaggaatattacgagcggacagtgctacattatcatcatagctaggagctacgatcaatgctttacgatcagctttaaggttattcaaaatggctgcgaattctttcgttttaggtccgttcagtgtaagagcgtccaatacgataatttcattctcaatcactttggatgacaacgccgatttgatcgccagacgacgaacttttttaggcaatttgtaagcatagctgcgtggagtcggaccgaatacagtaccgccaccaacccattgcggtgcacggatcgaaccttgacgagcgcgaccagtacctttttgcttccaaggtttacgtccgccaccacgtacttcagaacgtccttttactttgtgagtaccttgacgcagggaagccaattgcataacaacagcgtcatgaagaacgtgcttattcggctcgataccgaacactgcgtcgttcaattcaatttcaccaacttggctgccgctaatattaaatagtgctacttttggcatttcgtgttcctcctttcttcagttgtttattttttcaccgtttctaatactttaacgaagctatttttaggtcctggaatggaacctttcacgagcaatacattacgttctgtatcgatcttaacaacttcaagacgttggatcgttaccgtttcatgccccatgtgtcctggaaggtgtttacctttaggaacgcggttagcttgaatggaacccatagaacctggacctctgtggtaacgcgatccgtgtgccattggtccgcggctttgtccccaacgtttgataacgccggcaaaacctttacctttagaaatacctgttacgtcaacgaactcgccttctgtgaagacatcagccttcagttcttggccaacctcgtacgcagcaaggtcgatgccacgaagttcacgaacgtagcgcttaggtgcagtatttgcttttttcgcatgtcctgcttcaggtttgttggatcttttttctttcttatcagagaaaccgagttggatagcttcgtatccatcgttttccagatctttcttttgcagaacaacacaaggacctgcttcgataaccgtaacagcaagtacgttaccttcaggggtaaacacttgagtcattccgagtttttttcctaagatacctttcatgttgacacctcatttcttttcctaattacatattacaatttaatttcgatatctacaccggacggcaggtccaagcgcatcaaggcatccacagtttgtggagtcgggttaacaatgtcgatcaaacgcttgtgtgtgcgcatttcgaactgttcccgggaatccttgtacttgtgtaccgcacggagaatagtaatgatttgtttttcagttggcagcggaattggcccggatacacctgcgcccgaacgtttagctgtttcaacaattttctcagcggattgatcaagaattctatgatcgtaagctttcaaacgaatacgaattttttgctttgccattttagtccctccttctatcgcccaatttggtatcggacatactccgtgaaaattttccgacagccctcccatggcaaaggggccgggtgtgtcagtaacctctcacatcatcgcacagtcacaaacaacattagttattatatcgaatagttctgcctattgcaagcaaaaacgaaaaaacaatgcatcttattttcaaaagatgcagttgtgctcgcagctcgcgattttccccaagagaaaagcccccgcaccagggcaggggctcgtttagcttcgttccaatacaacgttactcgttccagtacactgttactctatttaaaggctaaagccttcttatttggagattgttgctacagcaccagcgccaactgtacgtccaccttcacgaatagagaacttagttccttcttcgatagcgatcgggttgatcagttgaacagtaaccgtgatgttgtcaccaggcattaccatttcagaaccttctggcaaagtaataataccagttacgtcagttgtacggaagtagaactgtggacggtaaccagtgaagaaaggtttgtgacgtccgccttcttctttagtcaaaacgtagatttgagcagaaaattctgtatgtgggttaacagaacctggtttagccaatacttggccacgctcgatttgtgcacgatctacaccgcgaagcagtgcgccgatgttgtcaccagcttgagcggaatcaagcaatttacggaacatttctacgcctgttactacggatttacgggattcttcttgaataccgatgatttcgatttcgtcgcccactttaactgtaccacgctctacacggcctgtagcaactgtaccacgaccagtgatggagaatacgtcctcgacaggcataaggaaaggcttgtcagtgtcgcgttctggagttgggatgtaagtgtcgattgtttcgaacatttcaacgattttcttagcccagtcgccatctgggttttgcagtgcttcacgagcggaaccgcgagtgattggagtgtcgtcgcctgggaagtcatactcgctcagcaagtcgcgaacttccatttcaaccaattccagcaactcttcgtcttcaaccatgtcgcatttgttcaggaatacaacgatgtaaggaacaccaacttggcgggacaacaggatgtgctcacgagtttgcggcattgggccgtcagctgcggatacaaccaggatcgctccgtccatttgtgcagcgccagtgatcatgtttttaacatagtcggcgtgacctgggcagtcaacgtgtgcatagtgacggttaggtgtttcatattccacgtgtgcagtggagattgtgataccgcgttcgcgctcttctggagctttatcgatttgatcgaatgctacagcagcaccaccgtaagttttggacaatacagttgtgattgcagcagtcaaagtagttttaccatgatcgacgtgaccaatagtaccgatattaacgtgcggtttgttacgttcaaacttagcctttgccatttgaacaattcctcctcaataacttgttttattttaggctgccggatgcctttttggtaaaaccttaagcataccggtcagctgatacattgtattactcgccgcctttggttttggcaacgatctcttcagcaatgctcttcggtacttcttcataatgagagagttccatggagaacacgccgcgtccttgtgtaccggagcgaagtgtagtcgagtatccgaacatttcggacaaaggcaccttcgcacgaatgatttgagctccactgcgggaatccataccttcaatccgaccacgacgggagttcaacatacccattacgtcacccatatattcctcaggaaccgttacttcaactttcataatcggctcgagcaatactggtttacatttgtctttcgctgctttcagcgccattgatccggcaattttaaatgccatttcattggaatcgacatcatggtatgatccgtccacgattgtagctttaacgtccacaagcgggaagcctgcgataacgccgtttttcatttgttcctcaataccagcaagagcaggagcgatgtactctctaggaacagagccgccgactaccttactttcgaattgactaccagtacctggctcgagcggttcgaactcaacccatacgtgaccatattgaccacgaccaccggactgacgaacgaatttaccttcgacacgtgctggagcacggaacgtttcacggtaagcaacctgtggtttacccacatttgtttctaccttgaactcacgacgcatacggtcaatgatgatgtccaagtgaagctcacccatacccgccaagatggtttggcctgtttcttcgttagtatgagcgcgaagagttggatcctcttcagtcaacttaccgagagctacagacattttatcttggtcagctttggttttaggctcaaccgcgatttcgataaccggatcagggaagttcatggactcgagaataacaggactcttctcatcacacagtgtatcacctgtacctgtatctttcaaacctacggcagccgcaatatcaccagagtaaactacagtgatttcttgacgactgttcgcatgcatttgaagaatacgtccgatacgttcgcgtttaccttttgttgcattcaatacgtaagaaccggattgaagaacaccggagtatacgcggaagaatgtcaacttaccaacgtaaggatccgtcatgattttgaatgccaatgcggagaatggctcttcatcggaagagtgacgttcaacttccgtaccgtcttccaaatgcccttgaatacttggcacatcaataggagccggcaaatagtcgagaacagcatccaacatcagctgaacacctttatttcggtaagaagatccacagataactgggaagattttaacttctacaacacctttacggagagcggctttaatttcggcaaccgaaatttcttcgccttccaggtatttcattgtcaattcttcgtccagttcagcaaccttctcgatcaattcattacgaagttcttcaacttgatctttgaattccgcaggaacttctacttcttcgatatcttgaccaagatcatctttgtacatatgagctttttgttcaacgatatcgataataccagtaaaatcattttctgcgccgattggcaattgaatcgcaactgcgttcgcttgaaggcgatcacgcatgtcagagacaacattcaggaagtcggcaccaatgatatccattttgtttacatatgcgatccgtggaacgccgtagcgatcagcctgtctccatacggtttcggactgaggctcaacgccttctttcgcactgaaaacaccaactgctccgtccaatacacgaagggaacgttcaacttcaacagtgaagtcaacgtgccccggggtgtcgatgatattgacgcggtgacctttccaggcagcggtcgtcgcagcggaagtaatcgtgattccgcgctcttgttcttgttccatccagtccattgtcgcagcgccttcgtgaacttcaccgattttgtgcgtacggcctgtgtagaacaagatccgctctgttgttgtggttttacccgcgtcaatatgagccatgatcccgatattacgtgtatttttcaaggagaactctcttgccatgaaatgggtctcccttcaaaattgaagttatttttttgagctgaatcctaccaacgatagtgagcaaacgctttgttcgcttcagccattttgtgcgtgtcttcacgttttttcacggaagcgcctgtgttgttggaagcatcaataatttcagccgccaaacgctcttccatggttttctcaccgcggttgcgggagtagtttacgagccaacgtaatcccagggacgtacgtctttctggttttacctcgattggtacttggtagttggcaccgccgacacggcgtgctttaacttccaggactggcatgatattcttgatagctgcttcaaaaacttccatcgggtcattccccgtacgttcttggataagcttgaacgcattgtacagaatgctttgagcaacgcctcgttttccgtcgagcatgatgcggttgatcaagcgggtaaccaacttgctgttgtataccggatctggcaacacgtctcttttggtaactggacctttgcgtggcatggatatccccctttcttacatgttaaaccgacatacgcggtttatattcattaggattttttagctttagggcgttttgcgccgtatttggaacgagcttgcatgcggttgtttacgcctgcagtatccaaagcaccgcgaacgatgtggtaacgcacacccggaaggtcttttacacgaccgccgcgaatcagcactacgctgtgttcttgaaggttatgtccaatacctggaatgtaagcagtcacctctacacggttcgtcaagcgaacacgagcatatttacgaagtgcggagtttggttttttcggagtcatagtacctacacgagtgcacactccgcgtttttgcggggcactgatgtcggtagcttcacgtttcaaggcattaaaacctttttgcaaagccggtgatttcgatttctcgattttggcttgacgtcctttacgaaccagttggttaatagttggcatgttggttgccacccccttcctcaatttttgctgttactttacaaaccttatctaagcccacagacccaggcggttcataaaagaacaaatgaaaagtctttgccgccaagaataacaattccttagacaaaaacgttccttaccctattgttttacgatagcagccattgcggctcccacttcaatcccacatgcagctccgagatttttcattgtgtctacgagagtcactttgactccttgcttgttgcacaaagcaatgatgttggaagtgagacgctgatctgcgtcttctgccacatatacttctgaggcaaagcccaattctaccatacgaatggtttgtttggtaccgattttgacatgagcatcttgcagtccttgttctttagacatatctcattcctccgaaaagacccaatagcatataggctgctcacgcacctttgctatattagcattgactataagtaatgtcaagacaattataaactataattcatttaaacagaatagtacgattcatttttgaaaagcaccggagcaccgtctgctgtagcttttatgcaaagcttatgtctacggtgttccggcaatcatactattttcatattactcggccgaaattggttcgagctcctcagatggagactgcccctcttccggttgggcaaatttcacgctacggtaacggttcatacctgttcccgcaggaatcaatttaccaataattacgttctctttcagtccaagcaactgatcgaccttgcctttaatagctgcatcagtcaggacacgagtagtttcctggaaggatgctgctgacaagaaggagtcagtttccagagatgccttggtaataccgagcagtaccggcttggctaccgctggttcttggccgctgagaatcgctatcttgtttgcattttcatactcatggacatcaacaaaggagcctggaagtaagatcgtgtcacccgcatcaatgatacggattttacgcaacatttgacgaatcataacttctacgtgcttgtcgttgatttctacgccctggttccgatatacgcgttgaacttcctgaaggatatagttctgtaccccgcgaatacctttaatgcgcagcatttctttaggatcaatcgaaccatccgtcagttcgtccccagcttcaacagtcataccttcgcttacgcgcaggcgggaaccatacgttactgagtatgttttcgtttcagcttcaccctgaatgtcgatctcacggcggtctttaccttcacgaacttctttaactgtaccgtcaatttcactaatagttgcctgacctttaggattacgtgcttcaaaaagctcctggatacgaggcaaaccttgtgtaatatcgtcacccgctacgccgcctgtgtggaacgtacgcatagtaagctgtgttcctggctcaccgatggattgtgcagcgatgataccaactgcttcaccaatctcaacgtgtttaccagtagccagattgcgaccgtaacatttcttgcagacgccatgtttagcccggcaacttaatacagaacgtatttgaactttgtgtacgccagctttaacaatcgcttcagctttgtcggagtcaatcaattcgttacgtctagccaaaatctcgccagtctcaggatgacgtaccgtttcaaagcaatagcgaccttccagacggtcatagagatcctcaattacttctttaccgtcctggatacgacttactgtgaagcctttatccgttccgcagtcttcttcgcgcacgataacatcctgtgccacatctacgagacgacgagtcaggtaaccggagtcagccgtacgaagggctgtatccgccaaacctttacgcgctccgtgagtggagatgaagtactcgagtactgtcagaccttcacggaagtttgatttgattgggagttcgataatacgtccggatggattggccatcagaccacgcatacctccgagctgagtaatctgtgatttgttaccccgcgctttggagtccaccatcatcatgatggagttgtagcgatccatggacttcatcaatacttcggtaatatcatctttcgctttagaccaaatatcgataatccggtcatagcgttcttcattcgtaatcagaccacgacggtactgattcgttacaacttgcgctttgtcttcggatcccttaagaatctcttgtttttccaccggcacgattacgtccgatacagcaacggttacccctgcacgagtggaatacgtaaagccaagctgcttgattttatccagaattacagctgtttctgttgtatggtaagtctcaaaacaacgggcaatgatattaccaaggtaatccttgcctaccccgctagcttgcggagcgttttgaatggcttctgtaagatttacacccttttcgtaaacaaagaactcctccgcagtaccataaagcaagttcgcacgggtagcatcattgatgtacgggaagcttgccgggaaaatttcattaaaaataattttaccaaccgttgtgatcaacatcgcttcctgttgtttttccgtaaagctcgttttattcaaagctttaaccggaatagctacacgagcatgaagtccagctgtaccacgttggtaagccgatatagcttcattcatgttgcgaaggatcatgttgcttccttcttcttctttgttatccatagtcagatagaaagaaccaagaaccatatcctgggaaggtgtaacaactggcttgccgtctttcggattcaaaatgttgccggatgctagcataagcaaacgagcttcagcttgggcttccgcagacaacggaacgtgaacagccatttggtcaccgtcaaagtcggcattatatgcagtacatacgagcggatgcagacgaatcgcacggccttcaactaaaatcggttcgaacgcctggatacctagtctatgcagcgtaggggcacggttcagaagaactggatgctccttgattacttcttccagtacatcccatacttctgcactcacacgctctactttacgcttcgcgctcttgatattgtgcgccaaacctttgttcaccagttccttcataacaaaaggtttgaacagttccagcgccatttcttttggcaaaccgcattgatacattttcaagtacgggcctacaacgataacggaacgaccagagtagtcaacacgttttccgagcaagttctgacggaaacgtccttgtttacctttcagcatgtggctgagggatttcaaaggacggttacctggacctgtaacaggacgaccacgacgaccattatcaatcaaggcgtcaacagcttcctgcaacatccgtttttcattttgcacgataatatctggcgcacctagatctaacaaacgtttcagacggttattacggttaataacacgacgatacaagtcgttaaggtcagaggtagcgaaacgaccaccatccaactgtaccatcggacgaagctcaggaggaataacaggaagtacgtccatgatcatccaatccggttggttgccggagttacggaatgcctcaataacttcaaggcgtttgatcgcacggttacgacgttgtccttgagctgtacgcagctcttctttcaagaattctaactctttgtctatatccaaatcttgaagaagctttttaaccgcttcagcacccatacctgcctggaagccatagccgtatttctcacggtagctacggtattctttctcggacaggagttgctttttctccaaaggcgtatctcctggatcggttacaacataagatgcgaagtaaatgatctcttccagagatcttggagacatatcaagagcaagacccatacgacttggaatgcctttaaagtaccaaatgtgcgatacaggagcagccaactcaatgtggcccatacgctcacggcgaaccttagcacgagtaacttctactccacaacggtcacagacaacacctttatagcgtacacgtttgtacttaccgcaatgacattcccagtctttcgtaggtccgaaaattttctcgcaaaatagtccttctttttccggtttaagcgtacgatagttaatcgtctccggttttttgacttctccgcgggaccaagaacgaatcttttcgggggaagcaagcccgattttcatatattcgaaattgttaacgtccaacaaggagcaaccctccttaaccaaatcctgagtttttaggtttgataccgcccagcagcaccgggcggtatcaagaaacctgatccatcctagaatggatcaaggtatataacaaagctgatatgagtcagtcagcagtcaaactactctacgccaacctcagagccttccagattcaaactcagcttatcgccggttgtgtcatcctcatcatcaagctctctcatttcgatctcttgttcgtcttcagacagaatcttcacgtccatacccaagctttgcagctctttgatcaagaccttaaatgattctggaacacccggttcaggtacattttcacctttgacaatggattcgtaagttttaacacgtccaaccacatcatcagatttcacagtcaaaatttcctgaagcgtgtacgctgcaccgtaggcttccaatgcccatacttccatctccccgaagcgctgtccaccgaattgagctttaccacccaatggttgttgcgtaacgagagagtaaggacctgtagaacgagcatggattttatcatcgaccatgtgcgccagtttgatcatgtgcatgacaccgacagtaacttcacgttcaaaacgatcacccgtacgtccgtcatacaacacagtcttaccattacgctgcatgcctgcctcttccattgtatcgaatacgtcatattccttggcaccatcgaatactggagttgccacatgaataccaagacgcattgcagccattcccagatggacttcaagcacctgtccgatgttcatccgtgaaggtacgcccagcgggttcagaacgacctgtactggtgtgccatccggcaggaacggcatatcttcttcaggcagaatacgggcaacgacacccttgttaccgtgacgtccagccattttatcgccttcggagattttacgtttttgagcaatatatacacgaaccaactgatttacacctggtggcagttcatcgccattttcacgtgtaaatacctttacatctacaacaatcccgtctgttccgtgaggaactctcaaagaagtatcgcgaacctcgcgtgccttctcaccaaagattgcgtgtaagagacgttcttcagctgtcaattcagtcacacctttaggtgttactttaccaacgagaatgtcacctgcgccaatttcagcaccaatacgtatgattccacgctcatccaagttgcgaagcgcttcttcaccgacatttggaatgtcgcgagtgatttcttccggtccaagcttcgtgtcacgagcctcggattcgtattcctcaatatggatcgaggtgtatacatcttccttaaccagtttctcactcagcaagatcgcatcctcgtagttgtaaccttcccaagtcatgaaggcaacgacaacgttacgtcccaacgccaactcacccatctctgtagaaggaccatccgcaagaatatcgccaactttgacaatatctcctctgttcacaatcggacgttggttgatgcaagttccttggttagatcgcataaatttgtgtaatttatacttaacaatgtcgcccttcacctcagcgccatctacagtttcgatacgacgcaaccaaatttcgttagccgaagaacgttcgataactccgttgtatttggatacaacgcaaacaccggaatcttttgcagacttgtgctccattcctgttccgaccaatggagacttcggaatcagaagcgggacagcctgacgctgcatgttggaacccatcaatgcgcggttagagtcatcattctccaagaacggaatcagtgcagtcgcgaccgatacgacctgtttaggcgatacgtccatgtaatcgacacggctactagccatcggaataatgttatcagactgtttgttataacggacaatgacaacctcatccttaaaggtgttttcctccgtcaattccgcattcgcctgagctacgatgtagttatcttcctcatcagcagtcaggtaatcaatctgatctgtaacttttccggttttcggatctacccaacgataaggagcttcgataaatccgtactcgttaatgcgtgcaaaagtggacaaagagttgatcaaaccaatgtttggtccctctggtgtctcgataggacacatgcggccgtagtgactcggatggacgtcacgcacttccatgcccgcacgttcgcgcgtcaaaccgccgggtccgagtgcggacagacgacgtttgtgcgttaattcagcaagcggattcgtctgatccataaactgagacagctgcgagctaccaaagaactctttaatcgaagcaattactggacgtatgttaatcaatgcctgtggcgtaattacattagcatcctgaatcgacattctttcgcgcactacgcgttccatacgggataaaccgatacggaactggttttggagcaactcacctacagaacgcaaacgacggttacccaaatggtcaatatcgtccgtacttccgattccgtgaagcaagttaataaaataactaatggaggaaataatatcggcaggcgtaatattcttaaccgatttatcaatatttccgttagcaatcagttttactactttaccatcctcaattggtgagaacacatcgattgtttgaagtggaatatcattgctttctagcacaccactcgcaacatgatacgtacgatgtcctactgattcctccagttgggccaaaatctcgtccaacaggcggcgatctaccatttgaccggcttcagcgatgatttcaccagttgttgtatcaatcaaagtctcagcaagtcgttgattgaacaaacggtttttaatgtgaagctttttattgattttgtaacggcctacgttggccagatcataacgtttaggatcaaagaagcgagcaactagcaagctctttgcgttatccagtgtaggcggctcacctggacgaagacgctcataaatttcaatcagcgctttctcggtggaatccgtgttgtctttatcgagtgtgttgcggatatattcgtcattgccgagcaaatccagaatctcagcatcagtgccaaagcccagcgcacgcagcaacaccgtaaccggaattttacgggtacggtcaatccggacatagataatatccttcgcatccatctccagttcgagccaagccccccggttaggaattaccgttgcggtgtatgttgttttcgcattcttgtcgacttttgtgctgaaatagacgctgggagagcgaaccaactggctgacaataacccgttccgcaccgttaataataaacgtacccgtttcagtcatcagcgggaagtctcccatgaatacttcctgctctttcacttccccggtttctttattaataagccggacttttacccgaagcggtgctgcatacgtaacgtcgcgttcctttgcgtcgtcaacggtatatttgggttctccgagagaatagtcgataaactccagaatcagatttccagtgaaatcctgaattggagaaatatcccgaaacatttcccttaatccttcctccaaaaaccaatcataggatttttgttggatctcaatcaggttcggaacctcgagtacctcattaatacgtgcataactgcgccgagtgcgtcgaccatattgaacaagatgtcctgccaacttaaactcacccctcatgtctactcactttaaaaatacattgcgaacctctgtttgtgaccttataataagacacatacagaagattcaatcttacaaatacagaaaagcccttactcgaatgcattcgaaaaaagagcaccgtatctgcagaatcctcttaccggaagatcttcatcacttgtagatttgcccaaaatggttgtattatacgtaatagagataaatagtatacctactacgcataaatctattgacatttcaacaaactaaagccatggagggcatcctaatactgacattttataataatatcacagaccaggattcaagtcaatggtcctattgcattttcttaaaaacttttttcagccttcaaaattcgataacctttatcctttgtaacttcctctacatgaccgaaaaggctctctatcttagcactcgccgaaggggccccctgctttttctgaatgactacccacaaagctccaccttcgtttaaatgctcataagcaagctcaaaaatggtatgcactgtttcttttcctgcacgtataggaggattcgtcaagatcacgtcaaagcgttcatccttcacttccgcaaacaaatcgctttgcttaatggtgacattcttaaccccattacgttccgcattctctatcgcaagttgaacggctcgttcattaatatcaaccattgtaacgtgtccctctgggacaagcgcggctgccgccagaccaatcgggccgtaaccgcatcctacatccaataccgaggcttgtacaggaagctgcatcgcttcaatcagcacacgactcccgtaatcaattccctgcttcgaaaaaacgcctgaatcgctggcaaaacggtatgaccgaccccgcagcactgtttccaggctccgtcgttcatgtgccgtctctggccgcttggagtaataatgatcagccattcatgcccacctctttcggttgtactaccatcatagcctttacaataacctttcagacatgctggtactaccgttttacagcaacaaaccccttgaagatcacctcaaggggtttgttttagtccattgtctgctagaaagcagtcaattattttacttctacagaagcgcctgcttcttccaattttgctttaatggattcagcttcttctttagcgattttttctttcagtggttttggagcgttgtcaaccagttcttttgcttctttcaggccaagacctgtgatttcgcgaactgctttgataacgttgattttggaagcgccagcgcttgtcaagattacgtcgaactcggattgctcagcttcagctgcgccacctgctgcgccacctgctacagctactggagctgctgcagttacgccgaattcttcttcgattgctttcacgagatcgttcagttccaatacggacatacctttaattgcttccaagatttgctctttactcatggttgaacctccatttaaattcgtatttttttgttctcaactgctatacagcaggtttaatccctaacttatgcgctttgctcttctttttctgcaacagctttaactgcaagcgcgaagttgcgcacaggagcttgaagcacgctgaggagcatggaaaggagaccttcgcgggatggcagttctgccagtgctttgatttcctcaacaccgataacgcgaccttctacaactgcacctttcagttccagtgcattgttcttcttagcgaaatcgttcaagattttagctgcagacactgcatcatctttgccgaacgcgattgcagtaggacctgtcaatactgcgtccagttcagtcaattctgctgccgcagttgcacggcggagcagtgtgtttttcagcacttgaaattcgattccggcttcgcgaagttgcttacgcagctcagttacttgggcaacattcagaccgcgatagtctgcaaccacagtcgttacgctctcgcgcaattttgcagctacaacttcaacagcttcttgttttgcttgaatcacctttgcatttgccaaactgtacacctcctgatcaatttatccgctttgttcaaagcacccaatctggtgatcttacaaagcttgctttcataagcatgaaaaaagcctccgtagagtacgaaggcttgataaatctacatggacgggacaagcccgtcacatgaaacgttctatcataacacctcggtaggaaattaagcccaaaagcacctactgtctacggtaagcatattcaactttaatggtcagtcacaaggactcacaacttttatagaataacaaatttgattgaacatgtcaatcaaaatattatctgtaaacagatgcgttcacacgtgcacttggtcccatagtcgaagaaatagcgatgtttttcaggtatacacctttagcagccgctggcttcgcacggttcaaggcttcaaccaaggctttaagattctcgttcagctgttcagcactgaaggaagctttgccgattggcgcgtgaatttgaccggctttgtcgagacggtattcgattttaccggctttaatttcttgaacagccttggcaacgtcgaaagtaactgtgcctgctttagggttaggcatcaaacctttaccaccgagcaaacgacccagtttaccaacctcactcatcatatcaggtgtcgcaacgcagacgtcgaattcgaaccagccttgttggattttgttgatcatatcttgatcgccaacaaaatcagcgccagccgcttccgcttctttcactttgtcaccttttgcaaataccagaacgcgttgtgttttacccgtaccatgcggcaggacaacaacaccacgaacagcctggtcttgtttacgggaatctacgcccagacgaactgctgcttcaacggtttcatcgaatttagcagtcgcagcctttttcaccagttcaacggcttctaaaggctcgtaagttacttcgctgtcaatcagcttagcagcttccaggtacttcttaccatgtttagccataatgttttcctccttatgtggtattagcggatattcctcccacacttgccggacagtcaaactgccggcacacgtagattaataaaattaatctacgatggtgatacccatgctgcgagcagtaccttcaaccatacgcattgccgattctacggaagctgcgttaaggtcaggcattttttgctctgcaatttgacgaacagcagcgcgatttacagttgcaactttcgttttattcggttcaccggaacctttttcgattttagcagcaactttcaacagaacagcagccggtggagttttggtgataaacgtaaaagaacgatcctcaaacaccgaaatttcaaccggaataatcaggcctgcttgatcagcagtacgagcattgaactctttacagaatgccatgatgttgacacctgcttgacccaaagctggacctactggaggcgctggattagctttccctgcaggaatctgcagttttaccattttaattaccttttttgccatggatgacacctccttgactcaatagtggtagacggacctatcgatcctcccacaagaaacctgtaagaaaaatctatattttctccacttgagtataatccaactcaagcggggtttcccgtccaaacatgttgacgtgaactttaagcttgctcttctcaaccaaaatttcttccacggagcccacaaaattcgcaaaaggaccaactttaattcgcacggattccttaacatcgaattcaatcttcggtttcggctctaccatgcccatatgcttcagaatctgttcaacttcttctggaagcaatggcgtcggtttggaacccgagcctgtcgaccctacaaatcccgtaacacctggtgtattgcgcacaacataccaagagtcgtcggtttggaccatttcgactaagacataaccagggtagactttacgcataacggtttttttcttaccgtccttggttaccagttcttcttccataggaacaagaacacggaatatcttgtcttccatgcccatggactcaacgcgtttttccaaattggctttgactttgttctcataccctgaataggtatgaacgacgtaccatcttttttccatatcaagccacctggaacccttcctagataatcgcttcgatcacagcggaaatgccgatatcgagaacccaaaaataaatcgtgacgaacgcaattgtccctatgacaatcaacgtatagttggtcagttctttacgattgggccagcgaaccttcttgagttcagcccagctttcagagaaaaaggaaaacagagacttgaaactgcgtttcacgccgactacacctccaaaaactatctggtttcccgatgagaagtctgttcgttacaggacttacagaatttcttcatctccatgcggtcggggtgattacgcttgtttttcgtcgttgtgtaatttctttgtttgcatgttgtacaagccaaagtaataattacccgcatgatgtgcacctcccgaagacatccaacaccggaagtctcataattgatcctaaaaaaaaccgcgaatttaggcctacctaaaacactttatcacacggggttttccatgtcaacgaatgtttgcatacaattcgcagtcccggctgtggtgcattttaacatctgttcatcctttaaaactgttctctgaaaagctgcttcaaaaatcaaggcgatatctattattcatcttttttagtataaatcatttgtaacacttataaacctgcatagcctacctataacgaataaaaaaagactcggactcgagccttttccctgtcagcctctactttcaactatctcttacttccagatacttttcaagtttacgcttgacccgttgcagcgcgttatcaatggatttcacatggcggtcaagatcctctgcaatctcctgatacgaacgtccgtccagatacaacataagcaccttgcgttccagctcgctcagaatctcggacatcttgtcctcaaggcccacaaactcttcctgattgattatcagctcttcagggtcacttacttgtgttccgcaaatcacatcgagcaacgtgcggtctgactcttcatcatagatgggtttgtccagagatacgtaagagttcagaggaatgtgcttttgtcgtgtagccgtcttaattgccgtaataatctgtcgtgtaatgcacaactcggcgaaagccttgaacgaagcaagcttgtctcccttaaaatcacgaatggatttgtagagaccaatcatgccctcctgaataatatcctcgcgatcagcaccaatcaagaagtaggatctggccttggcccgcacaaagttccggtatttgttaatcagaaactccagcgcttccccatcaccttcatggactgctccgacaatgtcttcatcatttttgtaatcaaactttgacaacatgatatccttgaggtccacactcactaacaatccctccggctgcaacgcaaggtacccgttactctctcaaatatacgacaagtatacgcgatgtaacctgataccgtcaaccacaacaacctaaaaaagaagagcgctaacaaaattgtcaatggtttcaaaatggaggagtccccaattattggtttattctcttctccatcgttcaaacaactttcgaagctccggactcagtttggcatctagcgagttacgggacaatttggcactatcctgctggattcgcttctgtacttccctttcggattcctcaatctcgatcagtaattcccgcgccgacaccctgagtgcaccttgtccaaatgcgacatgttgctctacctgatcgcttgtcgctacgtaaatacttcttcttttactgctcagctcccgaaccaatcgctcgatacactcatcagcagtttctttttctctagtaaaataaatctggactttgctctgagcaaaagttttacctaatcctggcaccctgtaagcatcaaatacgacgatgactcttctgccggaatacgcctgatgatccgccagtcgttcaagaagtctgtccctcgcttcctgcataccagattgtaccagtgcggaaagttcgggccaggctccaatcatgttgtaaccgtccacaagcagaacatcccgcgtgtcagccatatcgttagccccgtgcctgtcgtccgcgcaatacttcgtacatgacaacacccgcagctacagaagcattaagggaattaatttgccccgccattggcagcttgacgagtacatcgcatttttcacggatcaaacggcccattcctttattttcgttaccaatgacaatggctactggccccgtgaatactccattcccaaagacagggtctgtcgctgtaacatccgtgccaactacccatacaccttcttctttaagacgatcaatggtttgtcccagattgtttacacgcgccaccgggacgtactccacagcacctgccgatgttttggacactgttacagttacagctgcagagcgccttttcggcacaataacaccatgtgctccagtacagtccgctgtacgaaggatggagcccaaattatgagggtcttcaatctcatccagcaaaattaaaaacggctcttctcccttatcacgagcagtggcgagcaattcttccacttcaacataggcaaaaggcgcagcttgcgcgaccactccctgatgctgaatgcccggaaccatttgatccagcttacgcttgtccacctgcaagacaataattcctgcttttttggcctccgctgtaatcggcagcgtcaaatgtttttgtgcattatccgcaatccatattttatttatcgttctgcctgaacgcaatgcctccgttaccgaatgcttaccggcaatccattcttcttccatctctagcttcctcccgggacacggccgatgcttgttccatccagtccattcccatttatgatttttctgtattttccatctgtgcaattccgtacgtaatcaactctcttaatctgtccaaatgtccatcacaataaagagatccaatcaacccttccagtgcagtggcgtgccgatactcaagcacatcagcatttttgggcaaacttcctgatttagcatttcttccttgtcggacaatatcgcgttcttcttccgtcagtaccttttccaatagccccaacatgcgactctgcgccttggcggagactagccctgtggctcggcggtgcagatgattgggacgcaggttgggctgtgccaacaaatattgccggacagctacctcatacactgcatcaccaatataagctagtgcaatgggaggcatcaaacgagctggcttggacgcagggtacgggaaccagttccccgtatctgccaatgctcctgagttcagtggcttatcactcattttcgccgccaccgcataccctgcgccgtatcttcaagcacaatgccttttgcagccaacagatcgcgaatttcgtcagctctaccccagtttttggtcttacgagcttcgacacgttctgcaattaactgctcaatttcgtcatccagcaactcttcactcggttccaaataaatgcgaagaacgttattcatcgattgaaaggtatgcaatacagcttgtagttccgcctgatgtacgacatctcgctgcaacaaatggtttgcttcgctaacccaatcaaatacagcagtaatcgcatcaggtgtattgaaatcatcattcattttttcgccaaactgctgcaaaattccgtcgagcttcgtttgcagttccgtcgatactcccccattaccttccagcgcattagctaaacgatgcttcacattggcaactgcattggcgatccgctcgacactgttctctgcctgactcatagtctcttggttgtagttcaacggattccggtaatgcgtcgacaacataaaataacgtaaagcctccggcttgtgatgagcgcgcaaatctttaaccaaaataccattaccgagtgatttcgacattttttcattatctatgcgaatatagccgttatgcatccagtagcgggataatggcttacccgtgatcacttcggattgtgcgcattcacattcatgatgcggaaattgcagatcctgtccgcctccatgaatatccagtgtatcccccaaataatggcgagccatagcagagcattcgatatgccagcctggtcgtccatctccccaagggctcgaccaataaatttcgcccggtttcgctgccttccagagtacaaagtcctcagcattttccttgcgctcatccacattgatgcgaataccgaactgaagctcttccagattttgacctgacagttgtccgtaatctttgaactttttggttcgatagaacacatcgccatcattctcataggcatagtccttgtctaccaattccttaataaaatcaataatcaggtccatgctctctgttacacgagggttcatactggcagcagcaacattcaatcctgccagatcctcatggtaggcagcaataaatttctcagcaactgccgaaacatccatatcaagttcccgagctttgcggattaatttatcatcgacatccgtaaaattcaccacatagtttacatcatagcccaagtactccaggtagctgcgcaccacgtcaaatacaattacaggtcgtgcattgccaatatgaatgtaatcatacacggtaggtccgcatacatacattttaacctttccaggctccagtggcacaaaaggctcccgactcctcgtcattgtattataaatttgaagcggcattgttatgttcctccctcatgaaaatcatttttctaatttattctcttgggtcacctgatgtttctgagcagatgccccatccttcaaatcagacatttctgcacgcaaacgtcctatttcccgttgaagttctcgcatagagtccacaaccggatcaggcaattgatgactaagtcggtctggacgcctaccatcctgtctgacaactcgccccgggatgcccaccaccgtactgtttggcggaacttctttgagcacaaccgagttagagccaatgttggattgtgccccaatcgtgaaagagcctaatatctttgcaccggagccgataacaacattattcccaatggtcggatggcgcttccctttctctttcccagtcccgccgagtgtgaccccctgatacaatatgacatcgtcgccaatctcacaggtttcaccgatgacaactcccatgccatgatcaatgaacagccgatttccaatacgagcgccaggatgaatttcaatgcctgtcataaaccttgatacctgggatataacacgggctagagtacaccagtttcgcaaataaaaccaatgtgcgattcgatgtgcccaaagggcatgaacgccggaatacgtaaaaatgacctccagcttactccgggcggccggatcattatccaaaacagtctgaatgtcggatttgaaatgtctgaacatgtcgccctcctattcccttcatatccttgccgcatcatcactacacttcacgttccgccaattttcgcatccaccagcactcttcgacatttttcaatctataacgagtctgagtctgataaaaaagaaaaagcgtctccgcagcctaagctgcagagacgcatgaacgtggtcccactctgcttcgaacatatctgctgcataaaaagcagacagtccgtctttggcgtcctgtaacgggaacgactcggcacgcccttttcacatcagcatttgacgctaatgaaagttcgggcgcacggctcccaggcgcatttcctccgcaggtcatctggacggctctcagcctggagtttcccctcgaccgtcctctctggcagatgcccatatgcagtgtacttctcctgttcgcagcctttacacgtaaatatcaatccgtatcaatggagtcattatagcgaaaagacaacaaattgacaagaaatatcagcctttaatttgtgccttgagacgatccagtaccttgtcacgtccgagcaaaaagatggtttcattcagatctcgtccatgcgtttggcctgtaagagccacacgaatcggcatgaatagttgttttcccttaaaacccgtttccttttgaacttccttgatcagcttagccatttgtggagctgtaaattcctcactcgtttcaactttacctgcaaaagctctaagtacctcaggaacctgctcttcggccaatacagctgctgcttcagcatccagctccagatgtgaacggaaaaacaactcagacaacgctacaatatcggatgcagaagtcatctgttcctggtataaacgaacaagggccttggcccaatccagttgttccgaagacagttcagtcggcaacagccccgctgcctggagatgtggaatcgccatgctggcaattcgctcaggatcagcctttttaatatagtgattgtttaggtaagcaagcttatttgtatcaaacacagctggacttttggacaaacgattaggatcgaaaatcgaaatcagttgttcccgatcatagatctcttcttcgccttccggggaccagcccagtagtgcaatgaagttgaatatagcttctggtaaatagcccaacttgtcatactgctccatgaactgaataatggattcgttacgcttactgagctttttgtgatcctcgcctacaatcagcgtcatatgaccgaagcgtggcggttcccagccgagagcttcaaagatcatcaactgccgcggtgtattggaaacatggtcttcgccccgtagtacatgcgatattttcatcaaataatcgtcaaccgctacagcgaagttatatgtcggaataccatcctttttgacgataacaaaatcgccgctttccttggaattaaacgtaatttgacctttaacgatatcgtcaaacgtatattcacgatcttccggtacgcgaaaacgaatacttggtacacggccctctgcttcgaatgcctggcactgttcttctgttagatcacgatgttttccagaatagcgtggtgtcttcccacgttccgtctgttcttcacgctcgcgctccagctcttcttcagtgcaataacagcgataagccaaaccacgatccagcaaatcctgccagtacgttttatatatgtccaagcgttccgtctgacgataaggtccaaactcgcctcccacgtctacgctctcatcccagtccatacccaaccatttcaaatatttaagttggctttcttctccgccctcaatattgcgcttcacatctgtgtcttcaatacgaataataaatttcccaccttgattgcgagcaaacaaataattaaataatgccgttctggcatttccaatgtgcagatgccctgtagggcttggtgcatagcgtacacgaacttccgtgctcatataatctcctccaaattgaattactcaagatgatagcatttacttgataagacagacaaccgattgagccgcgattccttcaccccgtccgggaaacccgagttgctctgtcgtggtcgccttgacgttcacctgggatagctcctctgcttccagcgcccgtgcgatgacttcattcatctgcggaatatacgatgccattttgggcttttgtgcgataatcgtagaatcgatattccccaagcgatatcctcgctctttagctagcccccacacatgctccagtagcttaagactgtcggcatccttaaattctgggtcattatccggaaaatgcttcccgatgtctcccaagccaagcgcgcctaggatagcatcactaatggcatgcagcagcacgtctgcatcggaatggcccaacaaacctttttcatacggaatattcacacctccgatgatgcatggccttccttccaccagctggtggacgtcaaatccttgtcccactctgatcatttgatatcctctccctctgtttttacccataacgccgccatatccaaatcctcaggcgtagtaattttgatgttcttgtagctgccttgaacgacagtaaccggaattcctagccgctctatcagcatagaatcatctgttcccaagaatcccgactgctccgcttcctcataggctcgcagcagatcggaaagacgaaaagtctgtggcgtttgaatactccacagacttcggcgatccggcgttgctgtaatgataccatccccgttcacttgcttgactgtatcctttacaggtactgccgctacagaagcaccagtacgctgggctgcctcaaggcatgaacgtacaagctcaggttgaatgagtggacgcacaccatcatgcaccatcacccaatccgcttgtaagtggcgcagaccgcgataaaccgaatgctggcgttcattgccaccagccaccacccgtacatttttaccgattttgtattgatgaatccaatcacggcagcgttccacatctcctgtcccagtcaccatcaccatttcatccacttcgggcatagctgcgaatatttcaagtgtatgtatgaagatgggcttgtcccgcaaaagcagaaattgcttgctctcctgcgtccccatacgggagccgcgccctgctgccacaatgacaactcctacccgattgttcattcaaataactcctgccctgatcgctttggacgatccgtatgataacacatctacttcatcataccgcgtttattgagctttttccaataattttggtttagcaaagatcatacggccggcagaggtctgaagtacactcgtaaccagtacctccatcagagagccaatatagtcacgtccgccttctacaacaatcatcgtgccatcatccagataggctacaccctgcccatgctccttgccgtctttaataatctgcaccataatttcctcgccgggcaatacgacaggcttcactgcattcgccaaatcgttaatattcagcaccgatacaccttgcagttcgcatactttattcaggttaaaatcattagttacaactttaccctgcaacacctttgccagcttgaccagcttactgtcgacctctgaaatttcctcaaaatcaccttcgtaaatgagcacattcacatccagctctttttggattttattcaaaatatccagaccccggcgtccacgattacgcttaagtaaatctgatgaatctgcaatatgctgaagctcctccagcacaaattcaggaatcacaatcgttccttcaataaaacctgtcttgcaaatatctgcaatacgtccatctataatgacgctggtgtccaatattttatgttcctccagcttgcgttcttctacacccgttccccgaccaaaaaaaccagaactccaaaaggatgacagctcgtcccgcttttctagtccaaccatcaatcctacatatccgcatatcacggtaacagcggtctggataagttgacctggggcccccaaccatgaaaaaagcggataaactgctaaggaaagcgtcaatcccaccgctaaaccaatcacacctgccatcatctcgttcatcggaattcgtaccaagccttcaatgccctgctgcaatcgatttgccacggatgcccctgcgaatgaacacccagccataaatagcactgctcccgccatcatccaaacaatcattcccagtaaagacccatcactcaaccattgtggcatccacgatacaatgcctcctacccgctggtataacgtatagccaaaccatgctccgcacaatcctgtaaaagttaaaatagcctttctccacattgagtctctatacctcctttattttctttgcatatagtcagctgcttattggatacatagcatttctcttaccagtatgatccatttcccacataactaaccctgtgttttcactttttatgcataaaaaaaagcatttatctccctaaaatgattcaaggaaataaatgcttattcttgttcttgcttgatactagcgctgtgaatgacgatattgatcgtcctgttcttcctgactggaacgctcccgctcacgtccacgtctgcgtgacagcttacgaatgttcagcttcataccatacaatgcatacagcaccagcggtacaaaaatcagcttcgatagctggtcagggaatctaacagccaacaccaccgctgcaattacgacccatggagcaacccagatcgcttttttcggaaggccgacctttttaaaattcggatatctcatggagctgaccatcaaataagaaaccagcaacatggcaatcgacatgtataacaatgaaatatcgttatggaataaggacaaagtggctaatacgccacctgctgccggaattggcaaccccgtaaaataacctggtacaccaggacgtacgttaaatcgagccaaacgcaacgctccgcacatcgggaaaatggcagtaaccgtccaagcgagagccgaattcgcatcatgaaaagcaaccatgtacataataactgcgggagcaacaccaaaagatatcatatctgataaggagtccagttctttaccgaattcgctttgggcattcaggacccgggccatcctaccatccagtccgtccaacaacatggcgacaataaccataatagcggcaagactgtattttccgtctacagccaataaaatggcgatcattccgagaaacaagttacctaaggtacacatgttcggaattgatttggtaatcatctcttcacctcaatgtatgaattgttccattataatcctttcactgtattacatttacatttgcctgtcaatgaaaacttgttcctgcaaacgtttaagaccttctttaatcgtacgcgcacgaacctctccaataccatccacttcatccagttcttctatcgttgctgtgatgacatgtggaaaacgtccaaaccgctccaccagattatgaataatcacattcggcaaacgcggtatcttgttcagtacccgatagccacgtgcagcaatatactcctctgatgtcgcagctgaagaagggtagcctagtaaacgtacaatatgattcacatccaacaattcgtcgtccgtagaacgtttgagtcccaatataatttcacgaatcttctcgtcgctatcgtctttggcataatccttatacagcaaccaagcttcttcctcaatgttgctgacaagctcttccatctgcatactaatcagacggccctcatttccgagctcgttaataaatcgtttgatttccattttgatgcgcagcaccatttcgatccgctggatgacattaacgacttccggcatggtaaccagctcttcaaattcagatgctgtcaaattcgtagaggcttgccccaacacggatctatatttttctaacgtctgaatagcctgattggctttcgttagaataaccccgatttccttaagcgcataccgtaatgtcccctgatacaaggtaataatattacgccgttgggaaatagacacaactaatttgccagtttgctttgcaactcgttctgctgtccggtgccgaattcctgtttcaattgaagaaatggaggagtccggaatcagttgtgtattggcatataaaattcgttttaaatcctcgctcaatatgattgcgccgtccattttagccaactcatacaaatagttcggtgaaaaatcacaattgatggagaaaccgccatccacgacttccataacttctgggctatagccaacaaccagaagagcacccgttttggcacgcaaaacgttttccaacccgtcgcgaaagggagttcccggtgccacaagccgcagcaaatcgttcattttatccagttggctcgcttctttcattctcaatgccccctaatctaatgcggctgccagtgcatctgccaccgttcctactcctataatttgtatccctttcggatgtgtccagcccttcaagcttttctccggcatgatcacccgtttgaaacctagcttctccgcttctcgtactcgctgttctgctcgggataccgcgcgcacctcacctgtcagtcccacctcgccaaaaatcacatcatacggctttgtaggagcatctctaaagctggaagcaatactcacagctatagccaaatccaccgccggttcatccaacttcacgcctccggctacgttgagataagcgtcctggttttgcaaaaacatgcccatccgcttttctagcacggctatgattaatcccattcgatgatggtcgactcctgtgcccattcggcgtggagagggaaaatgtgtagctgcaatcaatgcttgcagttcaaccaatacaggtcgggttccttccatactggctacaacagtagaacctgccacacccagtggtcgttcagacaggaaaagttcagaaggattcgaaacctcacgcaaaccgctttcagccatttcaaaaataccaatttcatttgtagaaccgaaacgatttttaactgcacgcaaaagccgatacgtatggtgacgctctccttcaaaataaagtacacaatcaaccatatgctccaacaaacgcggacctgcaatggccccttccttggtcacatgtcctaccaataccgtagcaatacctagccccttggcaattcgcataaagcgtgaagtacactcccgcacctgagccacactacctggtgcactcgtcacctcaggcaaatatacagtctgtatcgagtcgatgaccaaaaactccggcttcaagctgtccactgcttcttcaatcgtctccaaattcgtctcacataatacgtataggctgggggacaaggcaccgagccgatctgcacggagtttcgtttgacggacagattcctcaccagacacgtacagcacctttaaaccagttaaagccagttcattagatgtttgcagcataagcgtagatttaccgattcccggatcaccgcctaccaaaacgagtgaacctggcaccacacctccaccgagtactcgattcaattcgccaattcccgtcaaaattcgtgtttctttgccactctccacctctataatagggagtggcttgtcttttgtgctatgagtaagaagggaagaccccattccttgagtttttacaacgctttccgtttcttcgaccatggaattccatgcctggcatccaggacattttccgtaccatttgggcgattcataaccacattccgtacaggaaaatttagttttcactttagccatactttgttccctggctccttattgacgacgatgatgtcaaatttatgttcatacagcccagaaagagctgtaacaataaaagtttaccattgaagcttggcggacgtaaagcaatatcacaaactttcccaaagcatttatccaaccttttcaccgtgttttatacacaaaaagggtgtcttcgcaatagctttccagcttgcgagacacccttttctactatttatttagtaaactgctttaggacttggcagatacattatcctttttggttacagtcaatgcaccgttctcctcatcaatgaagagtgagtcacctttagtaatgttgccagtcaacagttcctcggacaggcgatcttcaatatgcttctggattgcacgacgcaatggacgcgcaccatacgctggatcaaagccttccttggcaaggaattttttagcgttgtctgtcaactcgaagtccacctcatactcattcaggcgcttacgcagctcctcagacatgagtgatacaatttcggcaatatgtttttcttcgagagaatggaaaacgataatttcatcaatccggttcaagaactcaggacggaagcttttcttcagttcatccatcactttgcccttcatattatcgtaatccgctccagcgtccactacagctgtaaaaccaagcgtggagttacgtttaatcgcctgtgcaccaacattagatgttaggatgatgagtgtattacggaaatcaacgacacgacctttggaatctgtcagacgaccatcttccagcacttgcagaagaatattgaatacttctgggtgtgctttttcaatttcatccagcaacacaacagagtatggcttgcgacgtaccttctcagtcagttgaccgccttcttcatatccaacgtaccctggaggcgctcctaccagacgggacgtggagtgtttctccatatattcggacatatcgatacggataaccgcattttcatctccaaacatggattcagccaaggcgcgtgccagctctgttttaccaaccccagttggaccgaggaaaataaaggaaccaattggacgcttcggatctttcagtccggcacgtgcccggcgaatcgcccggcttactgccttaactgcttcatcctgtccaattacccgctcatgcagcaactcttccatattcaacaagcggtgtgtttcttcctctttcagcttgctgactggaacacctgtccagattgcaacgacttgagcgatatcttctggggtaacttcggaatctgtacgaccctgttgttctttccattggtttttcgtcacgtctaactcttcacggattttttgctctgtatcacgcagcgctgccgctttttcaaactcctgactttgtaccgctgaatccttttccttacggatatcttccagacggttttccagctgtttcaggtttggcggtacagtgtaagaattcagccttactttggagcccgcctcatcaataaggtcaatagccttatctggcaggaagcggtcggtgatataacgatctgacaattttacggccgcttcaatagcctcatctgtgatctttacacggtgatgcgcttcgtaacggtcacgcagaccatacaagatttgaatcgcctcttctggagaaggttgatccactgtaattggttgaaaacgacgctccaaagcagcatctttctcaatatatttgcggtattcatccagcgtggtcgcaccgatgcattgcagctcgccacgtgccagagcaggtttcaggatgttggacgcatcaattgcgccttccgctccaccagcaccaatcagcgtatgcagctcatcaatgaacaacacgatattacccgcttgacgaatctcgtccataatttttttcaaacgatcctcgaattcaccacgatacttggtgcctgctaccacagaacccatatccagtgtcattacacgcttgtcacgcaacgtttcgggaatctcattcgctatgattttttgggccaatccttcggcaatcgccgttttacctaccccaggctcaccaatcagaaccggattgttctttgtacggcggctgagcacctgaattacgcgttcaatttccttgctacgcccaataacagggtccaggttgttttccttcgcagatgccgtcagatcgcgtgccagactgtccagagttggcgtgctgacattagctggagcaccgtgatggctggaaacagcctcgctgctaccgagtaattgaagcacttgctgacgcgctttgttcaggctaatgcccaggttattcagtacacgtgctgctacgccttcgccttcacgaataagaccaagcaaaatatgttctgtacctacataggtatggcccagtttgcgggcttcatccatagacagttcgatgacttttttggcgcgtggagtataggcaatgttcgtcggttgctcttgaccgcgtccaatcagcgtttccacttcatcctggattttttccagtcccagtcctaaaccgattaaggctttcgctgctattccttcaccttcacgaatgaggcctagcaaaatgtgctctgtgccaatgttgttgtgtcccaatcgaacagcttcttcctgagccaaagcaagcactttctgtgcacgttccgtaaatcttccaaacatcatatatcctgcacctccacagtgtgtatttcagatcattctatatattaaagggttgtgcctaatttttgccggatcagcttcgcccggtacatatcgcgctcttcggtattcattttatccccaaagcttttttgcaggaacccgggttgtgtcatcacattcagctcattcatcgctgcggtggaaggacgctccaaaatcctcaaatctacgccaagacgtacatcggatagccgctgtgcagcctccttggaatccaatactgctgcatatgacaaaataccgaatgaacgcatcacccgatctgtaattcgcagcatagattcattcattagccgttctctggcagaacgctcgtgctcaataatttgtagcaccacgccatgtagattctctataatttccgcctcggtttgtcctagtgtaatctgattagatacctgaaacaaatttccgacagcttcgctaccttcaccgtaaatgccgcgaaccgtaagacctacctgtgaaacagcagacaatatacgattgatttgatgagtcatgactaatgcgggcaaatgcatcatcaccgaagctctcatacctgtgccgacattcgtcggacaactggtcagaaaacctcttcgatcatcaaatgcataatcaacatgcgcttcaaatgcatcatcaataatcattgcgcgttcccaagcttccctaacctgacatcccggatataagcactggatacgcagatgatcctcttcgtttatcataacactaaccgattcatcatcgctaattaaaacagcaccgttacgagattcgttcgccaaattaggactaatcaaatgcttctcaaccagcacccgcttgtcgatctcatccaactcggatattttcaacgtatgaaaagtaccaaaaccacctaaatcatcatactgaaggatatccgttaagcgttgaagtgcttcttccgactggtgattggtagcaagcatgggaaaaggcagatgctgcaagttacgcgcaattctcacccggctgctaatgacaatctccgaatccgcagcatcaccacgcatccagtcacttagcggcttctccgtaaaccgaatattgggcattacgcatccctcctactcttcacaaactttactcttcagtcatttctttttcaagctctctgatttgatccctaagctcagcagctgattcaaattcttcctgtacaatatgctgttgcatctcttttttcaaatcgtcaatttgccgtttaaccttcagtcggcctccagtgcgaaccggaactttaccaacatgattcgtactgccatgcacacgcttgaacagagggtccagacgactatcaaagtattgatagcacgacgggcatccgaaacgtcccagcttactaaactgtgcataggtcatgccacaatccttgcattgcaggttttgcggaccactgtggcctggagactggctctttgtactggagtcaaaatccagcatccccgacaacaagctatgaatcgaaaagccgttaggtgttccagggatcatctcccctttttccttggcacacgtctcacaaatatgaaactctgtcttttcgccattcacaattttggtgaaatgcaaagttgccggccgcatattacattcttggcacagcataaaagcacctcctttaatgtcaggatttataccaatccctacatccaaacgttagtctctattcacacactacttggtcgccagcaacgagatcagcatagccttaagcaatcttgctcgcagttgatcacgatagggaagcttcagtaataatgtatccctcgataaagcagccttcattagattagcttcccttttgcttaaaaaatgggcctcctctaactgataaatcagtccttctgctgccgattggcttatttcctccccgatgctctgatgaagatgtgtatggatggcatgctgtgcaggcagctgaattcgctgaatacgaatgtagccaccgccaccgcgtttactttccaccacatagcctttttccagcgtaaaccgggtgctaattacataattaatttgcgacggcacgcaggaaaagcggtcagccagatcattgcgctgaatctccactaaaccttggggactttccagcaatatactctttaaatattgttcaataatatcggaaacattgcgcatttcatcatcctccactaacggaaacgcaagtattcaagtacatttcacgctccacagagtccgccgtatattgaacttaaccaaacggtaaagtcacgaatctaagctgtattcaggctgttgcctgttctacattcatttgaattgtaccgttttgtctctagtgtggcctttatttgcgattagtcatacacttctcttattttcataaaaggcagttcctaactatacgcaaatcatttcgatcctcgtttgcttctttgctattaaaattactttatacggccaatccaccaaaatacttctacagaacctcacgaggtttgattgactttgactttctttgactatactcatattatagcacattattcatttttgccaaggggtcaataccatttttcgcaatctaattatgttttatacaataccataaaaaaactcttcccaactacagaaagagttttgaaaattataataatcacacaagttatattccctgaaaaacgaagcataagaagacctaaatgggcctttatcagaaaaaatccaataaaaacgtttgttttactggtattacacgtttaagcgcagacacagattcactgcccccttcaatacgcccccacttatacagatcatcagcctgctggtagccaagcatcagagtcgtcagtgactgaatcccaagtttcaagtcagctaccatagcgttttcagatgaattgcttgtatccattctctccagatgtcctttcccttccgtagtaattgttaatctccatactccttcattccatggtgcatatcgatctgtcagatttaaggttaaacgtgtttcctctccaacctgctcaaaagggtatctttctacaaaagcagctgcatccacaatacggcccataaaataaggcacggtctcctgttgaattcgcggatcatcaagtaaaaatggcagattgtcatctgctggaacgtaaataaatttaccatgggttatcatggagtcatgatttgcaaaataagtccataaagcctgacgggccgtctcattttcataaaccaactcatcacaattgaattgtttatcttcaattttgtacagtgcatatccctgaggatcgcctgtttctgagtaatataccgcagttcgatagttctcatttaaaatccgctcttgccaccattccttatctcgtaccagcgtgccattataacgagatgcaaacgcttgatacacttggtccagtgctaaaatatctttgacatcgcgtttgactgtaccttctgttttaagttttgcagggaatttatcaatgggaatgacgtactttttgtattcaatatacgtttcccatccaaatttacgatagaaggcaaaggagaagggatgcagaaaagaaaggctttgtcccgcagacttcatctcttcaagcgcatgcgtcaacaaacgtgaaaccatgcctccgcgacgcttttctggccatgttgccacaccagcaatgcctcccatatcaaaaacctgaccgtttatgtatacctgtagcggtaacaaagtcagtttagtattcaagtcatgtccgtcgaatattccccatgtttgctctggtttgaacttcttcctagctttctccagatcctccagggacattgtaaactgaaaagcatattgagataattcaatagccgcttcaaattccttgcgttgtaattgtctgatctccataacttcgtcacctcacttgtatacttgggcatccataaaaagattacacacttagagtgtggcaaaccccattctctctgtcaaccttagaaacaggtggtcatctaaaacagataaaaaaaggatgataatctcaatgagattatcatccttttcacttttgcttggcgacgtccta

SEQ ID NO: 2609 - DNA, 109452 bp, Unknown
  Kingdom: Bacteria, Phylum: Firmicutes, Class: Bacilli, Order: Bacillales, Family: Paenibacillaceae, Genus: Paenibacillus
  misc_feature (84589)..(84590): n is a, c, g, or t
ttgcagaaggtaagactaacttgtcaattcaaagtacctgttgcacatgaaggagtaccgataagaccactggctggttgaaccccttttggagcaacctcatttttggctacttgcaagtccagatcaaattgatttttcatcttgttacctccttttattttttacaattttattgtaagttatataatcttaactagactttatatatttcttacatttatcttaatttcaacgagtacatttaagataaacctttattactttttagtatttttaaggacagcacactagattttagtgacaatataatgagggaaaaaataatggaggctttcatatgaaaattgatagttttgttatacaacaatccgaccaagttcgtgcaagagatattagtaaaaaaattgctttacgtctgtgcgagcccgaatccgtctattcagcagtccattcggaacacaatgtttcgccagaaacaaagtaccacccatggggagaaacctcactttcgcatggttatcctggtaacattcatttactatcgcaatggcgtgctacagacctttcgtatgattggaatagagccacacatttaaatatggctcagatccaatcctcacttgctataattggtcttgacgacctctctctttacagtggctgggcaggcatcgctgcgtccgtaagagaggcttctaattatggagaatactacagcaattttttacagcaaatacatcaatggatgatgcctctaacagagcaatggcttcagtcgaacacagaacaattaagccttcacgaaggtatgcccatgcaatcctttgacaccatttcgggagcttccgggattggaagatatattttgatgaactcaaccgatcctatttgtactcctcttgttgagccaattcttcaatttcttactgatcttacacatcccatacatattcacaatcattatgtcccagggtggtactccccacaaaagtttcaatttttagatcgggataaacgtaactatcctctgggcaatttcaattgtggaatggcacatggcattcctggaccgttggctttattatctgtagcttatagttctggaattgaagtaaaaggccaatatcaagcgattgaaaccattacggaatggttgcttaagtataaatatgaggatgaatatggtagctactggcctcatattgttccatttgaagctgaaacaggctctctacggtttgatttggaacgagcaagagaagcatggtgctacggtacacccggcatcacctgttccctatttcttgccggaaaggctctccataatgtggaactgcaaaaattagctgtgaaagcttgtgtcggtgcaatctcctatgagatagctaagcgggaaatggactcttctgcactctgtcacggtcttgccggattacttaccatctcttggcgaatgtggcgtcacagtaaagagcctgcatttctcccgcttattcaacagttaacgaattgtctgcttgatcgctttcaaatggatagcccacttggatatctggaccccgagccaaggttagatggctctttgacttggctgacaaaagcaggcatgcttgaaggcgttgctgggattgcagctgctttattaagtgtttctgagaacaaagagatcggttgggattacatcctcatgctatcctaactacaaccagtccctattcacaaacatctttctcccaccatacagataggctaaaaacgtaaaaatgacaatcaatccgagactgtaaggctcaactctgggtgcataactcgctgtttgcggcatcataatataataagggatcgtaaaaggaaaccacgcacctatggaagaatgaaagcctgttatgacaatattaggaaccacacaacaaatagacattcccaaagaagctccaaaattccgaatttttatcgagaggataagctgtaatgctgccaggggaaaaatcccgagccaccctcccaagccggtagaaagaacgacagaccaagggatttctcctggagcacctgctatatttccacttacaaaatagcctactataaatataagctgatcaagacccagtatgagaatgagcaatatatattttgcataataaatttgctgacgaggatacgggctgcttaataaaatcttccatcccccatcccgatgctcatacgcacacaaaagagaagcgataattccacaatagagcggataaaaaaacatagagtgaaattgcgctgaatacgtatataaagttaaccagctgggcgaaaaaaactgcttcaaatcgttcagctccaggactcccattaaagaatttatgaccgcatctaatataatgagaatccataccatgatccattgaagctttatcgtctctacgcgtaaaatagagcccatgtatcttctcctctctatttgaattcatgcttggtaaactgtaatgtaccaagtcccgtaaagatgactcccgcacttaaagcaacgattacccaaatcatgtgttccttcatcagaggacttgatagtgcagggtacgaccaaggcaatattttaatccacagaatacttgtgcgtgccaaaaacaagcttgcaatagaaccgaatataccaaacgctaatgggaatgcctgattagtgaaaagcgtagacagccaaagttgaattgcaagtactggtagggtagccaagcttgcattaatcggctgtaacagcatgatccgccaaggaatgggttcgcttgtatataacacccagatgaggctcatacctgctacagtgatcaaggcagtacccaactgcagaatcacgatccatacgattttggataaatagatatagcttctgggaacaggcatggccataagctgcttccatgtttgagtatcatgctctgtaccggccataatgctcgccaaaagtgtaccgccaagcagcatcacaaacgaaaggaacataaacataacggcaaaaccagcatagacacctcctggtccttgccgaaagtaaagataccattccaccgcagtcatgcctgtaagtacacacccctgtataagaggaatccaccagcatattttcttcagcttaagaccctctgcctttataacccggagtatcataagcttcgctccttacctgtcagttccaggaatatctcctccaaggtttttttcttctctgtgacccgataaatgggatgattgtgttccacaagcaccttgatcatctccgaagattgttgccgatctacaataggagtcacgacctcattttgttcaatcgattcagctccggccgtccatccatactgaatcagtgcaccggcagccagaacaggatctggggtttcaatgaataattgaggcttgcttttggcggtgagttccttcatcgttccctggaaaatcatttcaccctgattaataattcctacataggttgcaatctgctcaatttcgcttaataaatgactcgaaaccagtaccgtcattccgtaagcgccaggaaggctcataattaactcccgaatttcctgaataccagaggggtccaaaccattcgtcggttcatcaagtatcaataatttggggttcgcaataagcgccatagcaatccccagtctttgtcgcatccccaaggaatatccctttaccggacgatacgcatccttgcttaatctcactaaatccagcacttcatgaattcttcgggtcggaagtccacgcatggttgtgacgatttccaaatttcgatatgcagataaatgggcataataggcaggtgattcaaccaaggagccaacatccttcaatatttccatacgctgatcctttagctttttcccgaaaatctcaatttctccggatgtggacttaatcagcccaagcagcatacgaatcgtggttgttttacccgccccattaggtcctaaaaatccataaatctgctgtccgggtacctggagatttattcgttttacaaattcccgttttccaaaacgcctagttagctgctgtgtatgtattacatattcagacatttcctgatctcctctcgacttctaatgctaaagcttaagttacatacagtttactgaagtaaagtaaacatcaggtaaacagtccctaaacaacaggcaaaaaaatcgagcagactgcaaaatgtgagattagatgttaaaaagttagatgtttagcggcagtgaaatctccatccttgtacccgctttactgcctggaaggatatgaagtgttccgttatgcgcttcaataaagcttttggcaataggtattccatgcccttgggagtgagatacctgcatgaactcattagaattcattcctattccgtcatcttcgatagaaataagaagcttatcgttcgctttgtttacttccatggaaacgtgtgtacctggaggattatgaatgattgcgttaatcaaaaaattctgcagcgctctgcctaataacttgctatcgaaggacataatacaagccgcctccatggacgtaaaagaaaattcgtatggctcggccgaaggatggttagcaatatctatgaccgcactacggagaaactctacaatgtcctccttctccaattggattggcaatggactttctttaagctgcatagaagcattcaaatcctgaatcaactgcttcatttcagtcactttctcactgatactcatactaaagcttcttctttcttcatcagaccagtcatactcttgagcagtcagcatggccgcatatccctcaatataagataatggtgttttgagatcatggcttacacctgctacccactgctgttttcgtttctctatttccactctctcttcctcattgctgcgcaattgagccgataagatgctcatttgttcaaaaacttctttatacaattgatacggaggtttataactatttttctgattctttttgccctccggcagttccagttcacttagcggcgcttggaattcccccgtcgcaatatttccaatccatttaattacatacaccaaaggtttgcctatataccatccgtaggcagctatgaacacaacactctgcacgataccaagtcctgtccagaatagatcaatatttatattttgagatgctccaaatatactttttataaaaatatataagatcgtgcaaataacaaaacataggacataggccagtacaaagcataacgttactttcataaaacgaaaggacatcttaaccagagagttcattcttgctcctccatcttgactgacatcatcattttataaccaagtcctcttacattgattaaaaattgggggtgcttgggatcaggttcaatttttttccgcaaacgggagatatgaatcactacagtcttctcatcacccaagtaggcctcgccccatatcgcctcgtaaagctgccgtacactgaaaatacgattaggatgcttgcacaagaataccagcagtagccattcacgtgccggacactcgacctgcttgtccttcacaaacaacacaccggattccagttccagtcggaaatatccaaaatctaaagttcgtaaggtcggtttcatggccactgtcgaaactttccgatatttcattcgagccttcatacgggcaacgacttccagtgggttaaacggtttggtaatatagtcatcccctccgataccaaaccccattaatttgtctaggtctgtatcccttgccgtcaaaaaaagaataggggcatccgtatataggcgcatttggcgacatacctcaaacccatcgttatcaggcagcataacatcaagtacaatcacatccacatgcgattccatcacgactttcagcgcttcccgacctgttgcagcatgcttgacttgaaggaacccttctttttttaacaccgttgtcagcatatcccgcagtccctgctcatcgtctactataagtactgcaatttcttccataacccaaggttctccattctttttttacattttttactttcattataaaagcaaacgggcagaatttaaatcgagttccatcacatatcgttcatccccgtgaatatacttaataaccaacaaggccaaactgtgccgtgtatccacttggggggtgcctaataatgccggaaccacgccagccatattcattcgtcgtatcccgcgaagattggtcgctgcatcgcaaagggtaccaggaccagcaacgtcatcagcagaaggtcaaagatgtcattaagcaaaatctacccgatctgataacggaagaaaatattattatgtcggacggtcaacagattatcaaagtgccgattcgcagtctggatgaatatcgcttcatttataactatcaaaagcaaaagcatgtaggccaaggggatggagatagtcaggtgggggatgtcatcggacgtgatcctgcctcccagaagcctggtaaaggtgagaaagccggcgaccagccgggacacgatattatggaaacggaagtcagcatagaagaactggaagatatgctgttcgaggaaatggaattaccgaatttacagcaaaaagacaaggatcaaattgaggttgaatctatcgtgttcaatgatatacgtaaaaaaggcatgcaagcgaacattgacaagaaacgaactattctcgaaaatctgcgccgcaacgcccgtgaggggaaaccgggcattcatcatattagtccggacgatcttcgctacaaaacatgggaagagaagaccattccccaatccaacgcggtgattatagccatgatggacacatcaggctcgatgggctcttttgaaaaatattgcgctcgcagcttctttttctggatgacccgctttttgcgccgtcagtatgaaaaggtggaaattgtctttctcgcgcatcataccgaggctaaagaggttacggaggaagaattttttacccgcggagaaagtggcggcacgatctgctcttcggcttatctgaaagcactagagattatcgacaaacgatatcctccttccagctacaatatatatcccttccatttctcggatggcgataacctgacctcagacaatgagcggtgtgtgaagctaatcgaggaacttataaagcgaagcaatatgttcggctatggagaagtgaatcaatataatcgcagcagcacgctgatgtcagcctacaagaatattaaaaaggatcagtttatgtactatgtcatcaaggaaaaaggtgaggtataccaagccttacgtaccttttttcgcaaacgggaagggggaacggtgggatgagcaccgaccagaaggagctagaatatgcgatatcagaaattatggagattgcagatggattcgggctcgactactacccgatgcggtatgagatttgtccggcggatattgtatacacgttcggagcctatggtatgcccacacgcttcagccactggagttttggaaaaacgtttcacaagatgaaaatgcagtacgattttggattgagcaaaatctatgagctggtcattaactccaatccctgctatgccttcctgctggaaggaaattctttggtgcagaataaactaattgtcgcccatgtgctggcacactgtgattttttcaaacacaacgcccgcttttcagcttctaatcgcaatatggtggagagtatgtcggccacagcagatcgaatcaacagctatgaaatggaatacggttcaaaggctgtggaatccttcattgactctgtactggcgatacaagagcatgtggatccacagatcatcaaaccaaggcatctggataagcagcgctacatggagctcaaaattcgggaacagaaagaacccggaaaacgccaccgtccccctgggccttacgatgatctgtggtcactggacacagtgaagcagcatgatcccgccgagaccgagggcatcaaggtacgcaagttcccaccggaacctgaaaaagatatcgtctggtttattcaggaattctcggaggtgctggaggactggcagcgggatattatgacgatgctacgggacgaaatgctgtatttctggccccaaatggagaccaaaatcatgaatgaaggctgggcctcctattggcaccagcggattgtaagggaactggatttgaccggggaggaaaccgttgaatttgcgatgctgaacgcttctgtcgtacagccttccaagcaaagcctaaacccgtactatttggggctgaaaatatttgaggatattgaaaaacgatgggataacccaacccgtgaggaacaagagcgacaaggacgcaaaccgggcgagggtcgagctaaaatgttcgaggtgcgagaattcgactcggacacctcttttatacgcaattacatgaccaagaaactgacagaggatttggatctgtacgtgtttgagaaacggggacccgattggaaaattactgataaatcttgggaaaacatacgggatcagcttgtgttttcacgtgtgaatggaggctccccttatatcgtcgtcgaggatggagattacctgcatacgggcgagttgaagctcaagcaccagtacgaaggcattgagctggatttaaaatatatggagcgcacacttccgtatgtatatcagctgtgggggcgcaccgttcatttggaaaccatgattgagggtaagctcgccttattctcatatgacggtaagaaacatcatcgcaagtttgtatagatatataaaatcaatagccatcctaatttaaaaaggtgcattccgaaaaaacggatatgcgcctttttactacttacttaataacagccctaagcaatcaccatttcttacggactggatggacatatttttccagaaactacttcctcttaaattcgacaatgtagctttgattgagctgttttccaccttccgaaatgttctggtacatggataaaaaccgggcggatgggctccataccgttgggctgtcataggattggatatcggtcgtaaccggagtggttttacccgtgaactggtcaaacacatacagccctctcatgccttgctgatcctcatcataaatggaaaaagcaagcttggacccgtcgctggaccagcttccacgactcattaaagtaccttgaccgacgattcctttctctttgccctgttcatccaaaatgatcatacgggctggttcggatgtattccattttcgcttttcaatggcaatagacttaccgtcaggcgacacggcaaaggacatggcaccctctgcaatggtcacagcctgaggatgattgagggtgaaccgattcagcaccggatacccttgtttatcactacctgtataaaatatggcgttacccactttttcgacatgagacatcaattcagagcgattcggatcttgaaaactcaattcttcagccttgccgtccagaccaatcagctggattttaccatccggtgtgcctgtaatgagatcattctcatcgctccagctcacttcgttagtcatatccagcttgccaatcggtgtaaccttaccactgcttagttccaaaatgtagccctggatatcatatttgctgctggtgctaccttcagtaaaaaagatatggcgctgatccggtgataccacagcaagtaactgtggagccttacgacctggtgttaaaatccgctccttgtttgtctctacattatgaatccacagctgggttttacgctcgacaatcaactcttcgtcgctcagccaagacctcgcgtagacatcccccagcctgccgatagacgataccaccagctcgtccgttacttgcttctgggctgtatccgtgtcaatcacagtaagctgttggcccggtttcataccgaatgctggatttgtctctcctgcgctcttcatgccgcaaccactgagcaatcccccgacgattaagccggtcatgagcacccccgtggctttctgtctgaaaactctggtacgggaattttcgcgatgagagaagccgttcttatgcctatagctgtctatgtttttctttatcatgtacaacggcctccttgttaacgatacccccagtttaatgccagaacatctcatgaatacatcgaattgtttccaagttgtaaacaagacatcattctatctagccctgtgctaacaatcggccggttacagggagccatcgtgaaccaagagggggagtctaagcgaaaattcattcccacttacattcgtatggccgttgccattttccaacccgccatgatctgaagctgtaagctgcaactctccccccatgcgctccgccagtctgcgcgccagaggaagaccgagtcccgtaccgctgtcctgacgagatcgatcacgactcaaggtagcgaacggctcaaaaatcatgttccattgctccctgggaatccatggaccggaattacgtatatacaccatcacagtgtcctgttctacccgattcgataacgtaatccatccaccgtcccgattgtacttcactgcattatccagcaaattcagtataatatgcatcagatgcttagggtctccccacacctgggcaggaacggtatctatcgaaaaattcagtccacgcgctgccgcttttcctcgaatacggatccctgcatcttccagtaacgaatgcagttccacagcctccgtatgcaattcaaaatcatatttatccagcacagatagccgcagcgagtcctcgacaagctcgtacaaccgttttgtttccttactgatgctttctctcgcttcacgcaccagttcaggatcatccccatacatatccagtaaatcagcataagcttgaatagaggttaatggggtctttagttcatggctgatatttccaataaaagatttttgctgctgctctatctctctcaagcgctgaaccgcttcttccagccggagcttttcgttttccagcgcggtaatgctcatccggatcacatgactcatttggagcattccttcatccagtcttcccagttcatcctgccgccgcagcagtctggcttttggataatgccctgccgatatctgttcggaagcccgagtcagtcgtccgatgtccctcgtctggcgactaacatagcctaaacccaaaataaagctcaatatcagcaccgcaccccccgtccatagaaacaagtgggcaatggcccggtagaactgctgctgtgcttctgttgagctgtgaagctgtaccactcccagtaagccgtctggaccttgaagcggagccaaataagtgattgcgcttccttccgtaatatacgcaattttgccttggatcgcataggagagcgcctggctgacatctgttctaaaagccagcgatagagaattgccaacctcatgcccctgactatcatataaaataacgcgcatattactggatacccctagttccactgcgagcccaggtgcctgcttcttcataaagtcttccggtgattggcgcactcccaacaggtaagactgttttacacgcatttctacaatttcggcctgacgctttaagctgcgttccatttgatctgtctggttagcgcgaataccagtaagcacgagccaactcagcacacccacagtaaacagcagcaaagccgccagtaccaacggaaatttccaacgcaggctcaagcctgtaggtttgcgtttgcgcttctgttggtcggtggaccgcaagcttccttgctgatggagtgaatgatgttcgttcacgttattttctctgccttatagccgataccatacacagtctgcaatatcgcttgatgtggctcaagcttcttgcgcaagcgctggatatgaatatccaccgtccgcgttccgcccacataatcgaagctccatacctgctccagcagatcgtctcgtgtatataccttcccggcatgagacaccaacagcgccagcacatcaaactccttgggggtcagatccagcgctatggctccaagttcagctgttcggctggacggacgtacccgtaatgggccgaggaccacttctgttccttccggggcaggcgctccttctcgctccagtctccgtaccaatgctttaatacgagcaagcaactccctcaggtcaaacggtttgctcataaaatcgtccgcacccagctccagcccgagtaccttatcaacgatatcgtttttggccgtcagcagtaaaataccgatgcccttccgattttccaaacggcggcacacctcatatccacccagtttgggcatcatcacatccagtatgagcacatccgggtggaacaaacgcactttttccaaggcgtcctccccgtcaacggcggtttccaccaaaaaaccctctcgctttaatgcataagccagcgcatttcgaatgctcgcctcatcgtccgctatcagtatttttttatccatgtcctgccctccctgcataaaaaaccgctccagctacctatgttcccgcaaataataatgaatcagacatgtatgacatataaactgctcacgtggatcgttaagatcaaaatctgtcatgtcgcgtatccgttctaatctgtattttactgagttacgatgtataaaaagataattggctgtatctaccagactgcccctgttttccaaataataaaataacgttttgagtaagtcactgccatgtgaacgatcatattgctgaagtctccccagcttgcgttcaaatacatttgaaaattcctctttgtccatcgcttctccaagcatatagtgcatctctatatcgctgtatttgcatacacgttgatcaggatacagccgctgggctacagtaatggcacgacgtgcttcattgtagctttgcagcagctcccataactttttggcacttccgatgcctaaataataatcggcggtaccccaggccttttcagtcgaccagtttttcagcgtatcactccaggacatttcctgatcagagccaggtacattctggtgatcattctgctgaagagttggcagaaataatatcgcccgatttgaacgaaactcaatatgagacaccacacgccgtcgggtcgattccatactcagtagcccagaaagaatctcttctggcggagccgcagcactttccagtacagccacctcccagtcatattccgggttaaatcccaattgacgacctctccgctcaacctcatgccgcaacggcaacggaggtgtcattagctcatctataaagttcccccgtagtcggctttccgtatcttctaccgccttttcacgcatgagttccaacgccatcaccagccgtgcctgctcaataccgacctgttccatatcatccagctcattgcgggcaatgaccaacttggcaactgtacgtttatctacgctaatgggaaaatgacgagcaccttgtaccatcgtccaatcccattcttgtggtgaagtgacaatggcttgacctccattatcaatcaaagcaaccggagctttaaaaagctctgctatattatcgcttacagcctgtatgccactgttctccagcaccatcgtcgttaacgttcgatagatttcttccgaacgtcgcagcagctctgcctgtcggttcaacaccatatccatgacacgctgcgtaatatccgtatagggaatatcggctggaatctcaatcacaggaaggccgcaggcattgctttcttccagcgcactgtggggaattcccgtgagaaagcgggtaggcttgatcacaagcgccgccgctccgccctgatgcagtaattgaataatttggcacaatatctcaggctcatgacggatcgaataagccgttgtcatcaacaatacaccttcccggacccagcctttcaggtcagggacttccataatgtcaataaaccggacaacccggcttagcccctgttctccgcttaataccttcgcctccttcaacacgggtattgccatgagctcttgaactgttacacccggtattttcataaagacagaccaccctgctatttattttgcaaaatccttacttcatctaattttcaggatagtgtaccaaaaaagtgtacaaaacaaaaccttttaccgcttggtcaagtctatccacaccagcccattcctatctttaggagctcaatggaacctaaataaaccgcccttttctggaaaagggcggtttattttaatattcaactatttataatgaagtttaagaactatcctgcttgttctccacacgaagcaactgctagcgtaccgacacggctgcacccaacgccacaatcggatcaatagcccgaatacccagtgaacgctccagctctggcgcaaagttcatcgttacaaaacctgtgcaggcaagtacgatgacctcagctcccttctcctgaatccgcagcgctgctgctatagccgcctctttaccttgtgcagtgttcaagtccagtgtcgtctgcacacctatgggacgctctgtaccgatataggaattgcccaaaatgtggcgaatcagcggcggagcctcctccaaaatggtcaacacgcctacacggctggccgatgtcagagccaagagtgccgcacaagaccccgccccgtatacaggtacagatacagcttgacgagtttcctctagcgccggatcagccgcgcagctaataccgatagacgtacagccttgttcaacgagttgttgcgccgcaagcacaattttaggcaccgcttcccggtctgtgatatcatcgtagattcctttcggctgatcagggatacatacactggtgacaggcagcccgtagcgctgctcaatgacccggccgtgaaggtcgatagctgctttgtcttgcatggtaagcactctgatcattccaagcatgataacttcctcccttttatctctctagcaactgaccagccttcatcatcagacgaccatccagatatacatccggtttttgtacgactccgtcaatatgtacacccgcagcgacagttcccccgaaggtattattactgccaaaagcgacatgaatcgtgccatacactttctcgtcctctaacacaacacctgtaatgcgggctttatcattcgttccaataccaaattcggccagcattctaccatcgccttcgccgagcatatccaacagggactgtccggcttccccttctgcggcgattaatctgccattttgcaccgttagcagcagcggctcttgtaaggcaccgattcctgctacagaaccgtccaccacaatctgaccctgtgccgttccttccagtggagcaatatacgcttcaccggaaggcagattgcccgattcgccaggattcaaatacatacctgtactgggaacgccgttgcgcccttctatggtaaagttcaagctatatccatccttttcaatccgtacctgcttggcagcagtcagcaatgcggttacctcttcggtcagcgccttgaccttcggataatcagcagcgattgctccattcatgaacatatcgtctgtcatgccaggcatggtcgccaggcgtgctccagcagctgcggcctgcttacgggcacttgtatgtgtcagcgaataccgggtgacacatacaacaacgttggaacgaagcatggcttcggcaacagggactggaggctcctcgcccgatttggagcgaaccttcatcgtcaaaatagctgcttctgcccccagtgccttgccagcctcatatatggactcgcccaattcttttttatcatcgtcggttacgaccagaagcgtctccccagcggcaagtcccaaacatttttgcaatacatttttactgatttcaatacgttgttgactcatagttcttacctccaatttttagctccttacaccatttccgataccagtttgcctatcaaggcattggacaatacaacgggaacccccgagtaatgcgccgctagctctctatgcgtttccgtatagcccatgcaatccagcacgatcagatcggcttgattcttgaactgtccggctgctcggcaaaattcttcctcactgccactgtaaggtgagaccgccgcaaactctggattcaatccatatggactgaatttaagcttgaggttgttcttctgttcttcgagcggtccaatgaggcctagtcttcttccgctggacatagcctttagtacaggaggaagcacatgatctggctcaattagaaaagcgcttcgggtatgcaatccaggaaacacaccggtacagagtagcaaaatcgtacgtatgccttgctgctccaaacgtgtgattttttcctggagcagcggctggattttttcgcgtgaaatgaccaccgactccccggtcgtcaagcgcgaggttaatacatattctcccggtgatggtgatagattctgttgtatatagtccaatgagagcccatccagcgcaccagcctgtaccagctctgcccgtccttccaacgccctttctacgataggggccacatctgaccgaggggcttgcccaatcgtaatcatcccaagcttatgcattttgaacccctgctttcgcttcattttattttacgctcctggcgacaaagggcaagcccgcggtctgcccttatttcggttctggtgaatagttttaacttatgttactgcaactttcctaacataaacaatgttcgttctgaccaaaacaaaggcttatttgttgtgcataaaggataaaaaaacaaaatcatagcgccattattacattttatccctttttagtgtcaaaaaatataacgcagtataaatatctcttccctcactgccctgcgctttgaagtgtcttacctgtccgtatatgctaaaatacttccgtatcggctattcgcctacaggagggcatgatcatgaaacaatctattttgatcgtagaagacgaagaaaagattgcccggcttctagagatcgaacttcaatttgaaggctatcaagtatgtaaagaaaaaaacggaattgatgggctggagacgtattgcaaaggcaattgggacctagtgttgttggatattatgattcccggtctcaatggcatcgagctacttcggaggattcgtaagcatgatgcgaacgttcctgtcattttgctgacggctaaaagttccattgcagataaggtcgagggactcgatttgggagccaatgattatgttaccaaaccgtttgtgatcgaagagctgcttgcacgtgtacgggccgcactcagagtgggtgcaacgaaaaacacggctccacaagtggtagataaatggcttagtgccggggatttacgtctccatgaaggtactcgtgaagttcttcggggagagcacaacattgagcttacaccgcgagagtttgacttgctcgttcatttactcagacaccagcggcaggtacttagccgtgaacaattactggagaatgtatggggcatagattatatgggcgataccaatgtggtcgatgtgtatattcgctacgtgcgcaataaaatcgaccctacgcgccagctccctgagctgatccatactgtacgcggaattggttatgttctgaaggaatccttatgaagctacaaaacaaaatccatacgtatacctcgttattattcggaattttacttgtggccattaacttctcagtctatttcctattcagccaactttcgatagacagtcgaaaaggccaggtagaggccgcagcagaaaacatgattcgtgggattcaacgtgctccggtatccgtagccgctgaggatcttctccgagcctatgtaccgctggatggcatgcttcggctaatgaaaccagaaggcgactttcttccccctatcacctcttcttccgagcaatctcttagcttgatgaagggcgtttttgatgaaacacggcaggttcgcatcattacctatgaaagcaaccgttacattcttgtatcgctccccatgatttggaccaatggcgaggttgtcaatctccaggtgaccgaaagtctgcaaccgacgatgcagacgctacaggtactcagaatcgtacttgttgctgtcactggaattgcgctcattcctgtcgtggtatcgggaagactgctcggcagactgatcacacgtccaattacatctatgattagcacgatgaaagaaattcagcgcagcgggaaatttaaacgtcttccactccattcatcatcacgcgacgaactggtcgaaatgggtgaaacatttaatgacatgattgaactgctggagcggaatttcgtcaggcaagaacaatttgtatctaatgcgtcccatgaattgaagacaccgctcaccattattgaaagttatgccagcctgctcaaacggcgggggttgcagcatcccaagatttttgccgaatccgttgaagcgatccattccgaggcgatccgaatgaaggacatggcagagcagcttcttttgttggccagaaacgaagaacagtggaatgtcgtgctggagcctgtacgcctgaccagaatagcgacagaattaaaggctacatttgaaaatgcgttcgcccgacaaattcaactggatgtacaggcagactgcattggctataccgatgaaaataagctgaagcagctcctatttatctttttggataatgcacgcaaatacagtgacgagccgatacacctgatgattgatacgataggcgatacagctcaaccctgcataagaatcacagatcaaggaattggaatcccggaagaaaagttatctaaagtattcgaccgcttctatcgtgtggatgaagccagaagccgcgaggaaggtgggactggactaggcttatcattggctacaggaattgcacaagctatacatgctcaaattgggctagaaagtgtagaggggagcggaacaacggcaacgatcatcctccctaccgttccaaaataataagccaaaggagggaataacgatgaaagccatctatgtgtggataattgggggtacgctggcggctgtattgattacaatttgtcttttacagtggccttgggcacggtcgttagcagcttctccattggaagaaaaggccgtcatccaatccgttttgcatcagtatcccggcgaggtgctcgaatcccaacgcttgggtgatttttatctgatcaggctggaacgcgccaaagggaagtatgatataaaagccaatgcctatgacggtgtcatcgactccattaagcggacacaagcttatacagatgtggagcaggagccccaagaccacaattccggtaactcaccaaccagagacacatcgaatccagctaataaacctgacccggtttctctcgttattacagagaaagaagcagccaagcttgctgccaaagcagttaacggaacatccgatgatattgagcttcaccgcaacgacaaaggcctctattatctggttgaggttgaggtgaaaaatgggcgtgaagcagtggtacaggtcaatgcagtatcgggctctatcgactctataacgtgggaaaaagaaaaacaggagcacaacgaatcatgacgacttgatgatcatctcagctcatgttttctcatggttttctcatgattctattatgttcctctcatgttcaagagataagctgtattcatgcttatagcacaaggaggaacaatgtaatgaaaaaaaactatacatttggaattatggcagctacggttctgcttggagttacggttacgggtgtctcagcgaatgccgtatgggccgctaaacctacgggccttattggagcgaccgccgctgccaacattgccaagaaggctgtggggaataatgcacaagttgaagatgtcgaactagagcgcaagaatggaaaagtctactatgaggtggatctccagcaaggggataaagattgggatatagatattgatgctcataccgggaaaaccatccgttcccattctgagcttgatcatgactctaataacgagtcctcccttaacaaaccaaatcacatcaccctgacagaaaagcaggctggacaaatcgcgcttaagcacgtgcccgggagtacccttttgtcttctaaattggataaggaagatggacaattcatctacgaggtaaaggtactcaccaacgaaggaaccgttgagcttgatatccatgcatcatctggcgcaatcgtggatacagacgacgatgatgacaacgaatattaattacccaggtcataattagggtaactaagtacagagctaattaaaacggagcagcgaactttcgctgctccgtttttttgaccaatgtgacacaggaaatgaacgaagatggctccataaaactgcacctattatttcttcatgaatagactgataactaacagaggattaccttttttcttcaatccaaagtcaagtgaggttcttatggcgaaatcctatactaaagcacagattcgcaaaatcacccgtcgtttcggcctgatcccgttaaaatcaagcttagtctcatcattataccgaaaaaatgcagtgatcaaggtgaaaacgaaaaagggaacttatgcattaaaaccctttagtcgtacaaagatggtccgttcaaatacgattcaacagatggaacgagctgcgagccatatcaggcttttgaaaaagagaaagtatacctacatgcccgcatggctccccactcattccggcaagttatggactctgtatcagggaacgccattttatgtaagtcagtggatcaaaggacggggactggagaccgctgaagatttcgaaaaactggggcgggcacttgctacacttcacgccacctccaccggcttgcatcagatagataaaggaaagtcccctccgaccattcaacaattgcggatatggaaaaaccaggatcgtctttttcaaaaaaaaatgacaaaaaccagtcgccatgataaaacgtaccgcaactggtacaatgctcacggcgaagactgcaaacgtttatccaggcgagcatggaaggatttgcaggatgcatccattatcaggctgcttcggatggaacatcggcatccctccttgatacacagtgatatcactaccccgaatgtcattatttcggatgacggtcatctcaaaatcattgattgggatcgggttaagatcggctcagcctatgctgatttggcaaaggcccttatgaatacgactcaattcaaccctgaatttgtgcaatccttgctgaaggcataccaaaaacgcaaaccgctaagccgtactgaacggaagattgttacagctttatataaactaccacgagaagcctggcatgcttcccgacacccgaatcgttcaagagatcgcgaaatcctggacaattgggatcagtcgtggcctcttcgattacaaatcatccatattttgcaggagtgggctcatgcataaaagaaagtgaggagcaaaatgtcgattttatcgaacgttgagcagatgtacggaatcaaaattcagcgtagccgtcaaatgaaggacattcacaagattgagaccgctaatacgacttattgcttaaaaccctacaaattcccggaagaagagatccgttttattacacgtgtcttgtcctacttggatgagcgcgggtttacacgcagccaaaaggtctatccaacagtacaacgagcggcttacatgacctatgaaggtgtttcgtatacattaaccaattgggttcatggactcagaccagaattcacaaaaagaatagacttcaaaaagggaattgctactttagccaaattccattccagtgccgtgggctttcctgtcactgaagctccgccatctagaatccgttatgaaggcttgagcgatgaaatagctggatacaaaaaacgcctcatcccatacagaggcacagcacacctcgtagctctttgtgaggaagtgtcccatcgcctacagcagcccaaagttagagaagccattgctcaggagcaaaaagccgccgcatttatacacggcgactataattatcccaatctgattaaagacaaacagctcaaaatccatatgatcgactttgaaaattgctccctacatgtaaggatgaaagatctctcccatcttcttcatcggaattgtctttggaatgggacaaagatgctgcgcgcgatagattactatcaacgatatcgtccattgagcacccatgatttgcatctgcttcacgcactattgatctctccctatcatgtggtccgcaatatcagaataggcggcttccgttctgccaagcgagtcattccgtcgttcgcgcatttgaacaaataccgacgtgaacttagatcgctcttataatctgtcagcttggaactaaacaaaaaaacagacccgatgaagcggtctgtttttttgtgttctgacaaccagctacaggaaaagcgcatgccgctaaagccaatcgaattgctgactgtaccggtacaaccaaaaatatatagcattgtaaacagcacttcccccttctacaatgatgctaagactcaatgctccatggtttcgagaagagaatttgggaaactaacaatagaggtgatggtacatgtacaccatgacaatagaagaaataaaagcttatttaaacagaatcggaattcccgaaattcagcctcctaccctttcctatttagttgagctgcataaggctcatgtaaaacatctttcatggcaaacattggatatttttgcaaggaagccggcagccattggttttcgagaatccattcaactcattctacatgggagaagtggttattgttttcatctgaatggtgcctttagtgcactactatattcactagggtacaaagtctctctgcatcgtgccggggtacaacctctgggagctgaaccacgcattaattcatttcatcttgggctaacagtgaacttgctaaatgagcatcatgaagatgaagtatggattgttgatgtcgggctaggcgatatgccatatgagcctcttccactccgtatggggacttatgaacaaacccctcttcattataaagttatggaatccggagttgttacaaaaggttggcgcttagagcatgactcacttgcttcatttgttggcgttgattttgcccctgcggttgttcaggatttggaagaatttatgccgaaacatcatttttatagccgctcagcggaatctccatggtttaacctgtttctgattcggcaaaggcaagcattagaggcgaatgaactcagaggatgtatttggaaaagacgcgggctacacagtttggaaaaaatagaactggataagaagtcgcagtggctggaagtgttggcagatgtatttggcgagccgctcgttaactacagtcgccaggaacgggacgagttatggaaaagagtacttgcggctcatattgaatggaaaaagtctatgactgaatcgttacagtagtgaagcctccaacgtaaggatagccttcaagccacatcttacacctttagcatttccgaggagtgctgcagcatttccaattccttcaccatgttttcgatcagctttgtgaacgaagccaattcctctgagctggaagcctgttgccgggcactggctgttgtgacagctgtttcggattgcacactgtcaagcatacgggcaatatccagcaccttgcgctgaatttgctcctgtgcttgcttcgaattagatgcaagctttcgcacctcctgtgccacaatttgaaacccgcgccctgcttcctgcgcatgggcagcctcaatcgccgcattcagtcccagcagatgagtctgatcggacagttcccggatcgtaccgctcatctgctcaatatgcttaatctcgtcactcaaatgctgtaccaattcctctgtatgttcctgcgaagaagcagtgttgcaggcactctccgcgatattatccgtattttccctaagctcagcaatcatcccggtcaaattttgcgcaattcgggacacaacggtcagcacctgcgtttgttcgtcggccagctcgttgatttgttccttttccttttcctgataagcttccagtacaagctgggaatccaggttgaacattttggaaagagcatgcacaatagaaaaccaatcctctatccccgaacgctttaaaatgtcgactgcaatatcaagataagcaatgtaagtgcctaaataataatcggaggacagtccgattcgggaatgtacctgccccacaaaaagacggtgctcgataaactgatcatctatttttccatctgcgagagaaagccagtattcacgttgtgtttgttttagtcgctcaatattcgaccatttggaaataatcgacatgagatgcggaaccttttctacatgctcataaaaccgatcgaccacctcattcacaatagattggaatagtccctgataatgatgcaataaagccaaatcatcatcagtaataccaatatattgtatctgttttaatctactctccgcgacatgaatcataagttcctccaaataatagtttacatagattttacattaccatatttatcggcaactttttagaaaatgttaaaaaagcagaagattgattataatttttttcatagcaatttcagaaaaaatatatataaactcaactgcttaatgatacaaaaaaagaatccggcagcacctgaaatcccctgtgcttgccgaattccctctacgaaacacgttcatcggatacctcacaaccgtatgacaccatccaaatcaacccatggtttcaccatactgtacttgtttattattcgtcttaccgattcaggaggctacctacataccttaacagatcgttggcgctggctcctgtgtagccgtgctcctcaatcagtcgcttaatcacctcattcatccgtttgagctgattagcgtcaggcgttttggtcgaagtcgtaatcttcacaatatccttcaaatcggcaaacagcttcttctcaatggcttctcgcagccgatcatgatgatgatactcaaactttcgtcccttgcgagaatacgcggaaatacggattaatatttcttcacggaacgcttttttcgcattttccgataccccgatttgctcctcaatagagcgcatgagccgctcatccgggtcgagttcctcatctgtgagcggatcgcgaattttcgcccaattgcaaaaagcttcgatgttatccaaatagttgtcaaacagcgtcttggctgattcctcgaaagagtacacaaaggccttctgcacttcttttttcgccaattcgtcatattccttacgagccacggaaatgaaattcagataccgctcccgttcttcctttgtgatggaggcatgttgatccagaccatccttaattgctcgtaaaatgtccagggcattgatggattccacattttgcttaatcaatgcactagaaatacgattaatgacgtaccgcgggtctaccccggacataccttcctccagaaactcactttgcatttctttcagatcggcttccttgtatccttcgacctcttcaccgtcatacatgcgcatctttttgaccagatccatcccctgtttcttcgtctccttcaagcgggtaagcacggagaaaatggcagccgttcgcagcgcatgaggcgcaatgtggatatgtctcatatcactttggtcaatgagcttggcgtaaatcttttcttcctcagatactttcaggttataaggaatcggcattacaatcatccgtgattgcaacgcctcgttctttttgtttgcaataaagcttttatactcggattcattggtgtgagccacgatcagttcatctgcactgatgagcgcaaaccgcccagccttaaaatttccctcttgggtcagagaaagcaaattccacaaaaacttctcatcgcatttcagcatttcctgaaactccatcagtccacgattcgctttgttcaattctccgtcaaaccgatacgcacgcggatcagattccgaaccatactctgtaatcgtggaaaagtcgatgctgcccgtcaaatcagcaatatcctgtgacttcggatcagaagggctgaacgtaccaataccaatccggttttcttcagatataaatacccgctccacgcggaccttttcaatatcaccatcaaattccgtgcgcaatctcatctggcaggatgggcagagattaccttcaatccgtacacccagctccttttcaaaatcgggacgcagctcatggggaatcagatgaagcgggtcctcgtgcatggggcagccttcaatcgcgtatacggctccctgatccgttcttgaaaatttctccagaccacgttttagcaacgtgaccagtgtcgatttccccccactgacgggtcccatcaaaagaaggatacgcttgcgaacatcaagccgcctggctgaggaatggaaatattcctccaccaacttttctagcgctcgatccagtccaaagatctcctgctcaaaaaatttgtatcgcttatgtcccccaacctcttctacaccaaaagattcaatcatcttgtaaacccgtgcatgagctgtcatcgccggcgtcgggtctttcttgagtatctcaatatactctctaaaagtgccgctccaggccagacggttgttttccgcccggtactccgcaacgcgttcaaaaatattcatgctcggttcctcccatgactgcgtaatgactatcctccactcctgatgattatggctacactcgtcacgcctttcaggatatgatgcaatccccttaaaaaaagtgtaatacatacctatgcagattgatttcagaattgacctattttttgtgacaggtctctctgctttttcgaaaaaaccaagggatacactgtgctaaaatatacaacaacgatgcggacctgacgcaatatggtacaatataagctcggaataatgggataaaggagcgggagaagtcatggcggttcggcatgagacggagctgtacgctccggtgaaatccttttttgagaacttgggatatgaagtcaaaggagaggtgcgcaactgcgatttggtgggtatcaagccagggcaacagacaccattgattgtggagatcaaaaagacgtttaacctggctcttgtgctgcaaggcatgcagcgtttgaaactaagcagcaatgtatatgtagctgtagaacgaaatcgtgccaaaaaaggggccgtgaatcaacgctggaacgagctggtcggactgtgccgccagttgggacttggcttgctcaccgtcacccattttaaaacgaagccgccgctcgttgaggtactgtgtaagcctgcggcgcatagcgacaatgtccacaatgcagcaacggtacgccacggctcgcgcaaggaaaagctgctgcgggaatttcacgcacgcagcggtgaccacaataccggcggcagcacccgacgcaagctggtcactgcctaccgggaaaaagcgctgcgcgtagccgcagccttgcagggcttgggggaagctgccccggcgcagctcgctcgcatagcagccgtcagcacagctgctgccgtacttcagcacaactactacggctggtttgagcgcgtatcccgcggccgctatcgactgactccgtttggcgaagctgccctgaacgagtatgcgacagtactgcaagagcatggcataaaaacggccgctgaaatagacgcagagcttgacgaggacagtggacagctccagattgcggaagcgccaatcacttactccaccgatgttgtggaagcggaggatgactgacatggggcgatggttttcgctagctccgcgcagtaaattcgctaatcgtctcaccgatcagattcatgcccataagcaattgctcacggcccggatggctaaaattaaggcgaatatgggacgcgccttcactaccaaccgcacatagcgcacctggcataaaggcaacgcctttgggtaacgccgcctttagcagcaatgcgctgtccagcccatcgggcaactgcacccatacatacatgccaccggacggaatatgatacgtcacgtctttccaaaacgggcgcttgagcagctccaagattaattgaagtcgagtcgaatattccttgttcaacatcgctaagtgctcatgccattgaaaacgcgagctggtcagcaattggaacagcagccgttggttcatcgtactggattgcatatcggccagctgcttcaaggcgtacatcccttcaatcagcggtgcaggaccagcagcccaacccgttctgagcgcaggagcaactgttttattgaacgaaccgatatagagcacttggccgccctgacccgcatgatccagcgcaaatagagaggggtaagtctctgcaaattttcgactctgaccatgtggactcttgtcatggaactcatttttttgcttcaaatgcaattcaccataagaatcatcctcaactactagcacctcatgatgcctgcacaggtccaaaatttcctgccgcctagccgcgctccataaggagcccgtcggattcgtaaacgtcggcgtggcaaaaaaaagcttgggtcgataacggatcattaaagcttcaagcttatcaggaatgacaccttccccatctgattctacaggaacgatctgcgcaccctgcatagatagcacttgtaaacatccaggagacgtagggttttcgaccaataccggatcacgctcatccaccatcagccttatgatcaggtcaatggcctgctgactgcctgtcgtgaggaggatttgacctggtggtactcttactcctttacgctgttcccactctcccgcaagccatgctcgcaaagggaaatagccctccggttcaccatactggagggcgtcagggccggagccaaacacatcatgggccgcttcttccagcagcttcaccggaaacagctcttgtgcaggtagttcttcagccagagatataaaggagtgtcttctcgcattttcccggatatgacgcactggagaagccaacatcgcagccgttcgtgaagcaaaggaatattgcatgaacatcctccttctcctgaaaaataggtcatgatctccgggctgacgcgtcaggcatatagctgcttcatctgacgcgcatataaggcataacgttcaatcgcctgcgcccggctggacacgcctaatttcgcataaattttacgtagataattatcaatggagcgccggctaacttcgatctcaatagcaattttgtcatatgtaattccttgtacaatacgttccataataaacacttcggtttgtgtcaattcgtcaaaaggctcggacgccattaacggcataaagggccaatttccacatcgaatccaatccatcggtaaagaagcaaatccttcgcgcaaaccgttgatcagatggattaactggctcggtgatgcctgtttggataacattccatttgctccaagcgaaattagctgctgaaacaacgtaatattatcctcatccgtcataataacaatatggctgtccggagacaaggcccgcatttgtgtcaaaaatggttccgccgttccctcaggcaacctgtagtccattaaaatgatttccggtcgaatggagcaagccagctccaagccttccgttccggaggaagacatccctctgacaagcaaatcctgctggtcttccaaaataagctttgttcccagcatacttgtaggatggatatctatgatgaccacctgccatacttttctcatatctaaacctcctgagtttacaaaaaaatacatagttagtagcgaaaataattctaaaattagggattgcatatgtagaaattgcgcgaatatgaacgtataggaagcgaaaaacgtttaaggaaattgtatcctaggacttccttccgatgcaatctctttttccaatatttttatacgactatttcgcttttgcgaaataaataggcccatgatagaattggtactgcaaataaaggactggaaatttgactttacacgggagttgaaaatcgtatgcaagcttcacctgaacgtcctcctgccgaagctcggcggagcaattcaagaaaggggttacccgtaaaggcttttctgctattttggttcattcttattatactaggtgctctcgcaacctatctgtatagcaatcacttgaaacagcaaatgctaaacgagatgcaaacccatacagaccaacagattcaagcactcaaatctgactatgaaaagcaactgactgctctttccaaggaagttagcggattgcagggcaaagtccagtccttcaatgaactactgacctttacgaaggataatgcaaacaataagaccgataacagcaacaaactgtatacccaattaaacgaagtcaagcagcagctcaatacacttcagaaaaaaatggacttgctaaaatgaatgtagacgcaaaacaagtgaaccggttctttatgttggcccttgctccttttatcggcttgttggggtatattttgttagtgcatccctcattgagctttcctgggtctacttctttgagtttgcaaaaagctgaagtcactttacaaatgcaatcagtaggcaagcagcttgatgaagccaagcaaacggcaacatacaccttgtctacaattcgccggacttctgagctatacaagcaaacgactcaaacgatgaatcagcttgtcgtgactgcctctacgcagtccaagcggcccgcgattatctatgatcgacgcatcaccgccaaactgggggttccctatgagcgggtagatagcaatcggattaccattgaattatttaaggtaaacccgggaatttatcatggctacgctatgaaggtcaaacttaaagatcctactgctatgaaaatgtctttgggaagtgacaaattgggtggctccgaaaccaccatgcgtgcagtcttgagacacggagctattgcaggcatcaatgcaggcggctttgcggatggagacggcaaacgctatccattaagcactactgtcttgaacggccactaccttactggctttcagtccagttttaaggatttgtccttcgtcggactgagtaacgatggcaagcttatcggtggcaaattttacagtcaaggtgctcttgacagcttaaagcctgcctttggtgctaccttcgttcccgtcctgctgcaaaggggacaaaaaatgcctattcctgacaaatggaaagtctcccccaagcgggccccacgtacggtcattggcaactataaagatgatcagttactcattattgtcgtagacggctacaatgaaagcgggggttcgggcgcgacgctcgaagaactgcaaggaaaaatgtacaatctaggtgttcaagatgcctataatttggacggaggcggttcctcgtcgcttatacttaacggtcgagtcgtaaacaaaccgtcagatggtaatttgcgtccagtccctactcattttttgttctataaatagctatgtgtagtctgctaacaaattaaatatgcttgccgacgtacggctctatccgaaaaaaagcatcacgaacgaatgtcgtgatgcttttgcctcatttaggaggaatactgtgtcatttctgtcaggcattgagcacaaatataacggtctttgaaatcgttcacttgttctactgacccgcagaatacacattttggacgataacgctccaaaataatgtggtcaccctgaaccaaaatttcgacaggatctccctcattcatttgatatcttttacgcagtgacttaggcaaaactattctccccagctgatcaactttacgtaccacaccggcaggtttcatcgtgatcgtacacctctcctattgagtaataacttacaaatttcttaccatgcgaaaaactaggtacaaagacactattctttatgtagtattcgctgtctttttgtcgaatcctgctgatcacaggaaattttattacattttttcataaaatcatgaaccatatcaaagtatggtacagaatgtctgtaatatttttatcgaccggaaagccaattatcattagccctcgctgagaaatttcgcaaatttttgaccatacaacctttatttaagttccactatcatgtagatttgagcaatataggtgaaacttttattaccaactaaggtcctggttctttattcgcatttatacttgttcactcgatgctctttatgataaatccggaaaatccatttgtctcaacgcttcatatacgataatcgcagcggaattcgacaagtttagagatcttactttatctgacataggcatcttgatgcatgtatttggattagcagctagcagctctggcggcaaacctttcgtttctttaccaaataccaagaagtctccatcctgaaatgcaatatcactatatcgctgattcgctttggtcgtcgcataaaaaaagcgaccttcctgatatttctcctgcacttcagcaaaagactcatgatattcaatgtggacagcataccaataatcaagtccggcccgttttaacgtggcatcgtcggtacggaagcccagtggcttcaccagatgtagatgagttccggttgcagcacacgttctagcaatattccctgtattagccgggatttccggctcgacaagcacaatatgtaatggcatcacgtttcgttcccttcatcattaaattcatcagacaaataacctacagtttaaccaaagtgtatacattgaaaacatacacattcttttattttaacaaaatcagacagatatgaacatcaaacgacaaaaatttcaacccacaccactaaaagccttcccctatacacattcagggaaggctctacatttactttttcgatttcaaataccgtgtatcgaaatatatgtccgtgtaatcaactgttacgttgcttgaatccgtccataaactcggctaatgcttgacagttctccagtggaacagcattgtagatcgaggctcgaagccctcctacactgcgatgccccttcagaccgataaacccggcctgttcggattccttaataaattgtttttccagatcctcgttcgcgaggcggaaggttacattcatgatagagcgatcagcgctgtccacacaaccacgatagaagccttcgctactgtcaatacggttgtatagcaaagcagctttctgctggttcacacgctcaatgccttccaaaccgccttcttcctgaatccatttcagcacttcattcaccatgtatatggcaaaggatgggggagtattgtagagagagttatttttttcatatgtgctataacgcaacatcgtaggaatattgtccggtgaggaagtcagcaactcttcacgggcaatcacgaccgtcacaccagaaggccccagatttttttgtgcgccagcataaatcaatccaaattgagtaacatcaaaaggcttgcataaaatatcactggacatgtccacaatcaagggtacggaacccgtatccgggaattgcttaaattgtgtaccttcaatcgtttcgttggacgtcatatgcacataagcagtattctcaggcaagtccaaggaatccacattcggaagacgcatgtacttctcatcagcggaggatgcagcaacatgagccttgcccagtagcttggcttctttataggccttgtccgaccagctacctgtcattacatagctcccagtctgtccttcactcaagaaatttaaaggcagcatcgcaaactgcgtacttgcgccaccttgtaggaataacaccttgtagccttgtggattgcccagcagagataacaggcgttcctgcgcctcattatgaacagattcatacacagctccacggtgagacatttccatgatcgacatccctgttccctggaaatctacgaattcagcttgtacacgttctagtactttgagcggcaatgccgctggtcctgcattaaaattgtaggctctcttactcaacaaattcccatcccttctctactctggtgtggatattatcgctatgatagcagtattcataaatgcgttcaagacttgtataaaaatgttttcaatttcatttatgatgtgacagagttgtgaatgttaagatatttaacatctttattctgtgattttcactttaatattaaaaggtccccggcataagaccggagacctattttgaataacaactgttacccgtaagctaatgcttgttattcaaagcagctatgctatcgacttattagcagtcaaaatacaggctgtattcgtgtggatgaacacggatgttcaccgatttagcttcagaacgtttgagctctacatagttatcaataaagtccttcgtaaatacgccgccttcagtcaagaattcgtagtcagcttccagagcgtccagagcctcatccaatgaaccaggtacgctacgaattttacctttttcagcatcagacagctcgtagatgttgctgtcaagtggaccatatcccaattcgattgggttcagtttgcgcttgatgccatccagacccgccatcagcattgctgagaaggcaaggtaagggttagctgtggagtccggtgtacggaactcgatccgacagcctttaggagtaacagctgctactggaatacgtacagccgcagaacggttacctttggagaataccaggttaactggtgcttcgtagccaggaacgagacgtttgaacgagttggtgcttgggttggtcaaagcgatcaacgcaggtgcgtggtacagaataccaccaatgtaatgaagagccatttcgctcagattagcataaccacctttttcatagaacaaaggagtgtcgccatcgaaaatagattggtgaacgtgcataccgcttccgttatccccaaaaatcggtttcggcatgaatgttgccactttaccatattgacgagctgtgttgtgtacaatgtatttataaacgagcaggttgtctgctgttttcttgagtgtatcaaaacggaagttgatttccgcttggcctgccgtagctacctcatggtgatggcgctcaattctcagacctgcttcttcaagcaaacggcacatttcactacggatatcttgttgggtgtctactggcgctacaggtacatatccgcccttcacccccactttaaagcccaggttgccgccttcttccttacggttcgtgttccaagctgcttcctcggaatctacgaagaaggaggagctgttcatgccgctttcgtagcgtacatcatcaaagatgaaaaactcggactcaggtgcaaaaaatgctgctgtgcccactcctgccgattgcagaaatgcctcagctttttttgcgatgccgcgaggatcgcggtcgtatttttcgccgtctggcgtagcaatgtcacacaggatattcagtgtaggatgctgagtgaaagggtcgataaaaaccgcttctggatcgggcagcataaccatgtcggattcctcaatgccacgatagccgggaatggaagaaccgtcgaaagcaacaccgttaacaaatgtctcttcatctacttcggaagctggcaatgaaatatggtgagcacgaccagacaaatctacaaaacgaaaatctacccactcaatattattttcctgaattgttttcaatacgttttcaacggacatgtcttcttcctcccaatttttccgaacattaagtcttatacaaccctgaaatgttcatgatcgaatgtttttttctgtcgtcattataaatctcaaacatgacacgggtcaatagctatgtaaggtattttttaaactaatgttagatatgcttacgcccttgataacatttgaatagcacaaaaagcccgaaacatcgggcttttaggcaatttaaatctccttgctgcgttgcggcaaaacttttatgcattaatgttaaacattggttttaagcaatggtagtaggcgtgtgaaatgttttccccacagcaggagccaatatttccaaatcttttagcaaatctgaaaattgatctgggaacagggattgtacgccgtcacccgtcatcgagttgtcagggtctgtatgcatctcaataattaaaccatccgctccggcagctaccgaagccttcgtcataggaacaaccagttcacgtctacctgtgccatggctaggatcagaaatgaccggcaaatggctcaactgttgcaaaacagggatcgcggacaagtcgagcgtatttctagtgtaggtttcgaatgtacgaataccgcgctcacacagcataacattcggattgccacctgccaagatgtactcggcagcattcaagaactcgtcataagtcgagctaaaaccgcgtttgagcaacactggcttgccgcaagtacccaacttgcgcagcagatcgaagttttgcatattacgagtacctacttgcaggatatcggcatattccgcacaaatgtctacgtattcaggtgtcataacctctgtgatggtcaggaggttgtgcttttggcccgcctcagccatcataatcaaaccttctacacccgttccttggaagctgtatggccctgtacgcggcttaaaagcacccccacggagaacttgcgcgcctgcagctttgaccaatccggcaatttcatctatctgtgcagcagactcaacagcacatggtccacccataatgacaagctcgcccccgccgatatttacacctttaatagagataaccgtattttccggatgaaaatcacggctggccaatttataggatttcgatattttaaccacattttctacgcctttcatttgacgcagatgttcagccagcttgggctctacgctaccgatcagtccgatgatcgtgcgatccgatccccttgatacatgagcctgcaatccttctttctcaataacttcaacaatagcttgaatatgctcttcaggtgtttgaacaccagcgataacgatcatttttttcttcctctctatgaaacatattttataaaccaacttataggttaatattatgacacttagacgcttgttcgcttttaagcttttattcgttaaagcaactatacttgttttagctatactcgtcaaggcttaattatcccgaattattcaatattctaacttagtgaagctaaccggaaaatatctacaaattaaaacaatttaaaaagccgctatccggatggttgtatccgaataacggctgtaatcaatcacatactatttcgttgtttttgacttctctcgtacaggaggcagtagttttttcatatctatggttcgctgaatctcccacgtatccgggttagccgcatcatactgctccaaatacgtaataacctctttggtaatcagtgtcggggttgaagccccagaagtcacagccactttggctacgccttcaagccactctctcttcagctcggttacatcagaaatacgataagctgttgtaccagcaatttcctccgaaacctgagccaatcggtttgaattgttactgcgcggatcaccgacaacgatcaccagatccgcctgcccagcctgctcagctaccgcttcctgacgtacctgcgtcgccaaacagatttcattgtgtatctcagcacccgggaacttctccagcagctttttcataatgtgcttgatgtcccattggctcatggtcgtctgattcgtgataaggattttgccagctggtaacgtaagactgtcgatctcttcttccttttcaatcagatgaacatggtcaggagcaataccaatagctccctctggctctggatgattctttttaccaatataaacaatctgatagccttcggcagacttctcccgaatcagatcatgcgtctttgtgacgtcagggcaagtcgcgtctaccgtagtcagccccttgtctcgtgccagcttgcgaacctctggtgatacgccatgagcagtgaagataacagtgccgctctctacctggcttaaaatctccatacggttcgggccgtccagtgtaataatcccttcgtcttcaaaggaattggtgacatgactgttatgcacaatcatgcccaatatataaataggccggggtaagtccagatttctggctgcctgacgagccaataccatggcatcgactacgccgtagcagtaaccccggggcgaaattctgagtacttccaaaatgagcccccgctttcttcgacacagtatacagctccgataactcggtagctgtgggcatcctagcctttaccggccaattctatgatgtagttgccttcctattatagcctattccaaaggcgcggaaaagctgaccggaagccagatgacaaatgtcgttccttctccttggcgcgtaaccacttccacagacccgtgatgttcatcaataatccacttggcaatagatagccccaacccaattccctctgtcaccccgcgtgattcatctgcccggtaaaagcggtcaaaaataaagggaacctcactcttgtccattccaatgcccgtatcactgatccgtaggcccacctgtccttgataaacaatggcatcaaatcggactgtgccctcaggcgtgtatttgaatgcattatcaatgaaaatgaatagcatttgctgcaaataatccttgctgccatccatataaataccattcagcaacgaaaaatctcccacattccattcggccgttcgctctaaaaactgagcacgacgggcaacctcacttacaagtggttccagcgcaacgggagtcttatcgaacgttttccctgtgtccgctctcgcgagtgacaacatatcactcaccaaacggctcatccgtttgccttcatccgccatgtcatttaatgcctccatagaaagctcgcgaatcatctcttcatccatattcggtcgctctcctggttcggtagtccacattttgagtaaaaaatcaacgttgccacggatcgtcgttagcggcgtacgaagctcatgggaagcatcagccacaaaacggcgctgtgcaccgtacgcatcttccagctccttgtaaaacacctctgtgcgccccagcatgttgttaactgtcccgattaattgaccaatttcatctggtggtccgtcatattcaatccgaacactcaaatcattactggattgaatctgattggccccctcaatgaccttgaccagcggcttcatagactttcgagccagaaagagacctgaagtcgcagcagcgagtaatgcaaacaacgagccgtatacaagcacattttgtaacctgttcatgagtcggtcctgagagcccgtgaattgtcctacctgtagcagcccgaccaccaagcccaactcctcggatttgatcggctgttgaataatcataaaggaatccccatttacgttcacacgtcgaattccctcattttgaactgctcctgccgctgtggaggggacagggaaggtgatattgaggtctttcatattttgggtcgttttcgttacaccagacgtataattgtaaatttgtacatagagctgtgagtcatctattccacgtccctgctctaatcccaaatccaggttggggacttcaaacaatcccccttttataataaggcgtaattgcttgttaatctgtggcgcctgagtcataagctgacttttcacttcattatatgtgtagtaatatactagtccgtaagtaaccagaccaaaaatgactagtactatagccaagatgctcgaataccaggccgtcagccgccaccgaatagacatattacacatcacctcttaaaatatagccagctccccgaattgtacgaatgagtcgtttaccgccatcctgctccgttttttgtcgtagcatggcaatgtatacttccagcacattcgattctccgctatagtcatagccccaaattttgtccataatcagatcacgcgacagaacacgcttcgggttttgcatgaacaaatggagcagttcaaattctttggccgtcagttccaaacgtttgccgccacgaaccacttcacgggattcgttatccagttgtaaatcctcgaaggtaagccgatttccgttattgtcctgttgttcggttttacgccgcaaaagcgctcgcactcgtgccagtagctcctctagagcgaacggcttaacgagataatcatcggcccctagatccaaccccttaacccgattctcaacctcatccttggctgtaagcatcaggacaggtaccgtacttccaccctcccgcatacgacggcatacctcaaaaccatcgacctgcggcatcattacatccagcacgaccacatcaggctcagctgtcaacattttatttaatccttctgctccattggcggctgtcagcacttcataaccttcaaatgccagccctctgcgcagcatggaaacaattttttcatcgtcatcaatgattagaatagtagaacgcatacacgatcgaactcctttatctcttcttttccttctattgtagcaggagtagacgcgtgtagcatctggctgcttcatatagcaagaaacggaagggatcttccttccgtttcttacgtgcacttgttcatttttgtagagttttcatcttattgctgaagcgtcgagctaaagtcatttttgttgccaattttcagctgaacatcttttttctgcccagctcgttcgatgttaagtgtcagcgctgtacccactttttgtttttgaatgaactggatcagctcttgtgatgtgctataaggcgtgccattcgctccgataatcacatcgtaaggacgcagatcggcctgataagctggtgatttgtatataatatcccgtacaaccgagccttcggtcagggatgtacccagttctttggctacttcaggacttaaatttaacagacttgcaccaatgaaaggtacaggttctttcggaataggctggttatttttcagcttatcgacgacttccaaaatcgtattggacggaatcgcaaacccgattccctgtgcgtctgcactaacagctacgttcataccgataacctgcccttgcagatttaacagcggtccgccagagttaccagggttaatggacgcatccgtctgaatgagatgcttgtattgcgtcggttttccagtcgattcactattaatagtgatcgtacgttctttcgcacttagcaccccggctgttaccgaatgttcaaagccttcaggattgccgattgcgaccatccattcgccgactttagcgttatcggagtcacccaaagttactgtcggaaagttgtttttgccttcaattttaagtaccgccaaatcaagatcagcatttttgcccaagactttggcttcgtaaggcttattagttccctctactgtaacctgaaccacactcgcgccttcaacaacatggttgttggttagaacgtaacccgatttatcaaaaataaagccggaaccaataccaagcggagtcagctgcccgctgttgctaccttcattttcattactgttaccgctgctgccactgtcaccatactgattaccgaaaaagtattgatacagcgggtcattgtaataagggctgctttgtctgccactgctaccactggtttgtttggcaagcgtttcgattttgacgactgccggtccagccttggccacaacagattgaacatcagcggtacctgaaggcatcacagccggaactgcgcttggagtcgagctggtggttcctgaattagtcgtttctccgctttcagctgccgccgaagtcaacgccgtctcgggtgtgaacatatttgttcggtcagctgtatacatcaataccgtaatgaccagcatcccggccaaaaaagataagaatattgtttttacctgcgacttgggcttattcggtttgaattgccagttgccgccattccgacccgaaccatcctgctgctcaggcatagcccgatggtaagagggaggaagaggtctcactgcctgcggtggcgtaatctcaacatccttttccaacgactgcccttccttacgttgtccgtccgattgaactgaagaaaaagggccgtaagaataataatatgaggaaccgttcgaatcgttttggcgagttgcgttatcggtatcaacctgatcgttgtcgttccggcgtccggagttattatttttaaattcgtccattgtatatctcctcccaaaccctatgcttcaaggtggtgttgtttaactgactttattttgcactttaaaccttaattccaccttaaaaaaaattaaaaaggagataaaaccttagacctattgtacctaatcacttttacttaaaacgaaatgccccggatataatccggagcattatcgattgtatatgcttttttatttcgtgttaaagttttcgtcgaacttttcgttcggtgtttgagcattgttttgaattttgttgcggctggagttttgaactttttgcgctactgcacctgtaccgccttgatctgttgcaaattcttcatcatacttctcatttggtgtctggaagttgtcttgaattttattttgttcagactgctttaccttttgtgaaacgacacctaccgtattgtcttgtgcaaattccgctttgaactgatttcctgtgcttgccttgaagcctttgttcgtgaaagaacttccgccttgatttggcataattctcaacctcccagtatgttttgcgggataagctcatcccgcaacatagtatgtgatgttggaaaaaacaatattcaaggattatatggaagcatccagtgtcgcactcggaatggttttatgcgtttctatcgccttttggagcgattttaccatcttttccgtacattttccgttccctttttttataatttgaacatccacatctttcttgccccattcagaatacacctgccgggttgttttaaaatacaaatcaattttattgcccttaatcgcagaacctgtatctgctacaatcccgtatccataacctggaatgtacaatatgcttcccaaaggaaacgttttgggatcagccgcaatcgtagacagtgtgttcttgtcacgacgcacttttacaccggaatacgtaataccgtagccgggatgacttggccgtttgccagtcgattcatagcctgctgtatatcctgtagccgtgaccgtcatggtcgtaataacctgctcctcgcgtggagccaaaacaggtgtggactgccattttttatgctggaccggttctttgtgaccgtaaacttcattgccgggcaataccagacaggttgcaattaacacggttcccaaaatccgtttccataccaacatggatctcataaaaaacctccccttgaggcaaaggctttccagaaatccattgctttatacgaaaagattattatttttgaacatcctgacctggataaagtctgctcagcttcactttatcttcaaaaatatgcaggagtgtccgcactatgggggtgtgctcatcgtctgtgtgcaatataatggaagcaggagaaatcgaaataagggtgcttacgattcgatcttcgacctccatttctagttcaatgcctggcatctcgacaatgatgtcatctgcatcaggagtcggtatgggcaccatggcactatccagaatcgtaaaattatgtccgccttggtgaagtacgtgtacgagcggaactttgctttcctgaaaaaaaacaaaatatttaagcagccccataaattcttcgtattgccgatctgcccagaattcttccatggcatagtcgacgatttcttcaagctcttttttatacgcatggagcctaaattgaatcagtccttccaaattgatcacatgaagctccttaaaatccttctccagaagagtggtcagcttaccatgacgcttcaaacggcctctcggaccatcatcgtttaacagtgaacgaatcatactgcgaatttgctctgtatcctctttctccagcagcgaacaggctttggtgagaatgagattgagcaatccccactccttgacttcgataatataatccgctattgccgaagacatgatgctgtatacacaggggagaaagctttcaaacgccgaattgctttctgtgcccttgcaggtccatgccactttgttgtccagctgtctgaaagtgaatcgaaatccgcgccgtgacatatgtagtccctttgttctacttttgaccacttcataaaaccggttggtttcctgatctccgtctgtattggtccacactgtaaacagttccattggctcactcctttcgatcactgctttcagtatatggcggcctctaaagggttatacgaagtgaacgactggaaacagaaagacatatccaaaagaggatgatcaagtttcaaaaagctggtttggcgtgttataaacaattactgtgatataggaaataacgaaagacgtttgaatatttagggtggggtatgttaaggttatagtaatatgaatttttcacaagagggaggagataagatgttaacgatgctgaacatgctgcgtacattcatgatcgtcatattgagcctcgttcagattttgtcccttcctgtgacgtttcatgcggaagacaccactcaatccctccagtttactgcgggatcttctgtcgtgcctcatgctgatgtttcctcgttagaaacagattctcacggtctggaacaccattccaaaccagctatacgcaaatcctcccctttacttcatctggtgatcgctgcggccaaatcacttccctttgtcattttgatagcgcttgtgctgttattgagcatccctaaactacgtctgccttttattcctgtcatttgcaaactaaagaagcaattatacttgttccccatcaaattcacctctagttatgtggcttaacctccctttgcatgcagatcaccacattcgcatgtctatttgttaatatttcccaatagctgtaatacgtaagtgtatgtatcaggttttttacgttaattcataaaatttaatacaaaaagaaagtttccatgtcactcccagagtatgtgatttatttcccataccattcatttaaataacgtatcgtacaggaggctttataaatggatattcgagagtctattttgccaggaatcgggattaagtatcgaatagatgcagagagtggcgaccgaattgtcattattattcatgatgatggcaggcgcgagttgtatcactttgattacgaggatctggaacaaagtatttctatgacaaccctgaatgatcaggaagcgcgattggtagcctccatcatcgggggtatgacatataagcccaaacagcttgaaagtgtagaaatgacgtttgatgattttattatcgaatggtatagagtggaatcccactatgcaagtgtcggcaaatccatcggtgagctggatgtaaggcaaaattcgggagccactgttattgccattgtggagaaaaaaggaatgaaatatgtaaatcctggtcctgaagtgattattaacgatgatgccactgtagtcgttgttggggaacgcgatcagcaaaaacgctttaaacaaatccttatgaacggaagcgggtgattggatggatcatctggtatttgaggttggattggcaattgctctcatcgctgcagctggacttatttcctccaaactgcgcttctcggtcatccctttttatatcctgatcggaatggcagttgggccgcatgcgatggagctatggcattttgattttcgctttatcgaaagcgccccatttattgattttatgggaagaatcggagtgctgtttcttctcttctacttgggtctcgagttctcagtaggtcggttaattaaatcaggccgttccattgccgtgggcggcaccatttatattggcatcaattttacactggggctggctcttggcttcctgagcggctttcctgtagcagagacactggttatcgccggaattacaacaatatcatccagtgctattgctgcgaaggtgctggtagatctcaagcggactgccaatgcagaaacagaaatgattttgggcattattatgttcgaggatgttttcctcgccgtatacatctccatcctctccggattggttcttagtgattcatcctcgctcgggggtgtgctgctatcagcgctaatcgcgcttggctttatgcttgcagtcattattatcggccgtaaggccgtccctctgttaaatcggattctccgtattcgctccaatgaggtattcggacttgttgtttttggctctctgtttctggtggctggtttttcggaaacgattcatgtggcggaagctatcggcgccctgttggtcggtctggtactggccgaaacggaacatgccaaacgaatcgagcatttaattgttcctttccgcgatttctttggtgccctgtttttcttcagctttggactatccatcgatccactgtccctgggaggaaacgcgatatggcttgcgctggcagcagtcgtcctcacgttgtttggtaacatttgggcaggaatgctggctgggcgtacggccttcttatctcccaaagcgtcagcaaatatcggtctgaccattgtggcacggggtgaattttcgattatcatggccaacttgggcaaggaaggcggtttgcttgatattgttcaaccctttgcagctatctatgtactcatactggcgattcttggaccacttctgacaaagcagtcaaaacctatctttaatatgttaaacaaaatatttaagttcaaggacccccgcctacgaaaggaagaaagtaactcggcataactgcaaaagctggatacgacaatccataggagggaaggctatgccgcacgctgtaaaacatgccgaaactctatgaggcggcttataaagcccacttcaggagatgcgagcaggttccctgtcttttatacggtgattggtggaattacggcatccgtcggtctggaattgtttttacatccgcatgatatgatcgctggaggcgtcacggggatctccagactcatgtcgctttatacacaagagcattttgggttactgctattcgttttgaacttgccactcatgttgctgtattctctgtctactcacaaacccatgctgcatcgagcactacccggcttgttcgccttttcgggctcagccattattctttcgccttttccggcagtgagtggccatccggtcgtatgcgctttgggcggcggcatctgtatcggtcttggcgcagggctggcagctcgtcatggtggtctgctcgattcactaggacttaacgaatctgacgatggccgtccatccacattgttgctaacacaccgtaagattccattaatacagattgttatgctgtgtaatggtctgctgctcattatcgccggctttgtgctaggctgggagccagctctctattcagccttatcctgcctcgccgcctatgaaacgacccggctgatgtttaccggtctgacgcgtatggtttgtgttgtcagcaagaaacagcaaaccgtcgaggatgccatatatcgcaggctgcgtatacacagcacacctgttggaggctctgcacagatagagggtaagattaaaagcgaatctgaggataaaaaagaacaaatggtcatcgtttacaacgttcaactgttggatttgcagcgttttaaggcagtcatccaaatggctgacccgcaggctgagatcatgtatatgaaacgatggaaaacatagcaaagtaacacatcaaaaaacgcttatctacactaatccttatacatagattagtgatggataagcgttttgtaattaacaatatattaacggatattaattttgcatgataaaatcatgttcaatactgctggcactgtcaaaagtacgaataatatcataacgggtattgcgctgtgccggaatgtgacccgtctcgcggatcaactgtaaaatggattcgatgtttaccttatacgttgcgcctgcagcggaaactacgttttcctcaatcatggtgctaccaaaatcatcgcaaccatagtataacgattttttaccgatttcaggtcccatagttacccatgaggattgaatatgcttgatgttatccaatacaagacgactgatcgcaacggtcttcagatattcctctggcgtctggcgttccttcttcagattggtattgtctggctggaaggtccaaggaataaaggccaaaaatccttcagaattatatttgttttcaatgcattcgtcctgagcatcacgaacacgcaacaaatgcagcgcacgctcctccatcaactcgccgaagccgataaccatcgtagcggttgtgttcatcccaaccttgtgagccgtttgcatgacatccatccaatcacgccaagagcctttgagacggctaattttgcggcgtgtgcggtcatccaaaatttctccgcctccgcccggaagcgaatccaatccagcttcatgaatggctcgaatcgtgtcttccatggatagaccggatttttccttcattttgtgaatttcagctggcgagaaggagtgcatcgtaatatcgggaaaacgctccttaatagctttcagcaaatccgtataataactgaacggcagattgggatttacaccgccttgcattagaatttcggtgccacctacctcctgcgtttccttgatcttctgaaagatcacctcatccggcaaaacataaccttcatcggaacccggtctacggtaaaaagcgcagaagcgacagtatacgtcacatacgttcgtatagttaatatttcgtccgatgacgaaggttttaatgggatcggggtgcatgcgattcatgactttattcgccgcgtgacctattttttctacctcgtctgattcgaacaaagcaacggtatcctctaaattcaggcgttcgccgcgtagggctttatctaaaatatggtcgattacactcatggtgtatcctccttcgctgtcacagggcgacgaaatgaacgacaggacttatgaacgagaatgctttcacaaacctgcgttcgaaccctgccgtaatgtatgttcatgactggccttgtatgttgtctgtgctatttagcatagtaaaacctaatgataatactaacatatctttaggtaaggaaccatacttattcccgcttctttctgcttttcacctaggaaaacaggcaactgccaagcttatctcaacattgcgtatagccaagaaataacaaaacaggactgaaagtgccttttttcacactgtccttcatgtcattcttatagaaaacagcaagcctcctgaaatactggaaacttgctgtttagtgctgtacatatttgttcccggcgtgaaaacgacaaagatgctgcggatgtgctaacgctctagcgcagcgcctcatccagatcactgatcaggtcgtcaatatcctccaaacctacggagaaacgaagtagtccgtccgtaatcccgcgctccaatcgtacactatggggcatagccgcatgtgacatcatcgccggatacgacaagatgctttccacagctcccagactcaccgctacaattggaatacgtacgcgactgaggacttcttttgcacgctcaccagaacccacatcaaacgatatcactgcaccataaccgctggattgacgctcatgaacttcacgccctggatgattttccagacccgggtagtatactgcctcaatgtcgttgcgctcgttcagccagttagcgagcttagctgcactcttttcgctgtgagccatacgagcctccagtgtcttcataccgcgcatgagcaaccatgactcctgcggagccagcacggtacccagtccattttggagctgcttgatttgtctcccgagcgattcggtacgtgctaccgcaagtcctgccagcacatcgctgtgtccgcccagaaacttggtcgcactgtgcaatacaatatcgactccctgctcaatcggacgttgataataaggtgtcataaaagtattatccaataaagttaaaagtccgtgatcctgtgcccaagaggttattcctgctacatcggtaattttgagtgtcggattggacggggtttccatatatacagcccttgtattctcctgtaacgcctctttcacaaggttaaggtccgtcatgtcgacgaaggtcgtttcgatattcatccgtttcaaaatggaggtcagcagtcgatatgttcccccatatacatcctcggaaacaatgacatgatctccagcggataaaagcataaaggtagtagagatggccgccatacctgacgcaaaggcaaagccgcacgcccccccttctaataaagcgatataatcctccaaagcttgtcgtgtcggattacctgaacggctatagtcatgctggggaggattaaaaatatcataatggtgaaaggtagaagcttgatagatcgggacgctcgaggcccccgtaacgctgtcaatttcagaaccaaaatgcagcagcttggtagcgaacttccgctctttgttcaaatcctgcccgatcctcctcgcatcctctatcattgcagctctcctccttctacttcttgacgtgccgcttccaacgccgaacgcaaatcttcaatgaggtcgtctgtatgctcaatgcctacggagaaacgcaatagcctgtcatctaccccgacagcatcccgaatttctgctggtatgtccgcatgtgtctgcacagcgggataggtcattaacgattccacaccgccgagactttccgcaaacgcaatgagcttaatgtgacgaagcaaaggttccacataacgagcatcctttactttaaaggagaagatacctgtatttccgctggattgtttattttgaatctcacgacctgggtggccttcgagagctggatagaatacttctgccaccgccggatgcgtcagtaaatagttagacaacactgttgcattatgctcatgtcggtccatacgcagcgctaacgtcttcatccccttcatcaactgatagcagtcactcggggaaagcacggctcctatggaattgtgcagaaaggaaatttcagctgatagctctttgcctttggttacgattaaccctgccagcacatcgttgtgtccgcccaaatacttggttgcgctatgtaccacaatatccgcgcccagttccaatggccgctggaagtatggtgttagcagcgtattatctacaatggtaagcaactgatgttgtgatgcccattcagccaccgcttgaatatcagtaatcatcattaacggatttgtaggtgtttctatgaatacagctttggtattcggtcgacatgactgttcgagtgcttcaagatcgttcgtatccacataactggctgttacaccaaatttagataaaatacgctccagcaaacgatatgtcccgccatacagatccagcgatactatgagatgatctccctgtccaaacaatgcaaataccgtttgcagcgccgccatacctgagctgcatgcaaagcctgcatcaccagattcaagtgcagcagaagcctcttccagtacctttcgcgtgggattgatcgtccgaatataatcaaatcctgtgctttgacccagacggggatggcggaacgccgtagattggtaaattgggtaattaacagccccggttactggctcctctactgaaccgatttgtgccaatctactttcgattttccactgtttctcactcatatgaatcctcctgttaacttccatagtgggttctataaccaatcctgcaaaaatggatgtcaaagactatactgctgcgctactgcaaggtggtactgtacaaggttaaactacaagccccttttttaaatctggggcccgatatcgtaaggtgtctcttggtatacataatagttcagccaattcgagaataataaattggcatgcgcccgccagattgagggcggtgtgcgctcaggatcatcattaggaaaataatttttgggaacttcaatatccattcctttggccacatcgcggtcgtattcccatttcaatgaaagcgggtcatattcagaatgcccagttacaaaaatttgtttaccgtcaagcgtggctacgaggtacactccggcttcctcggattcggataaaacttctaattcggcgatatgatcaatatcttcccgccgaacctccgtatgtctggagtgaggggcataaaacagttcatcaaagccgcgtagcaattttactttaggtttaatcacggtgtgtggaaatacgccaaagcatttgtagtcgagcccgtatttcgggacattgaaatgatggtataaacctgcctgtgaggcccaacaaatgtgcatggtcgaagttacattcgttttcgtccactcaaagatttgccggatctcctcccagtagttcacatcctcaaactcaagctgttcaaccggagctcctgtaatgaccatgccgtcaaaacgactgttcttgatctcgtcaaacgttttatagaacatgttcaaatattcttgcgatgtatttttggatacatgagacttcatgtgtaccagcgtgacgtccacttgcagcggcgtattgccgaccaggcgcaatagttgggtttctgtcgtttcctttgtaggcatcaaattcaaaatggcgatgcgcaacggacgaatatcctgatgataagctaggctttcatccattacgaaaatattttcgccctccagcacttccttggcaggtagcgtgtctgggattttaatcggcatgtaaactcactccttgttcggtaagttttgcgaaaatcgtcctgctgagatgccgggcatataataaaaagacctttctctggttagagaaaggtcatatttgtatccatatgcgcctctctcatctgtcagggcaacgctctttgtacaaagcgcgcgtcctgcaagaattagcaccgtgcgattaaaatcgccggttgccgggtatcatcgggctagtccctccacctgctcttgataagatttcgctatattcattttgggttcacaaagttcttgttgttcactttaatgcatcggctgggcttcgtcaagatgggacttttaaatttgtgccctgcaatcacattttgtctaccttttccataggttaaatcatatccctcctttcgctgaagctcttgccactactgtcgatttagcccatgattttgcgcttgaaaggccgtaggccgagcgttatactatacaagtgctattaggcaaaaatatggagcagtagtgcagactttgagtgtttcctgcgatactgtggcaatcaaaaaaagaacatttgagaggtgaatccggaatggaaggcgacccgagtccgaataggcggcgatccctgaacaacagcataggaatgacttcagcttgccgaaagacgggacgccaggctctgcatgctccaaaagcctccggcttttgatgagaatgcacgcttacccgcaccggctaactggctaactgagttcattccttatgcttaaggtaaacgtatttccgttacgacggagcataaggagtgacatatatgaaaatccgtttggtcaacaacggggtttttacccctgtcgaagaaattgaaatggcgcttactgcaccggcagaaggtttttattggattgatgctgatgtcgatgatttggcagtgctccaacctttattttccatgcatgatcttgcagtagaagactgtttgagtgaagaagaacagcgtccgaagatcgaaatttatgaaagccattattttatcgttgtaaatagcattcgttttgatgatgaagaaatatttttgcgagctttgaacatttttctcggccgccattttatcattacggtgaccaagcagaaaatcaatgagcttcgtaccctcaagcctatgctgtgggagcaagaagtcagccagcctgaccgttttatgtatctgttggtcgacttgattgttgacaactattttctggttggtgaccggattgaggtccgcattgaaaagctggaagaagatattctaatgcatacgaaaaagtcgcatttgaacgaaatcatcggcttacgaagtgagattctgtggctgaaaaaagtgctaggtccgcaaaaggaagtcatcaataccctgaacaaacgggatttgcgactcatcgacgatcaattacaaaaatatttcagcgacatttatgaaaatgctgtgaaaatttcggagacttttgaaacttaccgcgatttgatgggtaaccttcgagaagcttatcaatccagtatcgccaatcgtgccaatgaaattatgcgtgtgtttacggcaataacgaccgtatttatgccattgacggtcattaccggaatatatgggatgaacttcgataatatgcctgaacttcatacacgttatggctattttgtcgtcattggtattatggtggcactaggtgtcagtatgttctgtattttccgcaagaaagactgggtttaaaaagaaaaggggaaaaagtacggagttggatacctatttcgattttcaagcttgatcataaaaagcagcagccgtgtcctatgaggaactggctgctgctttttagtatgttggaccctgaatgtactttaatactttagctttatccaatcagttctatattatccaacatgtcggtcgggtacctgctgatggcgaaaccgtatacggatcagacgcagacgctcataaatttgatccaatcctgtttctgtcgccttttcttccccatacactttcagcatgacaggcttgagcaacgtatcccccaactcttcataagcagaccagatgactgcctgctcctcctcagatacattcaccaattccttgcggatcagcttctccatatcaatgccatccctgtccaaatgctccacagcttcaatcatttctctacgatgcaaacctgtcttcatcccgatatgctccagtgaaagaccgtccgaaatgccttcgataatcgttctagttaggctgaatttattcagctcctgcctgtattggttctctttttgcttgtatagccatgacaaaaaaacttcttcttccagcgtctctgttacccagttcaacggaaatggcgtggtccggtcattttgtgtcgtaatagccaatagctccgtcccatattgcgacaccttaccctgtcccataccaggcagctccaacaattcttcttcggtatggggaagatagacgctaatgagccgaagcagccgattcgtagcaataaaataaggcgcttttcgttccgttgctgctttttgccgtctccacattgtcaactgctcatacacttcatcacgtggaaacaaatcactgtagcaatacagcttttgcagcgtttgtcctcgtcctgatgatccttcttgctcatgaaatacgccatggattaagggcctgtagccctcagccattttgagcgccagctcatgacggtatacatgcagtaattcctgccacaagctgccctcataccaaaggtcgtctatactttcatccgggacatggtgtgtgctccagcctgcactccatcccccttcatgttgcccaatccatacctgagcaaagtcctcatagccctgttcattccgtttggacaaacgatttaaaaatacaatctccatgatttcttcctccctcatatcgttgaaagacagtcccgcacaacacaaaaacgcaaaaaaagcacctatcctgcgtattcgcaagaaaggtgcttccctttttgagccgtactatgctgttgcctatataataaccgtaccttggagtgccgtcaaccataaattctaatgattcagcttttcctttgccaatgccagagcaccgcacaatccagcattgtcacccaatcccggagatacgatatattgctcaatatctgttgtcagactcgaatgctgtacgtatccgttcaaaagttcttgaagcttggtacgaatgagcgggaacagttggtcctgcttcatcactcccccgcccataataattttttgcggtgacaggattaatacatagctcattaaagcctgtgccagatagtacgcttccatttcccaggctgcgtgatcgacagaaagctcatgtcctttaaccttccatcttttttcgagcgcaggacctgctgccagtccctccaaacaatcttcgtgataaggacatgtcccctcgtaagtatcttctgggtgacgacgtaccagaatatgccccatttctgggtgggataatccatgtatcagctttccaccaaccaaagcacctgccccgatgcctgtacctatcgtaatatacagacagttgtccaatcccttggcggcaccccaaatagactcaccaagtgctgctccattcacatccgtgtcaaaccccataggcacgtcaaaatgctgtttcagtttgccaattaaattgtaatttccccaatgtggctttggcgttgttgtaatatagccatatgtatcactgccttcgataggatcaatcggcccgaacgagcctacacccaatgcttcaatgcccttgccttcaaaaaatgcgatgacattctccattgtttctgctggggtggccgttggaaagcttgctcgttccagtacctccccatgttcgttgccaattccacatacaaatttggtaccgcctgcctcaattgctcccaatactgtcatagttgctgttgtcccctttcaataatccggttctctctccactatattcacctgaaatgtgcccgaggtcaatccccttatcgcaattgtatataatccttcacatgactatacaactcccttgacataacggtataaaaataaggacactaacgcacccagcgtcagcatccctataaacttacttcacttaaattgtccgtaattgtccgtatcaagcctaacagcttcattatgatccggttgcgacacccatcaatgtacacaagcttttcatttcaagctgctcaaacttgtctacaatttgcacgtgatccagcgtcagcagacaactatccaaagcacatgctacaggtacaccgcagtgaatttcagcaagcttgcgtgaaagatgcagcatatccaaatcactctcgatttttttacggaccgagggtgttaattgatccaaattctccagaatgccttcaatagagtcgtattcctgcaccagcttgagtgccgttttctcaccaatacctcgtactcctggataattatcgcttgcatcccccatcaggcctttaaggtccaccacttggcgtggcttaagccctttttcagtcagcagggtctccggggtgtataccatataattgccgtgcccttttttcataataatgacccgtgtccgatcatccactatttgaagtaaatcatgatctcccgagagaatcattacatccatgtcctcattttgcgaataatggcgtgcaagcgtaccgatacaatcatcggcttcaaaaccttccgctccaatgttgggaatgccgaggctgtccgtcacttcccgaatcaatgtaaattggggaatcaaatcatctggtgcgtcggctcggtttcccttatacgcagcaaaatgttccccacgaaatgtcgttccgcccatatcccagcagcaaatgacgtgtgtaggattaaatgtttggactgcatcccaaaaatatcgaataaaaccatatatggcgttcgttggcactccagcttttgtacgacggatataaccgtttgcggcggttgcataataagcgcgaaatagcagggccatgccgtcaaccagcattacggattgttcattgcgttgtgtcacagattgtattgctcccattcatcataatatttaacccccacagtataacatatcgtgggggtaaattgggcgttattgagctccccatgtgccctcaaatgtttcctctttgaatcctaccgttactttgttaccgtcggttacaatcgggcgtttgattaatcttccattcgaggataaaagcgaaatttgctcttcacggctcatgtctccaagcttatctttcagctttaactctttgtacacctcaccgcttgtattgaaaaactttttcagctccagcccgcttttgcgaatcaagtcttccaattcctccgggccgggcggttgttcaaaaataggaataagttccgtctcatgtcccttgttttgcagccatttcactgcattacgacaggtactgcatttagaatactgatatactttcagttggctcatcgctagattaacctccatttggttttcatcgcttatttatattttattctgaaagatattgcgctcttaatagctcctgcattccagccatatcttcaggcagcggagcatagaacgtcagccgctccccggtaacaggatgctccaaggatagctctgaggcatgcagagcctgtcgaggcatcctggcatcaagctgatcatatcgctcacgttgcgcagcgtcatcgggtgtaatccgatacattttatctccgatcaacggacaaccgatataagtcatatgcactcgaatttggtgcgtacgcccggattccaactttagtccgatacggcttcccccgttccacacttcctccagcttatacagcgtaagggcaggataaccatccggggtcaccatacgtaaatgcggatcatccgggttgcggtcaatcggtccgtctacctttccttcctgcagctcaggccgtccatgcaccagagctgtatagcgcttatccaccgttcccgcaatcatttgctcagaaatatgctggtgtacatacggatttttggctactaccagcacacccgtcgtctcctgatcaagacgatgaacaggacgaaaccggaacagttctcccttggcctgccaataatgcacaaccccattagccagcgttcctgtgtaatgaccgtgagtcggatggacaatcatgcccgccgccttgttcaccactaacagatgttcatcctcaaacaatatctcaaaaggaatgggttcaggtaaaatatcatcagaacgctcgcgctccatacgaatttctactcgatccccggacttcacctttacgctgatgtacacacgtgtcccgttcagcataatgccttgctcggtcagcttgagtttggatattaactttcgagaaatgttcatacgtttttgtaaaatagtcttcaacagcatgccctcctcctcaggagggatcgtatatacgataggttcataatacaagctcatcacaaattcccggttgcctccttatttgcggaacacttttttgctgcgcacatattcgacatcgggcacgccttgacggacattcgccgtgcgagcgacggcaaagaaataatcagaaaggcggttcaaataccgacgtaccgccggattaatgtccgtatgtttacctagtgtaacagcacggcgttccgcgcgtcggcaaactgtacggcaaacatgaagcgttgaggataatgtgctaccacccggtataataaaacgctccaccttcggattttcctcctgacatgcatcaatccagccttccagacgctctgccagctcgtctttcaccttatatttgctttcactaattttaacaaacgccaaatccgaaccacaatcaaacagctcctgctgtatttcttccaattgagtccgaatatccgtaaactctttcccttcggcaaagctgatcgcttgtcctacaaagctgttcagctcgtcaattgtaccgtatgcctccacacgatcatcatctttggacactcgaccgccgatcacagaagtttgtccttcatcacctgttctagtatatatgcccatttcattccatctcctttatcattccgtaagtgctttcagcaccttgatggcttcttccttattgcttgtacgaggcggcacggtagcaaataatgttttggagttatattttagctccttaaacatcttcatctgctccaccggaattccgaacaaatgagtttccttgcttacatctgatccttcttcctcctgccccttcttcttaaatacgccgccctcgaacacgccccgagcgtacgtcttcttgtcaaaagcatcatctaacggcagattcgagccattctgtccatacagcttcatgtcctcttccggcaaaagaaacagatcatgctccccggccgcatattctacaaccagcttctgctggttatacagcggactgactgaaatctcaatagtcggagcctgttcgcccagcttatccttaagcttttgtgccagctcttcacggatgactgaagcatcccctttatccataataaaaatggagaagctgtccttgtcccgtcccccacatccagccaataatacaagtgcaagcattccgatgatccatggcgatagcctttttagccctgctctcatatgtacgccccctcttccatgccattaatatatcataagttgtgaacgcaaaaaaagaaggcccgacggccttcttcttacatttggctgacttcatacggttaaaccttgcattccgtaccatacagcttcatatattcattgattttcaaatcgagcttgcaactgatctgaataacaagatcagaggtgaaggactgctcttcctgaaacgtccgcatcatctcattgcgcaggaacaaaatttcatcttccagggaaatgtcgtatcctattgaactagatgaattatatccaacatatgacatgagcattcctcctacaattgaaaaattgaacttcctgcttccgatttcaaattatagcatagaaatttagaaataaaagactattttttatgaattacccataaaaaaataattttaaccttcttttcttactttttctacaaaatgaccaatccgatccagtgcctccgtcagctgagcaacagaagtcgcgtatgagcaacgaagatagccttcgcctcccaaaccgaacacattacccggtacagccgcaactttagcctctgccaaaagacgctgtgcaaattcatctgagctgagtcccgtgctttgaatactagggaaaacgtaaaaagcccctcttggctcatggcactccaggccgatttcccggaacccttcaaccatcagacggcgacgctgattataggcttctaccatacgatctttctcacccaaaccattccgcaagccttccagtgccgcaacttgacccatagaaggcgcacacattacggtgtactgatggattttgagcatagcggcaattagatctggatgcccgcatgtatatccaatacgccagcctgtcatggcgaaggctttggaaaaaccactgacgagaatcgtacgatccatcataccaggcatagcggcaaaactgacatgcttttctccataattcaattcagcataaatttcatcagaaatgacgatcaaatcatgtttttccacgacttcggcaatcggaagccaatcctcataagtcatcgtagccccagttggattgctcggatagcataaaatcaacaccttggatttaggtgtaatttttgcctccagtgcttcagccgtcagcttgaattcatccttagcaaatgtttcaatacctactggaatcccgcctccaatcgaagtgattggagaatatgaaatgtagcatggctcgggcacgagaatttcgtcgccaggtacaattaaagcacgcaaagcaagatcaatcgcctcgcttcccccaacggtcacgataatctcatttttgggatcataacggacttcaaattgctcattcagataatcactaatcgcttcacgcagttctggcgttcccgcattagacgtgtagctggtaaaacctcgctccaatgaatagacacaggcttcccgcatatgccaaggggttgtaaaatccggttcgcccacaccaagggtaataatatccttgttgccacccaccaagtcaaaaaacttacgaatacccgaagatgggatctcgcgcaccaacggggacaaataggaactcatggctttgttactgtcggtaaatgcttctgttttgagattcatcatgatcttcctttacggcgaaatcatcagacgattatcttcctgatggtcttcaaagataattccgtcctgcttgtattttttaagcgtaaaattagtcttggtagacaagaccgaatcaataggcgacagtttttccgacacaaaattagcaacctcacggagattgcggccttcaacctctaccagcaaatcgtatgctccagacatgagatagaccgatttaacttgcggatacaaataaatccgttctgcaatcccttcaaagcctcttccacgctcaggtgtaatctgtacttcgatcaaagcggtaaccttttcgtcgtcgactttgtcccaattgactacagcggcgtatttgacgatcacatgttggtcttcgagctctttaattgaggtgcgaacatcctgctcgtcaacccccagcatagtagctaatagagtcggtgttcttcttgcatcttcttttaacaattccagcacttttaatttcaattcattcagttctgtcattctacataaggcctccatcgaaagagattactatacatcatacaatacgcactttaaacctgcaaagaaaaaccgtccactccggtaaacccggcagatggacggctgttatgggaatctgcttcaaaaacgaaaaatcccgtttacatataataagggttgttttgatgagtagactggccttgctggtgcatagattggccatatactcccgcggatgccgatttttgctgaatgaactgttggcattcttgttgggtcttgcgagcttcttgaatctgtttgtccaaatcgatgcgcagtgctttagtcggagtggcatacatattgttttggctcatcagatgatacaaatcaccttgcagacgcaatgtatcattcgtaaggtcggtgaacatctgacgcacagacggacaattggattctgtcgtcgccgttgtgtactcgcgcaccgtacgtttcatatcagcaagaatagtatagagcaaatcttcttcgggcataaatgacatattgttttgtgaatacattctgtcaaacctcctttattgtaaatccaaattactgctgcggttgcattggggcaagctgctgatgctgttgaagagcattagaaagcagattcaagtggtgctcatgagttcttgccagttgcaaacaggcttgttggatggctgggtgctgaatagaagccgctgtcgccgcactttgtttgagtagtagttcttcattggaaatggagtccacgatgtactccagctctttgcctgacaagggttgcatgttcgtagattgcataatctctgtgcctccttgaatgttttgttgcacgctggttatcttgtccgtttggcgaaatactatgtacacctaagaaatattacatattaccttatgaggagtgctatttatatggaattgataagcgggaatacatattggcccagtaccttggagaaaatgttggatttcccgcctttggcagaggatttaaattgtgatgtattgatcataggtggcggcatgggtggatccatctgctcccgactgttgggagaacgacaggtagacgccgtggttattgacaaacgcaagctagtacatggaagttcttcagccaataacggactgctgcaatatagcaatgataagaccttaacttccttcatcaatacgtttggtgaaatgaacggtgtactgttttaccgtatgagtaaagatgctctggatcagttggaaaaactgtctaccacgctggaaattgatccgtctttttcacgccgaagtagcctgtactatgcaagtacatcggaggatgtgcagacacttcaggaagagtacaaacagctaacccagtttggatttcccgtcgaatactgggatgatcaacagattgctgcccgatttcctttccgaaaaccagcagccttatatacacgcgaagatgccgaggttaatccatttttgttcgcccaaggactgctgcgatctgccagccgtcttggtgttcgcttatatgagcatacggaagccaagcatttagaatttaacgaaaatgaagttgtttgtcataccaacggtggaattatccgagcgaaaaaaatcatttttgcaacaggttatgaaacacaagagattaaaacagaccgtggagccgttctggaaagctcatatgctatcgccaccaatccaatcggagatacacccttgtggcatgaacagtgtctcatctgggaaaccgctcgtccttatctatacatgcgctccacaccggaaggacgcattattattggtggtttagacgaacctgtactggacgccaatcaacgtgaagtcaggctgctgcaccaacagcaaaagctgctacaaacattacgggaattttttccgggtataccatttcagatcgactttgcatgggctgctgtattcggctcctctcaagacggtttgccgtatattggtccacatccgcgttttcccaactgctactttttggaaggttacgggggaaatggagcagtcacgagtatgatggccgcacaacttttggctgatgaactgacgggcacacatcgacctgaaatggagctttattctctgacccgtactaccaaaccctcgcccgaaacaacggaaccgatggtttaacgtgtggaaacaaaaaaagaacctcctttccctttaagtgggtctggaggtctttttaaatatattttcagactattcggtttgcttgtgcaagcgtcgtgcgtgggaatgagactggctctgctttgtcttttgttccattttcagcacacttcgcataaaaaaccatccgagcactggcatcaatgccagtccaatcaacaaccagatcatcgccgtaggagccttgctgatacttaggacacccaagaaaatgagtgttccggtcaatcggcctaccattaagcatagttcgcgcagtacaaccagttccactctctgattggcgtctcctttactcgtacccattaaatcaaagctggcagaaatcatgggaattaaatacaggggcataaataaagcggtgccgatccccataatcagtagtgtactatactccatacgccacaataacggtaaaagcgcgatcactaacaacacagcacccaaaagcatacccgccgaacgatagtgtggcttgagccattttccgacagcccaaaagctgaaaaatgaaaccgccgatgtaataagtgaaaactgcgccagcttccattcctgttgagtagctacatacacgagcagcgtaatcaggaaggcaaataccccttcacggatgccctgggcaacaagtgataacgacaacggacgccacatactccctttttgtgacaatcgctgcttgggctccttccaattgtaatttcctgtcggcttacgcttgcgaagaaagaaactaagcaccactcctacgacataaaaggccaaggaaatactgaatatcacgcggtaacctgcgtcatcctccatacgggcaataatccaaccggacagccaaggtcccactataccggaaaacgagcctagcagacccacccaaccgttaaaatgatcacgacttgcctgatccgtgacttcgaaaaaaatcacattaaacgccagccagaataaacctaatgctgcacccagcaacatcccgagcggccatatgtagttcacagcctgcggtcccgtatataacacgatcagataaaataggccggataatgcggtccccacgcgcaaggcattcattttattatgttccttgacccactttccagccacccagaccataattcccagtgcaatttgttgactgacattaaaccagccgatcatcgcgtaatcctgcctgcttttccacaaatacacgttaagaaatgtgcctgacaatgctgctgcaaacacaaacaatccattcaagcttaatagcagaatggattgtccgttcaggtttgatttcaatgcagttccccctaaccgaaaaatcaccaatcagcttatttcaagccagcttgttcaaagatttattcgatttaagatgcccgtattgagcttgggcctatccgggggattgctatttaattgttggaaataccgctgagcttctccagcatccgcagtcggtcattctctgatagtgtctgctgtacatggaagcagctagcacacacataaacattcaagacgaacggcaaatccagaacaggcttgccaagcgctggagacatcgacggttcaaagccttctctggttacggtttgcgaacccgcatgcagcatgtactctccacattgggaacattcaagaacctcatcttgtctgtcgagtatttgttcagcgccatgttcataagccatcagatccgcaccactttcttcgaatttttgcaaagtatgcagcacaggcagcttatgaagctcattatcctgcaacaacggtgcatcaaccggtttttcaactacgatttcatcctctgcctcatataaaatatcctgctcctcatcatcaccgagctgaatactcaatgtacgataacccttcaggtcttcttttccatgagggtggggcaccggggttacagaagccacatgatcatgtttcgtctcttcatgtccatgctcaccagcatgtctatgcacaggtggagaaacagactcatcttcatcatcggtgatgtcagagtaccctttcagatcattatggcaataaggacactcttcctcaggtcctaattcttcatcccaaataatttccatgttacaccatggacaaatagtcatttccaagctttatcatccttccgttccaagcgtataccaggctctagtatacaagatgtgtcaagttacactggcaccgatcacataagataaagatatggaaataatcatggagaacaagccgacagcacgattatcctctttaatctgttgatcgatagaaaataccggtgttagaaactcaaaaagaaagtacgccgcaagtagcagtaaaaagccaacgaacgaccaaatcatcgtatcatacacactagatttggcttccatcgcaaagcggagcacgttgcaaataccgaacattttccctcccgtagccatggctaccgaaacattgccgcgcttgatctcttcccagcatttatagcgggttaccagctcaaaacacgacaaaaatacaattagctccagcaccgccaccgagaaataacccagcatcatccccaacggatgtgacagcaattcatcaatcgccatcttcacttcgtccctcccgttctaccaagcgttcccgggcaaagccggcaacccatagctattccaattcagcaactgttacgcctgtgccgccttcattgtaattaccgatacggtagcttttcacatgtttatgcttgcggaggtactcctgaataccggttctcaggacacccgtacctttgccatgaataatgtgtacctgacccagattggccagaaacgcttcatccatgaagcggtccacttccatcaaggcttcctcgacgttcgccccccgaagatcaagttcacttcgtacgttatcatcccgtgtccgcttaacgccagtcactggtttttgaactcttggagtcgttgcttgggcaggttgcagtagttccagatcatccagactgactttcatcttcatgatccccagttgaaccacagcttccttggtaccggacagttcaaccacgtggccttttttattcagactgtgaacggatacttcatcgccagccatgatagaacgagtacgtgtagcggccgggcgtttgacggtacttttcttgcgttgcttcggttcagcctcatccaattctctgcgagctgcaatcagcttatgctccttaacagaggccccttcttcctgagccaatttacgcaaatcagtaatgattttctctgcttcactacgagccttatccacgagaactcttgcttcgtcctcagctttttccagcatacggtcccgttgggactccagcttatccaactccgtctgatgacggctacgcaatgcttccatttccttacgcagctgctccgctttttcccgttcttgctcagcggttaaacggttctgctccagtgacgcgatcatgtgctcgacgcgctggtcttcttccgtcacctcaccacgggcatagtctaaaatacgccctggcaatcccaatcgctcggcaatggcaaatgcattacttcgtccgggtacaccgaccagaaggcggtaagtcgggcttaatgtagcgacatcaaactccatgcttgcattaataattcctttacgctcataggcatacgccttcaattcactatagtgagtcgtggcaaccatgcggcaacccatggcatgtatatgctccaaaatggatacagccagagccgaaccttccgcagggtccgttcctgcccccacttcgtcaagcaatacaagacttttgggcgtcatatttttcaggatgctaatgatattggtcatgtgactggaaaatgtactcaagttttgctcaatgctctgctcgtcaccaatatcggcatagattgcatcaaatacacacagctggctttcatcctcaacaggtacaaacagtccagacatcgccatcaaactaagtaggccgatggttttcagggtaacggttttcccccctgtgttcggtccggtaacgataatggaggtgtatgaattgcccagctccacatcaatgggaacaacctgctccaacggaattagaggatgtctgccctttttcagcttcaaatatccgcggtcattcattaaaggcaaggttgccttcatttcacgggcgagacgcgcttttgcaaaaataaaatcaagattacccaatatgtccacatcatacagcaacatatctgcttgttctgcgacaagtgcggtcagcttttgtaaaatgacttcaatttcacgctcttctctcagccttgtttccctcagcttattgttcatggctacaatggattcaggctcgataaacaatgttgcaccagacccggattgatcatgaacaattccgccaaaataagaacggtattcggccttaactgggatcacaaaccgatctccacgaatcgttatcaactgatcttgaagcattttggatacagttgaggaacgaatcatggaatccagcttttcacgaatacgcacttctcccgagcgcagctcccgacggatttgagaaagctctgtgctggcagaatccagcacctctgcattttcatcaatacagcctttaatggagttttctaaacctctctgctccgaaagctgctcgctccaatacagcaatgtttcgacaggattttcctcatgcaaacttgccacgtatacctgtatacggcgtgcggcctgaactgttgtccgaatgccaagcaactcctgcgggcttaacgttccgccaatacgggcacgcttcactgccggagtgatatccactactccgttaaatgaaggcactcctttgagtcgatcagcagcataggcctcatccgtacctttcaacattttcttgatatgctccaaatcatcgctgggctgtagttgaagggctgtctgttgtcccgttgccgtttgagcatagtgacttagtttatttagaattttttgatattcaagggttttaaaaattttagagtccaacttcactactcctttcacatatatctatattataccgaaagcagcaaacttacgctatttgccaactctcttttacacataagaaagctcttcatgccacacactaacctttgtctaaccctgtaaattcaaaaaacaaaggaggttattccgtgagcattctcgggcacattgtacgtttcatcgttgccgctctggtgctgatggtcgtaagctggatcgttcccggatttagtgtaggcggcttttggagcgcgctgattcttgccattgtcattgccttggttggttacattatcgaggcagtgttcggccgacgcgtttctccatttggacgcggtatcgtaggttttcttgtgagcgctctggtgatctggatcgctcaatatgtggtgaccaatgtcagtgtttccgttctgggcgcattgctcgctgcattggttatcgggattatcgacctgtttattccggtatcgacaccgtttgaagccggtcgcaaagacgggaaataacttcaatagacactcccgacaaagctgtcccgaagcagatttcgtctgccacaggacagctttgtgtcatataacttctgagtggatacaataagcaaacaatccccggcgatgagcagccggggattgccttacatttttaatccatatctactgatcctgttcgataagttcaatccattcattgtactccgtttgaagtttagtgtattcttcctgtaattgacgtaattctgtagaaatcttctccgtattttcccgatctacgtcctgttgtacttgtaacagacgaagctgatgcgccgccatttcatatttttgacccacttcgtccaattcagactgcaaggccattcgttcctgctctatggactgctgttcagctttcgctgttttggcagcttcaaccgccaaacgagtctcctcctgaagctgttccttttgttcaacggttaccgctatttcccgttcccaagatgcaaattcttccttacgggcagcatcttcagcttccagacgttccgcttctgccttcaactgatcgtatttaagttgccactctaaagattcttcctcagcacgttccagtttactccgccgttcgtgatcttcctgttgaagctgcttaatattctgctccagctgtccagctcggctcttcatgcttccatattgctcctgaagcgattgatatgccttagctccctcttgctctcggactttggctttctcaagctcatcctgaacgcgaatcagctcaggtgaaagctccttgattctcgcttcaagttgaactagccgttgctgttgtgaagcaaatttatcattaatagcttcgagctcagcctctgcgtgctgtaattgctcctgtatcgcttccttctgttcacgtgcttccagcagggagagctccagctcatcaactgccaactggcgttcttctgcaagcttcttccatgacttctcgctttcagctagcgtagccagctcactttgcagcttgcgagaagatacgtgagcttgctccagcagcttctgcatccgccgctgttcttcctccagcttagccgtctgctgctgcgtagccttagcttcagcttctaattgatcatatcggctttgcagttcttcacgcgcaagcgtatctgcctgctctcgctctatcgcagcctgtcgctgtgtttccagcacagactccagctcggactgttgttgcttcagtactcttgcttgttcttgagcctctcccagacgagaagcaagctctgtactgcctgcttgtacttgttctaattgttcctgaagctcctcaacccgaatctcctgctccaatgcagcttcatcagctcgcttctgcgcttcctgatgctggagcttttcttcattcaacgccaattcagcctgtttacgttcctgctccagctgctcattcagccctgagcacttggtctgccattcgcttaccttcttactatgctcttgctgtaaagcagatcgcagcttgtccagttctgtacgcttttgctcctgatgagtcttctctgcagctgacagcttggcttcagcctgtttagtcgcttcagctacttccttcttcatctgctcttctatttgccggatacggacattagccgcctcctgctgctctttcagcttgcgagaagcttcttgacgagactcctccaattcacgtttagcttgtttttgtccattttcaagttcagtcgcttttttctcctgctgttccagctttgccttcaattgggcaatctctttggctgatacagattcggtttccatcagcttcttctgcgttgcttccttttcttcctttagttgaataaaagattgatgcagatctgtatttttttgctgctgttcccctagagccgtctggagttgcgccagatctccccggagctctgctcgttccgctgctaagcggttcatatgactctgaatctcctggatttgtacagcttcttctgccatatgaaccgcagccagcacggcaattcggggcatatccagacgcgaatgagcttgagaaatgctgtgcatacgctcatccacgtaattggcaacctgcttcatataatcggtattgctgccgacgagtttataagaagtaccgtagatctctacagtgacgcgagtacgatctggtgtagtcacaattatgccctccttcaatactactgtatgttgattctaaggtgtgtccggtactatggtaacccgccttccgtgaagcgttcaaccttattagtccggcttccccgcagcgggtaaatatcagagtaagagagcttctatgatgataggccaaaaagccgtatcgaacctctgtcactaagattcgatacggcttcccgcatttcctgctactttctcaattccgctccaaaagtttgttccagagacgtaacgacaggagtatgcgccgcattgatctcttcatccgtcaacgtatgttcccaatgacgataggtcagagagatagctacgctcttcttatcttcaccaagcttactgcctgtaaatacatcaaacactcgtgcatcctgcaacagctctccgcctgcagcgtgaataacacgaagcagttcacctgcctcaacgtctttatttaccacgagggcaatgtcacgttccacggatgggaagcgagccagctctctgaactgaatatgagagttggcgtggtcaacgacctgttgcaacgcaatttccgctacatacgtatcattcagcccataagattgttgaagctccggatgaatctgtccaatggtaccgatccgttgagagtttccattcacatccagccataccgaagcagaacggcccgggtgatagctttgcggttggtcagccacataacgaatgctggcactcaatccgaaatagtcaaacaccgtttcaagcgcacctttaatatcaaagaaatcaaccttttcagcaccaatattccattgtttttcacggcgtactccagtcagcagtagactaagcacttgaatttcctgcggctgacgggttaatgtttgttcctctgtataaaatactgttcccatctcaaaaatcgccagattgtcttgcttgcgattcatgttgtacaccgctgtatccagcatctgtggaatgatactagtacgcaaaacactacggtcttcgctcataggcatagccaaacgtaccggatggctaccttctgtcagggcattaaataaccccgtactctgcggatgtacaaaagagtagctgatcgtctcctgccaaccaccatgagccagcaatctgcgcagggagcggcgcaatgattgcgatgctgtcaaagctcccggagttgtaggaccttcaatcggcgtggtcgggatattgtcgtaaccatacagacgagctacctcttcgattaagtccacgtcaatggtaatatctccacggcgtgtaggaacttgaacttccagtacaccttgctctgcgtcgccacatccgaaatgaagtctaccgaaaatcgttttcacctcaagcagcgacagttgggttcccaaatatcggtttattttatctagcgacagcttgataatgcggttttcagcttttgcagacgctgattctacgatgccctggtgtacagtgcctcccgcataacgctgaatcagcgcagctgcacgattcacagcaggcacaacagcgcctggatcaacctctttttcaaaacgcagacttgcttctgaacgcagtccaagttgacgggatgttttgcgaactgtaccgccgtcaaacttggcagattccagcgcaatgctgaccgtcgcatccgtaacctcggaattggctccacccatcacgcctgccaatgcaatgggtttcacaccgtctgtaatcagcagcatatgcggctccaacttacgttcctgatcgtcaagtgtaatcaatgtttcgcctgcacgagcgagtcgaacttcaatatttccattttccagcttatccgcatcaaaagcatgcaacggctgaccgtattccagcataacgtagttcgtaatatctacgatgttgttgatcggacgaacacctgccgccatcagacggttttgaatccataacggggaagcccccacttttactcctgtgatataacgggccgcatagtgcgtacacagttcaggagtatctaccttcacagacagatgatctgccgctgcatcgctaatttcaaccaaatccttagccgggtcagccagcgaaatgttacgtcccagaatcgcactcacttcatatgctgctccgtgcatgctcaggcaatccgaacggttgggtgtcagatcaaaatccagcacctgatcatccagcgccagcagcttcgtaattggcataccaatttcagcatcctcaggcagcaccaaaataccttcttgcaattcctttggaaggagcttgtcattcatgcccagttctttggccgagcagatcatgcccatggatacaacaccacgtagcttggcctttttaatgtggaaatctcccggcaactttgcacctacaactgcaacaggaaccttttgacctgcatccacgtttttggcaccacacacgatttgcagatcttcctcttgacctgcatcgacaatacatatattcagcttatcagcatctggatgcttttccttgcttttaacatagccgacaacgacaccagtaattccttgattgcgctgctcgacctcatcaatttctatgcccgaacgggtgattttctctgctagatcctccgcgcttacctgatccagcgatacatattcggacagccactcgaatgatactttcatatgggttcacttcccttgatatagttgtttattgacgcgcaaactgtttcaggaacgacaggtcactgttataaaaatgacgaatatcgtcgataccgtatttcaatatagcaatccgctctacacccataccgaatgcaaagccgctgtaaacctcgggatcaaaaccgcccatctccaacactttcggatggaccatgccacagcctaaaatttcaatccatacacgttcgccatttttcttcacaaaagtcacgtctacttcagcgctcggctctgtgaacggaaagaagcttgggcgcaaacggatttcggtcgattctccgaacatttcgcgtgcaaattgaagtaaggttcctttcaaatcactcatacgaatgtcttttccaatgacaagcccttcaatttggtggaattgaaaagaatgcgttgcatcgtcatcatcacgtcggaaaaccgtacccggacagataaccttaataggcgtttcgcccttcatcgcttccattgcacgaatctgaaccggtgacgtatgggtacgcatcaacagatcctcagtcagataaaatgaatcctgcatatcccgtgctgggtgatttttaggcaggttcaatgcttcgaagttataataatccgtctctgcctgtggaccttcagccactcgatagcccatacctgtaaaaatatcctcgatttgctcaatcactttgttgagcgggtgcagtccaccttgcggcaacgcgcgtccaggcagcgtaacgtcgatcttttccgcctgcaaacgctcatttgtttctgctttcgtgaactcgtcctgcttacggttaacgacttcttcaatcgcctcgcgcacctcattggctacctgtccaacaactggacgctcttccgcgctcagcttgcccataccgcgcaagatttcagtcaatgcgccctttttccccgaatatttgacccgtaaatcagccagctccttgggtgttgccaccttctccaatacttccagtgcttcttccttcaaggccagcaaatgttccttcatttggatggtttcgctcatcgcctgttcagtcccctttcttcatttccagcttttcagacaacaaaaaaaggtcttttctcccggtaagggacgaaaagaccgtggtaccaccctcgttagacaataagctcagctcacccagcattctgccttacggcaactagttacaggtgattttcatgctatgcatcatcgtctcgctctacacgttgtaacggtcgtgaaccggtatcccctacttgcacattcgccaatcacatggcgtctgaggttcaaggaactgctccggagcgaacttcaacagcccagtatttgcagaaacgctctcaatcctacggcgcttcctccctgttcaatcggacactgtctactcttctccatcaagacattttcaaaaattcgaactattgttcattattatatgcaaactaccgcgctttggcaagcagggcatacgtttcatttctttagatatcgagatcatccaaccgctccagatttgcacgaatgcgcctgatttcgctcaacaacttctcgttttcgtcattcgtgcccgtcattcccatcaactctgtaagacgcaattgtaatcgaagccgttcctcacgccgctcctggtcttctggctcccgttgacggcttcgctcatcttcttgcttttcgtcagctgtcccctcatagatttcatatccgccccccggcctcatatccagtaatcgagttgccgtgcacctcaccagctcccgatcatgtgagacgagcaccagtgctccatcatagttacgcaaagaatcctctacaatttcacgggtttcaatgtcaaaataattcgtgggttcatccagcaccagcagattggctccactaaagtacagacgcagaaaagctaccctgcatttttctcccatactgagtgtcccgatccttttaaatacgtcctctttcgcaaaaagaaagcagcccaacaccgttctcgcttctgtttgagtcatcgtcgggagtgcaagcaaactgtccagcaacgtttgatcctccggaagctgctccagctcctgtgaaaaatatccgatgttcaactgtgggttggctgtgattttccccgcctgcggctccagttgacctgttaataaccgaagcagcgtggttttaccaattccattcggcccccgaacagccagacggtctccacgtgaaatgatcagatttagatttttcacaatgatacggtcgtcgtagctaaagtcaacctgctcagcacgcagcaaatattttgcctgaaacccgctgtcacttaatttcatgtgcaaagacgcagcctcacgcggttgctctactctattggcttccagtcgctccagttccttctccttcgcatggtaacgggaaatattttttttagccttggccttataaaagctctgcgtaacggccatctcaaccttggatgcgccacgatgcgcctgatgaaaccattccctgtaatttcgaatcgtttcctccagcgcctgtttcgccagctcctgcttccgatagttggcttcctgctctcgcagttctcgctccttttgcgctttatattccttatagccgcctttatagcgcccaatacctgtcgatgtgagctcaactatactcgtagccacccgatccaaaaaggctctgtcatgcgatacaaacagcagtgttcctggatacgtggacagccactgctccagccaaagcaagctttcggcatccaaatggttggtcggctcatccagcaccagtagcttcggctgcctgaccatgagtccggctaatcgcactctcgtcttctgtccgccactcaggtcaccataagcaatggaccacgtctggacaggcattcccattcgagtgagcgccttttccacctcagactcccaggcaaagccttgcaggcgttcgtattcatccatcagctcgccgtaacgctccagatgattctccatatccttcccagcattggctaggtcagcttccagctgtcccaacacttgcttgagaagccaatgccgagggctggcctgctgtgcggcctcaagtgcggttcgagaccaatccaccgtatcctgctgcttcagccagccccgctcttccagtggcaaatcatgctctacttgaccagaggttggcgcttcatctcccagtaatattcgcaatagcgtcgtcttacctgctccatttcttccaaacagtgcgagccgttctccttccatcacatccaacgacacattctcaaataaagatgtcccgttccaatcctttactacattgcgaatacgcaaaatcgttctcataccgatcatcctttcccagtccggttttttgaccccggaagcaataaaaaaagccgcagaaggctgcggcttgcatacaaggaatatagaatgactgttatgaatcgtctcagaacatatgcttatgaaaaataataccgtaaacgaataagccaaatcccgttccggaataaacgcatacgcccctacattcattttcagacacacttctcccgttgcagcttacagccgcctgccagtaactgtgcagttaagtgggaaaatcagtgtgcttacttcatcggacgtatggttaccttccttttcatgggatacttacttgcagtcagtatagcagatcacagcacatttgcaaataacccgcgttattttccaaataccaaagttgtattggacgaacctgcatatttcgttacaaactctttcgtatattcaggagtctgaacctgatagctatagtttttgcttggattccagctggttacacgcgatttttggttgttgatggcgggaaaactccccacatctttaaactcgccattggctttatcatcaagaatacctcccttttcactaccttttccaaagtagttgtactcagaatagattcttgcattcgtagcaatggtgtaagcaagatggaaattattaatataattatttttaacatggaaatatccatatctcataagccctgggccacgtacaagtaagttttcaaagtaattattggcaatcgtgatatggggcatgccatcataatttttattgccatcatcagggtatcccaaaatgagaccatatttatgattagcaaatttggagttactaatggttacataatcagccgattggcctatgtacaaaagtttgtccagatccgagccattcgcattataactgtgacctgcaaatgtaacatgatcaatccaataatttgtacctgcagtgagataaagttggatgtcatcgttaccgttaatgttggcactgtgctcaaaagttaaattttgaaagatcacatttcccgaattatttgttgttttcaaatgaatgttaaccagcttgtgttgcgcgtaagaaccaatgagtgatttgttggaaccaatgttgaccacggttttagaggaggcagaaatatttttttcgattaccaaaattttaggagttgaatcccctaactggtttttcaaatcgtttagattattgatataaatgacctgaccgccttttccccccgttgtggcaggctttgcagctccattttcacttttagcctgtccggcaaaaccagtcattccattcgtcgacgtatttggaaaatcagcagcggcgaacgtagaacttgctgaaaaagtaaacagcatcaaagttaatgctaaaaacagaaaagaaattttcctcattgcagctacaccatccttttttaagttaaatcccgacaatccgactatacatattttttagtaattggtaaatagttctttttatctgtttatttatagcatctaagctaaatattttatattttattttgtgtagcaatgtaaaaatagttcgtaagaacgcaaaaagccgtgataccccgtcggcaccccggctataatgcatttatctagctccaaacaaaacaaaaacccttgcgtcacaagggtttcgaacttcttaaagcagtaagcgggtgatgggaatcgaacccacgctatcagcttggaaggctgaagttctaccattgaactacacccgcattttataacatctcgattcttatgtatgacacgcttaacctatcgtcaaccagctgaatcaggatgttatttagtataacttacctttcagcaaaatgcaagcatactacatactatcctgagccagccaattcataggtttacgtaaaaacaatttttcaaagacttctgcaggaatggggcgactaaagtaatatccctgaccctcatgacaatcctgtgcctgcaaaaaatgaagctgctcctcattttccactccttcagccgtaaccttcagcttcaaatggtgagccatggaggcaatagtagatacaattgccgcatttttgctgtcgaccagtacctcatttacaaaggaacggtcaatttttagacgatcaatcgggagattcttcaaataatgcaatgagctatagccagttccaaaatcatcaatactgattgcgacaccaatagcctttatttttttcaactgttcaaaggcccgatccttatcaaaggtcatactttcggtaatctcaagctctagatagcgtgcttcaagttccgtataggtcaaaatgtcccgaatgacatccaccagctttttttgctgaaattggcgcatggataaattgaccgaaatcgggatgggtgggtacccgagctcctgccattgcttattttgcagacaggcctcccttaatacccattcccccaagggcacaattaaaccactttcttcagccaccggaataaaatcgcccggcatcaccatcccacgatgaggatgattccatcgcaccagcgcctccaaactcgttagctcgccactttgcaggtggacacgtggttgatataccaatgaaaattcctcattttcaagcgctcgccgcagatcattttccagctggagtctttcatgcgctcgcatctgcatcgcgctagcataccgctgaaaattcactccctgctctttggcactatggacagccgtatccgcctgctgaataagctgttcgctctgattcgcatccaacgggtataaagctatgccaacactcaccatcacatgataggattcgccattaatatcgaaaggctgatcgaacagcttcaccatatcatcaatacgatttctcatagcatctgtatcttcgtatcccgttagaagaaaggcaaattcatctccgcccatgctaaagacagcttccccttcatggctaaaatgccccaagcgttcgcctaccgcatacagcaaataattccctgccatatgtccaagcgaatcattaatcgccttgaaacgatcaatatttagcactaaaagcgctactgtctcatccgatttcaatgatttgcgcaatattttatctaagcgttgggaaaggcgacgacgattggggagtcctgttatatcatcattataggcaatgtgattaaactcagattctgctgcctgcttttcacgataaggaaccagaatcatcaaccgaaccagcccgctcaacatattataaaatgctaccgcgttggtcaaaagtcccaaaaggtgattaatatcgctcatttgctcagaaaataaatagaacaactgactcacaacacacagcccaatcccacgaaccataagcaatatgcccaactccgccgggcgggctttccgatattttcgtaccccgaaaataaaagtgagcacaagcagtaacatgacagccagatttaatgtccagcccaggttgcctatttcgtatcgtatacgtagatccggtaagtctgcaccaaatgtcttaataactcctagaatcagcaaagtgcagcctatccctgcccacaaagccactgtcttgtattcagacttcgtcttgctaaacgggaggaaacaaacacataagagcaagacagaagtaacggcacgatttacaaatagcagccataacgaaatgcccggagacaaagcaaagtccgtcaggcttacgaaactaaacgaaacaatatgaacaaggtaaagcagaccagccaccaaaaacgtcggggcaataaaaagtctctgcaaggataactgttccagtaaaacggaccaggactgataaaaaatagaaaaacaaatcgcagcacaggaaaatcctacaatcggatataacaagaaaaaaacattatgggagtatatcttattcaaagttacgtgaaataactgaaccaagacaaacaaaactatcgaagcaatgccgatacctatcgttttttttacttccaaccgtatactcattcagcctcttcagccccctgcatatcggagattccgatcatctaagacgtttgacagctttggaagccgttgtttaagtctatagtatcaaaaataatgttgtattctggtatataatagcatttaatctgtgaaaggtgaatcatttttttgtcttaaattcatgaattcattttcgcatttacgcaaataaccgagcttacagcaccaaaaaagcgcatcatcttgtcagattatgcgcttcagacaaccttttccaaaaaggtgatacctataccccaacgctgcacaacataaaagaaatagtatgtacaggacccctctgcgaaaacctccccatattaaactacaggaagcgtgattttgaattgtgtgccacttccatgtttactgtctacatgtatgaagcctccgtgatttttgataattcgatagctcacagccaatcccaatccggttccactttcttttgttgtaaaaaaaggatcaaataaacgcgccaatgtattgtgatccatacctaatccgttatcttcaatacaaatgtggacataattaccctcaagcactgtatggatatcgatgaagccctctcgttccccactgatgctttcaatggcatccatcgcatttttaatcatattgaggataacctgcttaatctgcttcacatcaatggaaaccttcatgagctcatcattttcgtccaatgcaatctggcaacccttcattaatgcttcgctttctgtcagcatcactacctctttcagcaagcccatcacagatacagctgttttttgcggagccgaaggcttggacgaatttaagaactcataaataatgtcgttcgcacgatcaatctctgttaatataatgcgggcatactcgtccctgcccaactccaccaaatgtggccgaagcaattgaataaagccccgaattgcggtaagcgggttacggatttcatgggcgatagaggcagagatgcgtcccagcatcgccagcttatcgttttgatacgccgtctgctcaatctgcttataatccgacacatccttgacgctaaacaaaaaatccccatccatctgatcaccataggtcactgttatcaaccaatgccgaccatactcatcaatcaactcatgatagcgctttctatgaaagatagtttctttataaatccgcatgattttcttcttcttaaaccgacttaactcaggatgatgcaaaatttgcatcaaattgcgacctgctagcgaactccgtggtagctccagcaatttcgccatttgcacgttaataaaggtcagtaccccgtcactgtcaaacagcatgataccactatccaggttctccagcacattttcatacttgttattggcgatctgtgtggaaggacaagctcccacggtatcaagcaaggcttcttggaattcactgatcatgccaggcttcccccttgtttcggaatgacaaactggccgtttcggacgcgtaataatcttgaagaagagaaaggcatctatcgactacccttcaatgatgtagaaaacagtttcacagaaatccgaccatctctttccaattcgagtcttattttatgatagacaagattaaggatcgcagtcaatcggaaaaagtgtcgaatccaaatttttatcctgttttctttcgtcataatatctgcgcaacattaccaaaatgaaagattacgttaggaacaagcgccctacacaccaaagaagctcnngagcttctttggtgtgtaggatgtcaactgccgctcttattatgttgaagtcgggatcgtctttggctcataacggccagtcttctcttaagctctccctgccatttttcatcattcatctgtttggctaccatcaataaatccagagatatgtcaatttgacgcttcacaatttcaaaggcatcttcactttcacgattcacacaattttcaaatatcgtatcatcgtcttccatgacataatcctgaaaatcaatctcggttgccccatctccatgtgcatattcagccagaatttcatactcattttcgactttataatgaacttcaatgcgacgacataccgggcaaaacagcaaaggaacattatgaacttgggtgcggtaatgcttcagcgttcccttggttcctaccatgcttgctccacagcaataactcatccgggctcagcctcctctgaacaaaacctgttctgccttgtttatcttctacaataccttattcgctttcatcaggcaaaattcctccagaacacaacaacatttccataattatttgttacttcactctatattgtctcatttaaacaggatatcctcacatcttgcgctgcacagagcaggcaagcaagcccccaataacggcagagtaaccgctagttgggggcttgcttgtttaatttcaacttgtgaagcttatattacagattttgatcgcctggtttccagttcattgggcacaagccaccggattgcaaagcttgcagtacacgcaaagtttcttccacactgcggcctacgtcgttgtggttaaccacttgatatttcaattcgccttctggatcaatgatgaacaagccgcgcaatgcaacgccttcttcttcgatcagaacgccataatcgcttgctgttttcttcgtgatgtcagaagccaatgggaagttcagtttgcccagaccattgttttctttagctgtgttgatccatgctttgtggctgtgcacggagtctacactgatacccagaatttcagtatccagctctttgaattggtcagcagcatcgctcaacgctgtaatttccgtagggcacacaaaagtgaaatccagtggatagaagaaaaatacgagccacttgccacggtaatcggaaagcttcaccgaaccaaattcttgaccgtctccagtcactgtttccaatgcaaaatcaggggcgggtcttcctaccaatctttctgccataataatgaaatcctcctttaaaatatgtaagaaaaacaccgaatgtgttttcctcaatcatctgtattgtaatgaacaacttacttgataaatgttatcattcgctgaaatcaaagtcaatattataaccattacttttttataattattttaaactagcttaaaaattcacgttttattcacattttgaacttttgaatatacaagtagctcctgattgctcaggagctactgtgctaaacatttttcgaaaaggctgtactgtataaccttactatataataggaagctttttttcagaacaggtgatttacggagcttttaacgaatagctgctgcgatcagatctcccatttgagttgtcgagatcgcttgagatttatccaccgcaatatccgccgtacggtgccctgcatccaatacctcagctaccgctttctcaatggcatcagctgccttctcgtacccgaaggtgagacggaacatcaaagcaacggacaaaatcgttgcgatgggattcgccagcccttgacctgcaatgtcaggcgccgagccatgtaccggctcgtataggccgaagctgccttctccaagtgatgcggaggagagcatgccgatggatccggtcagcatagccgcttcatcactgagaatgtcaccaaacatattttccgtcacgatgacgtcaaagctagatggacgacgcagcaattgcatggcgcagttatcaaccaatacatgctccagctcgacatccgggtagtctacagcaacccggttaacgacttcacgccataaacgggaggtttccagtacattagccttatccaccgatgcaagtttcttgcgacgtttttgtgcaatttcgaaagattggcgcactatacgctctacttctgttacattatatgcacaagtatcgactgcttcctcaccctgaggactttctcgtctgaacttctcaccaaaataaatgccgcccgtcagttcgcgcaccacgatcaggtccgttccttccaacacttccggtttcaatgtagatgcgtccttgagacagtcaaagacgacagcaggacgaagattcgaaaacagaccgagctctttacgaatgcccagcagtccagtttcaggacgaagctcctttggattgttgtcccattgtggtcctcctaccgctcccagcagaacggcatctgcagattgacatactgccagtgtttcttccggcaatggtgtgcccttcttatcaatcgcaatcccgccgaacagcgcatgctccgtttcaaatgaaaggccgaacacttcttccgtacgtttcaaaattttctctgcctctgcgaccacttcaggtccaattccatctcccgctattaccgcaatctttttaacgtctgccatcacgtacactcctcttgttatacagctatacaaccgtatttttcataccttctttgtaacatacatggcaggactttgaccaagatatagaatctatcaattcaataggcacagcctataagctgattttttcatcagagaaaaaagaaaacaggaccggaaacatccgatcctgtatatatccaactcttaagtccgataaaattaagatttataatctacgcgattactgtaatttttacgcttgtcgatcaaaccatttagtgcatctacgtaagcccgagcacttgcttccagaatatcggtacttaccccgcgtccctgcacagacagtccgttttgcgtcagcactacatggacttcacccagggcgtccttaccatgggtaactgacttgatggagtaatctgaaagtacaacgctttcgctgctggcttggtcaatcgcattgtagatcgcatcgactgaaccatttccttcagcttctgtctcgataacctgaccttcatcgttaaccagacgcacttgtgcggaaggcgtagctttgtttccataggtaacaaaaatcgtttccagcttgaagacttcaggtgcatcggccaatttttcttccagcaatgccaaaatatcatcgtccgaaacttcctttttcttatcagccaagtccttgaactgcccaaaagcgcgattcagatcttcttcactcaattcgtagcccaactcgatcaaacgctcacggaaagcatgacgacctgagtgcttaccgagtaccagcttgctttcttttagaccgatactttctggtgtcatgatttcataggtcgttttctctttcagcatgccgtcctgatgaatacctgattcgtgcgcaaaagcattggctccaacaatcgccttgttgcccggcactaccatccccgtcaaacggctaaccaaacggctcgtgcgcgcaatttcagacaattgcagagacgttttggcctggaaaaattcctgtctcgtctccagtgccatggcgatttcctcaatggccgtgtttccagcgcgttcaccgataccgttaatggttccctcgatctgatccgcgccgttcaggatggcagcgagtgtattggcagtagccattcccaggtcattgtggcaatgtgcactcaattgaatcttctccacatcgaccacattttccttaatgtgtttgaatatatttccatactcgtagggtgtcaagtaacctaccgtatctggaatgttgacaacagaagccccttcttgtacagccatggtgaccatttcaaccacaaaatcaagctctgtacgacctgcatcctccaaagaaaactccactttaggcaaatatttcaacccatagcgtatggcagcacgagcagtttccaatacctgtgccttctccatccgcagcttatgctgacggtgaataggagaagttgccaagaagatatggatacacgggtcctgagctcccttgagtgcctcgcgaaccgcatcaatatcctgttcccttgcacgcgaaagaccaataaccgtcgaatttttcacagcttttgctactgcattaacagccgccagatcacccggagaagcagccgggaacccagcctccatacgatcgattcccagcttctccaactgatgagcgatctccactttctcacgagtattcaagttcacgccaggtgactgttctccgtctctcaacgttgtgtcaaatatatagattttgcgcaacctaacgcacctcctcaggattaggacccttaaattacaatgcggctcacgcaataagcagggccgcattgtaattgatatttataataattcatattgtcgaattcatagaacaaaagattattactttttgatccaatgcatcatttcacgcaattgtccgcccaccacttcaatcggatggttagcttcattacgacgagtagccgtcaggaatgcacgtccagattgattttcaaggatgaagtcacgagcaaatttaccttgttgaatgtcagtcaatacatccttcatggctttcttcgtatcttccgttaccacgcgtggtccagttacataatcgccatattccgctgtattactgatggaatcacgcatcgttgccaatccaccttcatacatcaggtcaacgatcagcttaagctcatgcaagcattcaaagtatgccatctcaggagcataacctgcttcagtcaatgtttcaaagcccgcttttacgagtgcgctcacgccgccacacaataccgcctgctcaccgaacagatccgtctccgtttcttcacggaaggaggtttcaattacgcccgcacgtgtacagccaatgccttttgcgtatgcaagaccgatttctttggcttgacccgttgcgtcctgctcaattgcgatcaaccccggtactccaaatccttctacataggtacgacgtaccatatgtcctggggattttggagcaaccagcaatacatcgctatctttaggagctacgatttgtccaaaatgaacgttgaaaccatgggagaacaaaagagctgcgccttttttcaggttaggttcaatttcatttttgtacacagaagcttgagtttcatcaggtaacaaaatttgaaccacatctgcacggcttgttgcatcagctacgttcagaacttcaaaaccgtcgtttcttgcgacatcagctgatttgccttcacgcaaaccaataacaacattcacaccactgtcacgcaagttttgtgcttgagcatgtccttggctaccgtaaccaataacggccactgtctttcctttcaatacgctgagttctgcatctttttcgtagtacgttgtaactgccatggttaatttcctccttttaattggacccttcataatgagcgggtaccccaagagactttccctcgtgctcagtatctaaaaatctcttcgagcccccgctcttatgcgggcggttctttattgctataatgcgctataagcggtaattcgttaaagctccatattaagcattgccacgtatcatagctgtaaccccggttcgagtcaactcccgaataccgtaaggcttcaacaactcgatcatggcatcaattttttctgtatcgccaatgacctgtacgatcaagctcgtcgttccaacatcaattacagctgctctgaatgtttctaccacacccatgatctctggccgctgaggcggttctgcctttacctttatcatcgccaattcccgagctaccatcggcttggaactgagatcgatgaccttgatcacatcaaccagcttgtaaagctgcttttcaatctgctccaagttgttctcatcccctacagtcacaatgaccatacgggataatccaacttcttccgattgtcccacagttatgctctcaatgttaaagcctcggcgaccgaacaggccggacacacgttgcaaaacgccgggttgatcatttaccagtacagcaatggtattttttgttgtcattttactcgtcccccatcagcatttgatcaattgtcgaaccttgcgtcaccatcggatatacattctcttccttgctgactacaaactcgacaacgaccggtccgggtgtatcaagcgcctcctgccaagcccgacgtgcctcttccttattcgtagcacgcagtcctttgactccgtatgcttcggcaagtttcacaaaatccggacttccagccaggtcaatgtgactataccgattgttatagatcaattcctgccattggcgaaccattccaagaacctggttgttgataattacgattttaaccggaatgttattgattgcacagatggctaattcctgcgaacacatctgcataccgccgtccccgttaatcgatattaccaatctgtcgggatttgccatctgagcaccgattgcagaagggaaaccaaatcccatcgtaccaagtccaccagaggtgacccatgaacgtggctgattgaatttgtaatactgcgctgcccacatttgatgctgtcccacgtccgtcgttacgattgcgccgcccttggtcgtttcatccaacaactcaacaacccattgtggtttaagcaccgtttcagaatccttatatgaataaggtttctctttcttccaatgctgaatttgcgctctccatgcatcagctcgatccgcacgttttacatcctgattcagcaattccagcactgccttcacgtcacccacgataggaatatccgctgcaacattttttccaatttcagcagggtcgatatcaatgtggacgattttagcttgaggagcaaagccatccaacttgcctgttacccgatcatcgaagcgggctccgatacagatcaacagatcggactgttgaatcgcttgattggaggtgtatgttccatgcatccccggcatccccgtccacagttcatgtccacttgggaaaccacccaatccgagcaatgttgtcgtaataggaatttccgttttacgaacaaactcgtaaagtgcttcatgtccaccggagtatacaactcctccaccagccagaatgaatggacgttctgcttcggaaatagcttgagttagcttgtctagttgaattttgttgggtatcactttcgggttataaccccgcatggtcacaggttccgtttgtggaacaaacaacgtctgggctgcagaaatatccttcggaatatcaatcagcaccggtcccttgcgccctgtgttggcaatatgaaatgcctcatggatgattcgcggcagatcctccacatctcttaccagatagctgtgcttcgtaatcggcattgtaattcccgtgatatcggcttcctggaaagcatccgtaccgatcagggaagatataacgttacccgtgatgaccactaacggcaccgaatccataaaagccgtcgcaataccagttaccaggtttgtcgctccaggtccggaagtcgcgatacagacacccactttaccgctcgcccgtgcataaccatctgccgcatgaatagctccttgctcgtgacgagtgaggacatgcttgaaatccttaaagccatacatggcatcatagatataaagcactgcaccaccaggatatccgaagacacaatctactccctccagcaacaggctacggagtaaaatttccgaacctgtaatcacttcaggcttcatccacttttcacgtaattcattggttgacctaacttcaggaatttgtgcactcattggtcatcctcctttacaaaatttacatacatctgacatttgtaaaaacaaaaaaacctttcatccctagaacagacttgctgttactgagggacgaaaggctgtagcttccgtggtaccacccgtgtttgcccgatatttcgcaatatcgaaccttggcaggtacagaaatcacaaaggatctccatatctggcgtctgtaacgtagaccgtacgattttccctaataggtgattcagcgcaccgttaatatcatcgggcccaaatacttttcaggaaaacagctccaaggtgagctcgttaaaaagggattttggtgaagcttgcagctaatgcctcactctctgaacaaaagagccctaatcacttcgtcctcttcattgccgttgagttcatgtcattctttcaaatgtttagacacattatatgtctctcatctgggatagtcaatacccatatttcataaaaattcatgtttcttttctgaagcacctcagagtcgcacgcttgtaagaggtacccgcatattataaaaaagaccacacggtgagacagtgcactcctccaaagccacgtcttatcttggtaaaagggtagaaaaggaggcccgtttatgattcgaaagcgcagctatcaagatgacaccattatctttcgtctcatcgagcaagagcttgtccccctatcgcatttaagtgcccaagaaatggaacaaatacgcaaagaattaccccggcgcttaaaccggggcatcacttttgtggcttgcagaccggataatgcacaggttgttggcttcattcatgttatgctgcatggcgaactattatacattgatttgatcgcagtctcttcggctcatcaaggtatgcgatacggaaaaaaactgctggagcatgccgaacactacggacgactgcgtcgctgcaagcgggctaaagttatggtggacgaagacaatatcagggggatccatttttatctgcgtcatcaatatcaaatgctgcgctacgtagctctgagccgatgccacgaactcgaaaagtcactgtaaaaagtatctttttcgagctcaagattttgtatgactaaaataaattagggtaatacggatatcctactccggggtaccccccgtctgtatacggacctggctgcggaccatatcctggtcctccataacctggaccgtagccaccatatcccccaccataggcaccaatgtatggagctgtgccgatggcaagcaagtcaaacagcaccagaggaataatcgccttcgtgtttacttttttcttgcggtttggttgaagaaccagtcggttacccgaaatgcgaatcagcttgccgctgacctgggaaccatccttgcgagtagcaaagatgactttgccaacaagcttctccacctgctttctggttactgcctgtttcatcgtatttcctccttctttctcaacggatggacagattgaacggctccttgatagctcatcaccaccacaaaatagaccggagctgacaggggccgagcgtcccgtccaatctgcatagcacagtctattccattcatgccagtggcgtatgtttaaatgcctgcacaatataaaaaaatctggtacctgcacatgcagataccagatttttttatacaccaatgtacattttcaaaatatacacatcagctgtttataagttttaacgcttgcttggatcataaagttgacccaaagcggccggagcacgtgaacgtccgacagccgctaccagtacaataatcgtcaggagatacggcaacataaaaataatttcctggggaatactttgggaccatgcgaacagctgcacatagttgcgaatggcttgtgaaaaaccaaaaaacactgctgcgccaaaagcgccgagcggattccatttaccgaaaatcatagcagcaatagcaatatatccctgccccgaaactgtattgtgcgagaacatattggttgtagtcagggtgatggtagctccaccaataccagccaacgccccactgatcataacaccaatataccgaagacgatttactttaatacccactgtatcggccgctcctggatgctccccaacggaacgcaaacgcaagccaaacggtgttttatacaaagtaaaatagccaataataactaatagaatggctaagtatgtcgttgggtaagcttggaaaaaggcttttcctgcaatcgggatatccacaaggtaagggatggatatttcgttgaaaccctgaatccgacctgtgtcaccatcaccctcaaataaaagcttgaccatgtacagtgtactacctgctgccaaaaagttgataactataccacttattacctgatcggctttaaacgtaatagaggctacagcatgaattagcgaaaccaaaataccgaacaccgcagctgacagcacacctacccaagccgcagaggtgcctcctagtccagcttgctcggcataaaatccgccaacacccgctgcaaacgctccgaataccataagtccttccaacccgaggttcgttacaccggatttttctgaaaaaactccgccgagagacgcaaaaataatcgccgtcgcaaaaacgagcgttgtatggattaattcaccaagtgttaaccaactcattttacaacaccttctctttcttccgcttggagtagagcggcttcacaacccaacgtacaataccttgggccgcaatgaagaaaataatcgagccaatgacaacccggataatttcgggcggtacatctgcgctaaagctcatccccgcagaaccatacgtaagcgttccgaacaaaacagaaccgagcaacacaccgaatgggttattcatcccaatcagggctacagcgataccgtcaaagccggttcccggtgatcctgccataacagattgataatggaatactcccagtacttcaaaggcgcctgccaatccggcaaaaactccactaatgaacatcgcttttacgatattacgatttacattcatacctgcatagcgggatgcatcctgattaaatccgacagcccgaagctcatagccttgctttgttttccacatgaaaatgtagaaaaagactgccgccagcacagcaataaccgtaccccaatgtacccgagcattccccatcatctgggacagccattcgatggaaattgaagcagaaggctgaatatcgacagaacgattttcaccatccataagtgcgaactgattgatcaccaaattagccaaatacagaccgatccagttcatcataatacatgtaataacttcattcacgcctcgtttggccttcaaatagccagcaatcgcagcccacaggcctccgaaaactgcacctgcaatcacagccaacggtgcatgtatgatagctggcaacccatggagtttaatgcccacaatcgaagcagctgtcatacctaccagaaactgaccttcgccgccaatattaaacaatccggcgcgggccgcaaaagcaaatgccaaccccgttaaaaccagcggagtcatctcacggatagcctctccaaagttataagaatctccgtatacacggctaaacaaagcagaataggccacaatagggtcatacccgccaatcagcatcacaatagcacccagaaggagacccaaaataatagagaccagcgccagtacaaaggagtcttttgtgaatattttcaatagattagccattctctactcctttcttcactgcacttcctgccatcatcagtcccagttcctggtcattcgtttcttctggcagcacttctccgacaatcttgccctcatagatgacagcaattcggtcggatacattcataatctcatccagttcaaaagatatgagcaacacagctttaccttggtcccgttgggcaatcagttgtttctggacaaattcaatagctccgacatccagaccgcgtgtaggctgtgctgcaatgagaaggtctggatttttatcaatttcacgcgcaatgatagccttctgctggttcccaccagataatgctcttgccttcgtgtgaatatccggtgtccttacatcaaacttttcgataagacttttggcctgtttctctatagcatctttgttcaaaaagccatttttactgtaaggcgcctggtaatacgtctccagcaccatattttcactcatagaaaaatcgagcaccagcccatgcttatgacggtcttctggtatatgggaaacgcctgcctctgaaattttgcgcggtggctgattggccacctcttgtccgagtaaacggatgcttccgccatccaccttgcgtaagcctgtcagagcttcaatcagctcactctgtccatttccatctactccggcaatccccaaaatctcgcccgccttgacctgcaggttcaactcatttagaacattaatgccatccttgtttttagaaattacattgttcatttccagtactgtttgtcctggttgcgcaagctgcttgtccactttaaaggacacgcgacggcccaccattttctcagccagctcatttggtgttgtttcagacgtcttgaccgtatcaataacctgacctcggcgaatgatcgtaacggtatctgcaatttgcatgatttctttaagtttatgagtaataagaataatggatttgccttcagcgaccaagcgcttcataatatccagcaactcagtgatctcctgcggtgtcagtacagctgtaggctcatcgaaaatcagaatatctgcaccgcgatagagcgttttgataatttctacacgttgctgcataccaacagatatatcctcaattttggcattcggatttacctgaagaccgtactgctcagacaaccgctgtacttctgcggcagcctttttataattgattttcagacccttacgtggctccgagcccaggacaatattttcggtaacggtaaacggctgtacgagtttaaaatgctgatgcaccatgccaatccccagatcaatcgccttatttggactatcaatctgtacgggtttacctccgatttcaattgtcccttcatccggctgatacagtccgaaaagaatattcataagcgtagatttacccgcgccattctcacccaaaagggcatgaatttctcccttatgcagcttgatgctgatggagtcgttggcaacgatgccggggaatcgttttgtaatttgctttaactcaacgacgggggtcgctgcatccatgagatcacccttatacactttatagtatgtgctccaatgagctgattttgcccgttataatccatataactccagacgtaagaacaaggctagtcttatgaaccagccttgtcgctacttctatgttcttcaagtcaaaacttatttcgaagggactgtaatttcgcccttaataattttttgcttgtattgttctacaagatcaagcacgtctttaggtacgtttttcgttgatgtgtctgccaaaccaataccattatccttcagagccagcgtctcgacaccgcccttaaatttaccatcaattacttctttagatacgcgttttacagcttcatctacacgttttaccatcgaagtcaatgttacgtcgtcaccaaactcaagcgattggtctttatctacgccaataacccatacttgctgaccttgttgcttacgtgcgagtgcttcattaaatacacctgtaccagatccgccagctgcatggaaaataatatccgcaccgctgttatagatcgtcgcagctgctgctttacccaggtccggcttatcaaatgcacctgtgtagttaacttccaattttgcatttggatttacagctttaattcctgcttcgaatcctttttcaaaacgtttgatcaatgggctgtcttgtccacccacaaaaccaattttgtttgttttggtaagcttaccagctacaacccccaccaagaaggaaccttcattttcagcaaaaacaaccgattttacgttaggcgcatccacgacactgtcaatgatcgccaaattcttgcttgggttgtctttcgctacttgtccaatcgcattcgccagattaaaaccgattccccaagtcaggttaaaatcacccttaacaaattggttcaggttaggaatataatcttgatcggatttactttgcaggtatttaactttaacgcccgattctttctcagtggcttgtagtgcctcccaagcagattggttaaacgatttgtcgtttactccacccacatctgtaaccatgccgatttggacattcgatgttttggcagaaccacctgtgtctccaccatttgcgttggacgcaccttgatttttgttaccgcagcctgcgagaatgaccgagatcgccagcagcataaccaaagacatactgaacattttcttcatgctgatactgttcccccttagtgttagatccctggactgtctcttttctttgaacatgtacatgctcattgcatgtcatttactgacgagacagatcgtacagaagacttactttagagattatacaattatgatcggctaaaatctagacaattaataaccttgggtcaattttttttaaaatctcatcaatgtaagcgttacaaagttaaaaaaaacatacattcttccatctcacgtcatatttattcgtattttggagaaaacgaagtcttttccgtaacattgagtatgtacaaaaaaaggcatccctacacagcgtactgcttgggatacctttttaccgctttcgcggtttccacgccttcattattaataattaagcgttgattttgcctttagcaacagttgccaaagagttgaatgcattaatatcattgactgcaagatcagccaagattttgcggttaatgtccacaccagccaatttcaggccgtgcatcaatttgctgtaagacaaaccgttcaaacgagctgctgcgttgatacgcacgatccacagtctgcggaagttacgtttcgtctgacgacggtcacggtatgcgtaaacaagcgatttcattacctgctcgttagctgttttaaaaatgcggtgtttggaaccaaaataacctttagcaagcttcaatacttttttatgacgacgacgaacgacgaatccgccctttactcttgccatatcaatagacctcccaaataatgtttatacttcattcattgcagtgctagtgctatttcaggttagcaagaccttgtttcagacgcttaacgtccccaggtgccatctcagggttagtacccagaacgcgttttgcacgtttggatttgtgggaaagcaaatggtttttgtaagctttgtaacgcattactttaccagtaccggtaattttgaagcggcctttaagactgctatgtgttttcattttaggcattgaacttcctccttaatttgtcattgactctttggagccaatatcataatcatgctgcgtccttcgagcttgggttggcgctccacggtacaaagatcagcaacttccaatttcacacgttcgagaattttttgacccacattagcatgggtaatttcacgaccgcggaaacgaacggagcatttcaccttgtccccttcattcaggaactttaccacattgcgaaacttggtttggtagtcatgttcctcgatgttggaacggaaccatacctctttgatgtcaacgatcttctggtttttacgggcttccttttctttcttctgttgctcatagcggaatttaccgtaatccataatccgacacacgggcggcttcgcttgaggcgccacgtttacgagatccaagtttgcgtcaatcgccatttgcaaagcttcacgcgtcggtgtaatcccgatttgttccccattcgcaccaactagacgtacttctctcacccgaatctcatcattgatcatatgttccttactaataaccctccacctccagaacctgttattgttgtattgtgtttaagcacaaaaaagggatgacgactatacagccgacatccctgtctgatactcaattcatcatgaaagttcaattcacaaatcattggatcatgaccagccggcaataccgggcaggtgagaagtcggaccttctacttgttaatccatacttttcaattaacatactcgaatatcttatcacggtgcaatcgaggtgtcaacactttaatagaaaatgaatgacaccgatcttcagtcctatttcaccgtccaattaaccttgcttgctctgaacctcttccaggcgaacgacacgcgtgtgctgggtatggctccattgcttgttgttctgtgtaaagaacgcatagaacgtaatcggataccacgagaccagatataccgggaatagcagcaggtacagatatacttttttgaacgtgaccttttccaaaatcatcgcgatcacaaaggtagtaatattcagacccacagctataacaccagtccaagccgggaattgtacataaatattttcgatattaggtccaccaaataacgctatatctatccacatagctactgtcatcaagaaggtgagcagtacgatatacacgtttagaccataaagagccatatcgaatttaatcaggcttctatgcttgatactttgccacagcaacgggaagaaataacgtcgagcaaccgtgaaatgaccttgcatccagcgcagacgctgtctggacgaagctttgaatgtcaacggcttttcatcatataccttggcatcgtaattaaatcttggatatacgttgcgttgtgtgcagcgcatggtgaattccaaatcctctacgagacttgttgcaccccagcccatttccttaagcagatttgtttcaaagcacatgcctgtaccaccgaggaaattagccatgttcagattgtgacgtgacagctgccacaaacggttgatgtaccaataagataccccgtatgccgctgtaatccaagaatcctcaggattcttagtatcaatgtacccctgaataacacgggcacctgtgcacagatcattgttcatttcactcaagaaattggtatgcgccaaattgtcagcatcaaacatgacaatggcatcatattggcgcggcatagcccataattccttgagcatccactcaatagcgtagcctttaccacgcagatttggattcgtacgttcacaagcattcatgccatgagcgcgaacaatatccgcagtcttatctgtgcagttatcacagattacgaacacatcgtaaagttccttcggataatcaagttgcttcaaattttccatcaatgctccgacaacctgttcttcattgtgggcagcgactaaaatggcaaatgatttttctggagccgcgtgctctttccttttcttgcgaaccaatccgaacaaggagaatgcaaactgatagactgcgatcaccgccagtatgacctggagcgtcacaaaaatagcgtctaacatgatctcttgttacccccttttttataccccttaaaatcttgcgtttgtttgttttctatctgtgtagcgcaagttgcggcgctttgcgcgccttttctgtagtttttgacccgacccttgctttcttcattggctgtgcgcagcccccttttggctgacacaggaatgccattacgattttcgttggttttcaatcttttgtcaaagcccttaaaccggtctcagcagcaaaaaaacacaacaaactcccgtttgaaccgggaatgcggcgctggtcttctcattgatgacgcttaggtcttattttcatccatttgctaactttttatttctttggtccctcctttttgtgggccaattagcaaccacttctaaacactctatcttattagacggatgaacgcaaagaaagttatacaatttggcttatattccattaacatttttgtgtaaaattgaaccaagtaagttatgaatctttagtgattcttgaaatgaacagcgtttaaaaatatgatgagagcaagagaataattacttatggtctgattatgtcaaaatgactcaaaatatttgccgactgacctgaaccggcaaccggaggaaaccaaatgcaacgtctagtcgtaaaacttgtaaatctggagcagcagttgttcaaatggatcaacggacgcttacacaaccgttttttgaacttctggctttattatctcacacatttaggcggggctacctttactatagcctccacactccttatttggtggctcgctccgaatccgtggaaagataccggtatgaagggagccatcgctctcggggtcagtcacatccccgtagctatcgttaaaaagctgtacccgcggattcgcccgtatttggcgctaccaggtacaaatacattccgcaaccccttgtcggaccattcttttccctcagggcacacgaccgctattttttcagctaccgtgcctttcatgctacagtcaccgatgctaacattgctgctgttgcctgtagcgacaattgttggtttttctcgaatttatctgggtcttcactacccaacggatgtactcgcaggagcggtcatcggaacgtctgcagcaataggaacggttgcattctggccttaaagccgatatggtatgattgagaacatcccagcaggaacaggtgaaatgagagtggctaaaaaacgagtgttattattatcggaaggtttcggtgccggacatactcaagctgcctacgcgctctcaagcagtttgcggaagctttctccgaatgtgcagaccagagtgctggagctggggagttttttgaatccaagaatggccccgcttattattacagcatacaagaagactgttgtatcgcagcctcgtctagtcggattggtttaccgtcatcagtacaaaaaatcattaaaccgtcttacaacgctcgctttgcaccgtctgttctacacgcagacccgaaacattctccggcagcttcgtcccgatttggtggtatgtactcatcccatcccaagcgcggtaatttcacgtttgaagcgcttaggcttacatgttccgctttgtactgtcattacagactacgatgcacatggaacatggattagtcccgaggttgaccggtactttgtatctacgcctgaagtcatgcgtaagctgcgcgcacgcggagtatccgtctcgaaaatccaggtgaccggtattcccgttcatccaaatttttgggaacatcctgggcacgatgaaattagagaacaatttggacttaaacccatcccgaccgtactcgttatgggtggcggctggggccttatgaatgacgaagtcatacatcgttcgcttactcagtggagagataacattcaatttattttttgtttggggcataatgataaaattcgtcgtaaaatgcagttggatcccaggtttaatcatccaaatattcatatcttcggatttacacgggaaatcgacaaattaatggaggtatcgaatctgctcatcaccaaacccggcggaatgacatgcaccgagggattggccaaagggattccgatgctgtttcacaaacctctccctggacaggaggaggaaaattgtcaatactttacggctcaaggcttcggagaaccgattacttcgctagatgttgtcgttaaatggatgaaccgactgctacacgattttccagaaatcgtccgcaagcgacaggagcacgtccataatgtagcgcgatattatcctcttcagagcgcacagagtattttggatatactggaaccgaacagggtgctttcctaataaggaagcaccctgtcttattctatccatttgatctgtttttatttcccgtacttttcaaggcgtgtttttccatactcttccaaagcatctttgccgatcagcacctcgactcgatgaatattcatacctttgcccataaacttttgttcatattccgtcatgacatgctcctcgttaatcccctcacgatgaaggtttaacgaaatattcgtcatctgcaaaccactatcggcaaacgaattcagagaaaactcaaacagtgtctccgaatcggtcttaaaatgaatttgtcctttgctgttcaaaagctgacggtacttgtccaaaaaacgcggatgcgtcaaacgacgacgtgcatgtttggctttaggccagggatcactaaaattcagataaatgcgttcaatctctcctggttcaaaaacattttcgatctgttcgatgtttgccagtgccaatttgatattaggcggcgtatcaacctctgaattactccaggccagacgagacttttctgttgcacggcgaaccagctcatcatacatatcaaagccaatatagttaacctctggattccggaagctcatttggcttataaattgccctttacccataccgaactctacatgaatgggacgatcattaccaaaaagctgctgccatttccccttatactgtgctggctccaagatgactaggtcctgctgttcttccagactttcccgaattccttttcttccgcgtaaacgcatgttactcctccatatactctgttatcaaggaaaaaggaatttcacccccgcttgaagatacggaaatgaaattcctttttcaatatatttggattggggtccaactaatttaattgttcatagtctaccccatcagcaggtgaaaaatcaattgtcttttggcaagccgctctgattttttgacgtgcggtcgttccaatctgacgatcctgcccaaaacggacaccagtcaatgccaacgcctcatcaaaggttaactcaacagtaactttatccatacgcgtcttatcctgcgcattcataaaagatcacctcacgggttatttgtgatggaaccgacgtgcacttaccctaaaacaggcgatagaaacagcaaagctgcctccctgaagaataatcattagcaacggataacttttatcttcaggatcgaaaacagtccttttattgtatgtctggtaccgcttacaatataacacattgtgtaacctttttcaatccgcaacgccataaaatacgcacattttattgacttgttcggtcaaatgattcccaatgaagactgatttttgttacaatagggtgatcgtaaaaaaaggagtacacccatgaaaacagatttattgcctgctcctctcctgtggggagataaacggttccatacttggaattacgaaatgcgtgagcaatttcaaaataaagtgttcaaagtcatgctggatgcgggttttacctgtccgaatcgcgatggctccatcgctaaagggggttgcaccttttgtagcgcacgcggatcgggtgattttgccgggcgtcgtcgtgatgatctggtcacccagttcaatacgattcgggatcggcagcatctaaaatggccaaacgccaaatatattggctatttccaagcctacacgaatacgtatgccccggttgaggaactgcgagaatacttcgaagttattctggagcagcccggtgttgtcggtctgtccatcgctacacgtcctgattgcctgcctgacgatgtagtggattaccttgccgagctaaacgaacgcacgtacctatgggtcgaaatgggtctgcaaactgtccatgaatcgacctcagagctgattaaccgcgctcatgatactcaatgctatctggatgcggtggaaaagctgcgcaagcggaatatccgcgtgtgcgcccacatcatttatggtctgccccaagagacccatgaaatgatgctcgatacgggacgggcagtagccgctatggatgtgcagggcatcaaaatccacctgctgcatctcatgcgcaaaacgcccatggtcaagcaatatgaagcgggattgctacgctttctagaaaaggacgaatacgttaagctgatagttgatacgctggagtttttacctcccgaaatgatcgttcatcggttaaccggagatgccccacgcgatttgctaatgggacccatgtggtcgcttaaaaaatgggaagtgcttaatgccattgatcatgaactgaagtcacgtgaaacgtggcagggaaaatactggaggcaaccttaaatggggttcctatccgtcctgagctacgctcatcaattggtggctgcgcgggtgcagccaggcgatactgctatagacgccaccgtcggcacaggagcagatacgttgtttctggcaaaagctgctggtaaacggggccgtgtctatggcttcgacatccaacaagaagcactccattgcgcccgtcgtcgactggaagaaaatgcttctccttcattagcagaagtatcgctactgctacaaggtcatgagcaaatgcgggaggccgttccggacatgctgcatggcaaagtcgctgcggtcatgtttaacctcggctacttgccttccgaaggcgccgatcctactgtcatcacccatacagacagcacgctcgtcgcacttgatgctgccttacaattgctgcgaccacgcggcattctgactgccgtgttatatccaggacacgccggaggcagtgaagaagcagatgccgttcttcaatgggcttctgctctcccggtctccagcggtcaaagcattatttatcgtcaactacaacgagccgcttcgccttacgtagtggcggttgagaagaaataatgacgaattttaaactcaggttatgagcggcttttttagccgccttacatatattattttttagctcgtttgggcactattcatcccagtttattgccccagcggcacgttattgatttccctattctgttaggtcgcactcattactcattatggaggagagaaattatgctaaagccatacccgctgcaatttcaacctgagttcaaagagagagtttggggaggacgggccttagagcaatttggtctaaccccaccagaaggacatatcggggaaggatggatgattgccgatcatccaaacggaacaacaacggttatcaatggtgagctggcaggcaaaggactggatgaaatccgcgagacttacgggcaggattggctgggggccaagggtgtatcggaaaaaggcggacgattcccacttttgattaaactactggattgtaatgatgacttatccgttcaggtgcatccgacagatgattacgcaggacttccagccggagaattaggaaaaactgaaatgtggtacgtgcttgatgccaagccagatgccaagattatttatggtctgaccgaaggtgtaacccgcgagagtctgcgcacagctcttgaaagtggggatatcctcggcagtttgcgccaggttccagtcgaagcaggcgatacgttcttcatccccgccggaaccgtacatgcactgtgtgcaggcgttgtcgttgctgaaatccagcaaaattcggatactacctatcgcttatatgactacaatcgccccggactggacggcaagcctcgtgagttgcatatcgaggattccctcaatgtaacctcctacgaaggtgcaggcgcaacaacgatgaaaacggacggcttacagcctggtaaatggctccagttggcagcctgtgagtattttgttgtggaaaagggtatcgtagaaggaagttgggcactttctacaacggaagacagcttcaccattctcgtgatttgtgaaggcagtggaaccataacatggaacaataataccgagtctctttcctgtaaagctggggattgcttcctgttgcccgctaacctgagcggttacacgctgaatgacggaatgaccgtacttagatcttatcttccttaaagcttaaaggatgtgatgtctaattatgcgggaatacaccttcaccatcgctgaaaatgacggaacagagctttttgcctaccgctggctgcctgatcaaaatttgcccattaaggggattgttcaaatttcgcatggtatgtgcgagacgtcctatcgctacatccgactggccgaaaaacttactgcttgcggttatggcgtgtatgccaacgatcatatcggtcacgggcgcacggctggtgatcctgataagctgggtatgccgggagctaatgcgtttaatcgaatggcaaacggcatgctggagctaggcgaaattgcggctaaggaattccctgatcagtctcgttttttgctgggtcacagcatgggatcctttttaacccagaaaattatgtatgatgatcggcaaacgtatcacgggtttattttatcgggaaccaacggacgacgtggtctcctaaaactcggagagcaagttgctctactgcaagccaagctgcaaggaatggatcatcgcagcatgctgctcaacgctatggtctttggcggctttaaccgcgcctttcgtccggtgcgtacggcgttcgactggctgtcccgtgatcctgaggaagtagatcaattcgtgcacgacccattatgtggagctatatgtacgacaggcttttttctggattttttcaggctattacaagaaatccactggccttcctcgctgaaacacatcaatcccaaactgccagtttatatttttgccggggatcgtgatccagtgggtttgttcggtaaaggtgtgttatcactagtggaaatgtatcgaagcctagagcttcaggacatcgaatatcgcctctatcctgacggtcgccatgagatgcttcatgaaacaaaccgcgacgaggtgatgagtgacatcgtggactggctcgaccgtcatgttaacacaggggtgacctctgtttccgcattgtctggagactccgaggcacctggacattcaacctcgcccaagtcatcaaccttgtaaagaaataagaaaagaaacctttaaaaccacgattaaagtgggaactgaccccataacgt

SEQ ID NO: 2610 - DNA, 208407 bp, Unknown
  Kingdom: Bacteria, Phylum: Firmicutes, Class: Bacilli, Order: Bacillales, Family: Paenibacillaceae, Genus: Paenibacillus
acaaatggggtgcagttcaaagggatgggctgccttttgtaattaacgggctgacaatagggatcgttgcaaaattcaatttaaaggagagatatataccttgtctaaacattcttctcatcgttcgatggggtcgttacaaccacattttgcaaccactactgaagtgagtaattttgttaatctatggggaatatttactgtgaatggtcaacagatcgttgcttaaaggcatcgcctgtagatgcacgcgatgccttttgggttagccactggcaacttcgattcccctaatgcttaatcctctggctctgaacatacatattaggctttgctggccatgtctgcaatctggcgaagccacttcttacgcgtattttcatcagattggggtaccgactcgaaaaatagatgatacatgatatcaagtccacaatattcaaatatgcctttgtcagacgtcaagcgaagggcttgatccataccattgctggcatattccgcatgtgattttccttgtgtattgaggataatggctttcttacccttgagtaatcccatctgcactccatttacatatttataagcaaatccgtaagagaatacgcggtctatataccctttcataatggctggcatccccgtccaccaaatcggataaataagggtgattacctctgcccattgcaaaaattcctgttcccgtacaacatcttctccgattccttcaatgacctcgctgctgctaatcacaggttgaaagttgattgcatatagatcacgaacaaccacatcatgtcctttttgcttcagcccctcgactgctgtggtcaaaattgcatgattaaagcttccctcggatgggtgtgcgtaaataataagatgcttcatgttctctcctccatttactttaaaataagtgattgatcaattacttaacttcgtactccttcaattaactgaatatgctcaatccatagttccgataaagatacttcagtaaacttgagcggtatcctgctcatgaatatcacctccgttgcttgttaattcggttagtgattgatcaattactaatgaatggcctcagtatagtttattcctttttactttgcaagtgctttttgttcaacttgtcaaaaagattatttaaagatctgatcccaaggcagtgttattatcgctgttcaaagaaaataaagtcccccagttgatgcccattagggtgtgatgtagagcaatcacttaatatgactttataatgtcatgttataaggtgtatgctaccgagagaggtgaagcgtatgccgttaagcagacattttgaaatcgtttatatgttactccataagaaaaaagtgactgctgatgaattggcagagcattttgaggtttccacacgaacgatttatcgggacatagataccttaagcgcagctgggattcccatctacagcagtagaggcaaggggggcggaatatcattgatggagggttatgtctttaacacctctttactgtccgagcaggaacaagatgatatcttaatggcacttcagagtgtggctacagctaccatcccacaggtagaagaagtgctaaacaagttgagtaggctttttaaaaaagacatgggaaactggatcgaagtagatttttcgccatggggaagccaaaacagccagagacagctattcactcttatacgcaacgcaataatcacaaaccgtgttataaagttccgctattataacgtcgccggggaacagagttatcgtagcgtcgaacctgccaaactcttgtttaaagataaatcctggtatgtggaaggttactgtttaaataccgaaagtcatcgtgtatttaagattagccgaatgaaagagattgcagttaccgaaattagttatgagccaagaacagtcgtagcatctacagatacaaagatgaacgacttgcttcataccattgaagtaactcttcacatttctgctcaaggagcttaccgcgtatacgatgaatttgccgagaaaaccattactcagaaggaagacggctcttataccgtcacagcacaatttcctgtaggcaattggctggacagttatctgctgtcctttggtcccctccttatagaggttagccccgaacaagtacgtacaagaatattgtctcatttagaaacgatgaaaagaaatttaaatggccctctataatatgacaccatgtagtcatattattactgctatgatgagtttgaagttatcgctcacaacatactcaccataggaggttgaaggatcaatgaatccacatagaaccctgccacccgcagtagaaacttactttacatcagcgaataaatcccagcttgaagtacttacttccgctttcgataaagatgcgttgatcttggataatcatcgtgaaatcaaaggtatggaagccataaaatcatggtgtgaagcagaaatatcggagccgaatgtcacctttgagatcgtggatatggatgacagtaataataccatcgtcataattgcgaaagtagacggagactttgataaatcaaatctccccgatccactcctacttaaacatcaatttctagtaaacaacaataaaattaaagaactgattattacacttccataaaggtattaaaaaaataagaaagggacaacgaatatgcccgcttatgttgtttttatacgtgaacagagtaccgatcaaactgaactccaactctattctgagttggcaccggcaggtttggcgggacattccgtcaaccccctagcaatgtatggcgcataccaagttctcgaaggacccgctattgaagggctggccatcttggaatttcccacttttgaggaagcacaagcttggtactttagtccagcctatcaaaaagccctaaaacatcgactgcgcggagggcggtaccggggtgtcattgtcgatagtttgtaaggttcgcaagacaagtgaactcgaagtggagatacctagaggtatctctcaaccacattgtagaatttaggaggaattattcgcatgagttttcaattagaaagcattttaagtgagtttaaaggcaaaagggccttggtcacaggcggtaccaaaggaatgggagaggctattgctaagagacttacagctgcaggtgctaccgtaataactacggctcgaactactccagctaatttagaaaatccagacctgtttattccagccgatattagtacgcctgaaggtgtagataaagtagtaaacagtgttcttgagcgcctaagcggtgtagatattcttgtcaacaatgttggaggctcgtcagccccatccgggggagctcttatcttgacagacgagcattggcagcaaacttttaacgccaatctgtttgctgccgtccgtttagaccgtggactgctgccggctatggtggaaaagggttccggtgttataattcatatttcatctattcaacgtcgcttgccgctatatgatgcaacattggcctatgctgcagccaaagcagctttaactacttacagcaaagggttatccaaggagttttcgcctcaaggcattcgtattaatacagttgcgccaggctttatcgaaacgaaggcagcacaaagtttgattgatcggattgctgaaacgacaggtgaccgagaaagtgcattaaagcaactgatggactcgttgggaggaattccaattggtcgtccaggactaccagaagaagtcgctgagcttgttgcttttctggtatccgaccgggccgcttcaattacaggaagtgaatataatattgacggtggaacagttccaacggtctaaaactttattttcatctgacaatagcgcaaaaggtgaaaaaaagcccatctaatgagcagacatacgcaaaacgtattatctatgtccatcagataggcttttatataactactaccgtttaataacgaccagctttgtttccagcatctcttccatggcgtactttacaccttcgcgtccagtgccgctttgcttcacaccaccatacggcatatggtcaacacggaagctcggaatgtcattaattaccacgccgccaacctcaagcttgtccgctgcatccagcgcggtcgtgatatcacgcgtgtaaattcccgcctgcaggccataaatcgaattattcacatggtttacagcttcatctatagagctaacagaatgaatcagcacaagcggggcaaacacttcacgacaggacaccttggcagtcgggtccacattaagcaaaaccgtcggctccaaaatacctcccttggcttggccacccagagcgatccttgcgcctgcttgaaccgcttcttccagccactcacggacacgttcgacatccttggctgaaataagcgcggatacatccgtgtccggctctagcggatctccaatttttaaacgttgagttgcttctataaaacgggatacaaaggtatcatacagttcatcaacaacgtaaatacgctgaaccgatatgcacacctgtccctgattggcaaaggctccactcacacaacggtcgatgaccgcgtccacatccgtatcacggtcgataataacggccgcgttggaacccagctccagcgtgacccgcttcaagccagccttggagcgaatttctgtaccaaccgccgggctaccggtaaaggtgatatagctgacgcgtgaatcagtgacaagtacgtcgccaatggttttaccatcgccgctgatcacgttaagagcgcccgcaggcaatccagcctgctccagcagctccgcaatcaagtaagccgacaacggcgtctgctccgcaggctttaatacgaccgtattgcctgctgccagcgcgggacccactttatgagcaaccagattcatcgggaagttaaatggtgtaatagctccgactacccctacaggttctttgagcgtgtaggccatacggccctcgccgcccggtgcggcatccaggggaatggtttccccgtgaatccgtttggcttcttcagctgcgaacttgtaggtttgcaccgtccgatcaacctccgccagcgcagccttccatggtttggacgcttcacgtgaaatgatgcgcgctgcatcctcacgccgctcttccagcaggttagccagcttctccaaaatggctgaccgctggtgtgctggcatggcccgcatctccgagcgtgcatcagaggccgcttgaatagcagccttggcatcctctgacgtggcctctgccacctcagcaatgatttccccggaatacggtgatttcaacgtcgtgtacgctgaagcagctttccattctccaccaataaataaatgctgctgcatgctttccctccttctcttgatatcaacgttccttttaccatctattttaccgtcaacaccggacaaggtgcatgctgaatcacctgatggctcacactacccagtatcatttcggaaacaagtcctttgccccgcgtccccataatgatcaaatccgtcttttcctgctttgcactttcgcaaatgacactggccggatcaccgtgacccgccagcatacggtaagaaataccctcgtccttcaaatagtcggatgcaggttctaagatatgacgaccttcctcttcgatccgctcatccacatcaaccccaaccggcggctcattcatggataaagccgggtttacatgcaatacagtcagatgcggattcccctgaagctgcttagacaacgttttggctgtctccaacgccttcatcgcgtgttccgaaccgtcaatcgcgactagaatatgtttgtactcgctcatactctgttcctcctcagaagtccaattttagtgtgcatccacttgaatatcctgcatatgtcgacgacgtacgatcagcacagctacaccaatcagtaccatcaatgctccaaaataaaacggggtttctgctgagtaccactctgacagcttccctgcaagccacggcgaaattgccccgcccaaaaaccgcatgaagctgtaggccgcagatgctgtcgagcgctccactggagcagcctgcataacagcagttgtaatcaatgtattgttaattcccagaaaaataccagctacaatgacggcgacaatgacagtcgttggcgaaccagctatcgtcccaatcgccataacacctaaatcaatggcaaacagcgtcagcatgatactaatggaagataccacgctcaagcgtgcttgaatcttcggtgctacaaacaccgaggtaaaggccagcataattccccagccaaaaaacacataacctaaaccatgctcgtccagattcataacatatggagaatacgccatcaacgtaaaaaatccaaagttatataataacgctacaataccgagcgtgagcaaagccggataactgagcgctttgaagggatcggtaatggaaccgcgttttttgggctttggaatcgaaggcagcataaacgtaatgaacaaaaatcccaccaccatcagtccggctacaccgaaaaacggaccgcgccaggaaatggaacctaactcaccgcccagcaacggacccactgaaatcccaaggcccaaggccgcttcatacaaaataattgctttagctgttccagaagtggacagacctacaatcgcagacaacgctgttgcgataaacaaagcgtttcccaaaccccagcctgcccggtagcccacaattccgccaactgtattggctgtgccgcccagtccggcaaacacaataataaacaaaatcccggttagtagtgtccatttgacacccaatcgactagatacaacgcccgtaatcagcattgcaacgcctgttaccagattatagctggtgaacagcaatgacacttggcttttcgtagcatgaagctgatcagcaatggccggaagaatcggatcgaccaatcccagtcccataaatgaaataacacaagcaaaggcgactgcccataccgctttcggttgagacagcaagcctgagcgttcttttaactcttcaggtaatgcatgttgtgaactcatattatgatgttacctccacatctgaatgtaaatgttcttgttatgatgggtcgtgatcaagttcttcatccagaagaaccttgcgttcacgcaccctaacccgtaactcctccagctcagtctggagcatacggatgctgttgatttttccctccattaattccaactgttcgttcaatgtactttccatatcctccaacatggcccgtcgctcgttcggttgcaaatgctctgttcgctcgcgatattcctcccgctgacccttaagcatttccgctgcggacatgtaacgctgaagctcttgcaaggagaatccaagtacttccttggcactcactattttttttagtaaatccacatcctcctgcgaatacaggcgcatattcccttcactgcgctgcggagagggcaataagccgatttcctcataataacgaatggttcgcttcgtcagaccactttgcttggcgacctcatcaattttatacgtaaccatgacacccaccttatgaaaaagattatatataaatactacgactctataacgttaacgtcaacgtaaacttttatataaaaaagaaaccgcctctattggagacggttcctagtttggcttgcacggtcatagacccgagcatcggtgctcaagcccatgaatatcgctttagatgaaaatggtacgtgtgatgataaccaacaaaatgaagagtaccagaataacaccagtggaagtaaacatgttgtagccaccgccaccgcaacctctttctacttcacccatcttaagttcctcctccctctgtcgattacaacaaatcgcccgaaatcagattcatgagctacgaattagatgacgaatgctttggaaataataacgagcagaatgaaaagtaccagaatcgctcctgtagatgtaaaagctccataaccagcacctactccagacatggtgattcctcccttcatggtttacaaaagcatcttatgcttatgccatcattcatgatagggacaaatgccgcacctgccgcccaaatctaggttgggattgtatagtcctgttattcttcggacccgagcatgccgtgatacaggaggtttcgtgcctgcttggcaagcacagacggactttcacgtccaggtagcaatttagttaacgtcagccgttcaatcaagccgatcacgcattctgctgtcagttcagggtccagttcctcacggcaggagccccaacgttgcgccgccaacagatgctttttaatatgctcggccatttccgccttaatgcgcaccgagtctgccgcctggtaaaatccgacacgagtgatcgctggattgttagacaacacgcgaaaaatagcttccagaaacacttgtccccgtctcaaaatttcagcctcgctttggtctgggccaatcttcatgctttgtaccgtatcattcaccaaagtacgaaagctctccacaagctcctcatacatttgttccttgctttcaaaatgaatataaaaatccggctgcgtcaatcctgcacgtgccgcgatcgaacttaccttagtctgataaaaccccgtctgagcgaactcttcagcccccgcttccagtaacaaccttcgactttcccgacttctgactcctgctctcatcacggtcttgcccccttacgccacaaatctatcgtattataaagttcctttgcagtaagaacaatgggcttgaggatgatatatacctgtccttcaaaagtcctaatacagaaggactgaaagttttggaagggcatctgcctacaaggtataattaaccaatctgatggtgagcgagcaggaatttattacgctcagtgatgaggacaatatttgcgcatcatctcaatcgttgtcagatcatcatccagcccccgttgttgcaagccgtcgataatctgctgacgttcctgacctttgacattttgaccgaatttaaacttggcagtccattcctctggtacaattttgatcagagcgacccctttcaagcgtgaagcataccgagaatcgctggcatcaatcgtatcatacccgccttccggttgcagcttactcataaaaatggaaaaggccgatgctttttcttccaaatccactacatgctccgcatgaccacgcacggtaatacttttaaaaaatgatgtcgcaggacatgccatatgttcatccgtaaaataagacggaatgagcgcatattctttggcagctgaaaaagtaacccgattatcctctttcatccgttccatcttttctccagcacggctgccatgaatataaaaaacgccgtttccataagcgaaattcaagggaaccacacgcggaaaaccatcctcgctgttcatgcctaaaaatccgaaactgacctcgctcagaaactgctctatttcctcttgttctgccaccgtaaattcttttcttctcacattgaactctccttccatctattgaccaatgatacatttcagattatgttgaaaatggattcataaaaagatccaatatgaacgaaaatgagtggtccaatcgaaggagaagagtatggatattacgattgcttatcagcgtgcgcttcaaaagtatcatttaaaatatttggcattgtatcatgctcttcgtgagggaatcctcaatggttccctagccagtggtacgcgtctgccttccactcgtgatctggctgtgatgtatggaatttcgcgagggagcgttaaagaggcatacgatatgctgttggcagaaggatatgtagactcggcagtaggcagaggaacctttgttatgcaacagacagcgacgctgcccgacaaatttctaatcaaccagcagaaccaaaattcacctgtcgcaaaacaaaaagcccctgctctatcagcatggggacaacgaatcatgcagatcgaaagggaacgaaacttacagtcgtctcctgtttctgctacagatagagacagtgcgcaaccgcctttgatttctttccaggcaggagaagttgtattggagggcaattcacagatcgcatggaaaagcgcaatgactgccgctggaaaagatctgcaaaggccctcggctgatacgacgactgcacccgtgaacggtgatgaatggctgcgcgaagcgatttgccatcatgttggcagaacacgcggaataacggctaccccggatcaagtcgtattatgcagtggttccatggaagtgatcacgttattaagtcagttgcttattcatgaacaagatcgaattgtattggaaaatccctgttattccggcatctatcgtgcagttactgcctcaggcggacagatacatgctgctgaaatggatcaacatggaattgtcccacaggattgggattccaaattgctgtttgttacgccgggacgtcagtttccaacgggtgctgtgttaccattagcacgccgtcaacacattttgcaatgggcagtatccaaaggtgcgtggatcattgaggatgattatgacagtgaattccgctgggcaggacgacccattgaaccattaaaagcactggatcgcgcggaatgtgtcatctatgtcggttccttttccaaaagcatgttcagcagccttcgactcggatttgcgattctgcccgttgaattggcccaagcgctgacagctgccaaacgactatatgatcccctgccgcctgcccgcttggaacagcgcgcactggcacgttttatgatgcgcggcgactatgtacgccatgtgcgtcggatgactcgaatatacagatcacgctacgacgtgtttcagcgtgaaatacagcagttaagtgaactgtttcactggcatcagaacgattgcggactacatgcctatgccatctggaagcatgagtctgtccagtatcatcatttgatgcagacagcacgatttttcggagtcacatggcgtgatgccgccgattaccaactgacaccgggacctccatctgcctgctttatctttgcccatttaacggagcaacaaattattgaagggtttaatcgtctgcgccaggcatgggaccgtaataaaaatcagtaaggaatcccttatttaatcactagccccaaaaggcccacaaatgatgaagcctgatgcggtgaaatgatgcagccattcaaatcttctatatccacctgtagcccatcaaattcgcaatcgctcagatcaatccctttgagcttggacccggatagcatcgcttgatccagattgcaacggttaaaaaaggttttttgtagtgttaaatgatacagatcggcacttattaaagaacaatcttcaaaaccaacttgcttaaaattagcaaaacggaacatcgaataatcccctaagcaatccgaaaaacgaacgttttggagcctgcttctggaaaagtctgttccaagcaatttgcagttcctgaactctacccgatggataaaggaaccggaaaaatgaacattagacagatcgcatttatcaaaaatgacgtctgtccattcactttccggcaatgacgattccatgatcgttacatttttaaaagtcatcttctctaatgaaaccttaaccgcttccacattatccaaaatcatatcctctacagaccccatacgatattcgcctttggatcgtaaggaatacatttcttcatttaatacgggcaagtcgacaggaatcttcggcaactccattttaattttcataatacctctacctccacgattgagcgccctctaggacatttatatgaatctattttctaccaattctcatacatagggtagcaaaagtatttctcacacatatattaacgtagtgagcacgctcacgaacctttgttaggaggttgatagcatggcagtacaactatctaatcaagtgttctccatctctgtcggagattacggcgatctctcttccttatggctggtaggggacacttttaataccaactatgtcatgaacagctccaacgcacctaaacagaatacgtcggatcatcagtggctgggtgaactcatgttcacctatcgtctcgacaatggagcgtggactcgggcatggacaagtaattctgctgatgcgcgccagatcacctcttctggaaacagtgtccaggtagcctatcagaattcatcaaacaatcagggaatacgtaatttcattttacatgaaacttattcgttggttaacgattatttgcattggcaaatgaaagtaacaaacacctctaatcaaacgctggagatcggagattggggactgccgcttccgtttaacgagtactggtccggtggcaataatgaacaaatttatgaaaccagagtactctcacactcctttgtaggccataatagctcctttattaccgccggacgacctagcggcatcggaccgtatgtactgctaatccctgatgcctcaacgggtgctggtctcgaatatcaggaccattggagaactgaggagcatcccggcagcacttgggctatggagcaaggtggctggtccgaaggactgaatgtgttctatatccactccaatgtcatcaagagcaccaaccgtggttatctcggaagcaccagtctgtcgctggctcctggtgaaagcaaaacgtatgcctttaaattttataaagtagcggacgagcaggctgtaaaggacaggctgtacagtgagggacatgtggatgtgaccgtggtcccgggtatgattttcccgaccaatctcaaggccaaattcgatctgcataccagcaaatccattacctctgtcacagcgcaatatccgtccgaaacgaccatcagctatctggaaacagcccctacaaaccataaaatatatgaacttaccctgggacgactgggacataacaatattactgtaaactatggtaacggcgaaaaaaccgttctccagttctatggcatagagccagtcgaagctgcacttcagcgtcactctaccttcatggtcaacagcacccaatggaacgtgccgggcgacctgagggacaaggtctttgatgactggatgatgcaatacaaggccaaacgcaacagctttgctggctactggggctggggtgatgattggggactaactcacggccagtttctggcggagaaaaacgttcagaagcccgtagcatctgaaatcaaggcagtcgatgattatttggaggtggccatctggacgaatttgatggaaggccatcataccgattatctggttcctgattttctgatgccgcagcctaatacgacaccaacgtaccggggctatgcctatccgcacatttataatacattttttagcatgtataaacttgccaagctgtatcccaacctgatcagctatcgcaatagcaaaaacacatatttgctacgtgcttatcgtatttttaaagcgttgtatgaaggccctgttgcttataattggaacacgggacttatgggtgagctaactacacctgatatgattaaagcgcttcaggaagaaggcttgaccaccgaggctaacgacctgattgccaaaatggctaccaagtacaacaatttcaaaaacaccacctatccttatggctctgagtataactatgacaacacaggtgaagaagccgtatatacactcgccaaaatgaacaacaacacgaccatgatgagcaaaatcaacgccaaaacgcgtgctgcacgcggtcatatgcctgtctggtactattacgccgatccggtcaccatcaccggagagaattggtggaacttccagtacaccacttcactggccggctatgcgatggatgactggacacgtcggcattcgtccaagcccgaagtggatcagcgtctgtcctatgccgccaagctggcgaacatcggggcgattaactcgggacagatcagccctgatcctgccaatatcggggcggtatcgtggacatatcaggcgggcaagggcaattatggcgcactcggtctggacggcggccccctctttaacggatggcgcgggatgtccggggaagccgacctggggctatttggagccattaaaatcctaagctcggatgttgctgtagatccaatattcggcttgttcggctatggctgtgacgttacagaaagcagtaacagctacgcgatcactccaaaggacggtgtattccagcgactgcatctgatcacccaaaagctgagtttggagctgaatcgggaccaatatagcttggccatcgtgtctaagtccaagaacagcatccgcctgacgctgaaaaacacgactccaggcacgactcacaccaccattatgagcttgaccggacttgcggcaggtacgtatgacgtgctcgtagacggcacaaaaaacggatcagtcacggctgctaacagctctacgaccacggtcagactgaatatcggtacggcagccaactatgatatccgtatccagtcgagtacagacaacccgtctcccgccggagacattgtagcccgttatgaatttgacgaaacggccggatctaccgcagccgattcgtcaggttatggacagcaggccagtgtaaatggaggtgcgtggggagccggacggaaaggcaatgccctgcactttaacggtacagacgcctatgctagcctgcccggtggtatcgttagcagcctaaatgactttacgattgccgcgtgggtacgggtgaacacgcataacggctgggcacgcctgtttgattttggagcaggcacgaatcggtatatgtttttgacacccaaagccgagggaaccggtatgcgctttgctatcaccgtctcggggaacggagaggaacaacagttgaatgcgccagagctggcaacaggggtttggaagcatgtcgccgtgactttgtcaggcaatactggaatgatgtatctggacggtgtagaggcgacgcgtaacacgaacatgacgctcaagccttccagccttggactgacagaccggaactacattgggaaatcccagtttgatgatccctacctgaacggtgcagtggatgaactgattatttacaacagaaccctaaccgctcaggaaatccggggcttggcctcggcaagcagcaccattacagcccatgatgtgggagcccattcatatgctgaaggagcagattagaatgtattcattcatgccgttaacgttttagattatgaatgatttgtaccgtgaatgatttgcgtcgtgaatcattatcgtcgtaaatgattggtatcgtgaatgattcttcctatattagctccacccccggattacttaagttaagtctataatcaggggagaaatccggggagatgatgcttccgaagcaagcagtccttcggaaagcttttaaagcgaccgctttattgggacgatcagcggcagcttttccatctggagggcgtttagctccgtctaatgcgtgtcgttcttggtcttaggcgaaccagttcctcactggtgagctgcctagtataggagcgaggggaagaacctgtatctaccctgagcaccctgcctgccccgttggggcgggctacccgtgtgttgaatacctgcatggcccactgcaccggaaaggctatagataagcgaccatctgccgtgcctgcatagttgaccgcagctgcataattatctgactgtctgagccatacagagccagaatccccaggtagtgatacgggagtcgtacctctaataaccgtctgatcttcgaaggtcagcaggcccaactccccgccataattgatttgcaggtccgtatagacggactctaccgtgccattaacccgtccggtcgtacgcccaaccttcttcaatctttctcctatgcgatatgcggtaacatgacctggaatcgctcctaccgtagcgtaacgcggattgagtaggttgttacggggcggaagcgaaagcgccgcatcaatcaggtttgtaccggtgggattcaagcgtacgtaacgatacagccttcctatacgatcctgagtaaccgtccccccatcggctccgcctggctgtattatagcctcccgattgtctgtattggagggattaaggacatggttattgctaaaaagataacgcgtcgccggcgctccagttggggcaacgatgagtccggttgaaccggagccttcaatcgtcccgacactgtagccggcgatgaccgggcgtatgcgcactttgtagtccgtggcattggctctgatctttccagtctttacaattcggactggaacgttcgttttctttcctaatgcggtggccgacaggagtccagtagaggccgacgctagacggtccgtatacacaatgacagcggctccccttttgggatgggcagggtccctgtatcctacgccaatgccgtggacaccggacatttttaagactcgcttggccatccgctttttcacatgaagcgcggccgagaaggtagccaacataatcatctccttttacattcagatgaaatattgtatggctagagacgtttcgcgttccatttgatcttacgatcgctgtattgaaaagcatatgaaaacattccaaaaaatggtatactcattttcgaaattgacatcttatcattggattttaatgttcaaggaggtactttatgttttcaatcatgttgacatacagcatacaagcaattgtaattttactaattatctttgaatggttgagaaaaaacagaaaaaaaataggttggggatcactttcactgcttttatctcttcttggtatggctgtttctttcgaatttggcaattatatattgggagaccagttgctttcctttttaggattgcccgcctggtctaacagtgttgataatactaggtttcactacaccatttttctatccagtattttttttattcccagtttaatcattggatataaaaatcctaaagagtttggagctacgatcggaaaacgggtttctagtatatatctaactttgatcatcatttcgcttttattttttattataagtattttctcgaagtaacgttggatgtgcgtcgttccaaaacaaaagccttcctcagcggagggtttctgttttatcacattaaatccaaacaatccggggtgagtaattagatcaaggagttggtattatctataattcatttacctccatattttttgctgcgttaactgcaatcaccctcataacgttgccaaaattagaagctagggtgagtaagagaacaatgttgaaagtgagaatttccttaataacaacagttctgctgatcggagtcgtgttgtatatcattgaccctcagtggtggatcattgtagcctttgcaattttgtttgtaacccttcctatctttttattgaaacgttggcgcgaaaaaagctgaatcagagaaaaagccttccttgttgataggaaggctttccaccttatcccttaaccgctccctctgcgataccctccatgatgaatttctggaagaaggcatagatcaggataaccgggatggaggtcagtacaagtgcggccagaataagcgaccaatccttgttgtactctccaaacagcgtattggtcgagagaattagagtgtaatggttcacatccgtcagcattaacaatggaagcaaaaagtcgttccaaatccacagaaaatccaaaatcgcgatggtaactgtgatcggcagcagcaaaggaaatataatgcgaaagaacgtttgaaactcattacagccgtccatttgtgcggattcttccagctcacgcgggatggatttgacgaatccatgatacaaaaagatcgccatattcacacccaagccgatatagatcagggccaagccgtacgtactgccttgaacggacaaatcttttgccattcgtgtaagcggtatcataatggagtgaaacggcaccagcatcgatgcgacaaacaagaagaaaatcgcactgctcagtttcccctgtgtacgagacagcttgtagcctgccagtgccgaacagatcacaatgccaccaatgccgataaaagaaataatcgtggaattaagagcgctgttcagcaaatgagtctgatgaaaagcctgactgtaattttcaaagtgaagcttcgtcggcagcgccgtaaaggatgcaaacatctcaccctgtgttttaaacgagttaattaccgccatgtagattgggaagaaggacacgacagcgcccacgcacagaatcagcgtaatcagcaaggaattggctttcttcagcctcatgcctccacctccctcttcttcatgacacgcagctgaatcagggtgaaaataagaacaatcgcgaacaaaataacagatttggcactcgcatacccataacggaagttgttggagaacgcctcctcataaatgttcatcgtaatcacctgtgtactgcgccctggccccccgccagtcagtccgtatacgacctcatacaccttgaaggcaccattcagcgtcaggaagaaacagatcgtaatcgcatgagtaatcatcggcatcgtcacacttcgcaatgtctgaaatgcgttcgccccgtcaataatagcagcctccttcaagctttgtggtacaccttgaagcgcagccagatagatgatcatcatatagccgacaccattccagagcgacacaataatgatagagaagaaagatactttcggatcgcccagccacgattggcccaaaaaggcgatagtcgtcttttcggcgatctgtggcagcacggaagaaaaaacgaaggtccacataaatgcgctaataatggtactgatcatattgggcatgaaaaatatcgtccggaaaaatcctttggtacgtgtacgcgactcaatcaacactgccagagccagtgccagtacattttgcagcacaatcatgactaatacatatttaagagtaaaccaaagggaattgagaaaatcggggtcttccttcaacgattccacaaagttccccaagccgataaagctgtaattgggattcaagccgttccagtctgtaaagctgtagtacatgccgctgatcgttggaatgagcaggaagatagcataaaagatcagcgccggggctgtaaacgccagtagcatgacgtattttttatagattttaaaaggcatggagtctctccctcctggtgtaattctataggttatcgttacttgttcactttgttatacgatttccatgccttatccagtgccttaatgacgtcatcctgcgagagctgaccagcataataggattgtagcgatttgcctgcctcgtccttaaccgcttgcgggatagatggatcctggtacgacttgcctgcttttacgtattcggtagcgtcattaacccaaggatagcttttaaacgtatgcactttggagatcggattaaatttcaatgcttcatagaacgcgctagaatccttgtcatccagcacatagttaacaaaatcgagcgcaacctccttgttcttgcttgtggaggatacagctagcgaagtcgaagtggacaaattgatcaatgtcgcattgggatcgtcattgatcggcagcgctgctaccccaaaatccatcttcggatcagattttaaaatcgtttccgcaaaccacggtccctgaatccacatcgccgctttacccgaggcaaacgcagccgatccatcatccccgccgatttccagcgccttgtcagtaccgttgctattcaccagatcaataatatcgaacatgctcttcatttcggaaaaggagccttggtcctgattcatccgttcgataaaatctttgttctgtgtgttcatcatcgcacctgctgtcagaggcacaaacagctgtggaatccaggattccttgtaagacaacaggaacggtttcacattattcgctttcagcttctccaccacagccttcatttcggtcaacgttcccggcggctgcaaatccaaatccttaaatatctttttattgtacaagtaaccccatgagatcgtttctaaaggaaccgctacgacctttccgtctttggttgtcaccgaaggcttcacactatccatcaatttgttaacaaaaggctgaccggacaaatcctccaaatagcccgctttataaaacggaggaatttcattcaccgcgtgcaatgcaaatacgtccggcgcatcgttggatgcgagtcttgtcttcaaaatttgtgcggcgttgtcagcaggcggcatctccagttgcaccgtaacgtcgatatttttatctttcttctctttcgctacgaaagcattaatgtatttatcgtagtgctccttcaaacggggctgagcaataaacattttgagattcaccgttttgccgtctccaccggaaccgctgctgtcactgcctgaagaattcgctccacacccggccaataacgtgccaaccagcatcgtgctcaatacacatttccacattttcatgaaaaatgacctcccctattttgaaaataaccgttgcccatcggcaaatcagttgttattcaaagcagctatgccgccggtcttcaacctctattcagctctgtgcgaacttcataaaggccaaattcctttgtactgctcgttttgtatacgctttcattatagaatgagaggtcacttctgccattggacacccttagcttattggattggacttttttaaacttccttcctcatttcaccgggtgccatgccaaaatgctttttaaatacccgatagaaataagacacatcctcatatcctgccatctccgcgactgctttgattgaaatctgtttattgaccagccattcccgcgcgttttccattcttcgctctacgatgtagtccgttacattttgaccatactcctgcttaaataccttactcatatactctttactcacaaaaaagttttttgccaactgctccagtgtaattggcccagcaaagtgactgtcgatatatcgccgtacctcttctaaattcagtttgtttttgtatttccgctgccgaatgagctgatccagttcctgaacatagcacgacgatacgaattccagcgcatgttctacagaggatacggcatcctgcgacagtgggaatcctgcctttgccgtagaagtatctagcccgttatccgctgtgagctcttttagcagggaaagaagctcctgcaccagcctgcccagcatatgtggacttggtgctccataactctccagctcctgcataacctgcctacaagttatgttcaccccgtcacggttcaactcattaaaataaagacgcagcagttgcttataccgggtcagcttgtgaaaaaactcataatccagctccgtcgcttcttgctgctgttcagcagccttgacctccagatcgtttttgcatttgagcaacactgcattcagctctgcaggattgactggctttaacaaataatcgacggccttgtaacggatggcatgtttggcatacgcaaagtcatcatatccgctcacgacaatgatttttacatcaggacaatggttatttagcgcttgcagcagctccactccgtccgcacccggcatgtgcatatcagtaatcacaatatggggagctaactccccgaccagcctgaacgcctcgtctccgtcttcagcctcccctactaccaacattccaagtttttcccatgtgccaaatgtctttagaatatcgcggttccatggctcatcgtccacaattaatactctgatcatacttttccctcctctgctgaggtaaatggaatgcggatagtgacacgtgtaccgactccctgctcactatctatcgtcactccgtagcgcactccaaaattcatccgtatgcgtgaagacacattgctcaatccgatatgactaccctgcgcccagatcggttcctccgacgcgttttccagctttgcccgtactttttccagcttgtccggggccatgccgtttccattatcgcaaaccgtaatacacacatcttctttcataatctccattcgaatccccattctccatgtccccgcctttcggtcaagaccgtgctgaaacgcgttttccaacaatggctgaagcgatagcttaggcagtcgaatatccatcgcctgttcttccgtctccacctgaaacaccaatctttgtggaaatcgccgttgctggatgcgcatatagtgtcccacatggtcgagctctgcgcgtaaagaggccaaatcctgaggttcccgtaccacgtaacggaacatctcactcagcgaccgaatgacttcataggtgtcctccggcttttgcgaaaacaccatacttccgatcatttgcagcgtattttgcagaaaatgtggatgaatctgcgcttggagcgctttcaattcagccgtctttttttgcaaatttatactgtattccgcctgaatatgctcgcgaattcggcctgccatcccatgcagacttctttccagcagcccaatctcatccgggcgtgtacttggctgtccaatcggtcctttgatcatatccagctcctgtacggaacgcgccaaatgaacaatcggacgtgcagtccgccatgcgatgaaaacggcaatgcagatggaaaccaggattgaaatcacgccgacgataataccatacagcatcgttgaaaaagcgctgtggttaatggaggaagtgggtacgattttgaccagcttcagcccaactacatccagatcattatagaatacataatgttcagcagtttgaatcatacctgggcccggcttaacgtcacgaagagctgtcagcacacctgcaggcggaggcgcctgccgagcctgtgctggatacataactctgccatccccatctgtaataagcacctgatgctcatcccctcgtcccagcaggcccagcgtctgatcgaattgcgaccacaatacatccaaagaaatagcccccgtctgcttctggtcttcaaaacgccgaatactgcgcgtcaaaataaagcgttctgggtcagcagagcttggacgaatcgaataatccttatttgcttgccacatctcggcatactgtgggggaataccgctcactgtcgtaatttcattttgcatactattgaaggtaaacaaggtttgcgattgcttcaaataaagctggatgccgatcacatgacttccggccgaataatacacattcgccatcgtattcagcatttttcgctgggcattaaattggcttgaaagattgtcaggctcgcgctcattcaaataatcgctcagatcagggctgatctgaatgctgtaaatcagatgattcagacgatctagctggtcgctgatatagatccccgtccatttcatattggacatgttcgtctctactacttcagcttccatggaagctctacttttttccgcagccagcaccgtgacagcaatgaccggcagcacagatagaacaatcatcgtcaagatcagcttgagctgaatgctgcgtcgatacggggccgtcagcgcccggaaccagtggactgctcgggttgtcatagcgatgcactcctctattcagccatatgcgaaaacgccccgcaattcgcaggggcgcttcatgtaccggatactcccggagaatacctatatgatattattcgtgagtcggtttcggctcattattcatcatttacgcttcctcgataattataacaccccaaggctctattgaaagcgtttgtccttggataactgtacgccccccgattaactccttgccgtctccatgtggatataccaccgagcctgcttgttcggaatagttaaaatagtaccggattgtccgtcccagctcattcgtgccggatttaacaatgatcggataagacgtttcctgatccactccccatactcccgcctttttggctacagagctgaatagttcgcggatgaccgccgggctgacgatacagccgatgtaggtcgctgttccctgaccatagcggttttgcgtaatcgcggcatattttccccaatgcgggtgatcgtaataggccaacacttcggcggtcgtcggggtaatcagctccatccacgtatctacctgattgtcttctagtgccacctcaaaaggattatttttgagcgtcaccttcttcggctccacgaacaagctgtaatgaatgccgcaggcttcgctaatcacgcccggttgccgggacgttctcacctgcacatgctcgtcggtaaatccgcttcggaatgtgtataccacatgaccacctttctccacatatcggttcagtttctccagtagtgcatctggggcagaatagagaactgggacgatcaagagatcatagtcgtcaaacgattctgtacctggatgaacgatatctgtcccgatattcagtttatacaactcgtcatacaaacgacgtacgatgtcattgtaatttaacgggctactcatattaaatttaaaccagtcaatcgacgtcaatgcttcgttgctgaccagaatcgccgttttatttttctttttcaagttgaccagatgcggagacaatcttgcaaaatccttccctatggtctgtgcttcctcatacactggattcggctcaaaatcatggctcagcagacccttccagtaggtttcgaaggaattatggatggaatgccagtgccagtatgccaccatattggccccggaagccagatggctgaacgcttgcagacgcaattgccccggatagggaacccagtgggtaaaagcctgcgcttccgtttccagcactagatagttgttattcttcgtcgaacgtgccacatcgccaccgaaggaaatttcaatgccagtcaggtcatcctgtgatggatggtaaatatccaccccagtcacatcaaaggcttgcgatgccgcaaagtgatccacgtctggctgaaccccaaaggaatgacctctccacgcaaaatcaaagttttgcgtaacaaattggtccttccgcttatattcattcaccagcgcaacctgccatgccagaaagtccgtcaccagcttgcgctgaaattgggaaaaggctgcgcccaaacttccattaatcgttccgaccaccgaaggaaagtcctcccagctattgatgcgattactccagtaatccagaccaaatttgcggttaagctcctccagcgattcgaaccgctcccgcagatactttacaaattgcaattgcacattgggcccgctcgtgtggtaatgcttggtctcattatccgtctgaaagccaataaccgccggatgctgactcacccgcccaatcagcttgcgtatgattcgctcggcatggaacaggtacaccgggttcgtaatgtccataatctggcgagctccatatttgcccggaccttgaggcgttgtcgccaatacatcgggatgctccttcaccagccatgtgggtacggcataggtgggcgtccccacaatgacttcaatgcccgctttatgcatggcgtccagcacccgatccacagaggtaaaatcaaacacgccattttgcggttcatgcgtactccaagtagattcggcaatccgcaccacgttgatgcccgcatccttcatcatttgaatatcttggtccaaacggtcatatggcatatattcatcataataagcaacaccgtatagtagctttttcatcaagtcgtcctccaattaggttcgttaggattttgcaaaattcgattccagtcgcttcgaagtgcaagatatagacgaaccaagccgccctttagattggcccggtctatgatcacgccgaagatcggagcgctaagtgcatcccatatacgggctagtacgaataaagtaccgataatagaaacagatatgccaacataatccgtataaatagcagagcaagcgctttcttttatatataaaagcttatactatagcatttgtaaacgctcttttattatagttaaatgttagatacaatgagattgtctaagcggtgtaaaatttgccctaatcgaaggtgatctgatgatattaaatcctgatattgatccagctctatttcatgattgccaatggctgcccattattgactggaatgtgaaattttttggcgcccatattcaccgggtccaagcggattggtgcatgccggaggagtctcatatcggttttgaaattgcactcattttagaaggtcgtcaggaaacgattatggaaaataacgtttattcggttggggaaggtgatattttaattattccgccgggtttcaaacatgtgagtcaatgtgtttccccaaacggcatgtactattttagctctcattttaatgtcgatgatccattgttccgtcaggaaatgattaagagcaatcagctcttttttccagcgggtactgaaacgaataccaagctgcaaaaggtcgtccatagctggattggcatggtgcaggaaagcggagaatatacgacagcagaccgttttcgtatgcaaattgccttatttgagctattcgggatattctcgcaaatgatatctaccggtttggagcccagaattgcgccttcatccgttcaatatgccaaggccatcatggaagccattcaatcaaggtttaagccttatcgggaagatgaatctggcgagcaagcgttccgtcttgaagatgtggcggcttccctcgggatcagtcccggctatgcccaggaagtgttccgtaaggtatacggttattctccacgtcactatctatcggagaccaagctgcatgaggcaaaggtgctgatccagcagcccaatctgccactcaacaaggtagcttccctgctcggatactccagtctggctcatttcagcagacagttcaagcgctggacaggcaccagcccacttaaataccgccagacgttaaaaccgattactgatgaacaaaggattaagatataaggacggatagcaaaagtccaccgtgttattcaaccaaaaaaagagcgtgacaccgaatatcgcggttgtcacgctcttttgtctctattttctataagctgtaccgttgccttaatgatctaaaatcttgaccaagcactcattattcagatcacagcctaatatcccctatatgctggtgcaccacatacatcatccccatcaggaatacggccaaagctaagtaactgatgccaaatttccagcgtgatgatgcgggcacttcgtaatatttatcattttcaaacggaatgtaatcaatcccacacagcaatctgagctggtacgcatccggcgtcggtatatgttccacaccgttcagccatacatgctggacaagacactgctgcggcagcttaagtgtctgctccacatccaaactttccatatacaccgtcacatattgctgcccctccaaatccgagtaggtattaaaggataatctgcgtgtatgctccggtccgggcagtggatatccttgctcatacagatgctgtacattcaccagcggcttttgcaaaaaagattggatcttgacctctcctttattgcgtttaacatattttttgtacaaatcgtaggcaaagaacgcccatatgaagaaaaataaaaaggattttaaatatactacgactacaattccacccaataagcccaccagccacagccaacgcgtcactgccgtggaaattcgtcctccgtcgagtggatgaatcggcagcaggttgatcaggttcaggaaaaagccgacatacgagagcgcatacaacaggggactgtctgttgcataggctcctgcgtataccgccatagccccaaccgtccccagtaacgggccgcccatggctacataagcctctgtctgcgcatccaaaggttgccgtttcattgtgatcagcgcaccgagaaaaggaataaataacggtgctgacacgggaagccccttgcgcttggcagcccatacatgtcctagctcatgcacaaacaacagcaacacgaatccgaccgcaaatccccacgggtaaatgatcgcatatgtgctaatcgttatcgccatagatatcagcgcaccgccaaatttactgaattttaaaagggcaagtaacgacttgcctttcagaagaagcaatgctgctgcactaccaaggtaccatttggatgagccggatttggaatcggtctttttctcttcgttttgcaaaggtatccgtctcctttctttaacacttccattgtatcctgctatgtgcagcttgtaaaaacttctctaacccacagataagcacccaagtgtccatcctcctatctgttctgttatcatgtaagaaaacggaataacccaggaaaggattacgaatcatgagttttgaacttacccggcgagccatcagacaactatgcagtcaagccgcttatgacgacggggatgcctattaccgggccaaaagagtggcctttacacaaatagatcatgatgaaggtgtgtacgaagctacggtcaaaggaagcagcttttatgctgttgcggcgatgatccgatccaatggaagtatccgagcagaatgcacctgtagcacatttcagaacactggacgatattgtaaacatatcgcagctgttctccttaacgcccatgatatacgccgtggaaaaagtctgtctgtgcgctcctatgcctccaggcttcatcccggtactgccccagatacagcagggagcatggattcagacgggatgtacacatctacagatgctccatatgatcacactgctagaacggcacgatcctctgacatcacacgaggcgatctccagctgaccgacagtatgttaaaactatttgaccgcaagcgaccgcttcgcagcacaccaaccctgctggatactcgcgcggtcttggattttcagttcgtcatccggccttttgcctatggttaccaaaaatatatgtttggtgtagaaatgaaggctggtcccaaacgattatatatcgtgcagaaaattcgtccgtttctggatagtattgaccgtggggatagctacatgttcacaaaaagcttctcgtacgagcctgagttgtaccgcttccgtcctgaacatgacgctattctccagcaattatcccaggtgtgccaccatgagcgtatgattcgggaaacctcaggcacgtattcatcttccagtagtcatatgagcggcgagcgaatgctcctcatcccgcctgcggcttgggaaaagctgctccccttgctgacagcagcacagggcgtctactttgaaattcacggaaacatgagcgacggtattccccagtccgacctgatgcttccgctgcaatttgaatttgatgaggccgaaatcgaaggctaccagctaagcattcaaggattagatgacttgaccatcatggaagactatggtgtcgtcattgccgatggcaagcttgtcaaacagaaagccgatcccttacggcgtttgtccgagctaaaacgaatggtagaagtacaccacaggcgaaaagttcagattgcgccagagcagatggaatcttttatggacaaggttgtacccgggttaatgaagctcggacgtgttcatatgactcggtccgtctcagatcgggtcacacagcagccattgaaggcaaagctatatctggaccgggtaagagacaagctgctggcagggctggagttccaatatggggatatcatcatcaacccgctggaaacagatgcacgaacgcctggtatcgaccgaattctgatacgtgatggggaacaggagcagcggattttggagctgatggagcatagctcctttgccagaacagatagcggatattttatggaagatgaagatgcagagtatgattttttgtatcatactgttccgcaactggaaaagctgctggacgtctatgccacaggtgcagtcaaagcaaaaataaacaatactctgcctaccccaaggatacgcgcggagtgggatgaacgtacagattggcttgaatttaaatttgatatggagggcataccggaaccggaaattcgcaaactgctcaaatcgttagaggaaaaacagaaatatcaccgtcttccaaatggtgccttgctgccgctcgaaacagaggagtacaaggaattgattcggttcatgaatgaaacaggtatccgcaaaagcgatctggatgcagcgcaaattcgtgttcccgtcacgcaaggactgtacttaattgatcctcacgatcatgggaaaaacctgactttgggtaaaacctttcgccagctgttggaaaatatacgtaaccctgaccatctcgactttccagttccagacatgcttgccccaatcttgagagattatcaggtttacggctttcaatggcttaagacattggcgcattaccgttttgggggtattttggcagatgatatggggctgggtaaaacgctgcaaagtatcgcctttctcgtctcagtattgccggagatccgcagccagcagcttccagccatgatcgtgtcccctgcatcactggtgtacaactggcggaatgagctggagaaatttgctccacacgtccgcgtcactatcgcagatggcagcccggaagaacgcggccgaatcatacgggatgccgccagttatgacgtcgtcataacgtcctatccgctgctacggcgcgatgcagatgtgtacagcaagccatcgtttcatacgctcattctggacgaggcgcaggctttcaagaaccatgccacccagacggcacaggctgttaaggatgtaaaagctcgttaccgttttgccctgacaggaacgcccgtagaaaatacgttggaagagttgtggtccatctttgacgttgtatttcctgcgctatttcccggcgggaaaagagcgtttcacaacctgcctcgaaatgtgatcgccaagcgggttcgtccgtttctgctgcgccgtcttaagagtgatgtcctcaaggagctgccggagaaaatcgaatccgtgcaggtatcccggcttctgccagatcaaaaaaagctgtacaccgcctatctggccaagcttcagcatgaaacgttgaagcatctcaacgaggaaggatttcagaaaaatcggatcaaaattctcgccggtctgactcgacttcgtcagctctgttgtcatccgggcttgttcatcgaaggatatacgggaagctctgctaaatttgaacagctgttggagatcattacggaatgtctcagctccgggaaacggatgctcattttttcacagttcaccacaatgcttcaaatgatcggacgcgagcttactcgagaaggggtgtcctacttttacctggatgggcagactcctgctctggaacgagtcgagttgtgcagtcgcttcaacgaaggagaacgcgagctgttcctgatttccctaaaagcaggaggcactggcctgaacctcactggtgcagatacagtcattttgtatgacctgtggtggaatcccgctgtagaggagcaggctaccaaccgagcacaccgaatgggccagaaaaaagtcgtgcaggttattcgtctcgtcgcccaaggtacggtagaggacaaaatgtatgagctgcaacaaaaaaagaaaaacatgatcgaccaggtcattcagccggggcaagaaaccctttcggcactgaccgagctggagattcgtgaactgctcatgatctagccaactctccacgcttatttttacgttagtatgacaattccacatgcaaaaaaggtccaattgacggtagaagttttcccgcattggacctttttcgttctaatatgattgtttggatcgagcagattaatcctgttttaatactctaggttcaatgggaaccaggttagactcaatctgggtacgctgaggctcataccattcaggcagcatcagcttatgtcccaactcattcaattcctcatccacggtaaatccgggtcgatcggttgcgatctcgaataaaataccgccccgctcgcggaagtatacggcattgaagtattggcgatctacaataccactggttccaaaaccatgctgatgaacccattcgttccacgcctgatgctccgtatcatcctgcgcgcgccaggcaatatggtgaaccgtaccggcgccgccattcccccacgggacatctttgaccggaatgtcgatcaggttgcccaaatcacctgtcgtctgatagcggatgtagcctgcatttgcgtcttctccgatgagagtcatccccaggacgttctccaacaccccttgcgtatgcttggaatccgcactgtacagtaccgccccgccaaagcccttgatagctttatccgtaggcacacccccggctgtccacgtgttcaacgggccatcttcccgttccaccaactccagatgtaagccctcgttgtctcggaactggatgaatgactcgccaaaacgagtggccttcgtgaaagatactttcaagctgtgcagacggttttcccagtattccaaagcaccggacggcacgacatacgtcgtaatcccgacctgtccgcctccaatcttacccttgcgtgtacccggagctggaaaaaaagtaatgatcgtgcccgggctgccctcttcattaccaaagtacaaatggtatacttctggagcatcaaagttgatcgtctttttaatcaatcgcaaaccaagtacgcctgcgtaaaaatcaacgttgccctgcgggtcgcctgcaaaggacgtgatatggtgaattccagcggttttcaatgacatctttatcactccttcattaacatgttgatttatttacacaaatgatttacaaatttcaaaatccattgtagctgacaaattgtccaaccggcttgcggtatccccgtgcccgctgacccgattcgtcctctttacccaaggtaatcatcattaccggtacaaattgctctggaatatttagtacttcctgcaccttcgccggatcaaaaccgatcatcgggcatgtatcccagcctttgtccttggcaatcaacatcaattgcatagccgacaggctggcattacggatcgcttcttctctctggaagacaggtccccgctcgcgataaaactgagttaccgattccactgtactatcatattcctgcttgctcaaaacgcccaaattcaggaatccttcgttgaggtcggctaccttggtataagcctctgtatcccccaacactacaatggtcgccgaagccgttaatattttatactgcttacttgcctcatcatgcagtctttgtttggtatcagcatcctgcactacgatataacgcgcatgctgtaaattgaaagccgatggagcaaacttcaccagctgaaatatttcttctagttcttttgcatctatagtaacatcaggaataaatttagaagctgatcttctctcttgaataatattcaccagttcgctcatgttaagttccgctccttgatattattttcaaataaattatctttaaattaagaatatatatattcatgatttctgtcaagtaaaactataataatgttaataagtatgttgggatacaacctaagggcttataccagccctttacagatccgttgcccgtattctcatcgtaatcgcttcgcgttgcgctttggttaagctcttgaagaccagctcatacgaatggtcgatcatgctgtacaaatcctccagtgggaaggtagcatcaacctcaatcgtattccaatgctttttatttaaatgatagcctggcttaatcgctttgttttgttcacgcagatttaccgcaatgatcggatcacatttcaaggataggtagctaatgccgcctttttcagataatagagcaaacattttgcccccaactttcagtaccagtatttcagcaccaaatggataatccttaacggcctctttttggctcagaccatacgctacaatttgttcatacaccagccttcactcctttgcttgagtcatcatctatgaaacgatttgtgccctattatatcacgctctccacttacaatagtcccgtaagatttcacacggtgacgaagctgccatccaaggatgaggccaatttatattcgctgtttgctggcaatccgaaggcacaaacgcttatgcaatgatcgcccttcgtggttgttgcagacgacggacagcgtctgggcgtatatgacctgcgtttctatcgggagggtcaatcctttcaatatgttttactgtaaagtcaattatatgaagaagcggcagcttcgaaggtgagatataatcttagactgccgctgcttttcctttattaaacttcaaaaatctaaagagttcctgtgcttaagcaagcttgctcaagcccttgaagtaatgcttctagctcctgcctagtttcagcgcttgtaatttcaccttcctggtttagcttcaaggtgatatgcggaataatgacctttccattctccacaatctctgcattgatcatttgcaatgtgagcagcagcgaggcatgcgccagatggccgcccataggagacggtgacgcgctgatgaccgctgtaggtttatttacaaattcacctgaagatacgagccaatccaaggcatttttcaaagcacccggcacaccattcccatattccggtgtacagatcagcactccatccacttgtttcaattgttcccgtagctctcttacggaagctgacccctcatctacatccaagtcagggttaaaatgcggaagatcccccaatccatcatagactgtgaacatcatattttcagaagccagccccatagtagccttcataagcgctgtattggaggacttttggcgaaggctacccgatatagctaataccttaattttctgttccatccgatcatctcatttcttttatcttgatctaatcttgcatattcagtgtactatagctaacaagagaattaaaaagtggatgaacgccagcgattcttcctatgaacaaacgggcaataaaaaaatgcctgcggcttcgcaggcattcgtaatgaatcaatagtcactatactagggtggaatctgtagtgctcaatcaagtatccttttcttgcttgcgttttatcccaatcagatccaggaagaaaacaaacaacggaatacctacaatcaagccccaaattccaatcagatgctcagagaaaataagtacgacaaaggtaaagaagatcggtaaattcgttttggatgacatcagcttcggatttaagaaataggcctcaatcgcatgaatcaccacgatcagaataaccagataaaccacatattgaatgcctccgacactgaaagcgatcaggccgagcggtgccagtgagataaacacacctgccaccggaaccaatcccagtacgaaaatgatgagcgcaagaccgagcagattagggaagcccataatccagagcgcaatcgtggtcaatatacaattaataagtgaaatcagcagttgagcctccaataccttcccgaacgtacccagaaacatacggccaaaatgacccacttccttgaaaaaccaacccagcttgctatctacaaacgtagctgtaaaacgtgtaatataggatttttccatcaggaaaaacaagctcaaaataatcgacaccagaagctgtgttcccaattgactgaccttcatcactgcactcaggccaggctcaaatagccgctgagcattcagcgtgtccataaattcgataatcgtttcgttccattgattgcgatcaggatacatatacgcttgctgaatcatgagatacacctgcttgacctgtacaacgattagcggcaccattcggtaaacgccccacaccataatcagaattagcaaaccatacaccaggagtagcacgatcattgacggcacattgacgaaccgcttgaccagcttattcactccgttatatatactgccaatcaagatcgtaagcagcagtgttaacaacataatattcatcatgcttcttaacataaacaacagcaaaacgattatcgcaaggacggctatccgcctgacgcccgcatgattcatccagtttcttaccattcgtctttattccctctctcccacttgactgtcaactttgcaatcttcctgagcatcaactttctctttttaacaatttactgttagcgatcaatagagaacctaccatgactaggatagcaatagaccaccagaatgtatttttagcatcatcatgatctacaataatgagcctgatgacagccgtgatcccaatatagataaaataacgtaatggaaaatgaaaattggttttaaagtacttaactattaatgctatgaattcaaagtacaagaaaaacacaagcaactcttccgtgaattcatagtaatttttgtcggtctctgcgtacaaaaaaacataagaaaaaatggaccatgtttcttttagcagtaagaagcttaaaatcagcccgaccagaaacagcgagatattcaagatcatttgcagaaaactcggtaacttctcaatatacttcattagtacattcaatacagatcccctcactggttgtacagtatctttatttatattatcggtggtatacgtgaaaaatgctacattacttttgaggtcaccttaatgaaagtttatattcgcccctgcaatataaccaatggagataaagataagcgtccatatcagagaacctgcgcttgccaccagcatatattttcggacaggcatcgcactaatgcccgacaaatagcttgtcgcatgtctgactcctgggataaaataaccgaacaaaatggtccacaacccaaagcgtgcaaaccaccccttaactcttgcaaatcgcttcggtgtcaatccaacccacttgccgtgcttatccaccaagggctgacccagctttttgcctagcgtgtagctgatcatcatccctgtcattgcaccaatgaagctgactaatatagacaccgaataattcagtaccataatagaagataaatagccgacaaacaccataataatttcatctggaaccggtaggccgataatcccaagagcaagaagagcaaaaatagcgatatatccgtattgtgtaatcatgctgatgacccattccataggggagccacctcctgaccgattattttttgaaggacggaaagggaatacggctaaccatcaggaacgacagcactaccattaatgcaagcaacaaccccggcttcaaatgctcactccataaaaacataaaggacaaaatcacacccgccgccgtaatcggcatacctacaaagcctttgctaaaagccattaggttgaatcttgccaatcttaccgcaccgcatatgacaaacaaaacagccacaagcggtcctatccaatgggtatctcccagcttgtataacaagatcaagaaagcaggggcaaccccaaatgagacaacatccgccagcgaatcgagctgtttgccaaaatcactggaacaatgcaacagccttgccagcaaaccgtctaatacatcccataaagcagccaccaccacgagaataaaagcggtcatgtattgctcatgaatcgtgaaatacagggataagccccctgcccccaggtttgcaatcgtgcatagtgagggcaaccaattccatttcatactcttaactcctttgccatagcttagcctccgaatataacaacaaaacggacgccgtccttggtattctccaccttatagcgggattcgtgcaaatccaaaattcgtttgacgatcgatagccccagtcctgtcccacctgtctgacggcttcgggacagctcggcccggtaaaagcgatcccatatctgctccagttgatcgtcaggaatggtctcacctttattttcaatggaaaaaaaactgatttccccagcaccttcgatacgaatcgtgatcgagcttccttcctcagcatgtcgtatggcattgacaacaaagttgataatcacctgttccagccatcctacatcggcatggatcggcatctcattggcggggataatgaccacttccagctttttctccttcaacaaatgaaataacttgtccacgacctcctccaccagctcactcaagatgaaggtcgtcttgcgaagcttgagagtacccgattccaatttggcgaggtccagcatatctttgaccaagcgctccattttgtccgcttcctctacaatgactttcatataatgatcctgcttcccagcgctaactccatcttgtaatccttctgcgaagcctttaataatactcagcggggttttcagttcatgagaagcgttggcaaaaaagtcttgttgcacagcctccatcctctgcttctgttccatgtcctccaccaattgctgattggcgtcctgaagctcgcgcaaagctgtgtccaggttctgggacagggtatacatgctgtaggacaggctgcccagttcatcattctgccggattggtgtatgggctgtaaaatcgagcttagccatccgcttggcggtattattcaaagcaatgagcggacgggtcaccatccgggaatagaacagggacaaaatcagaatgagtgcaaatcccccgatccctaggtacagataaaaccagcgcagagcttcattcgtctcactaatttcctgcaacgatgtcactgtgaacaggaggtcgatctcgcctgtgtcctgacgaacaggatggactatgactgcattgcgtacccctgtccaaggttccgtccactcttcttccaacacttcgaaattcttaagtttctccagatgcgcctgtgataaagggaaccattcctccagtgcactaaacagtaagccttgtcgctgactccatgttttcagatccggcagtacaatctctgtcaccgtaccggaaaaccttacacggccatctgtgcttgcctcttccgaagtcgatcctatatttttgaaaccaagcttctgtatgccggtaggataaattaaattggcggtagagatgccgtccgttcctaatccctcaccttcaaccgttaccgtatcaccgggctgaatccgagcagctctcagttcatctccgtactcgctcataaacagagacagcgatattttaacgattttaccatccgcttttcttagattgatatgaaacgcatcatccagctttactttgccgtccagcgttacaatcgccagctggtttttattctgaagcataaagcgagctgcctcacgggaaaccctgcccgatccccaagcctcctggacataactttgaccgaagctttgcaagcggctttccacacgaccaatcttctgttcctgataaaaattttcaaaaaacagcaattgacttaaaatcaccataccgtaaaaacacaggaaaaacacaaccgtcataatgaacaacttaaaggtaactccccgtttgttcattcttcctcctcaaacctataacctgtaccaaaaaccgtacggatatggcgtgattcacggcctaacttacttctcagctttttgatatgcgtatcgacaactcgtgtatctccttcaaagtcgatgccccacacccggttcagtatcgcatcccgtgaaataactatgcctttattatgtataagcagccgcagcagctcatactccttgggcgtcagctcgacttccgcctgatccactacaagccgatgagccatcgtgttgagaatggcactaccgaaccgcaaaatatgcgactccggctgtacatgtccctccacccgtttcatcagcgcgttggcgcgagcgatcagcaccttagggctgaaaggtttggtcacgtaatcatcggctcccagttcaaagcctaatattttatcatcatcaccggatttggctgtcaacaaaatgatcggcacacctgagcggctacgcacctggcggcacacctcccaaccatccagttccggcatcataatatcgagtataatcaggtccggctgcaccgaatcaaaccagatcagtgcatcttttccattgcctgcttcatagacttcccaattattctgtttaaaatagtcagcaatcacttcacgaatacgtatttcatcctccacgagaagaactcttttcttcaatcgacttccctctttcggtcattctaggacaccagcatatcaaagacatgtgtactttatgtgttcttgacacttctcatccgcaaattcaaccatggattagggcaaatttgtcgtggctcagaccatctcatctcctatgatcctaccctataataagaagagatacaaaaagcttgaacaggagggtaatacatgagtaatcaaaccattcagtggttttccacttccaaagctaaagcttggcaatcccaagctcatcatttgaccgatacccaagagagtgccaatctaatctttacgggagaaacacatcagcttgtcgaaggatttggtggctgttttaatgaattaggttatgtggccctgaaccatttggaaaaagacgaacgagatcgggtgcttcattctctctttcatccagcgggcgagcacaaatttgcgatttgccgacttcctattggagcgagtgactacgcgctggagtggtacagccacaatgaaacagacggtgacgtggagatgaagcacttttccattgagcgtgatcagcaatatctcattccttttattcgggaagcgttacaactcaatccggacttgaagttgttcgcttcaccctggagcccgccgacatggatgaaatcaccgaaagcctacaattacggcacgttgcgctgggaaaaggatattttgaaagcgtattcattgtactttgtcaaatttgttcaggcttatcgagaggcaggtattacaattcatcagattcatgttcaaaatgaagtcattgccgatcagaagtttccttcctgtgtatggaccggagagcagctgcgtgaatttattcgcgactatttgggccctgcttttgaggaacacggactggatacggaaatttggctgggcaccattaacgcacccgatccgtgggaggaattaatgaagaagacttcgaccggattcgatgagtatgcccataccgtgttgagtgacccccaggcctacaaatatattaaaggcgtaggctaccagtgggcaggcaaaaatgccattcagcgcaccgttgccagttatcctgagcttcgttacatgcaaacagaaaatgaatgcgggaacggagaaaactcatgggactacgccaaatatgtatataatctgtaccagcactacttcaccaatggcgtaaatgcttatatttactggaatatggttttggaaccgaaaggcaagagtacatggggctgggagcaaaattcgatgatcaccgttgatccggcggatcgaaaacctatcctgaatccagaatattacgtcatgaagcacttttctcattttgtattaccgggtgcccgacgcatcggacttcgtggttcatggactggaaatgcagttgcttttcaaaatacagacgggcaaagggtggtagtcatcgccaatccgttcaaggaatcgcgtgtgctgaatctgtctctcggagaaacaacacaccgcttggagatggagccggagtcctttaatactattgtgattccttcttaacgccgcagatttctggactcttccagtcttgcacacatcattaggtacccctgtccagtctataagtgtccaagcatatgcatagtttccaaaatggatgtatatccttttgcgtatagtagctataaatagtatacttggaataactacggacaggaggtcgatgaatatcactactgtaaaagaccggatagatttgaagctgattaattgtgataaggaattgactctcgcggtcatcggtggaaaatggaagctgattattttgtggcatctcggtatggaaggcaccaagcggtttggtgaattgaagaagctaatcccccacattacgcaaaaaatgctgaccaaccaattgcgcgaactagaggaagataaactcattctgcgtaaagtctatcctgtcgtccctccgcatgtggaatattcactgacagagcatggcgaaagcctgattccggtactgagagcaatgtacgattggggatcaaactatcgcgagaacgtgatctggaaagaagaagaagagattcaggacgtcacacccgtgtgatcagcaaaacaagcattttgcgaaatgctgaactatatttttagtagagacgaccctggggagatctggggttgtttttttatgatataaagacgttccccaagataacaaaagaaatggatgcaagtatccgtttccattggcattaaagctcgtttttcgctacatatccccattttacacttgtatccgtgatttacattacatcctctgtgacgtatgattcttccatccctatttacagtgaatccaagaaggaggccgttctagcatgagcatgacgcttgcccagcccacaacgtcccaagcgacccaattacgcattggttccatggaaatgattcaatacgactatcgtcaatttcctgactcaaaaccttatcaacaccattgctgtggcttgcttactatgtcgtgtaacctcaaggtgaccatcctcccccctcggattagtcgttcatatctcatagagcatggcctggtctactattcattctagatatcgtccacaactccattgtcaatccactttccagttcacgtaaaaaagcctgagactgtttatcacaggccaggcttttacactttcagcatagagttaattacacttgcaatttacctgcacgaatatcgtctgtcattcctgcgtaaggtgcttgggaaattagttgttcgttgttcacacccgcattttcgatgaatgtaatatctgcaaattcaggaaccacatacttcggatacgtttcatacttttcacgcgattcttccatcagcggaataaaatcgttttgatagcgcacagtgatttccggatgctcatgaacccatttagggaagaaaataatgccatgcatacgtttttcctcaggcataaagttcagagaaacgtcagtgcctgtcggttcggtccacgatactttatacacattttccaccaacttcaccagattgaccttctgatcacgtacccagcggccgcctaccataccactatgaatgcgataatcgatcgtatcttcatttttaatatatatttcgtactcccaaccattctcataagtgtagatcatgtggctgccgataaacttgtccatcttgcatccttctttcctaaattataagtttttatgaattgaataggagaccaaagataataaacattcaattcaaaacatgtaatattaaacatgtttttaaatacatataaattgtagcactatggtatactagtgtcaaataacgtttgacaaggagagctacgttgaaacgcacattaaaatacgccattttgggcctggttcataaagaggaaatgagcggctacgatattacgagtcaattcaagaaggaaatcggacaattttggagcgccaaacacagtcagatttatcctgagttaaaaaggctgaccgaagaggagcttattgaatatcgcacctccattacaggagccaagctggaaaagaagctgtactgcattacccccaaagggacccaagaactgaccgaatggcttctaagtcccaaagagttaccagaaacggaaaaggatgagtttatgctcatgctgtatttctcagcagccatccccaaggaagagaacaagcgattgttcgaggaccagataaccaaacgtaaagagaagctggagtatctgtacgaaagtaagaaatccctccaacggcaggacgagaaccttcaggccccaggttctaatcaattcgggcattatctggtgctgagccgtgccattaatcgggaagaaagctatattacgtggctggaagatacactatccctgtttgaatagcctaaaaaaccttcaacgccacgtagattcgtggtattgaaggtttttctaaagtacatacaaactagtctgccgtcgtaatcgaagagccgtaatcttcaatatggatatctgtgctaaaacgtacgggaatggtactaaaagtggtatcccaatcctctttgaccttacgccaagctttaggatgctgaatcctcaaggcttctccgaaacctccgacatcagcctgcagcttttgcattttggctacagtttgttcagctaatgaattcactttctcctgaaagatactttcttcttgtccgagcacagcgttgctgcgcaaattttctttcttgttaaaaacctcggaaacgcgcccctctgaggtcatttttacttggaaggaaatgtcgtccccctgaacgatggccttgatcctgcttttcactgctttgatctcataggctatatttttaccggtttgaggatcgttacctttcaacacgcctccaaccaattggcccttgatccacataagaccctcgacctctgattcattcagaaaaccaccgtatgtttgcgtctttcctttgatgatccccgcacctgcgaccttgatttcattctccgtcgaaatgacattgggtaatataaaacttcccttactcttcatgggcccgaccactttaaccaaagccacgggttttatcaaccgtgcgttccgtttacgattttggaaaatatcctttaagatataggcaggaatttgaccaggagttttttcctgaagcgcattgctcgccttgtctgtactaatcagtagctggacgctgagccgaatgtcattatcccccaagaaaaagtccagcagctcgtacaacgggatcttgcgaagcagactggagctgataataatcgttttcaaatgttgcccaatgggcggtcggttggttcgcaatgaaatttctcttaacatctcaaaaacggaatcccctgtttctgtaatattaaaaaattttttagcttgcggtgaggagctattggaaccgccgctttcctctgggatgataaattgaaaggttcccgtaattaactcttttttcggataatctcctcctttttgattaatttgctcttcttgtgaagattctgtcgctatatccatagcaatgcctgtctccagatttagatcctccacgggagagctgctccagcaacctgaaagtgtactgcatattagaagaaccgctattccgagtattcctgaacggaacttcatcatgaccccacacccctccagcgagaaataagcaggagtggcaatggaagtagagcaaataaaacgaatgctgcattcccgatgatcgttccaaaagaaaataactcattcaaatttttgggtatttgggacaggacgtagatgatcgggagcaaaataaacaacaccttggaataagagctattcaaaatttgagaaactccgagcgaggcgcaataaaaagctatgctgaatgtagcaaaaatttgcatgatccaaatggtcaacaataaggattcgaaccgttccaataacagatactccacttcaaaactgcgggccaaatctaaaaaaggccaggttctgctcataaccccttccaccgaaaaggcaccaatgcataaggtcagcgtagctatataaaaaacggtcgagatcccgatcgccagtccgattgccttggttgctctctttggtttttccatccgacaaagaataaacagcaagcattctgtccccgttaaggttagggttgtagtcttgagagctttaagcactggcatcacaccctcggacaaaacaggacgcaaattattcaattcgaaaatattcaaacttagcaagcatattaacaaaaagatagacgccgtaatcgggaatataaattggcatattttccccaacgtgcctatcccccccaagcaaagatacagagagatccacataaagggtgctgaaatagcccacgctggagttccttcaagcaaaaagaacgacgttacttcctccacagatcggatttcatatgcagctatacaaataaaatagatgacgaacaacatgcccaccaccttgccgatggctttgccggttatccgctgaacatactggtaaaaggtgctttctggaaaccgtgaacttagtttgactataatccatccgaacaggaaagtggcagcccctgctaaaatgacagacatccatacatccggtgtttttgcagtttcaacggctactctgggaagagtaagcagcccggctgccagcataaagcaaagcacaattgccgtcgtctgtagcgttgtaattttatccatttttttcccacgggccatcttgctccctcctgtgttgttgaactcatccttgtcgcttagggtctttatgcttcaatagaatgggtctgtttttcataaattgtagcggtgctcgcaagaagtaatctttccagtccttcaatgaacgggggaccgttaaactaagatatggcacgccgaagctgtgtaatttagccatatgaatgctcagcagcaggaaaaacatgatcactccatacaaaccaaagatagacgccgtgaacatggccccaaaacgaagaatacgcatagagatccctgcactgtatacaggggaggcaaaggaagaaatcgctgtgactgctaccacaataacgagaatcggacttacaatcccggcgtcaacagcggcctgtccaatgatcagaccgccgacgatgcccatcgctggaccgatgggtttgggcagccgtagtcccgcctcgcgtaaaatttcgatggaaatctccataatcagggcctcaatcagcgtcgaaaacggaaccccctgtctcgcactgataatggaaatgaccagcttggttggaatcagtccgggatgaaacgagataaaggagatatagagcgccggggcgaacagagatatcgtagttgccataaaacgaagaaatcgaataagcgaccccggtatccatcgttcatagtaatcttcgggagactgaagcatcatcccgtacgttacaggcataaggagcgcaaaaggtgtaccatccagcagaatcgccacacgtccctccagcaatgcagccatgacccgatccggtctctccgtattttggatttgcagaaagggactaagaaaattatcctcaataagctgctccacatagcccgactccaatacctcatccatatcaatagtttgaacccgccgtttcacctcgtccacaagctccggatcggcaatgtctctgaaatacaccaccatcagctgcttttccactcttttgcccactttgaaggacgacatggccagttctgtactttctccatgtctgcgcagcattgccgtattgtcgctgagggtctcggtaaaaccaactcgcggtcctcgcagcaccgattccgatatggggtcttccacccctcgtgtactccctttgggtgtgcccagcacaaaagcacccggtataccctgaatcatgagtatgactgaaccgaatagcaccttttgcaaggagaactgcacctctaacgtgtactgagtctccgataccagcatgacctgacgaataaacatatcccgaagttcttcccctctcgggagatcctccccgccttgtccggagctgccccaatccatcagcggctttagtatgttctgatccatgccaaccttgtctgttaatccatccacaaaaaaaagtgtgcctacagcgttcaatttttccagaaaaatggatcgttcgttcacgtccgacatatccgtgacggcttgtctgatttttgctacattggcttcataatcttcggtaaaggttcccttttccttctcagcctcacttacagacggattatgatctgcatgctgcgaacggtcttcttcttctaaaagctttaatcgttccatacgtctgctctctcgaccatccatcgctctgatttgtcgtaccgtcagaaaaataatcaaaggtacgatggataaaaagaaggcttccatccacacgttccatttaggcatatgagttccgatgacctgccacacactctttcctccttcacttccagatgatttgtatatagatttacctggattagaaaaaagatgcatggacaatggaataaatttctttactcacaaaaggaataaaaaggcgaatttgatagatgaactgtagtgccaaaagtggaattccatgataatatctattcattctatgactaatgtcacaaatttgttgaattcgtgggccattattcgaatctaaaaaggagttgtaggtatgaagaatcattttgggaagaaagccgctgtgttgagtttgttagcggtcattttgttagggggaacggcgatcagtcccaagcaggctcaagcatcgaccgaaccttatcttggggaaattacgatgtatccttacacgttcgctcccaatggatggctaaagtgtgaaggtcagctcttatctatttcgcaaaatacagcactgttcagtctattgggtaataattttggggggaatggaacaaccacatttgcattgcctgatttgcgtggagcctctccaatgccgaatgtagattactacattgcaaccgtaggaggattcccgtcccgtccataatgaaatgttcaatggtgtgctacttaatgaagaagaggtgatggcgtgctcgaaggcaataacttcacacgcaacaattttaaaccttatcgcttgctggttccattgctgccatttatcggcggtacgttcctgctcatagggacgaatgaggttcacgctgccggttgggaaaatgtggtacttaataagccagccacatccagtggctatagccagccctatgatccctccagagctgtggatgggtcaatcgaaccgacaagccgctggtatcaagccagcaatggtgagaaatggattcaggtagatctgagagactggtatatcgtagatcgatacgttgttacaggtatgggtgtccattatgggtggcatgatcagcgtgatccatacagtttccgattgcaaacaagcagcaacggaagtaattgggtgactgttgataccgtccagaataatgggatctctaatgttgaaaagagtattactcctgtaactacacgatacttgcgagtatatattgatcaaggaaatgcgagaaacaatcaatgggcttccatcatggaattcgcagcttatggcgagcgattgcccgttccgcaggctccgggtaattttacaggaaccaaaaatggaaatacagtggagttaagctgggatgctgttccttatgcaacttcatacaaagtcatacgagatagtgtaacgctttattcaggtaacttaactcaattcatagatacttcagcattgccgccaggtgaagcaatttacacggttcaggccgtgaatgctaagggggagagcactccctcagaggttaaagtgaacatactttccgatgccgagagagttgcacaggcaaaagctgctcttgcattaggcttcgcacctggagatacagctgattccgtatcccaaaagctgacgctgccactcgctgggttgaatgatacgacggtgagctggagttcggatactcctgacatcattacgaacgagggggctgtcacacgcccacagtatgatctgggtgaccgaaaagtaaaactgacagcaatgattgcgaagggaagcgcctcagatacccaaacttttgaggttaccgtagcgaagatcactgctcaagatacattaaatcaagcagcagacaccctctcgcttggcgatttgtctgcgctaacagaaaatatttctcttcctttatccggttatgccggagcgcagatcgaatggtcctcgtccaaacctcttgtcattgcagcagatggaacactcaccagaccctcctataacagtggagatacggatgttaccctaacggctaccctgcaacttgcaggcttaacgaaaacaaaggattttactgcacacgtactccgtctgccgatgagcgacactgaagccgtagacgcagcatacagagcacttgaactgccgataacgacagtaacgggagacgtatatttgccaaaagatgctctgaatggtgttcaggtgtcatggtcatcgaatcaaccccagttcttggatcatactgggcatgtaaccttcccaagctatgtacagggcgatcagaccatcacgctcgaagcagttgtatcacgaggcgcggttgagctacgaaaaacatttagcctgctcgtgcccgcactgcctgtaagcgctgatgaagccgtaaatttggcagcaaatacactgaatctggattatccgcaagggattaaggattccatcgctctgcctcgtacaggagcatttgacacccagatcgactggtcttcggatcaaccagatatcctcagcaacagcggtcaggtgaatcggcctaaatatacagatggtgatgtgaatgtacaattaatggccattatttctaaaggtgcagcttctgtacaaagaacattcacgatcacagtactgaaggcattaccgaatacaccttacgtacgattgaacggcagcaatccgattgttctggaaaccggcgatagcttcactgatccaggagccagcgtactggacagcgtatacggcaatatcctgatccctgagctttcaggtagcgggaatgtcgatacaaatgtacctggcgtatacgtattgaactatgcttatagcgacaatgggggctggacggcagaactggcagaacgccgtataaacgtgctgcctcgtgctgttacagccgcagcaggcactgaggatatagcctcagtgatcgttacaggcgcgttgccgagcgcacggcttgagctgtacaatgcccagcaggagcttatagcggaagggattgcttcgggagagggaagatatacatttacgcctgttcctgaaggagccagctactatgtgctgcagaacgtaaatggcatgaagagtgctccgtcagggctagtgtatccgcaagggttaaccgcgcagcgcgttgcggattccatcacaagcgtagcagctcctacaacaagtgatacactgctcaggttgcctgttgtacctgatggtttccgtgtgaccatcagcagcagtagccagccagacatcgtgcgtacagacggaactattattcaagcagatactccttccgttgtaactatcatgctggatgttatgagggtaagcgatggttctcatgctttgacgcaagccatagaagtcaccgtccctgccaaggtaattgcgaacacaggcaaatctaacaaagataagaatgaggatgtatctgctttcgtaccacagatcggattttccgaacaagggaaagagttttccctctttgttccttcgccggcattcctggatgagcagatacagcaagcacttcgcgaaggcaaagcatacgcagacattcgtttggagcaggagaagcaactaagtcgtgttatcctttctcattctttactgaataaatgggataagattggtgcatcggtaatatcccgatatggaacactgttgatatccagtgacaccttagccagcatggcctcaggccagcaggacgttacattgtcattccagcaggcagatgtacaacgtgcacagcagatccgtgattgggccgagcaacaatccagcctgacgctgatgggtccgattacagacatcaaagccaatgtgactgggacctcgtcgatcattctaccgctggataacgaatccttaggtgagttacacaatacagagccccagttctccattgttgttattcatgagaatggtgagcgtgagattctaaaagggactgctgtaatggattcaaaagggatgttgtcgggtgtgagtctgaatacgaccgggttaggtacctttgccgtcgccacagacgccaagactcaaaccaataatgccagtgtgcaaaatgacccaagcaattcgtcagatccacaagtgctagctcaggtatggccggatgtacaaggccattgggcagcgaagtccctgcaatctcttgcagacaaaggctggatacaaggctataaagacggaaacatacgccctgatcgcgctgtaagccgtgcagaatttgtagccatactgaccagagcattgggaactgctggagatgagagcccttctacctcatttacagatatgcagggacactgggctggatcagccgtggattttgctcatcgccagggatggattcaagggctaaccgctcaaactttcggacctgatgacagtcttacccgtgaacaggcgatggtgatcctgtcacacgcgatgcagaatcagacatccatttccagcactgctgcactgcaatcctacaaggatgagcagcagattgcagcatgggcctccgcagcattccagaatgcagtatcctccggttggatcagcggttatccagatggaacactcaagccaaaagcggctatcagcagaggtgagatggctgaactgctggtacgtattcttaaataagacgttttaagctccatagatcagatgagtatacgcacatacaacgcggcctccatgctttttgggggccgtatttttttatgtatattttatgtacaagcctttaacaatcatttttgcttgtttattcacccttttcgcttcagtaaatatattatgaatatctgcgaagcggggcgatgaaccacctgtcacctctacagtaggaagaatgaggaggagatatttgagcatgaaacataaaaaaccgttcaggttcagtggtgcttcaaaaaaagacgaagactgtaaaccaacaagagtaaatagaagtatcgaagatcttctcagactgattaatgaattgaccgcgatcatccccatcgtattcgcaaacccctctgcgactaatgtatcttccttgcaacagattttaagacgtttgttgtctctggcgaaaagcttaagacttagaggcggggttaaggcagacttactggcagcgctggagcttgctattgttgcgttagaagctacacccttctctccgatcggcgtaggtactgcactgcaacaattgctggatgccctattgtccatcgttttacaagaatccctcgatcctgctcttaaagacagcttaatcagcgcgatcagaatcgctggaaagacggttagcaacgtattaggtgaaacatacttgtcaggggagcccggtgcacaaggacctcctggacctgcgggacccggcggtgtgcctggaccagtaggtggaccaggcccacaagggcctcccgggcctcccggacctatcggcgccgctggacctatcggtgcggctggaccagtcggccctgccgggcctgtggggcctgccggaccagttggagcagctgggcctattggcgccgcagggcctatcggggccgctggatcggaaggccctgccggacctgtcggcgctacgggtgctgcgggccctgccgggggtgtgacaggtgccacgggcgctacgggcgcggatggattgatcgggcctgcgggagccacaggaccgaccggggctgatgggctgccaggcgcggttggcgctaccggagccacgggcacagctggtgttactggagcgaccggttcgggagccatcattccgtttgcttcgggcggacctgctatcctgacaaccgttcttggcggggtggtaggaaccaccagtttgatcggctttggaagttcagcaacagggattagcctcgtaggcgataccattgacctcacaggtacacttgtaggacctctgatcaactttgctttttccgtaccacgggatggcgtaattacatctattgctggttacttcagtacaacagctgcgttaactctcgtgggttcaactgcgacgattactgcccagttgtttagttccacaacacctaataataccttcacagcagttcccggagctatcgttacattggcccctccactggatggcattattgctttgggaacgatctctagcggtattactaccgggttggctataccggtaaccgcacagactcgtctgctccttgtcttctctgcaacagctacgggactttccctcgtaaacactatcgtaggttatgcaagtgcaggcgttaccattacctgatccgagacgaaaaaagggcccaacaggattgttcctgtcgagcccttttttatttgtattccatcagacggactaaaccgtttcgagtgatacttttacttcttctccctcttcacaaacggcgaatgttttaacttgtccgtgatcaggctcctgaacgatgcctgtcttcagatcaattttccagtcatataaagggtcatagatataatgaccagatactatcgcctctgtaagaggacctcttttgggatgaggattgatattttcaacggcataaagctcattctccgaagtgcggaaaacagcaatttcagcacctttgatatggatggtacgccctattctaatcggaaaatcgttactgtgaccgacgacaagccattcggcatttttgatcatttgcttgatcgctcccttcctcaggcattttagatacaattacacaatagacggagtgacaacctcaaatagatttttgcgtgtatcctcatcattgatgatctttttccacgggtcttccacctgttgtagtgcaaattcgatgcgttctactaaagcttgtcgatgatctgtatcctgaacgacagccttctgaatctcttccagaccgatccgttccacccactccgaagtacgttccaggtattgccctgtttcccggtagaattgcatcacggctcctacaatatcaatcagttcagcgtcggtttttactttacagagtgaatcagccaaccgcgctttaataccgccattaccaccgataaagatctcccagcccccatcgttgcctacgatcccgatatctttggtacaagattccgcacagttgcgtggacatccattaactgctaatttgaattttgctgggaaatccagtcgttcgaattttcgttccaacacttctcccattcccatcgagtcctgtgtgccaaaccgacaaaattgcgatccaacacaggttttaaccgtacgaagtgacttcgcgtaggcatatcccgacggcatatcgagttcttcccatactttaggtagatcctctttacggacaccgatcaaatccagccgctgtcctcctgttactttaacgaccttaacgttgtatttaagagaaacatctgctatcttcttcaaatcttctggggtcgttacaccgccgtacattctaggaacaactgtaaacgttccatccttttgaatgtttgcgtgcaatcgctcatttacaaaacgggaatctccctcattttcataggtatccgggttaatcattcccaaatagtaattcagcgccggacggcatttggagcatccttcatcattatgccaacccagtacattcataacttcacgcgttgttgtcagccctttggttttgatcgcttccacaatctcgtcccgactcaatgttgtgcaaccacatattccttgcttggctgacgtcttgaagctgtctccaagaacatattgtaaaatttgctcaacgacaggcttacatcctccacaggaacgtgttgctccggtgcatgccttaatttcatcgactgtggtcagtccattatcattaattgcatccacaatcgcctttttagtcacaccgttacagccgcagacaatttcatcatccgccatcgtttcagcggataatgttttcgccccgtgattactacatccagtacccatgatctgtccataaatctcatctgtcatcaatgtttgctgacgcacatatttttgaagactagcagattcgcttacatcgccaaacaatacagttccaacaattttattttcacgaagcagcacttttttgtatgtgcgcttccactcatcctttgcaacaatcaccgtatgttcaggctgggttatgaattcgccagctgagaaaacatccacccctgaaattttgagcttggttgaaactaccgatcccatataaccttcagtttccgcgcctgccaaatgtttggcaatgacacttccctgctcaaacagcggagctaccaaaccgtaacaggttccacggtgttcaacacattcccctacggcgtatacatccggtacggaggttctcatcaaatcatcgactacgataccacggttcgtttccataccactttgcacagccacctgaatattaggcttgatcccgacggccataacgaccaaatccgcttctagctcgcttccgtctgaaaaccgcagcccttgtacccgatcttgaccatacacctccgcagtttgcatttgcatagcaaacttgattccctggcgttctagttctgctttcagcatcgcagaggcttcccgatccagctggcgttccatcaaatcctccattaaatgaacgaccgtaacatccattcccaggttgaccaagcctttagctgcttccagccctaacagacctccaccaatgaccgctgcctttttaaaggtcttcgctgcctcaagcattgccgagcaatcggcgatatctcggaaaccgatgacacccggtaattctttacccggaataggcagaataaatgattgtgagccagtagctaccaaagctacatcgtaatcaatttccagtccgtcttcggtgtgaatcttcttgttctcaccgtcgatgcttttcaccatttttcctgtatacaaagtaatcccttgatccgcataccattgcaaatcgttcagtatgatatcatcaatcgttttactgccttctagtacataagagagcatgatcctgttatagttcggatgcggctcatttcccaagaccgtaatttcatacttatccgttaatttcaaaatttgttcgaccgtattgataccagccatcccgttccctataaccacaagtttctgtttactgtttatcatataccggttcctccattcattcgacgatactccctatccgacgacatctcctacgttcctatgaatattgcttatgcttctattctaatacagcagatagagctatatgtgactagaatcacaatgtagttcaaattaagaatatttagggatttccctattccgtttcaagggataaaggtaagaagctgaaatcaaatttcaggaatattaaatacatcacttgcccaattcatcgaacgaatctttccatttaatgagtaattgcaacctttataaggaatactttaggaacaacttgtatcttaaggaaacatgaattgaatcgtatggaggtgatcatcatgtggtctaaaataatttcttatattccaagctggagtacactctttcaagcaggcctcgcgttggttattcctttaggaatttattatataaacacatcgatttattcgtttgttggcagtaagggagcaaaatccaaacattcttctgatcgtccgctttccgacgaacataacgaaggccacgctgatcaacagcatgaaccaagctccaaaattacagggaattatgattccgacttcaagtcgattcgagaggctataggcgaaaatagtgatgtgcattttcgtgagtttgtagtaaagaaatatcatgctcggtccgtgttaatcttcatagaaggtatgcaggatgaaaagcttatgagcaagcaggtattggaggtcttgatgttcgagggccagcaggacccacagcgcccacaggaacagcaggaaagtataagtaactcctttataaaagataacttgatgccacttacgcaaattagtgaagttgctgatatggaggacctgcaggagtctatacttttaggccatactgccttattaattgatggaatgaagggagcactgctggtgggctcgcccaatggcgccattcgctccgtcaatgaaccaacctctgaagcattacttcggggtccccgcattggttttacggaggtattaagtgaaaatacttcgatgcttcgacgccaaggcttaaacaaaagtctggaaatgaagaaatttcaagtgggaagccgaatcaaaaaagatctggttgtcgcgtatataaaggatattgtgaatccagatctcctcgaagaagtaacccgcagaatttcaaagatagacatggattttttggctgaatccggttatgtggaacaacttattgaagacaattatttaagtccgttccagcaggctcacaacacagagcgtcccgaccgtgtcattaatgctttgttggaaggaagaatagctattttgctggatgggactccctttgcacttattgttccggtgaccttcagtatgctgcttcaatcacctgaagactattatgagcgctggattccaggaacacttttacggctgttgcgttttagcggggcttttatagcgcttatggggcctgctttgtacatctcttttatatcgtttcatcccggtttgattccgaccaagctggtcattagcatcatcgaaacccgtcaaggcgtccccttcccatccgtcattgaggttatgattttagaaatctctatcgaaatcctacgggaagccggcattcgcttgcccaaacccattggtcctgcgatgggcattgtgggaggcttggtcatcggcgacgctgctgtaaatgcaggcatcgttagccccttcctggtaattgtggttgcggttactgccatttcttcgttttcaataccgacatacagtgcgggtattaccttgcgtcttttgcgtttcgtcggcatgctctttgcagccatcctgggcatgttaggaaccatattgttctttctgttaatttgtatccatctgacgaaattaaaaagctttggcgtaccgtatgtaacgcccttttcccctatgcgcctaagcgattggaaggatatgtatattcgagctcctatatctatgatgaaaagaagacctcttatgatgaaaactcagcaaaccaaacgtaggccatgatgccaagacgaaggaggagctatggtgtttagacgctctgatgataagatcacaaccaagcaggcggctgtgttcctgaccaataccgtattgggcgcggggattttgacactgccgagaggtgtaactgaaaaggtacagactcctgatgcatggctttctgtccttctcggtggatgtattgtcatattggtcgtctggctcatggtgaaattaagtcaacagtttcctgaaaacaccgtgtatcaatattccagaagaatcgtgggcacaattccgggtggatttttaagtgtgttattgattatatattttttaatcatcgccggctttgagattcgggttttagctgaagtgaccatgttttttctgctggaaggcactccgatctgggcgattgtgattccattcatctgggtaggaagctatttggtttttggcggcattaatcccatcgctcggctataccagattgtacttccaattagtcttttttttctgctgctctgttttgtctttagcttaaggatttttgagattgatcatcttcgtcctgtactgagtgaggggattttacctgtcatcaagggtctgaaatcgactattcttgttttctctggatgtgaagtcgtcatgacactggtcgcttttttacaataccctgagaaagcattaaaggccatggtagtggggatcagtatccccttaattttgtactttttgaccgtagttatggtgatcggcgggttatcgatggactccactgtgacaagtacttggcctaccatcaatttgatgcgcagttttgaaatccccggttttctttttgagcggcttgagtttcctctgctagtgatctggatgatgcaaatgttttgtaatttctgcagtttcttcttcaatgcttccctaggggtctcacaggtgttcggtcttaaatatcgttatgcgatttttggcttaatcccaattatttttatctctacaatgactcctgttcgtatgatggaagtgtttagtctaggcgatgcgatcggatacatgggaatcgttatatttgttctggttccggtacttctctccatcgtgttcataatcaggaagaagggaatgaagcaaaatgtgtagacgccctatgctatccttgctgcttgctttcattctacttataactcaaatcggttgctggagcagcaaagaagtagaagagctcagcatatatacaggactggctctggataagggggagcttactcctttagagcagaatctggaaaagaaaggcagtcgttacttcaagaaaaataaaattaccgccagtttacaaatcgtccccaaaaaatcatccggaagcacagagcagcaaggcggtggcggacaaggaccaaattatgtcaatatagcagccaccggggattctctgcttgaaatctttcgacaactctctctccgtttggatcgcccggttattggtcaccatctaaaggtcatggtggttgccaccgatttggcgaaagaacagacgatgcagcaattaatggattttgtgctacgtgataatgatattcgcccgagttgtttggtcttcttaagcaaggatcgagcagctagcactttagttaccaaatatgaagacgaggtcccatccattcatattttgtatatgcttcgtaaccatttcagaaccagcaaggtaatgaggggagtcaatttgtctgaattggatgggttgatgcactccaaaaaaagctatatattacagaacatcactgaatcagatggagaattagaattttcaggtgccgggattattaaaggagataccggtcactggataggtactttgggacaacaagacgtggagagtattggatggattaccggtgatgttaaaggtggggctgtcaaaacgtatgacaagcggaatgaagccataacttacgaaatcaaatcggtaaaaagcaaaataacaaccaaggtgaccgagggcaacgatatctcgttccacgtaaaaattgaatctaaaggacgtctaatcgaaaactgggatgataaagcggacccgactgagacacgaaacatgaaagaggcagagaaagaatttgaagaacaagtgactcgcaggattaagtctgttatgcacaaattacagtcagaatataaagtcgatgttgccggctttggtgatcatttgcatatcgagaaacctcaggtgtggaaaaaagtaaaggatgattgggattacaaattcagcaaaatacccgtaaccttcgatataaaattatccattacggatttaggctcatctgcggaatgaaaaagtcgaattggtcttatataaaggccaattcgacttaagattcgcggttatctcttaacctttcaacgctgcaacggtcgttcctgaatttccagaagcggctacatgcttaattcaaattgattttaaatacatcccctgcattgccgcccaaaacgatcaagccgcctttgggcagtacaatcgaattgttattgctagcagttgaaaattgtacaaccgctccgttttcatcatagacagcgaaccctccgcttgttgaaaaatcaacggtcatcgttttattggctgagtttttatctattttataccatgtggcttggccattagatggtatggtgtacactgactttcctcccaagataggtttaacagcatcttcactgatataggattgtccatctatggttaaatactccgaaccatccttggtataaaaattcagatcaaatgcatctcttccactcataacaggaatctcaacggcatttactgctttattctcatccacaattttagtaccacttgcgtatccatcatgatcaaaggatatttttttcgttataaatgagggggccagatagaatatggaagatatcttttcatccaaagcataataatttttcccgtttctgttttcccatgcctttttaactatgggatttacaggattggcatctagcttttgatattcataagtcaccataaccatttgacctaatcccgaaaagtttaaatataggttagccttaatatacgttttcccgtttttttgattgtcaaagcttatggctacactgccatcactgcttttgaattgtccattgcctgtatacacatatttttgcgccgggacgaatccatccaagaaagcaggtaaatcaaactcaccgtttttaatctctacattgatggttgtacccacagaaccgtataatcccgaataagaaagtaaatcagatggcatttccacttttacaggaggctcaaatgttttctccggtatgatgtctttaatgatgcccttatcttttaaaacttccaataaaatgttagaagcaaaaatactatctaagatggaagaccctccagatgaaagcacagccatagaaatatgatgctctggtatggtgatcaaagtagagtgatacaaaacagtatccccacccttggataacgcagttattccgtaatcactaaacggtgccaactgaaccgcatcccaaccaagtccataattaaagctgtttgtctcttcaggtacccatattccatttcgatattcatgacttttcatggacttcgccgattgtgcagacagaatatcgggtctgttccccgttaatacttctgaaaacatagccacctcttctgcggtggagtataagccccctgtcccgatgacattggcattttcaaccggtaaagctccctcaatcgcaggaaaataagttttggacagcttttgtctatcaaattgatcgagaggtgttttggtagatttcaaacctaaaggtgtactaatatgctttgccaggaaatcggtgtaacttagaccgctcacccgctcaaccaatatttcaagcaattgaaatccatcattggtatatacggaatattcgccagggtttgattttaaagtttctgattgcaaccttagcaagagctcatcatgattttctgtatcattgtcattaaataacatactatttttatagtgagcaccgtaaagacctgacgaatgatttaacagcatacggggtgtaatttgtttgtatctttcatcagacattttaaagtccttaatgtatgttgttagcggctgatcaatatctaccttatgggcatcgaccagcatcatcgttgcagcagatacatacattttgcttgtagagcctataccgaacatcgtatctttggtgatcggctcgttggttgctttattctttacacccacgctatccgataatacaatgtttccttggtccataatggcatactgtacaccgctagcaccgtatttggataccagctccgaggctagactgcgagccttttccttgatgggttcagcagtgccttgagcaaaagtattcgtcatcggcagtacaaaaagcatagcagaaacgaacacagctattattttcttcattccatatttcctcctcttatagcttcaccaagctttattactgacctgatcatacaatgaacgaggattctatataaaaaaacacccttaaatgtaaaaaacaatccctaaacaacataatgtctaaggaatgtccttataaaatggcaataaaaccatattattgaatactttatttttcgtttcaatggtcatattcccaccatatttgtcacatattctagatatattggttaagccaataccatgaaaatccggatttgatttttgactatgcaaatgagccacttcattctccacatgattaaggatgtgaatgaaaagcgcagactcattggaatgtattttaataagaatgtacctgtcatcggcaatcttgacctttttggatgcttctatggcattatccagcaaattccctagaactacacataaatcataacgctcaatatttactttctgtgaatataagtgaagttgggtatctatctttatgccattggcttgcccaatattaagactattcgtgacaagggcatctataaccagattaccggtattaaccctttgatatgctccttcgattttatttaaggtaaccttaatatgttcacttgcctctgccaattcatttctcttgatacattcttcaatatacaaaaactgttggtgtgtatcatgaatgattctttttatatttttgaagctgtgaaccgttttttcgtagttagcatcttggtagtccatctgatgttgtaattgagcattttcatgcattaattgaaatttttcaatgacattatcaaaaatatatatgataaaaacatttaaggaaataaagccaataatagaaccaaaataatacatattcttttcactataaacagataaaacattgacctggtataaacttatgatgggaacgattagaaataaaatatagtaacgatgctgcaaagggaaggttctgcgtttggcaaatagccgtataatctgaatgacagcaaacatgataatgcagctgagtaacataaccttagagaatatcaagtgatcttgtccactcaaatggctaaagttgctaattttaacggagcctacagcatataaaatataaagagatataaaattaacgatggttatcaatacagcataaagaatagaaaaaatgatctttgtctttatttccactgtatacgattgcgctaaactaaatatgacaagtaatgctaaaatcgaagataccgcaggagtcaaataaacacttaaatataaggaattcagcaacccaaaaataatgaagtacacgaatctgttcggctttcgattggacttatcaaaaaccgagttaaagtaaaaattcacttggaagcacataacaaggacaacgcaaagattaagaagcagggagttatattccatcatattaatgcatcttcatgatcataaatttggtatataaatctttaacttcttttattttagaacgcccaataggtaacttcacatcatttgacatcaaaacatcaccgccagcaaattttttcacatgaattaagtttataataatcgaacgatgaatttgtagaaaattatgttcttttaatgctgaagcatagtccgaaagaatccctttgctatcataggtttgagtagaggttacaaaatgcagtttgttttttatggttaagcttttgaccacttcaatactaatgatatcatcatattttaaaagcacttcctcataagctgacttgatgataacgaattttttatcgagagattgaaaatattgacacagctttatcattttttcctcaaagatatggggagcaatcggttttattaaatactgaaatgtgactacgtcaaaactttccaccatatattcagggtagctcgttaaaaaaacaatctgttcatccaggtgatttaaactccttattttttgggcggtttgaattccattcatgccattcatttcaacatccaatattaagatatggaatggagactcatggttttgataatgagataccagctgttctccggagtcgaataattcaactttaaattctatactggtctttatcgacaaagtaatcagcatatttttaacaagttctctctgcttgtgctcatcatcgcagatcgccactctatacataaataacatacacctcgttcccattgcattgatcatggaattgtattctaaacagtatataaccttttaatattcaataaacagcttttggataaaacgcaaatccaaatccctcaaatgccagtatacaagctgctcagcagttgcatccaaggtaaaaaagaaaccctcgtcttaaaagacggggtttcttaactattttattgattgttattttaaaaaatctgctctcttgtcttcaccgtgggaacgtctggcaaagtcgataaattggaatttgtctagccgatgccttgactcggtatactggaacaacgtggtgtcctccagataaacatagttacgtactacgaccacatgagtgtagttctgaaggtccatcagcctatgatcttcttcgtctgcattttctacagaaaccacttttttggcataactaatttgaagatggagctctccctccaaatattcgtagatggacccacgactaatttcctcggtaagcacaggtacaatgtctgatcgaaagtaatctttatccagtatgacgcattcaccttcaatctcacgcgcacgaataactttccagaccaaatacttgtctttgtcaatctcaagatgattggctatgtcatctgaaactggaattagctgattttcatgtacaatggttcgtgatgtacgcccaattcgttcagacatttccttgaaactgaccagtcctcctataggaaaatccatccgtccaatatccagaacaaaagatcctttagcttttattttatggatatacccattttgtgcaagcaagtgaagtgctttacgtacggtttcacgagaagtgttatactctcgggccagttcattttcagatggcattttcgtgcctggagccaattcgcctgtctggattcgtcccgaataatcctgataaatttgcaaaaatatattctttgtcaattttcatcaccacgttcattgtagcattctttcacttccctgttcactataatagactgtgcgaattgaatctgaattaattcctatgacctgatgaagaattcaaatgaattctcattaaggtatactgcaaatcgtctgcctcacctggcagttcttcaaccgattcaatcatactctgaccatccggcacaatgactggtgtaatgacgggatatccggatctctgaatcagatcacggtcaaattccatcagtagttgtccttgctccacggtttgattggtctccacatgcatggtgaatccctcacccttcagtgacaccgtattgatccccacatgtaccagaatctgtacacctgtcgaatgctccaaaatcaaggcatgcttgcttttcatcatgatatgaataacttttcccctgaatggggcaagaatcttgccatccttcggttccactgcaataccttgccccatctgccgttcggcaaaagccgggtcaggaacttgttccagcggtacaacacgtcctcgtacgggagtcctcacttcaagcacatctattgcagtattttgcggaagcgagtctttttgtacggaatcattggctggtgcagcctgacggcgcttatttagcagtttcccatacataaaagttaaagcaaacggcacaattaacacgatcgccatcccgatgaagaatacaccccagttgtttgggaaaatagacaagaagcctggaatcccgcccacaccaatggaagaagccatcacatgatttacggtgagcagtatacctgcaataccggaaccgatcattgcgaatacaaacggatatttatatcggatattcaccccgaatatggcaggctcggttacacccagaaatgcagacactgaagaggtaagagccaatccttttcccttttgctccttcaataccagcatcattgccagtgctccggcaccctgagcgatattggacagcgccagcatcggccaaaggaatgttccaccctgcgtaccaattaattgcacgtccaccgccaggaaagtatggtgcattcccgtaatcacgagcaaggagtacaagcctccataaatcaggcctcccagcgcaggagccaaatcgaaaacgtatacaagaccagacgtaatagcattaccaatcataaaagtaaccggaccgatcactgtaaatgccagaaatcccgttattaataatgtaatcggtgctacaagtaacagtttaaatgaatctgctatcttcttatttaggaatttctcaatgtgcgcgagcacgtaagcggatactaaaacgggtaaaacctgtccttgataaccaatcttgttcacttcccacccaaacaaattccaaaccgggacggttcctttggtaacagcatctgcataaccgtatgcacttagcagatccggatgaaccagaatcaaacccagtacgatcccgagtaaaggactgccgccaaaccggacaacagccgaccatccaattaaggcaggtagaaatgtaaaggcggtgctggcaatggtgttaatgatagcagcaaagtcggtccattgaggatagacctgaaccagagccataccttcgaagaagattcccttgccagtcaaaatattatttattccaagcaataagcctgcagtcacgattgccggcaagatggggataaaaatatctgccagcgtcttgatggcacgctgaattggattttgttttttgcttgccgcatttttgacatcgtctttagaagcccgactacctcctgtaatggagatcatttcgtcatataccttatccaccagacctgggccaatcacgacttgatattgtccttgtgaagaaaattggcctttgaccagatcattttgttcaagtgcatctttattaaccagcttatcatcataaagggcaaatcgcagacgagttacgcaatgcgtagaggcctctatgttgtctttgccaccaacggcttttataatgtcttctacctgtgatctttcaatcgccatttagcccactcccttaacgtttgctcattttaaagtagcaaccccggttatcaaaataacatgcccagggtgctactagatgtctccatactattcactaagtctacgaacaatccacatatatgaagcatatggggttaaagagatcatttgttttagctctggggcgtgctgggtattaccaattaagagctcagccgcatccaacgcttgatttattaatcgtgaataaaatgaatccggtatacagaattgcgcatcctgtccgctaaaattagagatgacgatcaaagtctcctcttcattgctgcgttgataggcatagacctgaggatgagcttcgtccaagcgttgataattcccatcggtaatgacttgcaccgtcttacgcagatgaattagcttacgataatggtgatagatagagttcgggtcctctaactgagcctgaacattaatctgtggatatcgttcatctactttaatccaaggagtgcctgtagtgaagcccgcattgcgagtgccatcccactgcatcggtgttctcgaattatcacgagaccgctctcgaatgatattcaatgcttcttctgcacttttgccttgctcctgtaaaatacgatacatattcagagattcaacatcccgaaactcttcaatgtctgcccactgcgggttggccatcccaatttcttcaccttgaaatatataaggtgtaccttgaagaccatgtagcgtggttgccagcagcttggcgctttccgcatggtattggccatcatccaaaaagcgagagattgcccttggctgatcatgattattaaaaaacaatgcactccagccgccaccctgttgcatgcccgtttgccaatccgagaatagctttttcagcatttcaaaatcatatggcatgagttcccacttctgtccatttgggtaatccaccttcaaatgatgaaaattaaaggtcatggacaattcttttctctctggattggaataacggatgcagtgctctagggaggtagaggacatctcacccacagtgacgctattttgtttggcaaatacttcctcatgtaactcatgaatgtattcatgcacatgtggaccgtccgtataatatttacgtccgtcgccaggaagcgtgctcccatcatcattcgagaattgttgatctttggagatcaaattaatgacatcgagccggaaaccactgactcccttctcagcccaaaattccagcagattgacaacttcctgacgaactttgggattttcccagtttagatccgcctgagtcttatcaaatagtgtcaagaaatattggccagttgcctcgtcatattgccaagcaggtccaccaaatttggaaacccaattgtttggaggtccaccatcgggtgctggatcacgccagatataatagtctctatactcactatccttagaaagccgtgccttctgaaaccaggcatgttctgtggaagaatggttaaccacgatgtcgatcattaagtacatctcacgtgcccggattccctcgctcaattcttcaaaatcctgcatggttccataatcaggattaatctggcaataattagctacatcatacccgttatcacgttgtggtgagacatatacaggctgcaaccagacaatatcaacacccagtttttttaaataatccagcttttgcgtcagtcctcttatatcaccggttcctttgcccgtcgtatcgttaaaacttttgggataaacctgatagactactgatttacgccaccagtctttatcttgaggaattaaagtcttgttcattgcttccattcatgctcattcctttcttgcgaaatgaagtagcgtaaaaataatataacgctttcattgccttgtatatacaagattaagtcatgtatatacaagttgtcaacagctttatctattaaggtaatacccgttttgcagccaaatgatcaggagactcatctattctgttcgattgtatgttatgactcgtagaataagctcaattcacacgaaaaaaaggctcctgcctatagtcaggaacccttcttttctatgatgaataaggtgctcatttacatccatatcgatagtgcactataaaggagcaataaggacattatgatattgaaggaacgctcatgcttattcaagaaatgttgaaacacggcgccaaaaatcgcccagcatactacagctacaaaaccaatacaggtcaggagtaatgaaatcgtaataagctctatatacgatacatcataaggcattacaaacgttgaaatgaccgtaataccatacaaaatgatttttaaattgataaattgcagcagcagtcctgatttgaaggaatatccctcattgtgatcattatcgtccgtagaggatttgctccttgcaattttcaccgccagatagagcatgtacagactgccgaggacattcatccagatcttaactcgtggcaaaaaatgatacaaagcaagattaaaatagcaggctaacagcataatagcgaaacagcctgctgttactcccagcaagaatgggaatgcttttttcaaacccaaccgtctggcactgtctaaagacataatattgttgggacctggcgtaaagctggtaacaagtacataagaaaggaacggaataaatggcatgcaacaatcaactccagtatgttataattgaatgaaatgtacgttgaagcgcacatttgtactttatgattgtacaatatgttctttataaagcacaataggagcgaagaattatggagaatattaatctgattttaagtaaaaatttgaaatatctaagaaatgaaagaaaattaagtctagataaattagctgatctgacggggatcagtaaaacgatgctcggtcagattgagcggggagaatctaatccctcgattacaaccgtatggaaaattgcgaacggcttaaaaatctctttcactgctctgattaatgaaccacctgcagatgcggtagtcgttcctaaaagcaaagtacaagtgcttgaagaaaataaccactatcggttgtatccgtttttcccctatgaagaaagtagaaattttgagatttacaccgtagagattgaagcaggcggagaactgagttcagcgccgcaccgtgaaggtactgaagagtttattacggtatttgagggtgagatggtggtgaaaatcagcgaagaaatgcacacggttaaagctggggattcgatccgctttaaagcagaccgcccacacatttactataatctaggagaaacactggttcggatgaatatgattatttattactctgtatagtagttcaatcttgaagactataagtgttcaagactataagtgttcaagtctttaaattcaaatgatcctattaaaataaggagcccttttaataggatcatcggtacaaaatattatatgatttacttgtatgctgtttaggagattttaatttgcttaattattcgtgccggatttccagctacaaccgtattgtctggaacatccttggttactactgctcctgatgccacgacgacattattacctatcgtaacaccgggattaataactgctcgaccgccaatccatacattgttgccaatcttaacaggctttccatactccgggccagcgattcgttcaaacggatctatggggtgagtcgctgtgtaaatatgaactcctggagccaggaaacaattatctccaatacgcacttcgcaaacatccaaaatggtacagtcaaagttggcgtagaaattttccccaacatggatattgtatccgtagtcacagcgtatgttgggttccatacctatattttcaccagttgatccgaaaagctccttaagtaacttttcacggtactcacgatccgtctctgccgtctgattaaagagacgtacacatcttctcgcatactctctttcttgcgttaattgaggatcagcagctacatacagttccccatccatcatcttttgtttttccgttttcatagtcatgcgacaatcccctttatattttaatttgatttcttttctttcaccccaataggttgggctgcaccggatatccaaccagcaacaataacgccaacaagcactacgatcaaggcatgcagaagtccaacatgttcacctaaaaatcctaagcctgggggacctactaaaaaggcaatgtaaccgatcgtggctacggctccaacccggatagctgcaccacgagggtcatctccggcagcagataagcccacaggaaaaccaagtgaggctccaagcccccataatacgacgcccaatccggctatgaggtaatgctgtccccagatcactagaatgataccgatagcagccaggacagcacttcctttcaatacagggacacggccgtatttatccagtatgaatcctccggtaaaacgtccaatggtcatcgctgccacaaatagtccatacatataggaacctgttaaagaatccacgccataaccatccaccatcgttagcggtagccagtcattcgcagacccttctgcaaacgccatacctaacacgatgataccgatcaataaaattcgtctttctttccatacagcaagctgcgccttgagattagatccaaccttttgagtaggaacttctttctctatacctgtatcgtgaggcagaaaacgataaaaatagaaagttatcactgcaatcatggcagccatcgctccaaaatggaccacaacaggtatgtgtagtgccgctgctccagaaccgatgactgcacctacaagtgtccccatactaaatgaaccgtgaaaagccggcaaaagcgttttttgcaattgattttctaccgcagaaccttcgacattcagagctacttctgctgtcccataaccacctccaaagatgactaaaccagcaaacacgatgctcgtgagcgaaaatgcagttcccaaccctacaatgacaaaaccgcttacaatcaaaatcgcacttcccagaatgaccacccgtccacctacacgagaaatcatattgcctgcactgagtagtcccactaaagaacctgcagctaatccaaaaataataattcccatttcggcagtcgagacatgcaaaatatcccgtataatgggcgttcgagacacccaggaagcaaaagctacacctggtaaagcgaataataaaaacaaaatattacgaattacccgaggattcatggatggttctactggcatttacttatctccttatcaccactttttattaatcttttaataagttatattataattagtcattttattcgtatccaaactatttgtcaaaagagaattatagtcatagatcgttattgaccgtcagttgtaaacatataaaaaaggcctgagcaggtaaagcatgagcactcatcacctattcagaccttttaattaaactatacgagctttatatactgaatcaaccttgaattatcatttgcgttcttgttctattttcagtctggtttctcccagcaaccctccatctgctgacgcttgaagcaacaactcaccagccacataaccggactgtacaacaacgaaacaccttcctctgtgtgttcgtctctcattccccttgaaggattcatcgctggttagatcaccattgtctattccaaggatacgaccatcaccctgtagtttaaaggttacatcaaaattctggttaggtacaatgatcccgttttggtctatgacggttacttctacatgagatatctcatgcccatcagcaggtaggattacccgatcagcctccaactttagagcataaggaagtccggcagtggttaattcatgctcacaaaccttattgtttccattacgacccacagcccggatttcgcccggtgtatagggaagctcccatacgatcaaatgattaggataatccactaacttcctctcaccgtatgattcatcattcacgatcaattccacgctctcacaattggtgaaggtaaccaaccgtattaattttccagcgtattcaggaaatgtccagtgatcttccatggccggagatctccagtgcatcgtccatgtcggattaaattccgatttcatatgttcgttaaatacggctatgtgcacaacaggctgattagaccataaactttgttggagataagatactggtttgcggaatccgcaagtatcaatcaggcccgaagaccaccctttggagggatagctcgtttctcccaaatagtcaattccactccaaacaaattgaccgatcacataatcatgattagcgacatcaaaccagggattcataggcaaataacctttaacccggttatccttaccccgatagtatgggaatgtttctgttcccaggattagcgtatccggcatggccgccctatagtgctcataccactgctcctgatagtttaaccccagaacatccactcgttgtgccagcattttggtatgctccactttggcctcaatcgaaccctcacgcaagctgatcggtgtattatgcggctcaagcacacatgtaaccggtcgggatgggtctttttcatggcaaaaggcgacaagttgctccaacattttgagcatggacggctgaccttggttctccacttcattcccaacgctccacatgaaaacactgggatggttcctatctctgaccagcattgcttccagatccttttcccaccattcatcatataaatgctcataggaaagagatttccatttgtcaaaagcttcatcaaccaccaagaatcccatctgatcacaaagatctaataattcgggcgccatcgggttatgagcaaaacggatcgagttacagcccatttccttcagcttctgcagtcttctcttcatggctgtatcatggtaagcagcccctagacagcctaaatcatggtgaaggcacactcccttcaacttcaagctgcttccattcaacaataaacctttttgagcatccaggttcacttctcttatgccaaaaggggtacaataacgatctacctctttattttcgcaatagatcgtcgtctgggcttcatagagcaccgggttgtccggtgaccataattctggctctaaaactcgcgttttttgctccatttcgcctgtttcaaagcccgaaagagtcacccggttttcaatttttccttttatttgtccctgtgagtctagaatttcagtcacaatattacactctacggcatgctcatgatgattagtaacctggattctggcactcaccttggcttcctctggtgaaatttcaggtgtggtaatgtaagtcccccattcggttatatgaatataatccgtacaaatcagccagacattacgataaataccggcccccgaataccatctgtcaggtgaaagaatcgtattgtccactttgacggcaatcacattctcctcatcccaccgaatatatggagtcaaatcatattgaaagctaacatatccatagggccgcttgcccacaaaatgtccattgatccaaacctcactgctactgtgaatgccatcaaattgtatgtatacgcgctgttttggagaggagggcttcacattaaagtgccttctgtaccatccgacagaccatctcggcaaataagcttgattgccaccatacagcatatgtggatcaaaggacttctcaatgctccaatcatgtgggacctgaaggagtcgccaatgctcatcgttgtagtccattttctcagcacctgcgtaattaccctctataaacttccagtccgttttgaacggcataatcactctgcttcccatcatcttgcctccatttcataaagtggatgaacggatataacagcagtgctggatgaccatcacaaaagacgtgttctcattacaatatttgaaacaccgggcgatcttcaataaagtgtaccgggagcattggaaattgagcggaaagtacatctgcgagatacttcatcccaggtgcttcactttcagcatgtcccagcatgataagtgctttactttgaccttgatagacagcatctttaacatattctggtgtttcccattctgggccttcaccggcaatgactaaatctacattttcatttagaaataatggaatggctagatcaccacctcccctgtatcctactgagattcccactcgttcacatggcatggaaacctcaccagccacccgtacataacgaatatgtagtttagctttgatatattcagcgatctccttaacctccataaccggaatagtcaaaatggcggccgtcggcggccgcttcacaacgtagttgtgccagccaagcgcctgaagaagcccaaccatcactccatccggttgataacgatgtatggtgtcatgaaaccgataaatgcctatacctgcatcggcaatcagacgagatttttgcaaaaaaacgggatcatgtagtaaacattcctgcatcctctgatgactataaaagatgccttcatgcgtaatgataaagtttgcacctagagaaatagcttgttctatcacatactgtgaagcggagaaagcggttacaattccgtgtaactcagtatctatatattctggttccagcagatctacggtggtgttgggtatgcttattcccttggtcagatgattcacaacctgccccatagtcatggtcatacacgttccctcctcatggataaggtatatcaattgtaccattttatttcaatcataagtgctattctttctaacaaaacagccagttccaaaggagccagctgttttacgaatggttctattatttatacagaacccctaaaatggagtcgattcgttcttttgccccttgccaggatgtcatgacggggaactcatattgctctcttgctctcagattccatggatgaggaatgcaaagcacctttttccccgcctctagcgcaggcactaaattatgaggaccatcatcaatcaggagatcatagttaatcaggttttttcgtttacatgggaaaaagttctcaatcggaatgaatggcatatgtctttgaagccagttccatttctctacgacggtcttgggttctgccgctgtcacaataatgacatcaaaagcattgcaaagcttttccatttcttctacaacatactcgtcaaatagttcaagttcctcaaacaaacccggtcgtccataaaatacatcaagcgtgctctttggatgacgtagatgatcggtgttccaatctaacatttcttcataccgaagcggatgagtgggaaattcactattgttatggtatatggctcgtttgacgagatgacagatggtatcgtccatatcgactgcaatgattggttttctcatcagcttgcccctattcactctggtaaaatttttcataagaatatcatactataatttaatatcgtggtgaagcttaggtattgcttccgatagatctcacctttgttcaagataatcagtcaagtagaacgttaggtttatctacataaactaggcataataaagcaaaactagttaggttatttttatcttaaaaaaactaaattacaaataaatatcgaaggaatacatcttaatagaagcaataagtacaataaaatcatagaaaaatcacacataaataagtaatctatgtgtctgcatttcaaaagcaaaaaaatagccaaaaaaatcaattgcataacaaaaacacaaatgatagaataacaaaaaaataactattaccaaaaatgaaagcgttttatattgtgtttagcttactgctgtatacatacttacatacctacttcatctctatatagcaggaagttgaataatatatttagggaggaataaaaatgaaggtattgttaagaaaagcattattgtctggactcgtcggtgtgcttatcatgattggtttggggggattcttctccaaggcacaagctgcttcaggattttatgtaagcggtaccaaattgtatgattctacaggcaagccgtttgttatgagaggcgtcaatcatgctcacagttggtacaaaaacgatctttatacagctatcccggcaattgcccagacaggtgctaataccgtccgaattgtcctttctaacggaaaccagtacaccaaggatgacattaattccgtgaaaaatatgatctctctcgtcacgagttacaaaatgattgctgtgcttgaagttcatgacactacgggcaaagacgactacgcgtctttggatgcagctgtgaactactggattagcataaaagatgctctgatcggcaaggaagatcgggttatcgtaaacattgcgaacgaatggtatggttcttggaatggaagtggttgggctgatggatacaagcaagcgattcccaagttgagaaacgcaggtatcaaaaatacgctcatcgtcgattgtgccggatggggacaatatcctcagtctatcaatgactttggtaaatctgtatttgcagctgattctttgaaaaatacggtattctccatccatatgtatgagttcgcgggtaaagatgctcaaactgttcgaacccatattgataacgttctgaatcaaggacttcctctgattattggtgaatttggcggttaccatcaaggagcagatgttgacgagacagaaatcatgagatacggacaatccaaagggataggctggttagcctggtcttggtatggtaatggttccaacctttcctatcttgatcttgttacaggacctaatggcaacctgacggattggggaaaaactgtagttaacggaagcaacgggatcaaacaaacatcaaaaaaagccggtatctactaaaaacacattaagaaaatactcatgtattcactggctgattactttatgtagattattctggaaaagaatcaccatataaccttctgggttatatggtgattttgatttcatatacaggtacaaggttaaccgaactgatatctacgatacgttcctttgtcgtctctttccagcccgccatagtcgtattgctgttgagaaccttaccctttcgaatgggggaaacatatacgtacaacccttgctcgatgagccgatgttcaaatgctttcaaacctatttcccaggtcgtatggttgcagaaattatcattgatcagttcgccatcgataaaagcataaccgatatctccagtataatcgatacgcagcagagcttccttgattccatgaaacgcatctgtttcgaaatcaatagtaaatttatctatatttacccttttcaaattgaaatggatttctttcttaggagcctttaaacgatacgttttgaataattcactttctgttatttcaagcagttctccaccggaaatagatgtgaatgaggcgtcaaaatccgggaatacactcagggttaccatttcttggcccgttgattccagccttaaatcgccctcagatactagtagattggcatttgtcaaaatgactctatttcggccttgcatatttaccttccaaaatgtaagactttgctcatcagtcatcgtgtagatggcaacctttttgccactttcagataccagatggatgagactatcctcctcttcagcaaccttaatgatcgttttcccatcgaattgctctatcgaacctttgtcgattgtggcactgatgatatcttgtgactccattgcatacgttcctttcatgcccgctggtacaaagaaaaaataatatacttctccatcttcttctatccttgttatcagctgtgccgtagcatatttgagcttcattccatctaaattgaagttaaatggcaatatggcaaaactatcacgtcctaacgtcagttcaccttgactagggattacaatcgtttcctcgggcagctcaatgctcacattaaaatcgcacaggtcgtcattttcgacatggtcttggaaattatttagaaataggtaccccgatccggcactggatcgcactgcatatcgtaacgtttccacatcataagggtccatctgggacgtatcccctggcagaatagtctttgttagagagaattgcttttggaacgttgaaaaaaagtaatgttgcagctttgttctttggtatgactcccttacttgaccgaattcgccgatcatggcgttgaaatcataggatattttgggtgtagctagatcatttatatatgggttaacctgacctcgaggattggaacccccatgatacatgtagtatccgatcaggttacagccttctgcaaccttcatgacagtcatcgctggaacactacggtagggaaaggcgaaccgatatttataaaactgaaccatgccgccacccatttcacagcaagcgtacggatagtcttcaggggcatattgaggctcaaaattgtagctctttggaatcttgttattatgcttgtctcggaaaatgtattccggtgtcgcaggatgctcttccatcccttccaatcgtccctcttcgtagtagatccatggccaataggcatacccgccccataatggcagcatatcagggacaggagttgtggctcctccccatcctgtgcacgtatagatcggagtatcaatccccgcttccagagctatttctttaagttttaacatatgcgagttaccgtcacttccgctgtttaaccacatatcattaattcctacagtcaacgcccactgggcagatgaatgatgatgttcgttttcgatttgggtgccgataatcggccccccttccttatatagcagccctttaacctgggcaccgatctcgttatataatcttctcgtatagaacagatacccctcatcattagaacgaacctcaaatggtcgaccaaataaccaatccggcataccgccgtttcgaatttccccgtgattgaagggtccgatccgaataatggagtatacctgatgtttgccgcacaactcgatgaaacgacgaagattcttgttcccactccaattaaaaataccttcaacttcttcatgtaggttccaaaaaatataagtggcaatgatgtttacgccgcccatttttattttaaggatttcgtcttcccaatagcgttcatcataacgggcataatggaattcaccacaaataccgaaaaagggctctccgtccttctccataaaatagttggtgaatccgatttcctctccttttggattggtcccgccaagtttgatatgtcctttaacaatatgcttttgatcgtctttgactgtaactcgataggttctcatggagttcactcccctcactcgttaatctgaattcaggataaattgattccacttgcgctgccaagcgatatcattccagaatggatgatggggagcacagttagagcagagggtcattccccagaacccaagtgctattccttttcgcaacacatattcagcgataaatttaccgactgggccttcttcaaattgggcatacagcggcgtgtagcctacataaccttctcctatgacaattggaatgccggaatgacgagtccattcatgaatctcttccaaacgggtgtcggccttctgcaacatggcaattttatggtctccataccgatcgtacaaaaataaatcccattgatcgggatctacccaatcgtgcaaataaataagcctcatgccgactggattgccttccatccgccaattctgctccggaggcaggttccactctgcaaatggaggagcgtcttctcttaatagggattgtacaaatggattggggaacggcgccaactcatcataaagcactgccgcttccataagctcattgagtacccctttaatataaagatgaaaatgggcaacctgcatattgcgcgcgacgtaagctttagggtaggcttcatttaacgtatagctggcggtcatcatgatatcgggatgacattggcggagatatccaactgcttcttctacgtagggctgcatggcttcaataagcgctggtacattcgtttcggctatgccttcagacgttccgacggcgtttaactgcccaaattccacttcgttatgcagctctgtatagataatctggttcctatagccttctgctgtgacgaaacggatcaactgatccattgattttgcaatggccatgaatctctccttaggaggaattgcagctaattcatctctaagcccagcatgagccagaaagctgggactctgctgatattcccaagaggataacataatgtaacagttatgagccttagcttgtttaaacagttcaagtaaatgagcatgcccgtccagcactgcgccgccacgacagttataccaacgtgtacgctggcctacttccccaaggttagcaaactccaagggaccgggacgtttgccatccgcagtaaacaacatgtatggcatagcacatattcggatcgtattgtaccctctttcgaccgcttctttaaaacgggcttcaagatcgctgtagggctcaccttcctgtgtcattgtataccaggagaagtcccacatggtgatcgtcaatttgcgcggtaacttcctcatgcgattattcatttgatttcccctccccctcccagtcccaatccatatggttcaatgctccttggtggttagcttccagcttgagcacggatttaaaatgcaagatagcttcgtcctgtcgccctaatccaagtaaaccaagtgccttcatataagtacaatgaacctgattacgaatattcaggtcatcttcaaagatgagaaagtcgggtaacgagaccgcgaaataatccattttcacggattcaaataagtgtctttcggcgtaatcaatgagcttgttgaatcgacgcacgccttccttcgcatagccaagtttctgccaggccaatccttggtaaaatatcatatccggctgctgatcgttataatacatggcgttaatgggttcccccagtccttgagaagccgtggaaaaagcctgccttgcctcatctgttaatttcgatagctcatacgcgcagcccaaataatagtaaatatcgttatcttgggaaccctctagcttaccttcgccaagattctctggatacactaaagcctcctgcagcccttttacagcctgttcaatccgtccagacctcaggtcggacttggcaagctctaccttggcaagcctatactgtccagttaccttcccctctccgccttcccatggatgaaatattctccctgtcagcaaggacaacgctaccttatgttgcttcatcgtattgtgaacggttacatattccaaaaacagatcatcgcgaagctttatgattcccggataactctccattagattcaatctgtcgttgggcctgatgttcagcttcttatacagctggtcaagctcataaagaacacgcgcgtctgaagtattgcacgcaaaggcctgctctaacgaatggcgagccttctccacttggccttgtttgttaaaatatccaagagcaagattacggtgaacaacggggtaagtatcgtcaatggaacgagacgtttcccagctggaaatggcatccagatgccgtttcttatcatagagtaaattacctaagtaataatgcgcctttccatcccccggtctcgttcgaattgcaaattgtaacacatccaactcaaacagactgctaggaaagcagtagtcgggtactgcatctgcggcctgagcgagagcattgttcatctgctcatgcttgccgattttagcatagcagaaggcctgaacgtaatacagcatagggtatgttttcgcctgctctggagcttcttccagcacacatgctgcatcctcataaagtcccgccgccgcatagtccgatgctaccgctatataattatgcacatctccacgcatccatttttccagctcttcgaggaccgttttagcatcatctcgtaacccgagagcctctaatgataatgcttgctcacggtaagctccaaaatcggcgatatcgagcttcatcgtttccttggagaaggctattgccgcttcgtagctgccgagcttacgaagaatagccgacttcaggttgcatgctttgtaattgtgagcattgcggatgattgaacgctccacgagctccaatgcatcttcatagttcccttgttctgtcgtaatctgtgccagtgagaaatacccgctgtcttgccatgctgcactccatactgatttataaaatgcagcgaacgcctcacccatccgctcttggtgttttagcgacaaaccaagctggtagtaggcctcaccgtcatagggattagagttacgccaggttacccgcgagatggctttacgaaagcactcttcactttctgaatacaaccctctacgaagaagcagcgtaccatatgccacatttatgcggctgtcatttttatctcttttcaggccctcaagatagtacgcctcgggttcaaaggtagcatgacggtattgctccaaatgttgtcctgctaaatacaattcttcgttcgttcttaattcctccggtcctggcaggggggcggcggcagccggcatctgttcaacgtccttttttttcggctggtagctaatcagctcccttccggtcgcgtctttgacggttaagcatagttcataatccccatcctcagccaaaataactgtcttctgtataaaggccttattaggtgtcagatctaaggtttctttaatataaactttccgctgactacttaattccacaacagcctcacgaaatgaggaagttacatagactccaatcagtgctgtcccttcgctgcgatttaattccagattaacggctgcgtcaattgaagcgtttttgaccataccaatatatttgtaaggcataaaatactgcaagaacgatttttcttcatacggctgaagccaagtaaaatctggttggttatcggtatatacccccgtcatcagctcgatgtaggggccgtcttcgtctgttagattcctgtcccatgcttggccgaattcgccatttccccatgtccattgcttttttccgggagagatgtgatggttggccacatgcaaaagcccggcttgtttcatatggtcatagccacctatgaaattgtaatccgatttataagccatatatgaagtggggacaggaatatttttatatcgggagatatctacaccttcagaataatccattttataataagtgcctgtagcgatcgggaaacgggatacatctcgctttccatggtcgaacacggctgatacgtctggaggaaaaacagattgtgtgtgctcatgtaccgctacggctggattggcccaccatagaaacgtttgaggctcggcagtccggttgtatagctgggctccaactttaaggtatgctttatccggttgaagtgtaaaacccgctgttactttcgtgccgaacatacgatcaatttcgctcacccatatcgttgcgcttccgtcgtcatgttcttccaacttgtattcaacgggtccataagtgttgggacggtgatgctgcggccagttgaactcaattcctccagatatccacggccccaataagcccacaagcgctggtttgatgaccctgttataatatacaaaatcgtaaccgttggtcttgtcgaccgcacgataaatgcggcctcccagctctggcatgatctcaatgcgcaaatatttattttccagaaaaaccatttggtaattttcaagtttcttctcatcctcaattttatcaatgaccggatgcgggtacactcgaccggagcttccctggtagacacgtttctccagaaacattggatttttgtcaggtttgccaattccatacgtggggatctgcacagtttcctcccacacgcgtgccttagcatcgaaaatgctcaattccatcactccctcatagtcgcccttatattcagagcttacaagtaagcgacattacagacaattgacaatccactgtttatgatggattatatacgtatttcatcattagagccgcctaaggctaggagatggatagatcatgaataagaaagctgatggatttgagggtgaaaagttatatgtccttccaccctatatgctggataaattaaatttgaatccgcttacaaaaaatctatatattacggacataggctgcttcagccatgcccgccatcattttcgtgaaagaatgcacggatgtgactctcatatattcatctactgtgccagtggaaagggttggatacgaacaaaggatggcctaacgattgacatgacggagcgaagctttgcgtacattcccagggacatgccgcatgcttatggggctgacgatggagatccttggacgatttactggtttcatcttaaaggggaccaaatggatgattttatggcattatttgagccttttaaaacgtatatttccatggccgccagtgatgaagtcaaactactggagctatttcatcagtgttacgaccttttactgaataaaccatactccatcatacatttagttcaggtatcgcaaactgtccgttatctgctgagttttgttgtatccgttgcatttcgcaaggaagacagtacgtaccagagtcatgtggataaagcaacacgctatatgagtgaacaattggaatccaccgtttcgcttgaggagcttagtcggcatgttcaggtatccaagcagcatctgaacttgatattcaagcaatccactggctactctcctgtcgattactatttaagaatgaagatacagagggccagtcagcttttggatttaacgaatgcttctattaaagaaattagcatacaactcggttttagggacccttactacttttccaggctattcaaaaaaataatgggctgctctcctttgaaataccgaaataatttgaagggttgatctatgttcatcaagagcgttcaaatttgcttctatcgggctaccgcaaggtcacagatcatttacgaatcgggggtgcaaggtctatacttaaggttaaaaaaggaagttttgtatgctcctcacgttgaatcgtagactaaatacagctatgccgctaataacaccaatcagcattttaattggcgtcctgatcggtacgccgttgtcacaatatactgaactctctccctggctgtttgcattcatgaccttcgcgagcagcatcagtatggggtttaaggattttgtccatgtgataaaacatcctggtccgctgatcgcctgtctgtttattcttcacctggctatgccgcttcttgccatgatgctggggcatctggcattcagtaatgatccttatacgatcactggacttattcttggtgcggctatccctacgggcatttccagcttcgtatgggtcaacatctataaaggcaatacggcgctgacattggcgatcattttaattgatacgattttggccccatttgccgttccgggcatcatgtccctgctgatcggagcggatgtgcagctcgatacctgggcgatgatgcagagcctattctggatgattgtcgttccttcgctaatcggcatggtgttgaacgaatggactaaagggaagatccagcaggtatggggacctcgactgggcccgttctccaagctggctatggctcttgtcgtaatgattaacggatctgtcatcgcgccttatctggtcgattttaatctcaagcttgtcggagtatgcctatccatagtcgtccttgcttccactggatatgcaatcggctatctgatatcaggactgatgcggtggaataatgcagaccgtacggcgcttgtctttaacggcggcatgcgcaatattagcgcaggagccgtgcttgccatcacctatttcccggccccggtagcactgcctgttgtactcgggatgattttccagcaatccacggcatctctggtcggatttctgctgagtcgtcgcgaccgcggcaatgccaaggaaaggcgcaatacggcctctgtttcttaagcaaaggagtagcgacggttccagatgataaaactcctcctatgaggaggagttttggaagggcgtttctatacgtacatggttggaagtctgatgaaaacatgcatgcgcaatcatgtaaatgtttactttccaatataacatttctatcaaagtctaaaacagcttttgcgtaagattttgaaattgtgacttcactccatctttctgaagttctgattgtaacacctgattaaaggtttgaagtgcacgctggaatttattttcaccaaattccgtaatccgagtatacacacctcgtcgatcatcctcgcatgtatgtctttgtaaagccccgcagtttttggcttccattctcactacgagtctcgatgtcgcactttgacttaatcccaccaattcttgaagttgctgcagtcgtaattttttttcctcggaatgggatataaaacccaaaacataaaactccttcaaggataaatcataattttgtagtagagcttgttctaacttatcatttaaagtggaatggatgtgagacaaagacaaccatacatccaaaagttcgttttcatgttgcaagtttagaccacaccattctatattgaagtatctccacttagtttaacctattgtaacaagcttaaatggaatggtcaaaatccatacaatattttagatattacaatccgtcaccaccgaaccagtatgcaaatgtagcataatgattctcgtttaattgacccggtagtagtgacagattcgtttatagaactcattgaagaagtcccagtacacgtctgtaaagtcaatgacaatacggtcgatggataccgttactcctttcatatgtcgtaccctcccgatttttttcatgaatttcaggcttaattagagggcaggtggctagccttatacgttccctgcctgttatattttaactggtcgtcaccagagattttttcttcacagtaacaatcgcaataacatgccatgctgttgctgaaaaacaaaaaatgttttcaatacagtcgctcctattattaattgtcgtgctacccatcctagaaaatgcgatatatctcatcttccctatcgccgtggcttattttacagttgcgattgatttcaaaaaactgtgagaaagcgaatataacaaaaaccaggtcaattatggtggtatctgaccataatcaacctgtttgatgtaacggaatagtgatatttaggttataaaattaaagcatttgatgtgcgtacaacagaaatggagaaatctttatacgggtattacgtgggttagatgtgttattggttgaatgatgtgttatttcggcactagtagccaatctgcttaaccacttacttcacatttttctaacatccatttctttgcttcttctgacttcaacaaaataggtttctccaacgtaccaatattaatacttttaatatgagcttcttctatacctttaatatttttcaatatcactccgcttaataatgtttcttcaaatgtcgctacacttatatctacattttctagtcttgcgttactaaaatcagtgaggtagaaaagtacattaatcaaattacaatttactaaaattgcatttttaaataccgcttcccaacaatcacctttactaaatctagagtttttaatgacacagttagaaaaatctgtatatctaagatctgatttataaaaatcggatttatctaaatacgcatttttaaaagttgacgagcataacaatgatgtgtgaaaatcgatattctccagtttgagatcatcaaaagtacactctattaaatatgcttgttcaaccaatttatcggataaatcaaaatttcttaaatccacttcatctagctttaacatttcaccttctttaccaattgtctcaacccactttttatgcaaatcaaacatactaagaatatttctttcttccatttcctcactccttaaggataccacaatattctatttgctattcccgcttcatcaattgctttcttcagttgtttaatatgctcaggcaccattttttttgtgtcaataattacgtcattccctttagcaaattcttcttgtattttttgcataccattttgaatagaaaaagcaccctttttgggatttgttataggtactccgttcctaccacttggatatgattcaaaacttttcacttcccactttaagcctgtagtggtatcaataaactctgctcccttttctgcttgttgaaggagagatgcaatatgcctatcaggattcgactcaaagagattcttgccgagagaaatatgtcacaacgggaactggctcggctaatgaatgttcgacccagtacaattaaccgactttgccaagacaacgtgactactgcttttttcgatacattggagcatatctgccgaacattagatattaaccttcatgagttacttgtcatggaagatgagtagtaccgaacactcgcgtagccttctatacggctcgtagagccacactattgtgtctacatcaattctcgaccaactcacagaaacacctgtaaggcgattccgtacggtctcagagccatttaacgagcctcctgaagcggcaaggcggaatggcggcggaactctatctttgattctgagtaaagtattcctcccgtaaaaaccgctttggagcgaataccgccgcgctccgcccggtgacctgttttttgttatattcgctttcttgcggatttttgaaaacaaacacaactttatgattagataccccgatggatatagtgtcaaagaaaatgcaactaaagatagtccgaccactaatattgtcaggacttatctgcaaattgtccgcaataatttgactacttgccgcgatggttatagcgtaagaactctagtgacgaccagttgatataaagagtaggtcatggtaaggctagccgtccactcagacttaattcgagggaaaagcagttatggacttgaaactaacgaactgggaagaactacagtctagcttgtttagaaatagcgttgctgaacaatcggatgacgaagaagcgacacatctctatgaagtcaataccatgtttacgccgaagttccgcaggaaatccgccgctgtttcttattggaccgcaatgcagtcaacgtcctgcttgaacttgtatcatggggtatgttggacagaggacgaaaacgtgggattacggaatggttcgccattaatcattttacagacccactttcaactattgtttgatttctccaatactttattaataagatttattaactgatctttttctacttgaagaagttgatcctttgtatcgttaacatcgaaactttttatttctgaaacgatttcatctgggattaggtaattttgcgtatgagtatctcccctaaagtggtatacacaatcattttctcactgagagtattctcgcaatctcgtccaaactgacccaacacactatttgtaattgctgataaccaaattacaacttccacatgtatctttttccgttaacatagtaattgtacccttcgcttctctattatccccaagtttcttatcaatatcattcaagatcttatattcagtatccatatctctgagaataatatcacctttcccctcatccaaagaggccttagtagcaggaaatgaagggttttctgggtctaaaaaaaaaattttcagttccgggaatttttttgttcggatcactaattttactatgtgcaaagaattccgactgatcaagcccctcaatttccgctttaacatatgcaaaattccctttatctttatctttatatttattagataaccttgatctagcttctacaactttgtcaatgagatactgttcagttacaagatcaataggtctggcaggaatccagtcatgataaattatttctccagttttatgatcaattggtcttacctcatcagctacattacccgtcccctaagttgtaatcttaaacatagacataaagaaggtggcaactatttaccagttaccacccattttataatccaggcttggctcaccgccttgtattcggtctgtgccaatacctaccgaagctattattcagttcaaaaaactatcaatagcccacttttaattttctattaattttatttatatatgtcctatactcatccttctcatcttcgtataaccaaatgtctgatttattaattagatcattgtctatgattaaactaattattttaattaaagattctttatttgcttctaagattttatgatcaacagatgataacttttccgttaattctactgtatcaatctctgcaaaaaaagggttattatcctttaaaatcctttgaataatttcaaaaacgaccatttccacaaaaatattttgtcttatacatcgtataagatcaaaattttctaagttttcaagcgttttatcaagaatatctagataccatttgactaaaggactattaggattatctattgcattttggactgcttcttcatatgcttctttagttataaacaaactaagttttttagttctatcaaacacattcaacaccgccttattgataattattttggaggtaatattcctccaaatggagcaaaaatatcttctattttattcatagaagcatttacctcattaattttactagtatacaattgtctcaattcactatctaaattaggatttttaagaattccttcatagctttttttaagcttttccaatcctctatatgagtctgaaacttcttgcatatggttaaatggcaatccatcttccctcaatactagtgaaccatcctctcttaagagcggtattccctttaattccttttcagctcctaataaatcatctggtgttacatgagtatagaccctgtcgtgtagatttaaagtagcttgttggctagtcgttatttttgatcttgccccgtctgataaatcatcagcacttgaaattattctagtcctactaccgcccgaaccaccattattcgtctcctcagaagaatgatcattatgcgatcctcctggtgaagcaccgtcatctttagaatgattctttcctttccttccaacggcaaataaaaatgctgcttctactaacagacgggcattttcttgtttggagctgtttatcgttttttcataagcagcatctggatccgttatgactttaacaattttatctgctacgtcttgttttccttcgatgttatcgatcaccatttggagaatatctatattagggaaattccgaagcctctctgccatgtcctctacactctcataggcaaagtttttgatttcattaaacacaatccgctcagtctcatccaggtctttcataaaagagctttccctatacggcccatactctttcctatattcgtcaattgaattcagaaaatcaattagatatttcttctgttctgtcgtgtaccctttcatatcatcccgatacttggaactcatcaaagctctgtcactatatcgaaaatgattgtctgtctgccgttgatgttccatcaatgcgactatatctatggagagatcctgattattataataagcatccagcgccttttcaaactgttgatccacatttctttgataccatcgttcccgtatatcagggggaatatcgctataggcttggacggaagcctgattgactccctttacatagttgatgaagtcatgtatggattgtacttctccataccctctggcactcgtccataccttaccaagaaaatccatcgtcgcatgccgttcacgagccctctgttcctccgcgtgcgcatgtaaggtttgggcagcaaccttggcggtcttccccaacaccactccccaaccatgggaaggtacgctggcaatcatggacaatcctgctgccgcatgtttaactatggatgacggtcctgaggaagccacttcggaacgaatcgaagctattttttgacttgctgctttcggtatggcacccaatacaggaatagacgcagccacatcacatactttctgagctaatcccaatacgccatcgagtagactagccttcggtgagctgggagtgtttacagctgacttaacggctcccttatctttcgatgtaacgcttgaattggagcttccccctgtactgctgtttgctgcacttttcgccgcttgcgcctccgcataagctttcacagacattaatgggggctcccaaatcggtgctaaatcagcaacaaaaaccggtcttttaaccgtgccttccagctgtactttagcagaccgtatatccgtttctccatccaacaccaagctgctgctgcccgctttgaaataaatagcatcggtagcttgaatattcagttccccgtccgcatgcaaggagagcgtcttgcctgccgacaatgacaattcatgttcactgacgacctgaatacctgaaccattcattgaaatgtgaacctgttccgatttagctgtcaccttcaattcactggcactcagcttgatgtccttgccatgaggagtcccccaatacttggtggctggatcagtgagcttgagggacgagcttcgcccttgtcgtatggaacttgccgcatatccatccgcctcctgctctgtagggaagcggacagatactgtatctcctcgttccggcatgacgtaccaaccgctatgtccttcggcggtataactgctggcatatggaaaccaccacgccttatcccgatcttgtttttcatccactgtaagatgaacacggattcggcctgattcagcttcaattacacgtccttcgagtgaagctcctgtgaggtgggggcacaaaatctctgtttgctgaattccctgttcgtgaaccagttcatattcgtgtaatagcaaccctttccgcaattcagaagtgacttctgccaccatccattgctcaccattccaattcgtgaggtctccgggcctggcaagcgtttcactctccatcatgtagctgaattccgctatccttttcggatcaaaactacgtcgagtacggtaaaccggatgcttcatctcaacgtactgcccctcaggcataccaaaccagaatttaggtccattcaatgagatctctgggatcaacaccgttccaaaccgggaagccatccgtttgagaaaggcccaatccgtctctcgatattgtaaagtaaattcatgcaagatagtactatctgttatgttatcaataacatcggcctgattgtacttctgaatgatttgcttgatcaaatttccgtagggcattaaggtatcctgataagaccgcgttgcaggtgtgatatccaactgaatcgtatgagaaacggcttcaagctccacataatagatgccacgcaccatccgtgtttctgcatggaccaataaaccatggaacaaaatgcgttcaggctgaccattctctgttttggtacggataatgaccggttcgttatcctgatcctgttctatgtaatgatctctctgctcttcatctaaccatccactgatctttaaccgggcatggtcatttaattttcgttcaatacgcagttcgcttatcgtttgaagaggatatggacctgtacattccaactccgtatacgttaacatcgtttgtgtgtgattcaacttgtacctccttactccagcgtctggccatcgtctgtaatccgaatcattcccccgtataggcacgcattcgagcattgatccagcaaggctggttctccctccacaagcacatcacttttgccgccgatccagggtccggtgatgaccggaacacagttcgcttttttcaccccgtagatatccaccatgtcactgcttttgaccgctggattagctggacaggagcaacgaccgaaattgctgatattggttcctggcaagtaatctccaacgttcatttgcgctttatcttttacatatactccgtgactgaacggacgtttgagacgtgtcggttgcgtaccaaagctacagcttaagatcgccccagcaacaacatatccttgtttacttccccgtccagcttgaataggttccttatcggaatgagacttatttgccattcttctatttcccctttcattcctttcttagttcgtcttcacttcactgcccagaacattcgtcattccgcccagcgatacggtgctgcctttgctcgtcatttgaatttcatcccctgccgtgattttcactttactgccggaatgaatggaaatatttcctcctgctgagaactgaatctgtttgtcgcttacaatatgaataccatctttctcatttaactgtatatacacagctccctccttactggtgattacaatttcatcgggagttaatttgatttccttaccgtgggccgtacgaaataatttgatgtcgggattagcaagcgcatgctgctctacactctgattcttttggcgcaaagatgtacttgccatgccttcttcttcccgatgggcagggaaatagagtagcacggtatctcccaactcaggcatcacgtaccatccgctatgtccttccgcagtataaggagaaacatacgtgaaccagtgggctttcgtagggtcttgaacggcatctatattcaaatgtaatttgatacgatctcgctctacctgaatgactttacctggtaaagacagaccaataagctgttcgttaaaaacttccttgtgcctcaaccccttgtgagaagttaaggtatacacgtgctgtagcacacccttttgcatgtgagtatctaccttgtacacgtacaagcttttacctttaaaagtaacggtgctgcctaactccaaaacttgctccgcctcaaccagataatcaataaaatcatgctcgtttacatgtgctgtatcattgccgttaaaataacgataatccgcaactcgtttactgacggtgtaatgataattcgttaaatcaagtcctgactgggtctcctcaacaccaaaataacacttcggcacatcaaacaccgaggcaggcgtgagtgaagtatgataacgcgaagcgatccgctttaggaactcccaatctgtttcacgatattggaccgctatgcgacctaaagttgctctccctgtagccgaatcaataatgtcaaaaccgggataattcccacctacagcccgaagcaattcctctaccttcatatttttatcctgaaaggacctgtctttcttgcgaatatccagtttatacgtgtgtgatatagcctcgacctccaggtaatacacatctcggacagctttgacttccatatgaagtatcgttccgttaaatagcggtgttggtgttcctgcctcatccaattgggatacacaaaccggagaatcggcttcgatcaattgaacataactgtcctgtaattcttcaggtaaaatagctgtaaaagagagccgggtgtgctcattcaaccgcttggtcatacgcaattcctgaatactcaccaattcaaatggcgtaatttgcagccgatcatatgtaatgttagttaatgtcataagggtttattttcctttcgatcagactcgattttcaacgttagcagcatactgcgggcaacaggcttccaagtcaccatttcttcttccgtacagttaaacgtgcacattagcgcccgtccttccaatactgtaaaaaaagataaattatacatacgtgcattccatacaggcgtcatgaattcgcagtatcctattcgcttctctcctacctccaacacttcatggccaaaccattcggtcaacttctgggtttgttttaccaccagagccatctcatccgtaaagtcctccaactcttctgtttgcaacgggctttcggtatgcttgaaggttaagttaatcgtgcctgcctcattagtgaaaataaaatctgggcgatgatgagaaggatattttaatagttgctcatcaattggcatatcccgaaagctctttggcattgttatactgatacgttcatccactaaataccgctgagcaaaaatcagactttctccatcaagttgcatgaatgtttgtaaaggctgcccaaacggttctttctcgtgtgcgtgactcaaagcttcatcctcagttaaggatggattattttcagcattttctgatcttaccgtatgtagcaaagaaacaattttcttatccaaatgttccacaaatatctcctcccatttcgttactgcatatcgacttcctgaaaggagataccactcgttcccctccgcaacagactttctgctaatgctaaatttactaatgtacaggtttcacgcaaaccttgaacttgcaataagggccttccctcggtgcgctctcgatctactaccaacttcatcaatgttcctccgggatgaaatgtacttagctcacctacacagttcactaaagggggctgaatcatccagtacaacttttgctgagaacgttccatatcccgaaacaaagccatacgactgaagaggctcggcgtatagacctgtaacaactcatgtacagaatcagataccatcatcctcgaacccatcagaatatcagggtaaaccgtgtaatcgtgacccttgaccttaaactgtgcagcataagaagagggccattccgtccaattattaatatttaccttctctgcattggcttcttcgtcccatacgggaacagcagaatacaacatccgatcatcatgttgacaaaggaaatactccactatgccacgtcccttccattgcgtctgtcccacatggtttcatccaaatgaagttagatcccgggcaactggatgcatccctaaactaaatcgggttccatccagcaccgcccctttgaaacaggccctttctatagctgcacctatgaagtcggctccctgcaatatagccccggtgaaatctgcattctgtaagtaagcgccctgaaatttggctcctgtaagatctgctcctgcaaaacttacgggttgaaaaccaggtctctcccatcgttcagattggtatattccaggtacagctactgcatctcgaaaagaagcttctcttaagttggctttttcaaaacgagcttcttgaatcaaacaatcgctaaaatcagcttctattaaacatgctttattccaacgggaaccaatcaaattccctttcgtaaaaacactatttataaaggaactttcattcaaatcggcatattgtagacgtattccctcataatttccttgagacccgtcgatcttgcggaaaacttcatgtatgtagtcgtagggctttttttcctctagccagtctttaatcacaatggaatctttgacacgcacatctcgtttataaatgacttcacttcgatctaaatattctccgactctcagttcgaatacatcttccaactgtatttcatgagcaaactgaatatcatcgaaccattctcctgtgatactaaaacgcgccaaggcaatgatatattgatgaacatatactgccgcatgcaatttcatcctctgaatatcatctaatccgattcttccaccgtatttcttggcctgcttacttaattccgtctcccactcgtgcaagtagtgaaatgcccaatctgcattataggtatctcgacaagtatggagatccataaaccatcttttatccatcgcctccactaaataggtcgcccttccgtttgctaattcggtacgaagcatggaataagatatatatcccaaggcctgtttattaccttcttgctgcatcaacttgactttctcaaatatctgctccagtgaattgcaaaatgccttagccaaggcatgcttatgattttggaaatagacttccaatgcgaataacattcgatgttttaggggttcatagatctcatttttaaaatgtcgaaaaacctcttcacgattcacgctctatctcctttctagtcgtcacatttacataggctgcacgtatcaagtagttggttatcttaaaccgaagtctaattttaatgatatgtgaaatcataattttcaagggtatatttaacagtaaatcatccttatgtatgtatcggacaaattagtgattttgtttacagaaagaaccataactgtgttcaatggaaaatgggtaggttcacaatcgaacccacccattcggagaaaataaatattatttaatgtataacaatgtataactattcataactccacacactcacaccgcaattaaaaaatttaaatcttgtaagccttcatagcttttcttaactctttgaatgaaggacgtttgccatacattaagacacccgtacggtagatcttggcggccagccaaccgaacaacaaaatggaggcgaccagtataccaagtgacagccaaatttccagcagactcgcccgctccagaccaatccgcagcagcatgacagtcggcgagaaaaatgggatatacccggccacctttacgaaaatcgtatccggtgcggcgatattgaagataccgatataaaaggctgccagtgacagcacggtaatcggcatgatcgcctgtcccaactcctcggtacggctaacgatagaacccaccgcagcgaacaatactgcgtacagaaagtagccgaggatgtagaataccagaccatagcctaataccgcgatattcagttgcgacagatccagcccggctgagctaaggatgacattattatgcggcagcataaggttagcgcacacaacggctgcaaagacagcaatttgcagcaggccaaccaggaaaatgccgataatttttccgaacatctgggtcaacggtgagacgcttgtgatgagaatctccatgatacgtgagcttttttccgatgtcacctctgcagcaatcatattccccgtcatcatggaggaggtgaagaataaaatcatcagtacatagaccaaaccatagttaatcatagaggtctcttttttctctgtccccacggctccccctgcctcagacggaccgtctacttccctgctatctaccaatacaggtgtgctaatttcacgaatttgatcgctggtcaatgcattgccgcccataatggctttgaccttagcttcctgaagtcccgtctgcaacaatgtaattacagcaggagatggctctttttctacagagacatactccactttaggaaacgcgtctcccttggcggcaggctccgtgaactgcacgtaaccttgcagctccccgtttttcaaggcttgctgcattgccggcgtttgtacgctgtcataacgcacccagatggctgccgggttggattgctccttggtgaattgctccagctgattcgccacttctatctggctcccagcaatcagtcccaagcgatgatgctcggctgccgttgtgcccgaacctcctgccccatctcctttaaacaaagaaatcaaatacggcagattcataccaatcgtaatgagcaaggccagtaccagcgttgtaatgataaaagatttggttctcgccttctgacgaaacgtaaaaccgatcaccgtacccagtctattcatgggaatcccccacctctcttatgaaaatctcgttcagcgtaggttccttgatctcaaaatgctctacatccgtttgctccaacgccgtttgtaaaatcaacttcgccgcatccggctgctcaatatgcagcatccagccgcgatccataggctctgcacggcgcacgccgggcagctgctccagtccattcacttcacctgtagtaatgagacgaactttttcacgtgggtaacggcccttaatctcctgcacacttccctgcacaactgtattggagcgatgcaagatcgtaatatggcggcacagttcctccacatgctccatgcggtgggtcgagaataaaatcgcagccccatcgtcccgcagctctttcaccgtatccttaagcaattcaacgttcaccggatcaagcccactgaaggcctcatccaaaataagcagcgtggggcgatgcacaacagcggcaataaagcccattttctgctgattccccttggatagctcctcaatccgcttgtcgtagtattccggcactccaaagcgttccagccagtagcgtagacttttgtccgcctccttggccgacatgccgcgcagcctgcccaaatagttaatttgctcgctcaccttcaccttggggtatagtccacgctcctcaggcaaatagcccatcgtccgctgaagctccttgctgtagggcttgccctcatattgaatgcttcctccatcagggtaaatcaggccgagcaccatgcgcatcgttgtggttttgcctgctccattgcctcccagtagtccgtaaatctccccgccgttcacattcagcgaaattccgttcaccgccgtgtggttcccatattgcttcacgacctctttcaattgcagcatgctcatgattactccgctccttttttctgtgtgtatatctccgcatcttctgatagttgtccagcagaccaatgtattaaaatatcatccagctccaaacgccgcacacggatagggcgaatgcccgcttgttccaatatggcgctggtctctccggctgccaacgttacaattcgctgcaatgcgccttcgctctccgtctctaccactcccggaagctccgatgcctcctctggcgtgccttcaaaccacatttctttgctattttcgagcaaatggtctttttccagcttgccgagcaacttgccatcatgcatcaggacaatataatccgccaaacgcttgatctcgtctataatatgagtagcaataatgaccgtcgttttgccgttctccatacaatcccgcagttcgtccagcatgattttccaggcaaaagggtctaaacccgatgaaggctcatccagcagcaacaaacgagggtgaggtgccaaggctgcagccagttcaaacttacgacgctctcccttggacatgcgcgataatttcgtatgctgagggacctgaaatcgttccatcagacgctgaaaacgtgtttcatcccagccgggataccacaaggctcgaaaagccgctgcttcttctgccgtgattcgatcttcctcccggcttggctgctctgacatatacccaacccattgtcgtgtatctgccggcatgccgtctggatacgcttgaccgaaccaacggatttcaccggaatccgggtggataagctgagtcagcagatgaatcaatgtacttttgcccgatccgttatgtccagccaaagcgactacatatcccggttcaatggttagattaatcggtccaatttcccggttacctcgggttttatagacttggctcatctcaataatgggtgtttttatctgtatccccataggaacttccacatgatgatttatatcgttcttcacgggcgtcactccttcacttggacttcataccttctcttcaccatttctgcgaaaagctccaacaattcctgttctgtcatctgcacagcaatgcctgtgtcaatcgccgtttccaacgcctcggtcactgctttaaggcgataacctgagcgcttatcgtcctcgaccagagctacgaaggtgcccgtcccctgccgggtacgaagcaagccttcattctccaaatcctgatagacccgccggacggtgatgacgctgcagcggagcgtccctgcaaactcccgaatggagggaagcagcgttcccgctgcaatctgtccggttacgatgagtgaacgaagttgcttttcaatttgtgcatacagcggttccgcgctattctcatcaatttgcactggtatattcacctgcttctccccccctttttatctatctttgtacacataccgctaagttaagtcccgtttcataagcctacgctgtgtcaccttataggacacccacatacccagaactcctgccagcaacgctccccacatcaccggagacaacagcttccattccttgctataaaatgctgttaacgataccagattggctccacatactcgaactataatcgtaactatcccacaaatgagcatgatgacaatggatagccaaaagtaggattttcctcttttaagaaattccaaatgaatataaatggcttgaatcagcattccgtagcctatccaggtaagtgcaaacgatacaaagaaacctgtactggcatatacccgaaacgtagctgacaacgtaaacaatagagtgaaaaatattacactgttcacaacaaacgccaaaagcgcctgttgaattcgactcataatcaccgcattcatcggtataggcaaagtgcggaaaaaggctagcatatgcgtataggaatcttcctgaagatatttaaaagcacggcggttataaatgaatccgagaaacggaatcaacaccagcatgataaaatcggctactggactcaagtttccaagttcaccccattgcacacttacagcaaaactcatagtaaatcccaaatacgcaataaacagcaatgtccacagcatgacatatggattgttacgaaaatcgtgccggttaatcttccatgcctgcttgatgattgtcattttcttatcctgatcccttctgcactgcctgtaatgacgacctcgttctctcttcatacgaagttattattacagtaatcagtgttattactgtatatatccttatacacagtatataaaccatgaattacaactgtcaacacctgaatgtaaattgtgcgtacaatcacaaaagctcgtcagaacctatgctactctgtaaatgataaacgttctcaatcaaggggatgaataaatggataagatactgcgctgggatgagcccatatttaaccttgttaatcgttatcccgaagtgaaggacattatggtagagctgggttttcacgatatcgccaagcctggcatgttacagaccgcaggtcgttttatgacactgtccaaaggtattgcaatgaaaaaagtagctatggaaaccgtggaaagcacgtttttgcaacatggttttaccattcaaaaataaaggagctaacaatcatgagcgagctaattaacaaccgtgaacatacagcacaggaattaacggaacgccaacaaacgctaaaggaaattataaaagaattacatgccgggaaaagcgtggaggaagtcaaagcgcgtttcgcagaggctgttggcggagtaagcgtagcggaaatttcagctatggagcatgcattgatgaccgaggagggaattcccgtatcggaagtgcagcgtctttgttccgtgcatacatcgatattcaagggttccattgaggatattcaccgtccttcaggaccagaggaacaaccgggacatcccgttcataccttcaagctggaaaatcgggagatcgaacgattggtcaacttcaagttgtcattgcatgcggaccaatttcaaaaggacgacagccccaaaatcatctacaagttactggaagatttaagtctgctgctcgatctcgacaagcactatagccgcaaagaaaatctggtcttcccttatctagaacgctatggaatttttggcccaaccaaagttatgtggggtgtggacgacagcattcgtgccgcgattaaggaggcaaagagtctgctcaccgaatataacggagatcgtgaacagattgggaaggcacttgcccatatcatgagcgaagtgaatgaaatgatattcaaggaagaaaatattttgctaccgatggcactcagtaagctgacagaggatgagtggctgaaaatagcacgggaaagcgaagaaatcgggttctgcttgaccgctcccgaacgtgaatggatacctgaacgggcagaggaaccagcagaagcccttgagcaaacggaaggcacatctggaacaccgcagggcttcgtgcgattcgagacggggattatatctgtacaacaattggaactactgttgaatcatctacctgttgacctgacttttattgatgaaaatgatgttgttcgctatttttcccatggtaaggaacgaatcttcgcgcgcacgaaagccgtcattggtcgtaccgtacagaattgccacccaccccaaagcgtgcatgtcgttgagaagctgctggaagattttaaggcaggtcgcaaggatgttgaagatttttggattccaatcaaggacaaatttgtctacatccgttattttgccatccgtgatgcagagggccgctatctgggaacgttggaattcacgcaaaatatcgcaccgattcgtgctttggaaggacaaaagcgtattctatccgaatagtatccaaccgtaagccaccatgttcagatttttgccacccatatttataatatgttgttctactataagtttggcccccagcctttcataaaaagtacatgctggattatctgctagcacccatacgattacagagtgaatatccatactattaaaatgttgaagcagacgtaaaaatagtctcttccccaagcctaaactatggtattcactcaaaacgtaaatagccgttatttctcccccatacggggggtattcacctgacttttctggacccccactcacaaatccgatgatttcccccttctcattttcagcaacatatacccgatgaccgtcttcactggatagattcgcattccacagttctgttctttgctcataggaaagctgttccagaacctgggcaggcattatatctttgtacgtcgtcttccagcaatctacgtgcaccttggcgatgccctcggcatctgatatcgttgcttccctgatgttcatgtaagttccactcctagtttccaatattatgcactctattatatcgacgatccaaatcttgatctataataaggatattcattgtttagtgaagttggataggataacccgttcactacactactcgtttactgggggatttgacttgaataaaattgtttcattttatgtgccgcttggcatttcgtcattaattgctgcactaacgcatgtcatcgtcaatgccgtgcttgctcgttcggaacatccttcgtttacattaagcagctatgcggtcgccgtcagcttgtgcctgctgttggaaactccgttaaccgctgtacggcagatgaccacgaaattcggttatgatcgcaagtccgttcattctatcggtattttatgtacgttcgtggctgtggctgtattgatcatcggctggagcatcgggttgacgcctgtaggcaatctggtctttcaatatgtatttggtgtgtccccagtattgatcgaacccaccaagaacgtatttcaggttcttactttactatacatattggtagctgtccgtaacatatatcagggacttattattaacaagcaccgaacggcatggatgacattcagctcgtccatacgtattatcgtgatgctaattgcttcctggtttttgatccgtgctggctggacgaatgacggacgagtcggtgccgccatttttattgcaggtattctcatagagctggtcgttacttttttagaaggccgggttctcaaaagaaagctgcctcctgacaacggggagcaaaccatccatcacgcgaagcatctcctacctttttaccttcctttgctatattcggcgctggtgctggttatcctgaatccttccatccaagcagcgctgaacaatacaactgatccactgttggccgtggcatccttttctgtagcactgcaaatcctgaatctatttgtctggttttgcagctctttgcatcaaattgtgattcaattttatacgactaagcgcagggaagtgctgatatttttaagctttttgtctatcctgtcgccaatgctactcctgttactctccttcggatttgctggcgatcctgtgttacggaatgtattgggattggaaggagaactgttgctagaaaccagaggactgcttcgcatactggctgtctatgttgcattttatccttgggtggaatattttataggacggtcgatattaatcggtaatactaaacctatctttatcggtaggctgtcttctgtgagctttgcgattctcgcgcttattctgtgtatctgcttttttccaggactggacggcaaagtagcgggaattgtgatggctgtttcctcgcctgtcgagctgggaatttatctgttgctttatcgtaaaatctctacaaccacaatgaatgtgtcatcctgaaaaaacttacctagagagccttatgctaacgacccgcacattgactccctatggcacaactctcttttacgaggtcaaaatataaggaccgttctttgtaatcgcaatcgtgtgctcgtattgagctccccaactgccgtctgctgtgctgatggtccagccatcgtccccccagagcaccgcgccctcggttccgagggtaaataccggctcaatggttatcaccatcccttcgcgcagcggtaatcccgttttgggacgaccatagtgcagaacctctggcggctcatgcatttggcggccaatgccatgcccgatcagaggcttgacgttgccgaaccgccgccagcctgccgctttttccacagcatgcccgatatcccccaacgtcttccccgggcgggcaacctcgatcccgcgcatcagtgccttatgggtctgccgcaacagtcgtgctaccgggcggctaatgttacctaccgcataggtccatcctcggtcagccagccaaccgtccttgttaaccacaatgtcgatggtcacaatatccccatcatgaagcacccgctccgagggaaaaccatgacataccacctcgttgaccgaagcgcaggtggcataagggaaacctttatagcccttttgttcaggcgtagctccgcgcttgcttaaaaactgctccacccaagcatcgatttcaagcgttgtgattcccggaagaatacgactttccagcgcacgatggcaatctgccaaaatacgtccggcctccctcatgtagccgatttcctccggtgttcgtattgctatctctattggaatccgcctcctttgagcatacaaattcactaaacctatcccattgtatgcaaggcggacacaaaaaaaccgtctcctctgtggatagacggtttataaaagtcgtatttctagtttttcgggtaatcgaaccctttaagatactgaagaatttatgcgaccgagttcgttttccaccaccatggtcaactcttcctcataccctcctgtaatccggtattttcgcacatattcctttacaaattttttgggatccttaggccggaaaattcgagtcatttcccgcagactttccttaacttcattgtgacctttcgttgccatgtaactccctcccaaaacgttgaaaataagtgctccgttgaagagaatgccgaaaagtattgatgtccttatgcagtgaagtagtatgtctaattgcagcttaggtcgggaacaccttatacaaggcatgtacctgacactattattaaccgattttcttttggctgaatcactaccccattataacatattcagatacagctttcagctttccagtaaattaacattgattttacctatcttttacgcatcatgtcatttggggtactcaatcagctgttgcacagggggtataccttatttatcggtttttggagtgtatgtgtttggggtaaaataaataaacataacaaggagggaaaaggatgagccgctttgctccgctgttcactgcacctgttgcccgtatgtctgccctgaacataggaacctgtgaagaggagggcgtcaatgtctccctacttgatcaggcagaccgtgaaatccaagccaagtttcctaaaatgcacagcttcctgctactacgccacggcaaactgatctgggaacgctattataacgggcatgaagtaagctctctgaacgatttgcgatccgcgaccaaaagcttcacttccacgctcatcggcatagctatggctcgtggtgatatgcccgggccagagacggctgtgcataagctgttgcctgagtatttacctaggcggaaggaaacactgctagagcagattacgattcgccatctgttgaccatgacatccggcttgtattggcagacgggtaaaaagctcggagaagcttttatccaccgttttcatcgcagcaaaagctggccatcctttgctctgcgcttacctgtacaggaggatcaactcggtgtattccaatatcgtagtgttgattcgcacctgttgtccgtgctgctgacccattgttgtgggattgacgcctatacgtacgctctccagtatctgttcgaacccttaggtttcgggagaagtggttgggcacaagatccagagggctacaccatgggacacatcgggctatatctgacatcgcgtgacatggctaaattcggcgattgctgccttcatcaaggcagctggaacggaacagaattgattccggccgattggctgcatcaggcgacacagcgacaggttgaagggtatccagaattcggagattacggattccaatggtggacaggacgactccatggcatcaactatgcgtgtgcgcacggacatggaggacagcaaatttatcttgtgccagaagcgaatgcagtcgcagtatttacagcagatagcaaggtgagccgttggaaaaatccgcgaacactgctggagcgctacgtttttccagccgtatcctccctcaacttggaacgttcctgaaatgagctttaatgtgcttattgaatataggaggctaaacaatcatggaagtctcagcaccaaaaattctaatattgtacgccagttacggggaaggccatgtgcaggccgctcgggcgattatggacagtttgcgaagactcggacgctgcgaggtacaacttctcgacctgatggctgaatctcatccctggttgaacggtctgaccaaatttgtatatatgcaaagcttcaaaaccattcctcagctttacggctgggtctataacatcacgcgcggtatgcaggcaaaatcggccttcggccatgtattgcattcattcggaatgcgtcaacttacgctcacactgaaaaaggagttgccggatctcgtgatacatacgttcccgcagctcgcgctcccagcgttacgccgcaaaatgggaatgaatttgcctattgtcaacgtggttacagatttcgatctgcatgggcgctggctgcatcccgatattgaccgctactatgttgccactgaggacatccagcaggaagccgcccagcggggaatacccatcgatcgcattatcgctacggggattccgattcacgcttctttttataacatgtctgctaacgaaattcctgttcaggaacaggtaattccatcgcaacaggctgagactactacactactcataatggctggcgcctatggcgtgctatccggcatactggatatctgtcggcaattaagccagcttcctcagttgcggctactcatcgtctgcggacgtaaccagcaactgaaagcagaattggatgcgctgtatgcagaccacccggacatttacacctatggattcgtggactttgttccagcacttatgcgtgcgagcaatctggtgattacaaagcccggcggcattacactctcggaaagcattgcatccggtttgcctattcttgtgttcaagcccgtgcccggtcaggagctaaataatgctctgtatttgcagcaaaaaggagctgcccgtattgcgcgcactacggaggagctgattcagcattgtctcgacctgatttccatcccctctcttgccgaagagatgacgcaggcgattgagttgcttcgcaagcctcatcccgcagaccagattgccgaggatattttgcatcagcttgtggataaaagaccttccgtacggacaaattaacgaagaataagccagacggaggggataccaatggaacgcgaaggaaaggatttgctcccgctttcgggtgaaaaggtagaagtggatggtgtttatattgatgaggatggacatgaacagcatttgcacagaggtcagcattttccctctgatgttgttttgggtacttccgagtggaaaatgaccgaatacgcctttgataatcatcatgaaggacgtactgatgaacgacttatccccaaaaaggatgacaagaataaaatggggaaaatcacacatccgcgccgccatttaaaaactggcgaccgataattacggaagtatatccacagttactcccaatatgttgatagtttgtggacaatctgtgtgcaaagtgtgagatatcgttatattgtctacagtttgtgcacaaattgtgtataaatcatgttgtttttgtggataaatagtaatgtgcggtggataaagtgcgtacaacatgtgcaaaacctgtgtgtaaccatgtaaatggctgagcgaatctttttcgttcagcctttttcgtatttttatacacattctctaattcatttttttaccgagatcgggtatgttcgaacgagaatatcgctcccggaagtatgagttgcccaaaaaggactctatcccattaacggagactaatcgaaaattcgcaaatagcgcatagaggagtgtaaaatggaaacggggacgaacagagtcaaaagaggaattaccgaaatgtaaaaggcgtaatcatcatagaaattctcgcttcaggcgggcgaacatatgcaggaacgcggtatatagaagcatctagcaaaactcgttgaccaaaatttagaagtaggggtgatccgaatggcatctattaaaatcctttcacttaatgtcggcatgcccaaacagatccagtttaatcagaaggacgtttctacggggatattcaagtcggccacagatgaatatttgtatttatcttatctaaacttcgaaggggatgggcagggcgatctagttcatcacgggggtaaagagaaagctgtatgcgtatatccctacgagcactatccgttctgggaaaatgaattgcggagaccgctcgattacggcgcgttcggggaaaatttaacgataaagggtttgctagaatccgacgtttgcattggagacgtctttaagcttggcaaagctatcgttcaagttagccagccgagacagccttgctacaagttgtccatcaagtacggcgtaccggacatgcccttgaaggtacagcaaacaggctacacgggattctacttccgcgttctggaagagggagttgtctctaaagccgagggattatccctccttcatcgccatccgaaagcaattacggtttcatttgccaatcgaattatgcatcaagagaaggctcatatcgagggtattaaacaaattctcgaagtggaagaattgtccttaaactggagaaatacgtttctaaaacgtttggcgggaaccgaaacggattctcgggaaagactatcaggcaattcgtaaggtggaagtggttcaatgaatttgcaagctcgtctggctgcagtcgaacatcgaatctgcgaagcttgtgggcgatgcgacagaagcgcagtccaaatgggaggcctttcaaccacggaacgtggcactttatcggtcatttgcaaaccaataaagtaaaaaaaggttatcgccaaattcgagtatatccattcgcttgaccgcttatcctttgtgtagagccaatttttttaccgagatcgggcatatccttcaatcctgccctcatagcttgtatagtacggagacttagcttgaatcttttataaaggaggatatgcctgacatgtcagtctataagtcttccacaggattggatgaaaatatagcagctgtcctgtgctatttgttcgcctttattggcgcgctggcctttgtcatgctggaaaagaaaagccgattcgtattatttcacgcactgcaatccatacttctttttgtagcccttatgatcggacatgtgctggtcggattcattccgctactcggtcctttcctcgcttccctgttaacgctggcaggccttgtattgtgggtcatcctgttaattcgcgcgggacaaggcaagtggctcaagcttccctgggtaggcgatctggctcttcatcaagcccggcagttgtgaaaacaacaaaaaaccttgatccttagcaggattcaaggtttttgctgtttcgatgattactttttatcgcatgatcgcttcttctgtcctatatgaatgtatcccaacttatctgggttgaccattaaataaaaactctgaatatgctccccgtccggtgtcagtctgagacataaggtttctctcacatttccgtcttccagaaatgccagctggacctcgccattgatgacggtgtggaacacatctctttctcgtaaaacggttaatacccgacgagaagtcaacagggcgagaacgcctttacgtacaaccatgggcctcatcactgtatgcacattacctccaccatctgacacgaatataggttgttcagccagtagttccagcatagcagtcacatcgtaggcgagaaaagcggttgtaaaacgttccagcagttttacccgggaagagttatttatattaggactgattggagcttcaggagcagattctccggaagatagaatacgacgggaacgactgaacaactgccgacagttgctctcggtcttgcccagtaactctgcaatttctttataatcatattgaaaagcttctctcagtacaaaaacagcccgctctatcggctttagctgctccagcaaaaccagaaaagcgtaagatatcatgtctttacgctctaaccaatccgcaggaagatctgcactttcacccaacggctccggcagccactgtcctacatatgtctctctttgcttgcgtgcagagttcaacagatttagacaccgattcatcgtcattttggctacataggctttgggattgtgtaaatcatccaggggcttattcttcagctcgacaaagcagtcttgaacgacatcctcggcatctgtaaccgttccaagcatgcgataagcaatggaaaaagaatatttacgatatctttgatacagctcctccagatttacatccaccgattgttgttcaattctatgttctttgccagacaaagcatagccccctgttcattaaagaatacccggatacatccccgttgcaatcgcaatccggttccaactgttaatcacgttaaccgcggttatcaagtctacgtattcttcctctgtaaactgttctctgaccctattgtacaaatccgtaggtaccccttgttcagagatacgggttaccgcttcagctaattcaagcataacacgttctttttccgtgaacaaaggaacctcccgccataaggctagctgcaaaatgtggtcagcataatcccccagcttgagcaaatccttcgcatgcatatccagacaataggaacatccattgatttgggatactctaattttcagtagttcgtacaatactttgtctgtaaaacgaccggaaatatatttttccatctccatcattgccttgaacgtgctaggactcactgctctgtgattgaatcttaaactcacgatacatcgcctccattattggtttacatatagaagacaaatgaacacgtgattttgtgacaaagtgcaatacatcaatttggaattgccctcaagtggcatagcatgtattatagataaatgattttatgcaaagaaggtgagcactcacatgagcggaaaaggtattataaaagaatttaaagaattcgctgtacggggtaacgtgattgacctcgcggtcggtgttatcatcggtggagcgtttggcaagattgtcacttctgtggtaaacgatattatcatgcctccgattggtaaacttctgggcggcgttgattttgctgatttgtattatgctataggcgcgaatccatataacggagataacactcgcatgactctggcacaggccaaggaagccggcattgcggttatggcgttcgggcaatttttcaacgtcctgctggacttcctgatcgtggccttctgtgtgttcctgatggtcaagggaattaacatgctgaaacgcaaagaggaagaaaaacctcctcaggaaaaaacgattaaggaatgtccacattgcctatccgaaattcctgtagccgcaacccgttgcgcacattgcacttccaagctggaagggtacgtcgaagcacgctgactcaacccacacctatatgactacaacaaacggcttaagacggtataccgtcttaagccgttttggtatggtgtaggagatctgattagttgaaattggtgataatgccacggggtctgacgggcaagccctcagcgtacagatgggaaacatcaccgaagccgatgcaacggggaactgcccattcctgggagcgctcatcaaacaagatcgtagttacggagctaggcggcatccaaaagccggaccagaccaaggccaaaggcagctccagcagatgggcaagccaggtcagcccaaagccgccatgacagaatacagccacctgatcttcggtgtgcttgagaatccggtacctgccctccatccgctcaaagccttgccgtttcaggaattcatcagaatgaagcttcagctgttcgaagatttcgggactctgcgttccctgataataggaaatctcctgccaagagtcatgagtcggcaggggtaactcggaacggatcacttcaccaggcaaatcccaatgggaaagacggccgtatggagtttcctccagctttagggctagctcctgcgtccagtgttccacttcatgagtcatacccaaagactcggcagtgtagcgcatcgtatccaaagcccgccccaaaggagaggcataaattcgatccagtccgtgactggaaagccgtttggccaatgcctgggcttccaaatgcccctccggcgtgatggtgttgttggggtaatcggggtctgcgtgtcggataatatacaatctcatcattggttctccgttcctatgaatggcgacaggatcgctttatctcattccatcgattagttctcctgatctttaacgtttaatgtttattcagcaaattttccaaaatcgcgcgcaaatccctgtcttcctggtagacttcctcacccgtatccagctcaataacccggatatatgtataattggctctgacatcgactggtttaaaaatcaattcctccggattgtctggacggacatcatagcccatatttttgaacatatccgtgatttgatcaatccccggcttgcccccactttccagcataattaacccacgaagttccttgggttcctctggatgcatgactcgaaaatgtactatacattccatgtaaaatcgctcctttcaatcgtaaacctgtgtgatgttgcaaatcctcatgttcccagcataccccaaatgccactccacattccacacccgccttcatatcgtcaggaaggaaaacacgttatactgtaaagtagacctttgatttctgcttactataggaggaaccacaatgactagcgagcttctagatatctacgatgatgaagacaactctcttggcacagcttctcgacaagacgcacatgccaagggatattggcaccatacctttcactgctggctagcacgagacacttcgataggccgtcgcttactgttccaacagcgtcaggatacgaaggacaccttccccggatgctacgatattacagcagccggtcacttgacggcaggcgaagatatgtctcaggcggctcgtgagctggaggaagaactgggtattcatgtgccctttgcctcattaacaccgctgatgaccgttcggtatgaaagcaaaggtaccgcacagggtacctctttttgggaccgggaggttagctcggtgtttggactgctatcgaaccagccattggaagcttatcacctccagcaagaagaagtagccggactgtacgaagcagatcttgaccaagcactggccctttttgaaggccatattccctttatcgaagcccatggcattacgtcggggccgaacccagaaaaaacccgccgcctgattacatcggatcaattcgtgcctcataaggcgggctatattacatctatatgccgggcactgctggaacttcctagccggtaatctttagctattctccagctgacatatatttgccgataatgccttcataccgccagccataccgggtcgacagctctctgcccatatcatgctccagctcatacagaataagatcctgagcaaaatgattaagcagcagacctgtcattaccggatgctcggtaataagcgcctgtgtcggacaattctctccccgcatacccagcatgcaccaacgccgatcaataacaaaagaaaacttgcgccctgctggttcctgtccgtctgtaccagacctaagcggtaaccacggtcccatcatgctttctccgttatcgcaggaccagagcagacgcacacctcgactctcggctttctccaactctgtccgcaacagttcggcttcctcgcgccacaaatccaacacaatctcatgctctgcccgttccaattcacgtgtcagactttccagtaccttccggtcgccttccgcattataaaaggtcggcttggttggttctgttcgtggcatttccttctccaccgcacgcagggactcctgcatttgtccttcgatcatccgggtcaattcacccggtggcagcatgctgtaacgaacaggctctccagcactggttctgaggtatccctgcccggccaaacgctgtaaagccgcgtacacgttggagcgcgatgcgcccagacgcttagccacttcatagccggaagccgcattttgcctcgaaagctcgaccataaccttggcttccatttccgtaaaacccagattccgcagatgatgcagcaaacgctccatatattctgttccccctatgctgcccggcgttatgtctgtgtcctgcagcagcctgttcggctgcgtcaaatctgttcagctccgcagcgcgggcaccatttggaccctctgggtagttctgcagtacagatttggcattttacattttcacgtacttgtgcagacggcgttgccggcttatcagccccggagttgttggccttccaatatcgaatccgctcgtccagctcttcctgacgctcacgctcacgtgccagttcttcaagacgacggtgttctttttccagctcttcctgacgacggcgctcccactcagcgtcgaatgccgctttttcttccggtgtaaaatcagatactgtgtaatcgcggtctagtcccgctggttcgtgtgtttcataccgctcatcctgttcctgttcatgccgatcgactacttcatgttctgcatactccgtgtaagcaggcgtagcatccttcactacctctggcttgcgcagatcaaaagaatagacgtccgttggcacctcttcacgcacagcagccacctgcttggaggcagcctgtccttcattcagcttgcgtccgcatttggggcaaaagttggcatccagtggcacaactgctccacaggtgcataaatgagcgttttttaattctgcaattctactgcgcagctcgtcaatttcatcctgaagctcatcacatgcggtggatagctgtgtcatctcggtttctgccaccgacatgtcggatgcgcggtaaccttcgtaaaagatctgacccattcgcaagaaatgaacatccatttcctgctgaatcgttgtaatttgtgaattgatcttactaatctcgacagcatgctgcgccttttctgttgcgcgattagcgccttcctttatacgttgaatcagcttcatcgttatttcctccccatatccagccggatttcactgtaccgtccgtatatcccaaagtttttttctgttggcaaacgtcgaactcctgtataatggaatgcggtcatatcgcctgtttgaaggctataggcattagcgtcaacgtattgacgttctgtcactccggcatgatccgcatgaatttcagcattattttagtccatcgccttgttcttttcgtcagctaaagctgactagaactctatcataccaaaaactacccccatttgtgaaaatggaagattttaagaacgaaaggggtttcaggattatggacccaaatccttctttttacccccgacccatcggggttccttactcaacgtcgagccctcaggcacgtcgtgcttccatggataccagtatgacgctggtgcctgacaccgaccaagactcggcctattttcgtgctttagagaacgccggcattcacctgaaccgcccgcagatccaggccgtccgacacggcaaaggcccccttctgacccttgcaggggcgggctgcggcaaaaccacagtgctggctgcccgtgcaggctacctcatggcgatgcgggatgtccctgcatcgtccattctgctggtgaccttcaccagcaaggcagctgccgaaatgaagctgcgcatcgcgggattacccggtgtgcgccctgccgctgcacgtgcagttcaggctcgcacgtttcactcattcgctttggcgatgctgcgtcatcgcggcgtgcaagatgaagtgttcggtgaaacgcaggcccagcataccgtcatgaaaatgatgctgcggcagcttgggctcagcgaggctttccagccagaaagcctgctgtctgccctctccgcctggaaagcggaaggccgcagcgcggacgaactgccggaaagcgtgcgtgaggaatcagatgccaagcgtgccatgctcgcctatgaagcgtggaaacaggaacgcaataaaatggattttgacgatattctgctgcgtgcctccgccctgctgcgtgacccggatgtgcttcagccgcttcagcggcgtttttcacatatcatggtcgatgaatttcaggatacgaatgccctgcaatatgagatggtgcagcgattggctgcccgacatcgcaatctgatggttgtgggggatgatgatcagacgatctatacctttaatggagcacgccaggattccattctggaatttgacaaggtctataaggatgcaaaggtcattaccctggatattaattatcgcagcgatgcgcggattttggggctgggctctaacattgtcgccaaaaatgttcatcgacgctccaaacgtctttcggctgccgggcgtgaaggcttgccgccgcagtttgccaccccatccggacccgaggaggaggcggggcatattgttactcatctactcgggcaggtagaggaaggtcggctgcgctaccgggatatcgctattttgcaccggacagccagcggaagccgatctatttttgagcaattaattatgcgggatgtcccatttattcagtacggagcaggggctgtattttatgatcagtccctgattcgtcccttaatggatcacctgcgcttgtcgctaaatccccggcgtatggaatccattccgagcaccctcgggccgctgtacgtatcccgtgaggcggggatggaatggattatgcgcgaggaaaaacagcaggctaaaaaatacccgctgattcatctcagccgctgggatcgactacgtgattttcagcgtgagcaggtgaaagagcgtattcgtctgattcgcagtctcactacaatgaaacctgcctatgccattcaagaaatgcggcgcgtcttttatgacaaatatttggaaagcggagatacgggcgcgtggactcattataaggaaacgatgcaagaaagtctggaggagctcgaaacggcagccaagcggtttgacaccgtggaggcgttcgtcagctttgcggacgagctttccgagcgtcaccgccaaatggaatcgctgcgcagagaagaagacagcgatgctgttcggctcatgacgatccaccgcgccaaggggctggaattcccttgtgtctattggatcggggccagcgaaggcatcctaccccacagctccgcgctacacagcgagctgccggaggatcggcgggcaggcgccgccccgactacggctgtggataacgatgcagcgcttgaagaagagcgccgcctcgcttacgtggccgtcacccgggcgaaggagttgctgtacatcacctctcccgcctctaatcatggcaagcctgccgccgtgtcacgcttcctgctggaagcctatggggtcacccctgaggcttccaaaccggaagcacgccgcagcagcttcggccaaccgaagggtgcttccgggtatagcaaccgtgctggtgctggatcgccagcgtctggcacagcgacccgcgtgagcagcaggccgggaccaggcagcgctacgatacggacgacctcgtcggtgacagggtctccggcggagccacgcatcaacgtgcccgtgtggaaatgcaccgacggtgcctgcaaagcgtggatgcgtcgcgacacaacaagcggacgccgtacaagcgcggctagcacaggcatgccgccggtgtgcccgctctgcgcctccccgatgacagaggggacacgcagcatcccagccagataggcataaggcgcatagctggtatggagaattgttcttttgctggactggtgacactcgtgatttccagcctaactgttgcagattattaatgaatcaaaaaagttaagttgtagacagaccaataaaagaaaaggcggcagactaggatatgaaaataaaatcctcgtctgccgctatctgttttcacttgctatcgaacgatcgtatcccgttagttcaatgccttgcctgttgtgaagttatatattttaatgattaaacaagcgttccatcacccaataggtgttccgtcaggtagtttggtatctggtttcaatagaaccacatcccccttttcgggtattcctccaaggaccaatacctctgacttaaagcctgctatccgtcgaggtggaaagttgactacacctatgatttgttcccctataatatcttcagccacatatctttttgtaatttgtgcactcgaagcttttattccgatatcttgtccaaaatcaatttcaagtttaatagcaggtacttttgcttctgcaaaaaactcagctttaattatggttccaactcgaatatctagtttcaaaaaatcatcaatcgttgccatctaaacattctcctcatcgattgttttcttcaatttcgcgataatgaatttcaaatttaatattttgcaaccttagtatactttaaagattttgcccaaaaatacatccccataccgaataaagtcatgattccacctatgaattgaaatgcagagattatttctcccaagaataagtaggcgagaattatggcaagaacaggctctccaataataccaactgagaccgtagttgcacccattgatttcaacaacaaattaaaaatatattgtccgaaaatagttggaattactgcaagtaacaagaaatacatccaatccgacgagccatattcgatcaaggcataatgattcaacaaattgtagaccagcatgacgctgccaccaataaaaaaaacaataacactatatacatttgcatttattttgtgacttactttctgtcctgccaacatatatgctgaaaccaaaattgttcctactaaagataatccatctccgattaatgcctctctcgaaatcccaatgtctccccaagctataatgattgaaccgacaagagcggcgatcaaacaaagaatggttaatatatttgctcgttctctgaacataatgtatgaacccatcattacaaataaaggctgcaaggataagatgaccatggagctcgcaactgaggtatatactaaagattccatccagaataagaaatgcaacccgagaaaaagaccagctatgaaaacagtactccaatcttttttgttcatttctaaggaacggaacattttccaaggtacaaaaggaagcattatgagtactgacatatacaatctgtacatcccagccacagaggttggagtatctgaggattttatcatgatggatgagatagaaacagacaatatgctgattaaaagcaagatatacggatgaaacggtaacgacgattgatttattttcacatgtacgcctccaagatgtcttatccaatcgcctgtacacaggattgtaatgataagccgaagatctggtataataatatcaccacttttattttatttgtgtaactatatctttaatttatatagaaatatcgtcatcagaaaggacctcgctaaaatggaaaaacaattgcatgagaccattctatatcccgatgtttcatttccatacatcatgtacacccatactattcatgcaagtaatcctgaaggtagaggattcaacgatttacattggcatgaggaactacaaatcactttggtaaccaaaggaaagctagtgatacaagttaacgggattgatcatgaattgcaaacaggtcaggccattttaattaataaaggtgttcttcacgttactacacaccttacacataacggtcaatatgtcagttttaatttccctgagaagctgttggccttttatgcagatagtgcgatggaaaaaaactatgtacttccttatacaaactctctcttattgtcattcgtaatcaaaggagatgttgaatggcaaattcaaatactgcaaatgctttgggatatgaaacagaaatttgatatgaaaaaaaagtggggctgggaatacgaggtttccatcaaaacggcacaattatggttagtcttaatatctaatatttcgctgtcttctgaggaagcacctaaatacatgaaattgcaacaggagcgacttcaattgatgctcagctttatccatcaaaactactcagacaatataacactgcaagaaattgctgctatagcacatttaagtatttcggaatgcactcgtagttttaagagaactattcatatgacaccttacgactacttaattaagtaccgtatcaagaaaagcagcgagttattaatttcaacagattctacaataactgaaatagcccacagagtggggttcaatcatgtaaatcacttcattcagtcttttaagaaacatcataaaaaaacacctaaagaattccggaaatttagaaatgaattcatcaattaaggaagaattcgttcagcaaatttcgcccagacaaattcagaagatatgaagtttgtttaccatcggagttaaaaatccataatttaaggatgatttcttccgaaattcattgtatggttcctgcctcgcctctaatttatgatgaaattaaagcgaggtgatgaactaaaaaatttaaaaggaaatattgaaaacgcatacaaataaagatgcgattatggaagcagttgtttattatttaattttttcatttttgaaaacggtttcttaaatctgcgccgcaggacaattagggtggtaacatctaattcaaggagtgagtcatatgccagatccgtggaaaagaagatttttccgtattcttagttttgttctcttatcttttttgttggtatctctcgatttaattccaagcttagcaaaagcagaatcaactaacttggtcacccatgttgaagacgaaacgacgatgggtgcaagtcaagatttatccactaatggcaaatctccttctacagttgtcagctccaaagatgcaattattcaaggttacggcgtagaaaaacgggatactccctataccggcgatacactttataaaggcgacggctatgtatccttcttttatgattatgacccaaattcgggcaagtctgacgggacggctacgtttaaagtgaatgtgccgacagcaggtctatataagctgagcctcggttactatattccggcggacaccggctccaaggataccagcttcgaggtcaatggtacaatggctgaaagcataacgctggttccccctccgggaggtgcggttgtaaacgagaagttggtaagcaagatcatgttgaatgccggtacaaacgaggttactttttcaagaggctggggatattacgggatcgaatacgtgaaggttgaattcgccagtttgcctgctacaaacagcaaaattgaagccgaagacggagtcattactggtgaggtcagcaccgaaaccgccagcacgggctattctggtaccggttacgcagcctttaaaggcacagggtcgttaacccttgcctataacgcagcttcaagtggcttttacaatattgcaatcggttacagtaatccaaatagtgacaaaaagacccatatggtggtcaacggtcagacaagcgaaatatcccttccgacaacagcaagctattccgaggtatccggcggtaaaatcatgttgaattcgggaaacaatacaatacagttcaatgtcgacttgggccagtatcatatcgactacatcaagctggcagcagtgctccccccgaaactgcatcagattgagaaaaagccggtaaacccgaatgcgactgcggaaaccaaggcactcatgagttatctcgtggatgtttacgggaacaaaattctttccggtcagcacactctggaggatgcccagtggattaaagaccaaactggaaagtatcctgcgatgttgtcaacggacatgatggattactccccctctcgcgtcgagcatggtgccacctcaactgaggtggacaaggcgatccaatgggccaaagaaggtggaattgtcacgtttgtatggcactggaatgcccctaagggactacatgacattccaggcaaagaatggtaccgcggattttacaccgaggctactacattcgacgttcaatatgcgcttaatcatcccgagtcggaagaatatcagctaatcctgcgggacattgatgccattgccgctcagttgaaacgcctccaagacgctcacgttccggtgctgtggagaccactgcacgaggcggaaggcaaatggttttggtggggcgcccaagggccagactccgccaagcagctgtaccgtatcatgtacgaccgtctaacacactaccatcacctgaacaatctgatctgggtatggaactccgagagccccgaatggtatccgggggacgatgtcgtcgatattgtaagtgtggatatctacaacccggcggctaattatcacccaagtatcggcaagtacgacagcttggtaaatctcgtgcaaggcaagaaactggttggtctgtccgaaaacggcccgattggcgatcccgaattgcttcaagcatattcagcgcattggctctttttcaccacatggacgggcgatttcgtccgcaacggacaatataactccctggatcatctcataaaagtgttcaacagcgattacgtgatcacgagggatgagcttcctcaagacctatttacttcctccaagaatgaagcggagtaaggcgctcttacggggctcaccgtaccacggaaggtagcagatacttcggacgatgggtatgtggctggattctgataacaacgtcgacaaattggtaattactttgaacgtgcctgtaattttaccgtcccacccagcaccatgaagtaacgcataagcctgcccctaacgaacagcggccacctcagaaaataaccgaggcggccgctattggtttgtaacttcaatgaatgcagtctatagcaaaccttaatgaaaaaggaccgtctcctctccaattggaaagtggaaacggacccgttctttatgcaaaacgaattaattggtggaccatagcttaatccggttttgaatatgtttggtaaaggattgttccatttcttgtactccggctttctccagctctgccatataggcatcccaaaccttatcgaagttctccggcttggtcatgacagcctccggaattcgtttccatgtaatatccttcatcttggctccgagaataacagccggatcgtcattggggagagacatcgtgtaggctgctccgtatgctctcggttggaattcttcttcttttgggaatagatctttccaatgatcaatcttataggcctttaggacttccttctccgacttgttataagttgctgtcagcatctccggataactacgagtaaagtagttgccggtggagtccttgatgccatcaccataatggaccgacaagttccaatatagaccgattccagattctttttggaaagctgcattgtcattattcatccgttccagcacagccggaataatcgtccgtttgccgtctttaaccgtgtaatgctttccttcaatcccccaattattcaggatttgcccctcttccgatgccagaaagtcgaggaactggatagcgcgtaccgggtccttgcacttgctagagatcgagattccatatcccccatcaaagccaggaagccaaaagttggtgtccttatattccttgctcatggtgactggataatgaccgtatgtttggtcgaatttgccctccgcttttagcgcattttgcccgtcgccatagtcccattctggatcggcaaggccaagtacgcggcctgaagccaccttcgccttaaactgatcggtcttctgcacgaagctttccggatcaagcaatccaatggagttcatgtgattcaaccagcggaaatattccttttcttccggtcggcggaaatgataagtcgcttggtgtgttttttgatcaatgtagtattcgccgtcgtctggtcccccggtcgtttgaaatcctgagtttgttacctggtacatatgccaatcgtcggcattaagggacaatccgatatttttatttccattttcgtccgtcggatgcttggtgatatagtccttaatgactttttcaaaatcctgtaccgtacgaatgtccgggtatcccgcttccttgacgacacgatgctggagtttaaaccctacgtcgggtttaatttttttctcctcgacagcggaccaggtcggaatcacatagatcgatgggtcgtccaaactgtactttgtccgaacaagcttgtctcccagcatttttttgatgttcggtgcgtgcttgtcgatcaaatccgtcagatcaatgattgcaccagcatcgacaagtttgccgacatccgccttagcagcgatcaaatcaggatagtttcctgtggctgcaatcaacgaaatcttttggaccgggtctccgacagcgaattcagcatctatcgttactccggttttttcagcgatgaccttaccgacttgatccttcatgctattccaatttgtgctggagtcttccgaaaaataagtaagtgtgatgtctcctgttgttacggccttggtagcctcagacggattattaccgctgcaccctgcaagggtcgcgactaaagtcagtgacattacgaaagatacgaccattctattttttcttggcttcatggagcgaaacctcccattataatgaatgtttgcttcgtttagctctttaccgctccgagcgtcatacccttaacaaaatatttttgtaaaaaaggatagacgataagaatcggcactgtaacaatgatggtgattgccattttgacggattccggtgaaacctgtgccatacgctcggccatattggcagcgtcctgggaattggttgcgcttgttgtcgtactttgcagaattttcatcaattcatattgcagggtcgtcaacgattcgttggacccattaaacaggtaagtatcgaaccaagagttccattgcccaactgccaagaagagcgctacggtcgctaatgccggtttgcaaagaggaagaataacgcgccagtagatcgtgaaatcgttggcaccatccagcttggctgattcctgtaacgcataaggcagaccatcaatgaaggaacgaataatgaagacattaaacgcacttacaagacctggcaaaatatagacggcaaatgtatcaattaaatgcaattccttcatcaggataaaacctggaatcaaccctccagaaacatacatggtgacggccagaaagatggagatgaaccttctagcttgaaaatcacttcgtgcaagcgtataggcaagcatcgagccgctgaccaagcccgctacggtgccaatgacggttcgcagaaaggagatcttgaatccagtgattaacccctcataggtgaaaatcaagtcgtaattcttcaaagtaaattgccttggccagatggtgatcccacctctaatggtgtctaccgaatcgttaaaagagatagctagcacatttaagaacgggtagatcgtcagaacggtgaccacaatcatgaaaacataaacaactatccccaggattcggtcttgtggtgatttcgcctgaagcttgttgtttaatccgccgaccggcgtagtgcttttgacagcctccatgtccattctcctccttacataatgctctcgttggtatagcgcttaaagattccattagccgcaaacaataggatcaggcttatcaccgaattaaaaatattaatggccgttccgaaagagtaacgtcccatcgctagaccataattaagcgcatacaaatcaagtacttcagagtaatcaatgaccaggtgattgcccagcagaaattgtttctcgaatcctgtaccgagcaaatgaccaatagacataattaggagaatgataatagtcggccggatccccggcagcgtgatatgccacatttgctgtaatcggctagcgccgtccacccgcgcagcctcgtataattcaggaccaataccggcgatggcagccagataaataatggcgttccaccccgtttccttccagatgtctccgaaagttacaacccaccaaaataatttaccttgggccataaactggactggctgatcgatgatgcctagacccatgagcatatcgtttacgacaccgccatccgctgaaagcattttggtgacaatgcctgcagcaaccacccatgaaacaaagtgcggcagataagatacggtctgaacaaatcgttttatcacttgtatgcggacctcgttgagcaatagagcaaagacaacgggtacaataaaaccagcgaccagtcccataaggctcatagccagcgtgttccgcagtacttggtagaaatgatcatcttggaacaaagtacgaaaatgctccaagcccacccacttctgttcaaaaaaactcaaaccaggtctgtatttctgaaatgccattgtccagccccatagcggcaaatactgaaagataaagacccagataacaaacggaatggacatatagtaaagatacctctggcttttaaataccttccaagcattccgcttcgtttttttgtatacgttttccgaatttgctgttaccgctttcatttttttcatcccctctcttaaaaccaatcataaaacagaggagagtcagaacccatacaacggatttcggaaaaaatcatccacaaattatggatttctatattccgacggtgaacggccttcgtatcttttgaatttgctgtaaaagtagttgacacttgtatagccgacgctttcggcgacttcgtatactttcattccctgacccagcagctccttggccttttgaatacggactcggtccagataggtattaaagtactcccccgtcttgttcttgaaaagctgacccaaataggcggtactatagtttagtagtccggctaacgcttccagcctcaggttgtctgcataatgcttgtgaatgaagtcgatcatttttttgaattccagctcctttccacggtgttcagagtcttgcgccaatgttagcaggaaacggtgggtctcttccaaaagatcatatagatgatcatgctggtatatcccatttaaaaaacgggaaacttcctccgtctctttcaactcgatacagaaacccgcggtcagcttatgaatgattgcattggacagaaaaaagaaggactctttgatcgacttctcatcttgcccctgtttgagaaaaaatgcagccgcctcgttcaataatggcagtattgcggtttggtttcctacttccagactgtaatacaggcggaagatgaattcctccatcgtttcctcagctttatcagcagacaatcggggagaatccagcgaagaagaaaagaaaggatacggacctagcagtcggttcttctcgctgaaaaaggattgttttaccgcttcctgggcctttaaaaaagatttacaaatatcttcaggagcagatactacccctccggttgcagcggcgaaccggacattatccgcaacattacgaatctcattgtggagaatttcacgccgttctcttccgcgcagcggcgcgttgagcaacaggactgtatacggggggattactgtgacaagtcccatcatctgcccctctatctttgccttcaatccattcgaaagctggtatgcgacatcagaacggtccacttcagaaacacgcgggtagacgaccacgacttcgtagttgctccacaacaaatccgcttcttttgccttacttctcaacttggccggatcttcagttctctcttgagagacgagcaagctatgcaggtataaatctcgatttataacctctctcttacgccactccccttgaagacgctcctcttcgatccgctcgcgtatccgttttaaactggacgacatttcatcaatgtcgaccggtttaacgagatagccgaacaccccgtatttgatcgcttgtttggcatactcaaagtcggcatatccactgaggatcataaaatgcaaatgatgaccgtcggttgtcaagcgctcaatcaactgtaaaccatccataaccggcatgcggatatctacgattacgacatcaggagctttttcctcgatgactcccagtgcttcctttccattggctgccgtagctgtaacgataaatccgaggctttcccatgggatcagcgtttgaagcccttgacgaagcttcggctcatcgtcaacgatgactaccttaatcatttggattcacccccaggtatgaaaaactgaatacaagtgcctttcccaggctcgctctcaatatgtaaagcacttgaggtcccatacagtaagacgagacgatcatttacgtttcgtagtccaattcgctggacctcctgttcatgtacggatgcagcaagctctgcttgtactagggcgagacgatcggccgtgaaaccagcgccgttgtcacataccataactcgaaccccctccgggatttccttaactttcacttcaatgacagctccttctgcttgattatccagaccgtgtacaatagaattttccaccaatggttggataatcagaggtggaaccaacatttcctccaaatttggatcaacggttaagcgatactccaaacggtcttcataccgaaacttttgaagatcgagataacagcacacttgttcaagctctttacgcagtggaatcttgtcgttaccagcctccagactgctgcgtaacaacgcgctcaactgccagactgctttagcgatatcgtcctgttggcgaatgtgggcctccattctgatagactccaaagaattgaagagaaaatgcggattgatctggcttgccagcattttgaacttgatctcgttttgtctttgctccacgagtcttttctggcgattcgtctcttggacctcctggaccaaatggtttacgctgctgacgagcgcgttaaattccctcgataatagacccacttcatctttcccatcgatatggagataggtttcccatgagcccgcccctacttgggtcatatgcttgcttaagcgaagaagccttctggataatagcgaagcagaagcatagataagcaaggctgcaaatatcaggctggctgtgatcgcgattccgccgagccatatcacttgattagcatctcgggtaatctcagaaacagaaaaaatggaaataatgcgaagtccattccagctattctgtggagctagattggcgataaccaccttcgacgcttttccatcgatgagcatgttgtaacttccttcctgatggaaaagtatattttcgtcggcatgaatttcagaaagattcttcccgaacaactctgcttcattggacgcgacaatctgattccggttatccacgatcaaggtagggaacgattcctgattcaggattgaatttaattggcgcttgttaacatttatgaccagaaccccttttcgtcctggtgaatccactgaaaatgatcgaatcaggctgagataatcggcatcgtccctctcatccttaattaaattccagccggccaatcctttctgtgcgatggcctccttgtaccaatctgcggttgtgatcctatcatccggttggataaattcccaattattaagtgctccaggattagagacatagacacggatgccggatatctctttgtacaactggaggtagtcacgaatacctgtatactcccggtatgcctgaatgacttcgatgtagctgtcatacttctggctggctaccattttcatccgattgtcattggtcagccggtacgagatgtccagcggcactttgatcaattcttctgtacgatttcggacccgctcgacattgttggatacttgcataaaggcgtctttaataacggcctctcgaagcttccccgtcagaaacaggccacacaacagcaagggaagaacagctaccgaaatgaatgtaagcgtcatcttctttctcagtttcatgtcattcatcattcgtataaaaaacatggtttgcccctccccaatcagtacgctgatgcgcgcaaaatgccccttttcatataaaaaggggcataactccatcgattgttttctctctttcggcaattatactgttgtactgatccttaagccttaccaggctttattgcccgaagcctgaaccatccactttcatagtctttctgtctgtagagaagagggaggcccaacttcataagccgatcccccccatggatagacttttgcccgctatttcctgacttaacttcatattcgagctctggatttagtccgtcaaggcgcagggctcgccaaggcgcgttcgggacagccatcacttggaaatagtagacgatggcatcctcttggtcttcagaaacaaacatccaagccgattcgttatcttcaaacgggctctttaagcgatacaagtcacctttctgtactaagccacgtatctgcttgtatactgcgatttggcgtttgaccgtctctttttcctcatcggtaaatttcgtgagatcaagctcatatccaaaatttcctgacatggccacatcacctcgaaaatcaaggggtgttatgcgtccaacttgatggttcggaactgccgacacatgcgctccggttgcgcttacaggatagacaaggctagttccatattgaatcttcagacgttccaccgcatcggtattatcactagtccagacttgaggcatgtagtaaagcatgcctggatcaaaacgtcctccgccacttgaacagctctcgaaaagaatatgcggaaattcggtggtgacgcgctccagcagctcatacaatccaagaacatagcgatgggcagtctcagattggcgctccggcggcagagctgcggaaccgatttccgtcaggcagcgattcatatcccatttcacgtaagaaactggggcgctggagaaaatggcagccagcgaatcgtagatgtaatcgcgtacttccttgcgagtatagtccagcaccaactgccatctggcttcactgcgtcgccgtcctggaacgtgaaggcaccaatctggatgcttccggtacaactcactgtctggggagatcatctccggctcaaaccagagtccaaatttaagccccaattgattgatgcgtttcgcgacatcggcaagtccgtctggcagcttccgacgatcctcgtaccaatcaccgagagacgaattgtcggaatcccgttttccgaaccaaccatcatccaagacaaaaagttcgatgcctagctctgccccctccttcgctatcgataccagcttatctgcattgaagtcaaaataggtagcttcccagttattgaccagaatagggcgttcttcatcccgatatttccctcggcaaagacgagtccgatacaagcgatgatatgtacgcgacatttctcccagcccttgaccagagtaaaccataacggcttctggcgtttggaagctctcccctgggctcagtaaccacgaaaaatcaaaggagttcacgccgatgctaaaccgtgtagagccgaatgaatctatttctgctcccgcctcaaagcccccgctgtacacgaggctaaagccgaatacctcaccatagctttccgttgttccccgagtgaccaatgcagcaaaagggttgagttgatggctgctcatgccccttttactatcaattcgggtttcaccttgaagaatcggtttgcgggtaatattcccctcccgagcccatgctcccgaaagatacatgaactctaaatcgcttttacctgaaaaatcgacactggcacttagagcacggagaagccgaagattcttggctcccgcattactcaaacgagccgaacgagcgattacgtttcgatctgcgaagacggtataaagaagaacaactttaaggcctgaaaagtcatcttgtaactccagttccagcgtatccgcttcgtcttcattttcggtatatacggccggaagcccggttaatgatggctttcccttagtgatccggtagccaatatactttaactccgtgatgcgagttccatcctcaagctctacttgatacgccgggttacggaagtccccgctcccatactgcggatattcttgcggcaaccgatccaatccagccttcgcgggagtgtgaagcaataggtcagccatgggttcgcggtgcttcaacctgtctccccagtatacatgaacaggaaatccatccacaatctgaataatataactcatgcccgacgactgcaaatgaaacagccctgtttgctcttgaacaatgatacccattgggaaaataacccctctcttagataataatcatcggagttccacaccaaaaagacactcagaagaagcattttgtaacagccatcaactatgttcatatggtgtaaagcttgataagattcaacaatatagcagtaggttctacagaaatcatatattaatttcagatatgaagtacatggcatggtgctcactatttatgttataatgcttgataatttacataaggagatttagcgtgatagaatatttgccgcgtagtaaacagcattctgaattgtatctaactcagtttggcatagaggaatgcataccgagtcacttttttggacctgcgataagagatcactatctgcttcattatattttggacggagaaggtaccttcgaggtcggtgggttcagttatcgcttgcggaaaggacagtggtttctaatctgcccccaggtcattacttattatcaagccgatgtagtgaatccttggtcttattgctggtttggatttgacggggcactggcagaaacactcctcaagcaagcaggtctaacgatgatgcgtccaatcctcaactttgaaggagaccatttgattcatcagtatttgcagcgaatgaacgaatcaagtgaatgccataaagctcgggaaaccagactgaccggtctgctttgcttaatgttatcggagcttatagaattcggtccggtaacacctcccgaacaaaaggaaagccggtcggaaatttacgtggaaaaagtgaaggattttatcgaaatgaattatgctcagaaaattaccattgagcacattgcaaattttatcggactcaatcgaagctatttatgttcgttattcaaacaacaagtgaacacaagtattcaggattatttggttcgctataggatcaacagagcatgtgaaatgatgggaaacgctgaactttcgatcggtgatatttcccgttcagtcggctataacgaccctttactcttctcgaaaatttttaaaaaggtaaagggactctcccccaaacattatcgaaccgaaacccatactcaaactcaagtcgactactaacgaacaaaagaggtcaacccaaaaaactggctgacctcataagtttattttgtagtttgtccttccaaataagaaaccggctctttaacctctactttggtgccgccaaattcatctttaatgtatttttgagtatcctcgttatgatagagatccgctaacttttgcagccctttgtcattcgccttatcagatgaagtaaccaggacgttgatattatttttggttgcctgactgatctcctcatggaacaaggaatctttcagtacattcagccccccttctaaagcaattgtattcccaatcagcaccaagcctacatcttgaatcactcgtggtcctgttttatcatcaattagttcaaatttcaggtttttaggattgctagtaatatcattgactgtacccaaggcatcattaaagtcagccttaagcttaatcaaaccggatgcttccaataactttaaacctcttgccgtattggctgggttatctgccaaagctaccagagccccgtcggtcacttcatcaatgcttttgaatttttgcgaataaatccccatgggctccaggtaggttgtggctatagccttcaaatcagctttgctctctttgttatagctaaccaggtacgcccacgattggaatgcattcacgtctacttcgccttctttggtcgcattgttcgtttcgattccgccgttaatttctttcacttcaatgtccaacttggcatccttggcggcctgggactgggcaatatgcttccagatctgggcgtcagagcccatggaaccgatgactactttttgcgtttccgaaccggaagcggcgctggagccattgctgtctgaacttttattaccgcatcctgcagcaaccaataataaactaatccctaatagtaaaacgaacgatttcttcatgttgttttcccccagatcatgtatgctagtgcatcgtcattccacctgtaacattaatcgcttgtcctgtcatatatgcagagagcggactggccagaaacagcaccacattggcgacatcctccacctcagccgttctccccaaaggtacctgtgaacaatcttcttcgtatatttcttgagcggtcattccgcgaatgacgcccccttcaatccgttcgcgatgtttcatcggcgtttctacgatacctggacaaaccgcattcaccaaaatttgatgcggagcaagctcaatggccatcaccttggtcaagccgagaaccgcatgtttggaagcacagtatccgcccatggcccgatatccattttttccagcctgcgaagcaatttggataattcgtcctggtttgcgcgcatccaccatttccttggcaaaccgtttggacgctacatacagcccagttgaattgatcgaaaatactttctcccaatcagctaactcactatcaatgacataattcatcgtagaagtacctgcgcagttcaccaatatgtcaggaactcccgtttcgctaattagtagatcgcaccatctttcgatatcatccggtttcgatatgtccaattgcgtttcaaccaactgtggattgaccactctatacggctcttcataagaaatatcagcagaaatcactttagctccgctttgaatgaaaagctctacaattcccttgcctatgcctgacttgccgcctgtcactaccgctgtctgatgagataggtcaatcgaaatcatagattttaaagtactctttcgaaaggatcgcggctaataccagcttccaatacaatcttcacatattcctgcgcggaaaaaagagagtggtccttgtagttcccgcattccaaagcagtaacagctggaacctcagtcgtttccagaattcttttcaaagttttttccaaagcgagtgcaatttcctcaggctcgtgttcattccacaaaatcaagtagaaccccgttctgcatcccataggagagatatcaataattcctttgatttcatctctcaggtacgttgctaataagtgctccagcgtatgtacagcagctgtagggagtgcatcttcattgggttgcaaaaatctcaagtcatacttttgtactgtgcttcctttttcgtcatgctctactcccgctgctcttacataaggagcctttacaatcgtgtgatctaattgaaaactttctacttttgccatttttcttttcctcttttctgtaatttatatttttaatctaatgatggatactctacatttgtgattttttcaaaagaattaaatgctctaaatcagcatttttgtaattatacatcggattactcggttttaccactataattcttgttgtatttctttttttctttgaccgtctctcctttgcctgtaggttttgacatagtgtacaatgtatacgataatgcatttttacgaaaaagatcgaggacatcataagcctcatttaggagaatgctctgtgaatgaaccggattggaagcacctgaatgctgtcccattacccttgcaggaatttcagctacagctggatcaaaacagtgtcgacgccaagcaactagaggagtggagaaagattcccgtcctttatcagctggctctggaggaattaaagaataaaattaagctgattcagacggaatggaagctgttagacggttttagcccgattgagcatattaaaacccggatcaaagagccccacagcatcgtggaaaaggttcggcgcaaagggcatgaagtgaccttggacaatatattgcgtgaaattcatgatatcgctggaatgcgcgtggtatgcgcttttgtgaaagatatttatcgtctgatggatcatcttcacacacgggaagacattcgtattctggaggtcaaggactatatagcccatcctaagcccaacggctatcagagcctacatgtcattgtggaaattccgctgatcctgtttgagggcacacgctggatcaaggtcgaaattcaattgcgcacattggctatggatttctgggccagtatggagcatattttgtactataagtttgataagaaagtgcctgaacatgtcgttaatggattgaccgaagccgcacgtgcaacctacgagttggatcagaaaatgctgaagttgcgcggcgaaattttatcgcttagcaaggaacaggatacggaagaatccccttcgaatcaatccgaagagacgtccttaaagacactctccctccctgcagatcacgccacttcacggccacaaacctgctaagtatttgtgtacaagataatttaagaattcgaattcagtcgaggctgcaacaactatggttcagtcttacgctggattttatgtattgggtacaaaaaaagagccatcaaaaccacgttcatcatggttttgatggctcttttacacattttctgatcaaatattactgtttctcgcgaatctctgtgctgattttctcaacgatatctgcaatgctgagtgatcccagatcgccttcgccgcgtttacgaaccgctacagtaccggttgttttttcattttccccgataacgaacatatatggaaccttctccaattgcgcctcgcggattttataaccaagcttctcattacgagtatccacttcgacgcgcagacctgctttcagcaacgcatcctgtatctcattagcagtctcgatatagttctcggatactggcaacagcttcgcatgaacaggagccaaccacaatgggaatgcacctgtaaaatgctcagtcaggatgcccatgaagcggtcaatcgaaccgtagatggcacggtgaataacgactggacggtgcttctggttgtcctcgcccacataagtgaggtcgaatttttcaggcatttggaagtccaattggatcgttccgcactgccagctgcgtttgagcgcatcaagaatgtggaagtcaattttcggaccgtaaaatgctccatctcccgcattaatacggtagttgatgcccagatgatccagcacgttttgcagagcttgttccgcttgatcccacagtgctggctcgcccataaagtcatctggacgtgtggacaattccactgtgaagtcaaagccaaacacactatacatttcgttaatcagcttaattacgtctgtaatttcttgttcaatctgacctggtgtgacgaaaatatgcgcatcatcctgacagaatgtacgaacacgcatcataccgttcaacgcgccggacagctcatggcgatgcacttgtccaaattcggctatacgaattggcagatcgcggtaagagtgaagctcatttttaaacacaagcatatgccctgggcagttcatcggtttcagagcaaatgtagtttcatccacttcggagaagtacatgttttccttgtaatgctcgtagtgtcccgattgttcccacagacgattgttcatcatcagcggtgtacgtacttcctcatagccatgcagacgttgaatatcacgggagtaatcttccaatgctgtgcggacaaccatacctttaggcaggtagaacggcatgcccggtgcttcttcggagaacatgaacagttccagctctttacccagcttgcgatggtcgcgttttttcgcttcctccagcaaatgcaggtgctcatccagttgtgcttttttcgggaatgctgttccgtagatacgttgcagcatcttgttgttggaatcgcctctccagtatgcgcccgctacactcaacagtttaaaagctttgatgcggccagttgatggcaaatgcgggccacgacacaggtcaaaaaattcgccttgatcatagattgtaatttccgcttcttccggcaaatcacgaatcagttccagcttcagtggatcttccaactctccaaaaatacgagtggcttcctcacggctgaccacacgacgtgtaatcggcagattttcctgtgcgatcttcgtcatttccttctcgattttggccaagtcgtcaacagacaatggattttcgatatcaatgtcatagtagaagccgctgtcgatgaccggaccgatacccagtttcacgtttttctcaccgtaaatgcgtttgagcgcctgtgcgagcaaatgcgctgtactgtgacgataaatttccagaccgtctacaccatccagcgtaatgatttcaaggtcaacgttctgatccaaaacggtgttcagatctacagccttcccgttcactttacctgctacggcgttctttttcagcccggagctgatcgaacccgccacgtcagcaattgttacgccctgctcgtactcgcgtacggctccatctggcaatttcacttgaatactcacgattaaagcctccatttcaaattgtgttctatatcaaaattgaacgcaaaaaaacgcctctctccctcaagggacgagtgcgttcagctcgtggttccaccctagttcggcccgctcctgtgcgtacattatgttcatcggaacatgctcatgcacgacatgcgtgaccctccattggtatccgttaacggggataaagcggtaggcgcttactgatgttactgccagattgcacagctacatgttcaacgtcacggctacaaaggggtaacttcacatgcggttgccggaaaagctctcagcctcgtcttttctctctgaacggcccttcaaggaaatcatgtctttggtcaatgccttgaatatcactatatgctacagcattatagatcaaattcgcaggtatttcaagtgggcgtttatgtaatttcatgcctcctattgggtattcggcggacaaaaagatgcaaaggcagcgatcccaagcacaggaacggctttgctctttgagccgtttttcagtacctttcattcctacggtgcaggcttgttgtcgtgcgtatttattttacgttctataggagatttcaaatgggtagggttcttcaagagaaaaaaaggaactgtttttgcaaagtgggacactgtgctctactcgcccctttgttttctcttgggaacagccattttaatgattatgtttttgcgtacggcatagcttaaagccgacctctatcaggtggtttgtttctttcgcacgtctccactcgtttctttctcagtgaaaaagtacagcaaagccagcacaggcaggacgactccaatcagagaactaaaattccaacctcctaacgcatacgaccaaccacctaatgatgatccaatcgctccgcctatgaaaaaaatagacatgaataatccgttcagacgccccctcgcctcacttcccaaggagtaaatcacacgctgtccaagtacaagatttcccgatacagccatatccagtgtaatcgctgaaataaagagaagtacgagtgcaaccgtcgaatgactttgaaaaagataaatgagcaaaaaagacaaggctgcaatgatcatagctaacccggttaaacctttgctccaacctttatcagccaatctcccggcaatcggggcagctactgcaccgcctacgcctactaaagcaaacaatgcaatcccttgttgagacattccgaaatcatccgccaaacgtagaggaacaacagtccaaaataggctgaaggcaccaaataggcaggcttgatacagggcacggcggcgcagtgcaggcgtttgttttaaaagagtgcctagcgagaaaattaatttactgtaagataccgtaggcacaggcttgcgctctggaagagctcgtgagagcagaatcgtcaacagcgtcaagacaatggctgacaaaataaatacggcttgccatccccagatgctggtgataaagcttgctactggccgtgcgaacataatgcctagcaagagtccgctcatgacattcccaacaacgcggccgcgctgctcttcggatgctaaataggtggcgtacggcaccagtatctgggctaccacagatccaattccaatgaataaggatgcggtcaggaacaacggggcattggtggcaaaagcggcaacagccaatgcacagactgtgataattagcgatatgaccatgagccgtcgattttcaataatgtcgctgagcggtacgataaataacaaacccaccacataaccgatttgagttaaggtgacaatgaagcccgctgctgtagaagaaagacccatagcaacgtgaataggtcctacaagggtttgagcatagtacaggttggcaacaataaggccgcatgcggctgccaacaaaaacatcatccaatttgagatacggttactttttaaggcttgttgttctctttgcataataatcctcctcattaatttaaatactaaacgtatagttcattaatttgataatcaaataatatactgaacgtttcgttttgtaaatagacaaaatcaacttttttatttcacataatatttgatatactgaacgtatagtttatttttcgcgtttacttatatctgttaagaaggtgagcattccagtgcagagtaaaagaggacgtccacgtaatgtcgagacgcaaaaatctatccttaacgcttcctatgatctactgttggagcaaggctttggggcggttacggtagaaaaaattgctgagcgagcgaaagtgagcaaagccaccatttataaatggtggcctaacaaagctgcagtagtaatggatggtttcctgtcagccaccatagcaagattgcccgtgcccgacacgggttgtgtattagatgacattctcattcatgccacgaatttagtgcggttcttaataagccgagagggtaaaatcattacggagttaataggcgaagggcaacttgattcaggcttgtcagaggcataccggacccgatatttccaccctcggcgacttgaggccaggcttcttattgagcgcggaatagagcgcggagaattgaaggataatctcgatattgaattatgtatcgatctcatttatgggcccgttttttatcgattgctggtaactggttatccattagacgattcctatgtgcgacaattagtcatgaatgcgttcaaaggaattggcgtggactgaataagtggtatcaagcagttctcacagagtatcctctgtgagggctgctttttcttttacctgccacgatcctctggctaactccttatttgtttatttgtttattcgtcagggtctatactaatcttttgcagtaagtcgataagaagatcctcttcctcttcggatagtttatggacaaggctgacattgagctcgtccaatattccttgcaagacaggggcaaactctaacgccttggccgtgggagatacaagataggaacggcggtcatttgggtccgttttccgttcaatatagcctgattcctccaattgtttcacagagcgtgccgtggttgccttgtcaaatttaagttcattcgtcaactgctcttgtgtaatgcccggtcgctgcaaaatgagctttaaaaagctgtgttgtcctccactgccgattccgtaagggcccagttttttggacagtattttttgatttcgacggtacaagtgggaaattagctttccaatcggtttttttctcatcaaatacacctcattggcttgaaaatgacaaatccccagttgggaccaaagcaaagtttacaacaatattgttgcgcacgcaactaatttgctgtacactagaaccgttcatttagttgcgcgtgcaactaaatagaaattgttaacgataacgaggtgtaatgatgagttcaactgctacaacggctacaacctatcaagagaatatcgaagtccagaagaaacgttggctgattttaattgttttgaatctgtttacatttatgtccacattggatggaagcatcgtcaatatcgctcttcctgtgttgtctcgcacgttacatttacccgtggcacagattgaatgggtgacaaccgcctatttaatggcgatatgtaccgctatcttattttttggcaagcttggagatatcgtcggtaaaatcaaaatattcaaaatcggtacaatcgtattcattcttggctccctaatgtgcggtcttagctcttcgctttctatgctgctgatttcccgtattattcaagcatttggagcgtccatgaccatggcgaacagccaggggatcgtgacagatatcttcccgtccaatgaacggggcaaagcacttggcctcattggaaccttcgtttctctgggcagtatcgccgggccaagcttgggcggtattattgtctcgtcgctgggctggcagtacattttctgggtcaatgtaccggtagggctggtcgctgtctttcttggctggaagcttctgccgaaggatttgatcaaggtgaaagataaaattgacgttcccggtagcttggtatttgctatttttattctcactttgttcgtcggattgttgctgggacagcaggtcgggtatggcgacaaacgtatcgttgcttcgctggtggtggctgtagttgcttttgccatgttcattaggttggaacttcgtcgtcctgggccgctcttacagctcgcgctattcaaaaatccgttattttcgctcagtattttgtgtgcttttctggtgttcgtcgctaatttttgctttaacatcatttcgcccttttatgcgcagaatatgctgaacttgtcgccttttcatgccgggttcctgctgatgctgctccccatctcgatggttattgtggcccctctcagcggtgcgctttccgataaaatcggatctgaactgcttacattcgccgggctggtcgttatggttattgcccaaattggattggcccaattgcatgcaggcagctctatcccgctcgtgggtctgtggattgccatgctgggcattggcagtggtttattccaatcgccgaacaactcgctgattatgtctacagtaccccgcacacagctcggctcagccgggagtgtcaattcgctggttcgcaacgtcggtatggttgtggggatcactttggccacatcgatcctcttttatattatgagtaaagaggctggttatcgggtcaccggcttggtctcgggtcatccagaaatttttctggcaggcatgcatgtagtctttatgacgtccgcgtccatctgtcttgtggcggcattgttaacaggctggcggctgatcgaggctaggcgggcaagaacgcagcaagaaaagggataaagaccaagcgaagaaataaagcgtccgtagacagaacaatgatcgtagaattaagatgatgagtattgcattacaaacacggcattaaaagcaacatttacaattttaaaaatgggatacaagggtggagcttacatgaaatattgctatgaatgcgggacaaaattgatggtgaaggagtgtgaaggcgaaggccctatccctttttgtcatacatgccaggtctttcgtttcccgatattcagcactgcgatcagtaccgctgtattgaatattcagagagataaggtgctgctcatacagcagtacaatattcagggtttcattttattggcaggttatgtgaacaagggggaatccgccgagcagacattggtgcgtgaagtgaaggaagaagtaggattacaagtcgatgagtatcaatatatgcgcagcgagtattttgaacgaagcaatacactgatgctgaattttgtgtccattgtgaatgacgatcagttagatgttcttagtacggaggtagatcaagcacgttggtttacactggaggaagccaagcaagctattttgaaaaacagcttagctgaatccttcttgctgaccattattgaaaagattgaggcaggattgatttgaagtgatataagcgtggcgatgcgaaaatgatgaaaaagatgtctttacagatatattgaattgctaaaccgcaagatggctgctctttccaaggaaccctcttgcggtcacagcatgtttatactttttgtcattgctggaatttcagcgactcccctcacatccctacatttctactaaacgtccattttctttccaggattgcagtattttttcaagtacccactggtttttgtagccgtcctcgaataagggagcacgatccacagactttccccttgccagctcaacaaaatcttcataggccgtatgattatagattgcagggacagcccaactctcgtattcggcacccgggtgttccaggtcacgcagcacaatgcggatactttccgggttattgaggctggcgtgcagcgtaccaagttctccatagatatcgatttcgatatcgtgccgtatgcctatggcatttttatgagtgataaaggttcccacggtattgtcgcctacgatgccatgaaaggcagcgagatcttccacatccacttttacaggcagacccgtgatcggatcgaaccgctcgggtgtaatggtatgtagcagtgctgcgacacttttaaattcacccaccaaaaaacgggccagatcaatgatatgtgaggctgtatctcccactactccagaaccagccttggctaaattgtgacgccatgtatacggatgctgacgatacggcgcaaatgcatccattagataacgaaattgaatgttatagattttgcccagcttttgctcatccagcagttgcttggtatattggaaggccgcgccatagcgatgcttatagtgaaccagcaaaggtaccggattcgctgtatatagctttttcaactgatccgcttcttcccatgtgagagtcaatggtttttctgccagtacagctttgtgttcttccagcgcaatacgaataatgtcaaaatgcacatcattgggtgtcagcgacagaatcgcatctacctctgggtcacggattaatgcttcataatgggagtaccgcttggaagcaggcagttgcaattgttctccgatggcttgaaggcgattgggattcacatcactaacggccacaatagatacccccgagatgctgtgcagtgatcttatgtgatattcagcgataagacccaggccaatgatacccatccgaatttgtttggttggggaggtggaggtactcatatgttcagaattcccttctcttctatttggtttgaactctgtagcaaattccttttgctatgcagtatcacccgttgctttatagaatagtcccacaggaagtgatcgttgcaaccttcaattcaacagtctgatgccgggcagtgaatgcaatgttccacaaaaaaaggatctgcagctccgttatccggtattgcagatccttgatattccttctctatatcgactacatcaaaaatgtacctacgacaaaagacactccgacgatgatcgagcgcagcagctgtgccagagccacattgcctttggcaatttcctcgcacaccttggtacgcggcgtcaccagatcaaaaatcacatagaccaaacacaatactacaatgcctacggccgaccatgtcagcatttcgagccatgaatgactgctgtacgacaccatccccacgataatacacagacctagcagctttgcacccatatagatgcctgccgcctcattgccgcgtgcgatttcttgattatcgttataacgtgtcagcaaactgaacacaaaataacctacgattaagatagcaaataggataagcaggccgacacctacattgcccaatgcgttccccaaactgatataagagtccaattttcttcctccttatgatacttcaggattttgccaaatcctcacttgtgaaaatgaacagatatgttcgaatattgtacattttttaattcagcttatataatttgcggattaggaggtgcggtggcaacggcggcggcgcaatagtaggccatatcacctgttaccttttcaccgattcgcggcaggacacccgcaaaacgccctccaatcacgaatatgcctgtcagcacatagccgtggaatagtccttcgtcggtctgtacctctgcactctgcatcggccacagccgctgataaatcttaggctgtccctcgtaataagcggcaatatgtgcggcttcctcctgctcaggcgttcgtggagcgtcagcttggtgaagcagatcagggttgtcaatctccgcaggttcaacctctcccaaggcgcctttcagcatctcctcggattgaggatgttcaatcaagtgcgtccctttaccctcccgtccccatatacctttggccacataaggctctttattttgcataaacaccgagggctcaaaatacgtaggcagcaggtaggttcgtatcacctccagctcgcgatcgtcaaacaaacgaaagccacagaactctggtgtttgctcattgcgctcatacagtgaccacacggttgcggtgaaccctttgctctgggtaatgatatgctgtggcgggttgattaatcctattttcccgtctgccaccatatccattagtgcctgccccacctcaagccccgtattctcttcccggtcatcaattagatattccagcggatacaggcgatagagaatgtggatctgctctccccggtgatacaatccttcattcgggataatctccagttcttccaagggagcataaacgacttcgaatccggcttgttcacataaatgcataatatatttggtgttggtctgatcctcgatgtgccagtcatagcaagcaaaatacacctttgtccctaatcccttgcggctataaaaatgaatgagctccgtcaaggcagactgaatcgcctcgtccattccagttgagggtccatgtagtgcattgtcatcctccgacattcctcccttactcagcacctccagcagctttccttcgagataagccacctcgggaatcccggttggggtatcggtgttattctcaatgcacttgatacccgcttcccccacaatccagtcctggcgggttatcccatccggctcggcctccatacgtgcagcacgcagcaagcccggatgaatccccaaccgttccaccaggtattcatccggcatatagcgctgaacgaattgctgaaccttgcgataaatacgatgtaccgcctcagaagcagcctgaagctctgccagctcgctttcccgatataccgttaaggccggcacgcaataggatttgccatacatgcggtgatacgggatgatacggctgatttcacccttaaaaagctcatcatgttcataaggcaattgccgaatcgtacgcatgctcatcttaacccccagagaagaagccgctgcgtgagccgctgctgccaaaaccgctgtgtgagctggaagatgaggatgagcttttgcggtatgagctggaagatgaacgactgctatggtatgaggagcctccactataataagtcgatccgccatagtaatacccgctgctgcctgaatcccgacacgctgtttgttccgatacaggaagctcatcgcagtcataatactcgtcgtcaccgcaccccgtcagagcagctgggacagccaacatcagggcaaaggctgccatccgtgtacgagagccgggcttggatttcatcttttcccaagaatgctccatcacagatcgacctccttcacaaatagatgtacctttttcagctgagggtccagtaccgaatatataaattcatatgttttgccacccagtactgtatagtgatctaatagccgttgggccaactccaaagtaaataccgaaccttcccgctgatccatactacggaatgcaggttcatgccatatccagtacattgcactgtatgtggaagtgtaacctccctcactggcaagcacgaggtctgtgatggacgcaccgtatggctttgcacgttcccctgtaaattcagtcacatagacggaatgatccgtatgttcctcactttcattcgatatatgcgaccatagtttgtcatggagacgcgtagcgtctacaagcttgcgtagaaacagctcatctcccgatacggattcccgtgtcaggctgcgcagttccttttgagtgtcttccgaccattcgcgatacgttaatgaataataaatgatgattcccttcccttcctatacgcttctgtcatgaggtttgcaacaaatcaaagcgcttatgtcgtcgttcactatacgagattctaccttgaaaaggtccaatttggaagaaaaacacgacaaaaagccgcaatccctaggattacggcttggttttcactgctacagcttgatattgttctcgtcgaaatattcctctagcgtcattccctgcttggctacatcctccgcaatgtctattcccacataacggatatgccaaggctcgtacacatagccggttacatcttccttacccttcatataacgaataataaatccgtactccggtgcatgtttttccagccattcgccttccttggaagctccgaaggactgctccagcacattacccacgcttggactggatacatcaatggacaaacctgtctgatgctcactcgtacccggtacagcgctaactttagaggcatattcctgcccttttgtctttacattgttgttgaaaatagatacctgacgcttataggaacggtatcccgataccgcacgcagctcaatgccgtctttttccgcaccgtcgaacagcttctccagtgcctctgccgcttccttacgcaaatgccgcttttcatgcggtccctcgaaggaaaaaggcacctgcggctccaccaggtcatcggggacatagcctacaggcaagctgcgctttttgttcacaacgactgtatcagaagtcgcattggtgacaatcgcagttccatcctcttccttaaccgtggcttgcagcgcactctggcttcgcaacgccatcacagggtcggcctgtccactttctgtacccgtagaggcttgtccagcgctagtgctgccattgcccgcatccggctgggcggaaggctgtacattctcctgtaccgctgtagatgacttcaacggctcgctttcctgtccacctgatcctccctgctggcaggctgccagtaataaccctggcaggatcagccctggaatgagcgctttggtccatctcttagatgcttgcgtctgttgtatatgtcgtttcatgctggtatctcctccaatattgcatttgatgcatgacttgctgtgactttttcgtttccccattgtaactgaacttttggcactcttcgaagccattatcccgttcgatgaaggcgaatagactcgaaaaaggaagtatatacccgaattgttacggagtatgacgtttttgcgggattgcagctcgggcccgctcagctacccgctcacgtatgagtttcaatgcctctcccgcacgtggtaaacccggcagcaaatctgtaatatccgcttccttcttaggagcaagcttctgcggcagacgaatctcaattgcatgaaagcctgcaccgggacgatgcaatgctccttctgcggcagactccgcaatccattcgctaatcgctgccgatccgctgcgtccgccctctgaccgcgaggtagactcaagcgcgggggatgtcccctgcacatgggataactccccggcccaagcactgaatacgtactccagcagctcttcccgtgtcattccgaccagttctagacaggtctgcggctcgctttccagaccggtttgaagggctttcttcaccttgtcgactacacccacgccatcctccgtgctagaagtggctgtctcagctgctagctgaacgatctcatccagcgatagacaggtttccccttgcaaaaaacggtagatgtccaaaggatctgcttttagctgctccagccatgcttttcgctgttcggggttcagtacaggcgctgggccagtccattggacagcatgtgtggaaggtacaccctttgattcgccttccaacccatttccgtctaattccgctatccattgaccgtcagttacttttagcttcactcgcggcctcgtcatcgccttcatcctttctctgctcactcaatccatacatcattttgcaacgcaatcagaccgcgtaattcatcatcagacatttcggtgagccaatgttcaccagagccgacaacctgctcggaaagtgcctttttgctctcgatcagctcgtcaatccgctcctccagtgtaccttggcaaatcagcttgtgcacttgtacattgcggctttgaccaatacggaatacacggtccgtcgcctgattttccactgctggattccaccagcggtcatagtgaataacatggctggcacgtgttaggttcagacccacgccgcctgcacgcagggaaagtacgaatatattagggccttctccctgctggaagttgtgaacaatttcatctcgtctggttttcgccagtcctccatgcagaaaatacggctcttccccgaagattttggccaaacgagagaccaacaattcccccatcgacacatattgggtgaatatcagcgccgattcgccgttctcgcgaatcgtctctaccaattccagcagtcgctccattttgcccgagttttccgttttaccactatcagcccgacccggaatgatcagacccggatggtcacaaatctgcttcaacttggtcagtgaagacagaacaagccctttgcgagccataccgatctgcccatccagtgttcccaataattgatccaccacgccccgatacaatccggcctgctctggtgtcagtacacagtaggacttcaactccagcttctctggcaaatccttgcgtatatctgggtcgcttttgagccgacgcagcatgaacggggagacgagccgatgaagctcgcgcaacgcggacccccgctcttctcccgccaaactgtaacgctggcggaacgaagacgccgtaccgaggtaacctggattcaggaattgaaaaatagaccatagctcgctcagccgattttccaccggagtacctgtcatggcaatccggtgtggagcagacagcttcatgacgctttgtgcttgctttgttcgtgcattttttatatattgcgcctcatccaacacgatagaggaccagtataccgcagataaatcgctgccgtcccggcccgccaaatgataggtagtgaggacgatatcatactcacgtacactttcctgaaacagctcgccatggagtcgctggttgccatggtgaatatacagcgacaaatccggtgaaaaacgttttagctcgcgctgccagttgccgagcaaggacgtcggacagatgatcaacgccggacgttgatcatctgcaccaatgccaccatcgagcaggcaggtgatgacctgaatcgttttaccaagccccatgtcgtccgcaaggcagacgccaaagcccaatccacgcatcgcagccagccattgaaagccgcgctcttgatagggccgtaatgcgccgtgcagtgtctccggcacaggccgcggctctaccgaacggagtacgccgccctcagccaaagacgcaagcaatccggcggattccgcgccaaagatggacaagcctttccatgaggcctcgcctgcactttcattttctgcagccagatgcatccattcggacaagctcatctcaccgttttccccgcgcttgataaagcgcaacacctgacggatttccttggggtcgacctcgatccattcccctccgagacgtacatacggcaaattggccgcgacgatgctttccagttcctccatcgtcaaagtcgtatcacccagcacagcctcggcatcaaacgaaatcatgcggttaatgccgacagacgatgtatcggcaatcacaccatctggcttggcaccctgctctgtcgaacgcattttgagccgcaagcctgcacgtcttcggccctcccggctccagcgtgaaggcatttgcacggtgataccgttcttttgtaatgcaggaacggcttccgtcaggaagcggaagaacaactctggctccagtgtcagcccctcgggataaggacgattcaacgcttcttgcaatataggtgccgcttcagccgcctgtccgagcctcattagcagttgagcctgcacttgacgatatacaattccgcctcgaaccagatcacgttcaggatgtgcccacagtgccagagcaggcagtcgcaaccccggctcagcatcgctttctgcccaaaaggtaatgcgccaatctttgacactctcttccagggaaggctccaaacgaaggcacaaccgcagttgcccttctatcggctccttgtcttcccgttccgtgacaggcattgcgcttccctcaacagaggacgcttgaagcaccagctcctccatctccgctggcgttccctgaatcgccaccgggcgggaacctgtcagcagactgttccaccacagctccgccagcggtgatcctccgcgccgatactctgcgcgatatcgacccagctcacggtctgatgctgccagcaccgcggtcgtttccgcatggatgaccgcacacaagaaggagtacagcacgattccggctgcatcctcgcgtgtttcaggctccttacccgcaaaaacggccggagctgccatacaaacagctggcatcgcagcagccagctcatgaaagcggcgtatgtcctcctcttgacacagtcgaggaatccacaccccgacagccgcttccggaccacgacgacgcggtcccgatggacgcgcctctgtaagcgatggcgcaatttcgccccgttgcatcagctctagcgcaaaataagcggctttttgccaatattgcatttcctcgcccagcgtaatgcccgatgccgcacagcccttctcgtccatgcgggtcagcagtgccatcgtctcgcgcggttccagcgccaaaccctccaatgtacgccccaacatggaacgtcttttgccacctctgcccgcggtttccacacgagcagtgttcggtatccgtacctcagcaagacgcaacgcagcctgccgaaacggccgaaggtctccctttagcgtcagcctgcggattacactgctccacgcatcgatacgtggttccgacgtctcaccagaaaagcaaaaaaacacatctccgagccatattccataaagcggttgattcatatctgtctcccgtccagccttttgaattattactcttcatcatatacgaaaacgggctcttttcaaaactttatcacaaaaataaatggaaagtcataagttaataaccttaaatattcatgtgattaactataaaaggggggagtccgaaaagccatggaaatggctatggatactctctcctattcgtcatcctccttcagataaggatgcaggctgtcttgcagcaattccttgaccctcatccgcagctctttcggatatataacctcggcctctggcccgtattttagcaaaagtcgggacacatatctaaactcttcgatcggaatatatccctgccattcctgatcctgcccttcttgatgggaaacattttggaagagagcatctgatccagccagcctggcacccaatgcggtaaattttattttggacggaattcctatacgggattcctccgaagccaaccattcctgaagtgtgggaaggctgtccaaggtttcgtccagcatcgttattgtaatcacccgatctgaacggtacagaatgatgcggtctctgctatgcgctggcatgtaccaatatccgtgatcaaaatacagtccaatcggatatacttcagtccacttttcaccggaagcggagcggtaaaacatgttcacccggcgcttattcagcgcagcctccaaaatgattgaggtgtagggtgactctgcgtgagtgggtagcatacgaaaagaaatgtactcctttaattgatcaatactgtcctgcacatcctgtggaagctcggcataatagtgctcggataaatgtccacgaaccgagccaaaagggatatctggaatgttctccaacagttgcagcatgaggaaaagacccagagcctcgtcgcgagcaagatgaaggggaggaagaagccgattggggagtgcttgatacccgccatgaggacccatttcggtataaaggggtaacccggtctgctgcaaatagtcgagatctctttgtatcgtcctgacggagacaccaaaacgttcagccagctcacgcgccgtatatttttttcgggaatccagtatcctcataagagcaattctgcgttcgttcataaggtacccctcgaatccaaaattaattttaaatgaccgttttaactacgacatactatgtcataaatacattgtaacattaggaaatagaaaggagtgaatgaactatggaagatttgaaatcaaacgcagttgtgctgtatattgccataagtctcgacgggtatatagctttgccggacggttcggtggactggctgtatgatgttaaaggagatggcggggacaatggatatgccgacttttactacactgtaggtacagtgctgatgggcaggctgacgtatgaggaagtgttgaagctctcagatgatttcccttatgctggcaagccatgctatgtgctcacacgagcattaacggaacaacagcaagcgccacatgttacatttacggacgaagctctgactgaactggttccacgtctacaaggaaaatcgaaaggtgcggtatggctagtcggtggaggccagttagttcaggccttcttacaagctggactgctggagaaggctatcattgcgatcattcccaaggtgcttggacaaggaataccgttatttccagaaggaacgctaccaagcacatttaagctcaaagaaatagaacgccgtggggatatcgctctgctccattaccatttataattttgtttacagaaaagccttcatatttcaggatcatgcaatatccctgaaatatgaaggctttatcgcgtgcttttgttcattatttggtcttcaaattatcccatgttctctggaaatcctcgaatagcttcccggcatccgatttacctgccacataagcttgcatctgacttccgaattcttgctgtgctccttcaggatagcggctaaagaaccagcccaacagtttgttttccttactgtatttcaccacttccgcacccagttggcccatatcagcctctgccccttcgatgctcttgaacgctggaataaacttgaattccttggtgatatactttttaccctgctcggatgtcaccatccagtttaagaactccttcgcctcgggtttgacagtcgaatttttattaactacccagttgttagcgacacctacaaacagcttatctccggctgttgcgtcttcaccaatcggcataggcaaaatacccagattcagcttcggattaataccgtcaatttggacctgagtccagttcccttgctgcatcatggcagcctttccagtggcgaagttcgttacctgcgtgttgtaatcggtcgtgagcggcttcgaattgccatacttcatggtcagatcgaacagcttaatccactcggcgaatacagcgttgcccggaatctttgctgttccatcatttagtcctttgacgaaggccgaaggatccggctgattggcaaatgccacgttcagcaaatgattgcccagcacccaaaattcctgatatccattagaaaatggagtaatcccagcggcttggagcttttgcgcagctccctccagttcggacaatgttttaggggtctccgtaatccccgccttcttgaacaaatccttgttataaataaagccgtacccctccagattcatcggctggccatacagcttgccgtctttggtcatcggttctttggcgacatcgaccacatcgccaacccaaggctggtcagacaggtcctccaaatattccagccacgtatccagctcgcggtaacctcctacgttaaaaatatccggctgctccccggaggcgaacttcgcctttaacgccgctccatagtcactgcccccgcccacggtctgaatatcgagcttgatccctggatgagacgcttcgtattccgctttcatgcgatttagtgcttctgcaatctctaccttaaactgaaaaatgtgaattgttttttccttcacttcctctttgcctgcgttttgtccgccactgctgttacaacctgccaaaaccagggcaaaggccgcgagaagcaagatcagtgcttgagctttctttttaaaagtatgcgttttcatttttatgttcctttctattctaaattcatatcagatgaactcgaagtattcatgtggaaacggagcaaacggaatggtgctgaacaagcgatagcgctcgcctttgtctctagattcccacctttattcgtttattcaggggaatctggaggcaacagcgatggtaagcaccatccgtttgcggagtggcacaccgtgtacattttcagctcatcgccacactcaacctttgaccgaaccagccataataccttgtataatatatttttgcatggccagaaagaatacgatgactggcaagatgcccagcaccagagcaggcaaagccaaatcccactgcttcgtgtattgtccaaaaaaggcataggtcgcaatcggaatcgtgcgcagttcagccttttgcaataccagagaaggcaggagataatcattccaaatccagagcgtatttaaaataataacagttaccatcatcggtagcatcaacggatacacaattcggaaaaacactccgtaaggcgtacagccgtccaccgtagctgcctcttccacctcgactggcacacctttgacgaatccatgaaagagaaagatcgacataggggctccgaatcccagataacagattaccagaccacttatactgttcattaaatccagtgtacttacaaccttgaccaaaggaatcatcaccgattgaaagggaataaccatggcagctacgaacaggctgaacaacactcgattataacgcgtcggacgccggaccattcggtaagcagccattgagctgatcagtacgagcagtagattactaactaccgtaactacaagtgaattccataaagcttcgggaaaacgcgtgatgctccacgctctagcgtagttgctccatacaaaggtttgtggccaggccgcagaatcggtgagcaggtcaccaaagcttttgaccgaattcacgaataaaaagtaaaacgggacgaggaataacaatgcgacgaggatcatcaccatctcggtcgcccatgttccaaagcggtagcgcttgcttgtttccatttacgcttccacctcccgacttttcgtcagtcgtacctgaaggctcgtaaccagagcaacaatgataaagaaaatgagcgctttagctgttcccagcccataacgattattcacaaacgcttcattgtaaatattgagtgcaaccgactctgtggacccgaaaggaccgcctttggtcagtgacaaattgagatcgaacattttgaatgaccatgatatcgccaggaaaagacataccgtaacggcaggcatgatcagaggaagtataatcgaccgcaaaatttgcatccggcttgctccgtcaatttcggctgcttccagcatatcgcggggcacattggtcagggaagagatataaataaccatcaaatacccggcagtttgccagataaacacgattacaatgccccagaaggccgtgatctcatctcccaaccaggacaggttgaagaaggacaagttcgtgctctctccgattgctgcaaatcccttgacgaaaataaactgccagataaagcccagcaacagacctccaatcacattaggcataaaaaagatggtcctgagtacattttttgttttcagcggtttggttaaaaaatacgccagcagaaagccaaaaatattcgcagccaccactcctaccaccgtaaaacggaccgtaaaccagaacgctgtcccaaatttgtcatcattccataaaatgtgactgaaattatccagcccgacccactttgcctcattggctaccccattccactctgtaaaagaatagtacattccgagcataaaagggattacaataatgataacgaaaaataacgtcgacggccctacaaaaatgcattgctggagccattgcgacgacttggcgcgattcaatccgatcccccccttttgttgtctgttggtgtctggaacgctcccttacggctttctttcagcagcatgatgcttgggccgtacggatatgcgattcacatgttcattatgtcgaattagcgctctggagaacacgtaggatcgtgaaccattaggggggaaaatattgacctctggctcgccttgaattgtgaaaggagctcactgcatgaaatttcacagtattcgttcccgcctgatctggtttttgctcattgcggtcactctgccgctgctgctgtcgatgactatgaccttcgttctcaccaagcaatccttgcgggagcaggccacacaagaaaatgaacggcttatttttcagggaattacgaatctggataactatttacagggactgaatcgggcgtccatcggagtctataatgacccccattttctgcgtaatctggccaaaattccggatgattaccgggccgtcgctgaaatttacaccacactgcaaacgatgatgaatgcttcgtcaggcattgaccaagtgtatttgcattcttttgaggctgggcaatccacgttgattaccagtacagtcccgctacgggaattccgactggagccctttactggttctattcattacggcccttctggactattcatacagccttcgcacatgaagcatttgtacggcttttcggcggtttcctatacggagcacagcacaaagcggcaggtatttacacttcatcgggcgattcggaacattcctgcctcagagacgcttggggtactagctatagatgttgatctggagccgctgcgcagtatttgccgtcaattgtatgatgcagatacagaggagctgtttttgatcgatcggaacggaacaatcatatatagcggaaaagaagcagcgattggaacacactggaaggaatctgacctgctcaatcgaatttctaaagaaggcgagcacggagtgattgaggatgatacggcactgcacgtatacggcaagctggatgccaacctatcaggctggacactcgtcaagaaaattccacatcgtacgctgtatctacgggctacccgcctgactcagattaatgcggtcattacaggcgcagcgttgctacttgtcattgtggccacgttatggatttcgataaaaatcacggaacctattaagcgactgactcgctacataaaccagattcagtccggtcaactggatgtagacattcgggccatgagtaacgatgagatcggagtactgtcgcgccgtttcagacagatgatggataccatcaataacctcattttgcgggaatacaagctagagctggctaataagacacatcagttgaaagcgcttcaggcacagattaatcctcattttttatataatacgctacaatcgattggaaccctggctctacagcatgaggtgccgcggatttattctctgctctcttcccttgccaaaatgctgcgctataacatgcgggaccatacggtcgttacactcaaggaagaagccgaacatgtaaaacaatatcttgatttacaaaaggaacgcttcggtgagcaattagaggtcacttaccagtgggaagatgaggtcctgaatgatcgggtgcctaaaatgattctccaaccgttggtagaaaactactttaaacacggagccgatccccggctggggcccggtgaagttcgcattacaggcagccgaatccgggaaggcattgtgaaaataaccgtggaaaacaacggaacttccattccacaggccgaattggagcagctccagcatatgttaaaacgtccgctgaaagcctacgaagagccggacactagcgagcaggattccattggccttcgtaatgttctattgcgtattcagcttcactcggaggatggttccaacaccctgtgcgtagacaacatcctgcctcatggtgtccgttatacactcgaaattcgcactgaagcccctgcagaaattcatattaagggagagtgatctgtcaatgaaagtcctgattgtggatgatgagaagcatgtacgccatgccattcggatgctcgtacattgggaagcgtgcggtgtgagcgaggtacttgaagctgagtcgggcgatcaggcgattgaggtcattaccgccctttccccacccgttgtacttacggatatgcggatgcccggcaaggatggagtagcactgatggagtggattcaagtgaattccccagcaacccgagtcgtggtggtcagtggttatgatgattttgatttggttcgacaggtcatccgccggggaggcatggactatattcttaagcccgtagatccagtggagattaacgaggctctaaataaagccactcaagcctggcggacagcggagcaagaccggaacaggcagacgatgcaggccatggaggtcaaccggatgaggccgcactatgccgataagctcctgactgagatcgtttccggtatagcgagtacccctctttccattacgcccttacgtgaggagttacgtcttccagcagctattcagatatgtaatgcagctgtgatgagtagcacgcagctggatgccgatatactggacaaatataaaacgcgtcgtgcgcttttgagcttttccctgattaacatttgcaacgaatttcttggaacttctcaaaccggaattgcattccgtcatctggagcgtatggacgaaattattctgctatattggggcgagccagctcgttggccgctgctcttgcaggatattcacacagggatcaaaacggctttgcgatgttacatgcacatcggggttggctcttttggctcttttggcgcttttcccatagcggcagccactgcctaccaagaggcacggcaagcgttgtggaaacgggatgtgttgcaaaccgtcgactggatgcaccagagttcccagacacggcaaagcattcgtcttccccagttgcctgagatggaagaggaactgcggcttagtgcactcagctgtaatgccaatcgtgtgtcgatagcggtaggccactggatagcagccgtagccgagctgccttcggtgacagcagagcagctagccagttggaatcaggagttggactggatgctggcccgctggctgaatgacagacccggagataccgatggcgaggaactggcagatgagtccggctccattcatgcattgccggtcgacaaccgtggcatgctttccctgcccttatggcaaagacaggttgaaaaccgactgctggcagccggtcaggcacttacaccaagccatagcccaaacaacccgaccatccgagatattgcccgctatctggatgcacactatgacgaggacatttctctacaggatatggcgagtcgcttttatctcagtcgcgaatatatttctcgtaaattcaagcaggagtacggggttaatctgtcagactatttgtgtcagatcaggatgagcaaggcaaaactattgctgctgaatgacaagctgcgccttcatcatattgccggtatggtcgggtatcaggatgaaaaatattttggcaaggtgttcaaaaaactagagggggtcacgcccggcgaattcagaaaacgccattctgcaaatcctcagccgtgaccgcatacaacacgtgatcttcccacacaccattaatcttcaaatagttgagagccagcccttcgcggcgaaatcctgccttttccatcactcgattggaaggcgtatttcttggcatcactccagcttgaatacggtgtaagtccaactcatttaaggcgtagcgtataatatccttcactgcggaagtggcatagccttgtccgtggtatgcaggatctacaaagtagcccagattggcgttttgaaaggggcctctagcgatacccgacagctccattctgccgatcagcttatcattttccggcaaaaaaagtccaaacgtatatccctgtccggcttgtgccgcttccaaaccattagaaatcagacgagcctgttcttccagcgtaaagtaaatttcaggtcgttctggctcgaacggtttgaaaaaattaaaattttcacgtctgatctctaataaacgttttgcatcacttacttgtaacaatcgaatctgtagccccggatgggtggactttatcaaaatggcgccattagctttatgtaacattgtcattttccttctttctcagttattcctatattattgtgttcacggtcacgagacaggaaaataccccaggtgcatgagagcagcctagggtatctccatcattcaaaatttagtccgtaacaggcatccagcctggaagggtcgtcaacgcaccccacaagtagtcaggaatgactagctcctgctgggcttgcttggataatgtcgtgcgaatggtatcttctgtgccgttttgcaccttctgaacccattgcggctccatcaaaagcggacgtcccagcgatacaagcggtacacctgtctccagtgctgcaagcgcctcgtccggtgtattcagcgatccaactcccataatcggcacacggttacctaccttctcatggatgagaacggtacgtgaccgttcgtcactgcggtcgcggaacgaaccaccgaagaaatgatttacggaaatgtgcaggtaatccagcccttgatccgccagacggtctacaagcaccatcgtatcctccagcgtaatgcctggtgtgtgtccttcctcaggagacaagcggtatccaaagatgaatggccgctttgcatgttctgcaatcactttcttcacttcgtgaacaaccgccagcggaaaggtcaatcgtttttcaagacttccaccccattcatcggtacgaagattggagtgcggggagaagaactgctggaccaggtaaccgttcgctccgtgaagctccacaccatcatagcctgcttcaatcgcgcggcgagttgcttcgccataggcacggatgacgcggtggatatcatcagaggtcatttcacgcggcacaggcgcaccttctttttcctcggctactgcgcttgcactgatcggctgtccatctggaatttgatctggtggacacaggcggccaccatgataaatttgcaggattgcttttgcgccctcctgatgaatcgtatccgccagacgacgcaggctcggaatcaattcatccttgtccgcaccgaactcattgacaaagcctttgccatctggagttacatacacacaagcagtaataaccgcgcctacaccaccggaacgttcacggtagtatgccagctcctggtcactgacttcaccattttcgtgggaagcaaagttagtcataggtgccatggtaatacggttcttcaacgtaacaccggatggcaggggaaaattttcaaatagagacttatattttgggttcattcgttctctctccttcagtttaaatcagatcagataatataaggctgttgagcataaagccgaatacgaattcgatgcagttttccttccataacgaacttaaactactgttgcttacttaaatacagtggttgtaataaccacagtataaagatccgcaactataaagtcaaatctatcctttctgaccttctctaaactgtttgaaaaagctgaaccgcagctacttgtcacaagccactgacaaagcttaatggttctcggctgtgctgttcttctcctcccggcgggaaaaccaggtcgcgagcaacgagccggaaatattatgccacacgctaaaaatcgcactcggcacagcagcaatcgggttaaagtgagctgctgcaagcgcagcgcccagtcccgaattctgcattcccgtttccagcgtaacagctttacgcttggaaagattcataccgaatagcttggcaaaccaatatccaagcaggaacccgataccattatgcaaaataaccacaccaaaaataatcggacctgtctccagaatctttcctttgctgcctgcaaccacaatagccacgatgagtacaatcgccagtgttgatatgagcggcagcgcctgaacactggcttctgcctgtttgcgaaatagcgatttaacgataacacccagcactatggggacaataactacgatgagaatatccatgatcagcgacttcgcatcaatattcatccatcgtccagcaagcaggttaatcatcgccggagtagccagtggagcaatcagcgtcgacaccgaagcaatcgacacgcccaatgccacgtcgcctttggataagagcgtcattacgttggaggcagttccactcggacaacagcctaccaaaatgacacctaccgcaatatccggtggcagctgcaatactaatgccaatccaaaggccagaaacggcataatcagataatgcccgaccacaccaatagccacatccactgggcgccggaatacttcacgaaagtcagccgcagataaagttaatcccatcccaaacatgacaatgcccagaaataactgtatgtatcctttcaaccctgtaaacgccgcaggaaagaaaaatcccaagcatgcaaataaaagtacccagatggaaaaggttcctcctacaaatttccctactttctccaagccattcattctacttatctccttacttctatataagttgaatctgaggaatttcagcttatatagtgcttaaaattttcaccattgtactacatatgactgcatatacatacaactttttatgattataccgggatcaagaaactttttcccgttaggacatattcgaaagcaaagtgggtatattcataatagaagttgtgaccagtcggtcattttggatcatcattcgttgaggaggagatatccctatgtcacgaagtcatccgtataaatggtggaatattattgcatttatcgctgtcgttctcgttaacattctggcttctacacttcctatcggcggcagaagcactgctgctgtatccaacatgtaccctaccttgatcacaccagcgggttacgctttttccatctggtcggtcatctacgtactgctcgcctgctttgtcgtgtaccaagctacacttacagggcaatccaagacaagcgttcagtccatcggtattttttttattctaagctgtctcttcaatatcatctggattttcctctggcagtatgtatacgtagagctgtgcgtcatcgtcattattctatacttgctttccctgagcgtcgtgtatgtacgtacccgcacgccgcagccaacccttggagaaatgtggttcgtcaagctaccgttcagcctcaacctcggttgggtatccgttgctactattatcaacattgcagtggcactggaaaagaatgaatggagtggctggggactcagcgatacgacatgggcgatcattttcctgctcatcggcaccgcattggcgatcatggtcagcttcccttatcgcgacagcatttatcctctcgtatttgtatgggcctatgtcgccatcgccgtcgagcatccgaacaatgaaaatgtacggctagccgcattgatcttggcggcaatcattttggtatacgcgctatggctattctttgcccgtaatcgagaccgggattaaagaaaacgaatatgatctctagcaagaacaagcgagtttgggtctgaatcatctagcccaagctcgcttgctttgtttattcattttaaccatgtgattaggtatggactttaaacaaatctataagcttgcttgtcgagtgatctgcattgattttcttcatattgataatataatccgaccttttttcatacaaacgaagtattatgtcgacaaattgttcagattccaactcttcttcttctaaaaattcacaaaagccttgcgctttaaatgattttgcatttagaatttgatctccccggctaaccacctttgaaagagggatcaatagcatcggcttccgcagcgtcaagaattcaaaaatggaatttgaacccgccctagaaacaaccatatctgccatcgtcataacatccgccagttcatcgtttatgtattcaaattgcttgtagccatgcatatgaatggaatgattcacttgatctttaccacaaatatgcacgatttgaaaatgaacgagcaaagcctctaaattcatccagaccatctcattgatcttcttggagcctaaactcccacccatgatcagaatgatcggcttattccgagtaaaaccgcaataggtcaaacctttggctgccttcccattttttagttcatctctcacaatagcacctacataccgagtatgcttagagcgaaagtactgagtggtttcaggaaaggtagtacaaatttctgtagcaaatgtgctggaaatcttattagctaagccaggggtaatatctgattcatgaatgattacagggactttattcaaccatccagccaataccacaggaaccgaaacaaatccgccttttgaaaaaataacatccggtttttcttttcttataatccggtacgcttgagaaatccccttcagtactttaaaagggtccttaaaattatcccaatcaaaatatctacgcaattttccagttgagatactgaaataacacacatcttctagtccggaaatcaattttctttcaatcccttgttcagagcctatgtattggacactccaatgttgttccagtaagtgaggaatcaaagctaggtttactgctacatgtcctgaagagcctccaccagtcaaaattatttttttattaatcatctccacctccgctctgtattttaaaagaacaaaacacattaaatttgagcaaacgggtgtctctatttaatagggacacccgtttgtcatgcaaactttttattttatgaacggatctttcagattattcgcccttcaatgcaatgacttcaatctctaccagtgcatccttaggcagacgagctacctccaccgcactgcgtgctgggtagggttgttcaaagaaagaactgtacacctcattgacgctgacaaaatcgttcatgtccttcaggaatacagtcgctttcacaacctggttcatgttgctgcctgcctcttccagaatggcttgtacattgctcaaggacaggcgtgcctgctcctgtacatccttaccaaactcacctgttgccggattcagtccaagctgtcccgaagtgtaaataaacccgcctgcctctaccgcttggctataagggccgatagcaccgggtgctttttcagtagcaattgtttttttcatatgggatggattctccttcctgatactggttcaccgtattatagcatgtgcagtccaaagccactattccgtgcgacgggttaacgcacttgatgaattagagattacggtggatgtgccgcaacatacaaaccgccattaaaacacaaataacgccgctgttgtccgaatcatcgggcagcagcggcgttattttcatttttaaccctagccgtggttttacacgttctcatcaggagccgttcctgtaccgggttcctcatcatcggatgttagttctgcaccaatgactcgaatgatgtcgttcggataaatatgtacgccgctcgcctgtgcgagagcaattcgtaccatggctcgtgcgatgaccggggccgggatggcgcggtaggaagcgagcttgcccgtcatcaggccgtccagtgccttcatgacaacagcggcagcggcttcgcccaaacgtcgttcaggtctcgcgcccaaaatcagcgacggacggaacaaatgcagcgcaggcaatgcgacagcagcaagcgcctcttcagcctcacctttggtgcgattataaaacacgcgtgagtctggatcggcgcccatcgcagagaccgcaagcatctgtaccgctccagcttctttgcccaactgggctgtcagcaccgggtagtctagatccacctgacggaactgctccttggagcccgcctttttcattgttgtcccaaggcagcaaaaaacatcatccaccccttcgaaggcgaacgccgctttctgcggctgttcccaatcgatgagcgcctgctccagcttgggatgcttgatgtccaatggacgtctgcccataaccatgacgcggttgtattccttttgcaccagcagctctcgtacaacataacccccgacaagccctgttgcacccacaacgaccgctttgcgttccatgatagacctcctttgtgccatagcgctcctgctcctacaattgcgattaggttaatttaaagggttgttcgtccgcctccttgttttcggacggacacatcggtaggtacagggaaaatgtacttcccttgccctcctcactctccagacggataaacccgcccaacaagcgggaaaaatcacggctgatggacaatcccaacccagttcctccatatttacgattaatggaaccgttcgcctgctggaatgcctcaaaaataacatgctgctgaagattggaaatgccgatgcccgtatcttttacagcaaatacaacccaatctccctcttgtccctttcgatctagatgttgtgtgcttatttccagcaatacacgtccttcatgagtgaacttaaaggcattggacaatagattacgcaaaatttgctgtacgcgtttggaatcagatcgaatttcattcggtataggctcatgctccttcaagctgaattccagatttttatccttcgctgtgacttcaaaatgcatcatcatcacctgcgcaatctcacgtacactgactggctcacttacgatttccatgtgcccagcctcgaccttggataggtccagaatgtcgttgatcaattggagcaaatcatgcccggaggcataaattagatcactgtactggtctagctcgtcctcatccagctcttttccctgctcgttgataatttgcgccagattaatgatgctgttaagaggtgtacgtaactcatgcgacatcgttgccataaaatccgatttatattgggaagccatcatcagttgcttggcacgttcctctagaatgacctttgccttctgcaactcatctcgctgctctgataacaactcattcgcctgcttaatctgatgattccgctgctgctccatctgaaagtcacgtaaaatcagagcaaataaaaaactgaggacgatgccaataggcagtgtaagaggaacaacctccgctacataatagcgccagggaatgacgcctagaaaggcaatatttaacgtatttacgatattaaccgctaaaatggttaccgatgccttgataattaaacgccaggtggaacggcgcatccagtaattcaatccagcgcacaggacgcccagaatgctcatattcaaaaagccgacccacgccgccatatgcaggccgaaggtaaatctcgtaagtccgattgcgaccccaataataataagcgtataagagcgaggatacaccaacgccgcgataatcagcggtacgaaacgcagatcaaaaataactgtttcactaaagttaaaaccaaagcaagagctgacccatccaccaaatatcactagcagcaccgagctgacatatttgaaccgcgaagaggtacgactcaaaccatatttataaatcacgttcgccacataggcaacggcaatcagcatccccaaattcattaaaaacatcattgaaaattgcatggactcacactcccatagcgcaaaaaattggatgccaggcctatgttaaccgcgtttgcctttcttgtacatcataacatgaagccccatctttcgacatgtcaaaagatcttatatccgtatataaaaaaagcgaacctcaatggctcgccctagtattgatacctatagagtcagcttgtgatgcctttgttccggcgccactctttgacaaataattcggcaaaataagggtcccattgggttccctttccctcttccaatatcataaccgccttctcttccttcataccttgccgatagggacgatcagacgtcatcgcatcataagcatccgctacagcaatgattcgcccaaataaggggatatcttccccagcgagctggtcagggtatcccttgccatcataacgctcatggtgcgagcgcacgccgggcaaataaggggccatagcataagccggctcaacttgccggagaatgctttctcccataaccgggtgcattttaatctgatcaaactcctcgtccgtcagcttgccgtccttgagcagcacagcgtcagctacgccgattttaccgatatcatgcagcaaggctgttttgcgcagcaagtcgaggtccgtctcattcaaacctcccttgcgcccaataagtacggaatattcagctacacgcaaagaatgtcctgcggtataagcatctcgcgcatccagtgctgctgccaaggtggcgaagtaactgtccaatagctgaccgttcttctcttcccgttccatcagtccctcgatcatcatgttaaatccttcgaccagctccgcaaattcgtccgaatacaaatcgctggcattactgttcaggcggccttccttcacttcattcattttttccagcagatggtggatcggttgttcgatctcacgggtcagcaacctgccgcccagataagcaaaggctacaccaaaaattaaaatcgtacccgcccaaacccaataggagctagaatccgtcgcctccaaacgttccaggcgaatctgtgtagctaaacaaaataaaaataaaggaaaagcaccaatgagcgtcgcgcttaattgaaatttatgccgaagcgatagcaggactcgtcctcgcagggacaggtttaatccatattgctggtaggttcgatcacgaatttcctccagcagaggtttgattgctctcattgtcaggaaaaattcaaccagtgcgtgcatggaagcgaccagacaagctcctatacaggcgattcctacataataaaagggaaaagtaagttgtccagtatgtatcatccataaagcaataacggttgccgggatagagaagcctaacaaatgcggtccaacaatacgtaaaacggacaaattaggcagatgatgaacccggatatacaccgtttctacatccttgagcgcttcctggttacctagaaaaaaacgatgcacgggtctcaaatgcattcgaaacactatagtttcacaagcaatcataataacgctggaaaatgcaataattttaacaagacccagaatttcatagtgggctacatttaacgtggaaaatacaaaaatcatacctaccaacaatacagcgataaacgaacctataatatagttcaggataacatgctgaataaagcgcttataggttggcaaattgctacccctcttttcatccgtacactctaaaatatcttgtgtattcaatatcggagtccaaccatcaaaagtttaccttcttgctcgagcattttacataaatacaaggacggcttttagtctgcaatttatagatggaaaatcaacccattcttaattaagaaactcgcgagggaaggacattttagccaacattttttccagtctacaatcaaaaaccaaaaatgacttgtgttttataatcattcttgatatactgttaaagtatgtattaaccccataagattccacgcaacaagctattactcctaatcacgtatggagcttctccaaattttatgtataaccctaatgtagaattttgagcttttgccgaagattttcacattcacactggcgcggtcatcggagccgcaaggacgaaagagaggtagggcttttgtcgtttggaaaatgaacagtggaatcacactgccccttatgaacatgctgaccatataatgcaaggtagcaggggttgaatatatattatgccatcaaacgatgaagtttgagcaggccgtgcagtatatgcaaactgcaccatcctccggatgatccccgggggatttttcatatacggaaagcatatttatgaacaaaaaagtggccctgccgatacatcggcagggcctatagcttgatcaaaaaggggttaatagggtcattatagtctcgctttcttaaaactaaatgatatgcaccttaaaaactcattaattttccagttttatataccttctaataattcgtccaatattctgtaccatcgggcggcatcgtttgcgtagtggaacgtcttgtttccgcttgggtgcgcctttgggtcgagggacgttcccacccttccagtaaaacaacatgctgggtacccgaattgttttcccaagtgatgtaacgctcctgttccatatgtcgcaaggcggctgtaatttcagcgtctcgcttgcctgtttttacggtcaattccgccattgtgggcatgtggcgatgctgggcgaaataattatacaaaatacgtagcagctttcgttccaaatctggcaacatcgtcttccctcctacaaagaacatatgttcccattataacatataaaaatgcaccctcctactggaagatgcattcgggcttgtatgcccatgttgaatttagtttttttccttctcctgacgaccaatagagcgcaaccaccaggcgattccaccaacacttccaagtgccagaaccgttaagaaaataatatagaacaaatgaaatgcacgatcactcatggcaatcgcctccttactttatgtatacactttccagctaagcctgtaaacctctttttagtcccacattctaattttccccaagcactcgacaatagatacttgcttgagatccatcggtacatactaactaaaagtggttaataccaaatatgagacagaccaaggaggttattgaatatgaaattcctattgatcgtgatcatcgtcgtgctaatcgttgtattgcttatgagaagacgtagataagcagagacatcctccatcgtaaaaaaatacaaaaaaaggctttcggtacatcaccgaaagcctttatccatctgaggttaaggctaaattacgccttgttcttcttgttatatttaataaaagcaattacaagcgctacagcaaacaatattccgctgaccacccatgttgtcagaaatgccatacccaaaccgacattagaccccatcgtcgggtgattcatggcagtaaacactgatccctgcatcataaatatggtacagaacaaaacaacgggcgctaaaataatcgtgcttgctgtcttccgagtaccagatactgcgatcacgcacagagcggaaatcaccaagatcacccaatatataactgcttcccaaatcactgaagtgcccacctgttcaacctcttttctatccattcgtatatgcctcttctattgtaacagacgtcacacagtgaaccaagccataatttgatcagaaaaggggtaaaccctgcggataacgtaaataatgtacagtagcgatcctacaccaaagacatgaaaggaaatgatcccatgagaagtgcaagtccttttgtcattgtaaacgatgtgcagcagtctattgattattaccaatcggtgttaggcgggaaaatcaaagtgctaaacaagcaggaaggcagactcttgcacgctgaacttcacctgggtagcagtcatatccatttttcagattcctacggtaaaccgctcaaagcgcagcatgtccaaatcattctcgactgtgaaagtgaggacgagcttaagcaagcttaccgcgcactagcagaaaaaggtaccgttaccgtggagctacaagatactttctttggtgcgctgcacggcgaagtaacggatcacctcaaccagattggatgggtgatgaactattttaagagatgattacgttcagccataaccgaatacgtcttatagccaccatcaacgttcctcacccgataaccgttttgagtcaaaattctggccgcaatatagcctcgcagaccgacttggcaggataccgcgatctccagattactagggatttctgccatccgctctctaatctcggccagaggaatatgaattgaaccagggatggctcctgcctgtagctccaccgcatcccttacatcaattataagaccaccattgcggtgaaaatcatcaacttcatgccactgtatcgtttggaccagcccatccatgatattcgaagccacgtaacccgccatattcacagggtcttttgctgaagaatagggaggtgcgtaagcaagttcaatatcagccagttcacggacgttcaaatgaccacgaatagccgtcgcaatcacatcaatccttttgtctgctccatcagctccaacagcctgcgccccatagatcatcccgttctcaggattaaagagcagcttcatagcaatgggtgatgcgccagggtaatagccggcatgcgaaccaggatgaatatgaacagcctgataaggaacgcccagccgctgtaatgttttttcattattacctgtagaagctgaagtcaatgcaaaggtcttaattacggatgttccaagcgccccatcataagaaatggcttgaccgttaatatgatccgctaccaaacgcccctgacgattggctccccaagctagtgataccatcgttgcaaacccatgattgcggtctttgacctggatggcatcccccaccgcataaatggccggatcgctggtttgcagttgggcgttgacccgaatggcgccgcgaaaaccaagttccaatccgctttgcttggccaactcattttcaggaacaacaccgatcgccagaataaccatgtccgtctgaagcacacccccggaggtcaaacgaagccgtgtaccctgctcttccaaagccgtgactccttcctctaaacgcacctccaccccgttcagcctcatatgctgttctacccatttggccatttcagggtccagcggattcaataattgttgacccatatcaataatagttactgcaagtccacgctcccgcaagttctcggccatctccagcccaataaatccggccccgatcaccgtgacatgctggggatgtctttcatctacatatgccttaataacgtccgtgtcatgaatgtttcttaatgtaaatacattcacagcttcatgtaatccgggaatgtccggtatcatcggtttggctcccggcgacaataccataatatcgtacggctgctcatctgtttcccctgtaatcatatcgcggaagcggacgagcttctgctcgcggtctatttgtatcacttctttcagtaccctcacatctatattaaaacggtttcttatcccttgaggcgtctggagaaacagcttctcccgcgcatggattgtcccgccaatatagtagggaaggccacagttcgcaaaagaaacatgctctccgcgttcaaacagaataatctcgtcttcctcattccatctacgcaatctcgcagcagcagaagctccacctgctaccccgccaataataactattttcctccccatttcttccccctcctcatataccctacggggtataatatatacctatgggggtatgatgtcaacacgcaaaaaaagacggaggtcgccccccgcctgatcaaccctgaacgaatactgatctggtcgaaaaatcacttgcgatgctacacgaatgctctgtgacacttagtctaagaagaatctactgctactactgctggctggccgcgatcgcctgctccagatcgtacaaaatatcgtctatcgcttctgtcccgacagataggcgtaacagctctggtttgactccggcagcgacctgttcttccacattcaactgctggtgtgttgtgcttgccgggtgaataattaaagacttggaatcacccacattcgccaaatgagaaaatagctttacattcgcaattagcttgcttcccgcttggcttccacctttaataccgaaggtcaggattgctccttgtcctttcggcaaatacttttgagctaattcataggacgggtggcttggcagcccggtgtagctgacccactccacatccttgtggccttcgagatattgcgctaccttcaaggcattttgactatgtctctccagccgcagatgaagtgtctccaagccctgaagcagcagccatgaattaaacggagaaatggccgctcccaagtcccgcagcaattggacccgtgccttgataatatacgcgataggtcccaccgcctcggtgtaaacaactccgtggtagctcgggtccggctcagtcagtcccgggaaacgaccactcgctttccagtcaaacttgccgctgtccacgatcaccccaccaatagacgtgccgtgcccgccaataaacttcgttgcagaatgcacaacaatgtccgctccgtattcgataggacgcaacaagtaaggacttgggaacgtgttatccacaatcagcggaataccatattcatgcgcaatcgccgctacagcttccacatccagcacattgccctgtgggttgccaatcgtttcggcaaataatgccttcgtcttatctgtaatggctttgcggaagttctctgggtcatccgaatcgacaaaatgtactttaatgcccaatttcggcagtgttgtagaaaatagattatatgtaccgccatacagactggaggccgacacaatttcatctccagctcccgcaatattcaggatggagaaggaaattgctgccattcccgaagctgtagccaacgcgccagccccgccttccagtacggcgatccgttgctcgaatacatccgtggtcggattcatcagacgcgtataaatgttgccaaattctttcagcgagaacaaatcagccgcatgctccgcatcccgaaatccatatgaagtggtttgatacaacggaacggcgcgggcaaaggtagtaggatcaatttgttgtccggcatggacagcgagagtttcgaatgacagcttgcgttcttctgacatgattatttcctcccttgttatacgtgttgtatgaatcgtctcttcctgtatgcgtactcatggatgatttttcaatcattctcgcacaaaaagaacgatttgggaagataattctcattattcaggtaggatattataattttattgaaatatcaggtttcagatcggaaggttttgcccaaatgctcacccagaccaaagtaatggcggaaattatagatgagtgggctccattttgtcggatcaatatgtttctcgccgaggatgatatcctgatgaacatgcacctggatagcatgagtttcgacgatcgcaaaataaggagaatggtcaggaattcttacatccttcactttggcttcaatttgaatagggcactccctgattcgggcgggcttgaccctattcgaatccatcgaagttagtccactgatctcatacttatctttatggtgcataaatccattttccttcttttccgctggaacaggattcttgcctgtataaggagccaatcgttctacattttcccacatcaaaggccccgggacgttgattacacattcaggatgccgcttcatattttcaaatgctttcccaccaattccaatacctagtaccacacaatctcctaatgcccacgaggaggaaatggggctaatattggttgttccatcctcattcagcgtattgagtaaaatcacaggggttccgtagtatagaatgctagggctaatcgttttaatgtctgggttgtgattcatctcattcatctgatgtattgggttcatcatctcttctccttctattcagatctacctccctattgtaaaatataaatatttcaaccttcatcgaagtatggattacaaagggggataaccgtgccatgagcaccaaatcaaatatagccatgatcgcttctctcgtcagcgagccttcccgtgcagccattctcaccgctctattagacggcaggttccacacggcaagtgaattggcccatatggcaggcatcaaaccgcaaaccgccagcttccatctggcaaaaatgaccgaggcacaagtcgttactgtggaaaaacaggggcggcaccgttactatggcattcaagaccccgaagttgcccgggtgatggagtcatttttatctatagctccgcctgtccctatccattcattcaaacatgcctctgaaaacgaggccctacggttggcaagaacttgctacgatcatgttgcgggtcaattaggcgtacagctcatgaattttttcattcaaaaggggattcttttcgaagatcaggacgggcttcatatcacggaaccaggagaggctttcttcactgactttaagattgatctaaaaaaaacaagacaaaagcgccgctccttctcacataaatgcctggattggagtgaacgacgccatcaccttgcaggtgctttaggaagtgctgttctagacagattattcgaattaaattggatcgagcgtctgcccacaacccgagcgatacgtattacagccgatggtaaaagaggttttaaagagatattttcgatagaagtcgactagatcatcatagttctagtccttttattatttggtattagattttatgactggagacaaggccattcgttttctcgtcattggacggacataggcataattgttttttggagcctttccttttgctacacctgctttatatcttccagctccagccgggatggcgaccaaggttccgtacgttctcatcgctcgttcaatcgggaaagatgtagaacgtgttccgtctgtagatccggcaaaatggaccgcggccgcatagttattcaaccgatcattactgtcattcaaccatacggaacccgaatctccaggcccagttcgcccctgggtaaaacgaatgaccgtttgatcacggaaaatcttgattcccgaatcgcctctcaccctttgttccacgccaatcgcctccacgactcctctggcgaagccgttggttttagccattcttttaaacgtcattcccagacggtagctcaataagtgcccgggtacggtaatgaggccaccgctttggttaatcagatacctcgggttaagcagactgtttgaattggcaatagcgatggcggagtcctgaaagttaacacctgtcgtagtaagcggaacaaattgaaaagctctcccgatctgatccgccgttctgcccccatctgccggggaaggctgaatggtattgtgaaattggttggtattcgtcgggactagaacatgggcattactcaaaataaacaaagtattattcttaataacaatgagtcctccggttcctcctgcagtggtgggaaccgtcgttcctacactgaccgcgccgggcacggggcgccatctttggcgagggttcgtttgggtaggagccgtcgcttcccttttgaaggaacccacacctaaaattcggacaggtaccgcagaagcccgacttatattatgggttactgcctgcaattgggtttgcgtcacagccgaaagatttctcaaggtatataacacaatcgccgcaccctttgcaggtctgttaggatcagcatagcctactccaatccctgttactccgttccgctttagcatcgttcgccaaatccgactcttcaacttgaaggcttgataaaaggtagccacagccacatacatccccttttcatatagtcaatgatgtatatacatatgactaatccgcacatcatgactgtgcgtttccccagaacaataaaaaaggtgtgggctggaagcaaacgactgcttttatggatcaacctttcttgaagaactctaccatttctttaaatgattgctgagctgagtgtacgttatatcggggagagtacgggtcactgaatccgtgctgtccactgaatttatgtacccggatattacggttgtctaaagttgaaatgagctcatccacattaaatgatggttcttcctgtgggaaaaaaagcagtattggaccatgtggagctatttctaaataatttctaatacgagagccatagtatcctacgattccatcagcatacttttctttactacacagccaggcaatcgttgcccctatgctaaatccgacgataaatacctttttataacgagctcgattacttaataataaactttcgatatgatagaaagcgcggtcaaatcctacattctccataaaattggtgtaggcagtttcctcttgcgaatagtcataaggcgtttctttgcctagtaaatttggacaaatgacgtcataaccctgatctgataataggctacaaaaattttgtatatgctggttaatcccataaatctcatgcagcacaacaattagggtgtccgactttttatctatgcttatcatattgtccccccaaccagttttgaatatgggaaaataattcatccggatacgcgtatttatacttagctgccacttccgaggataaccgtttgaacaactcaaaggatacgaccagtgcttcccaactatgattgggatcatattccccaaaagattttttcaaatcagcaacgacatcttgatcagcccattcattgatgaatttccctgcatgccaagtatcatattccgatccatgtacagcttttgcatgccactctatcatttgcagcaataattgtttacagtccatatctctttgcttagctacccacagatcattgcgcaaaatttgtttagccacatagagagaggcgaagcaatacatgttaacaacctgtagataagcaccttcagatatcggaggagtatccgggatcgttgtggattgagggatgatgtggtttccatttcccgtcttatcgagcagcatcctgaccccccgctgaaatccttcaggaatacgtccatttttgattatatgatccagatcagaggtatgacggaatagaaaatcaacctcagccccttggtcaaagagaacgagtttttccggatctccttttgccgttcgaaacataaagctggtccaaaccttgccgatgcttaacaaccattgatcattttgaagatagtaatctggattcgttgaaaagaccactacatccaagtcagaaaactcatcaaaaggtttgtcctctcttgcccgggacccaacgatataaaccgcaataatttcctcattagagattccccattcggatatacgctcctcaagcacttcgtaagcattattcattacaatatatcctccttttttagaaaacattatatccaatccaataattacggtatatatttttagttaacattcaaaggaatgctgcctgatatacaccaatcatcaaatcaatttcccaatcttcagcctgtgatataattatttttaatattacagtttggaaggatggtggagatgtcggatcagcaggtatacatccggttctctgaggagacggacgccgcagagttggcagcaatgtacaagcgcaatcaagagttctttgataagttttcgccaaacaaccaagagaagtactatacggaggagtaccagctccagacgattattaagagcaaggccgacatgatggaggaccggaaatattcctttgtggtatgccacaaggaggacgaccggattataggcagcataggtctatcttttgtggtgagaggaccgcttcagagctgtatgatcggatacagcctagaccaagcatataacggcaagggttatacgacggaggcggtgaagcaggtggttcgctatgccttcgatgagctaaagtttcaccggatcttcggggaagcctctcctcggaatccaggatccatccgtgtgcttgagaaggctggctttcacaaagaaggcatctctcgaagcaacgtaaagatcaacggaaagtgggaggatcaccaggtactggcgattatcaatccatcagaggatatctagtttaaaaggaggatattatgaagtatcaatcaatcaaactacatgaaaagttatctaagtttagtgatcattggtctccgaaagttattggtgaaatgaatgactatcaatttaaattggtgaaaatagttggggattttgtatggcacgatcatcaagataccgacgaggtctttattgtacttgagggcgagatgttcattgattttagagatggacgggtacaggtttctcagggagaaatgtttattgtacctaagggggtcgaacacaagcctttcgcacatgaagagtgccatatcatgctagtagagccgaaaggtgtggtaaatactggaggagcggagtcagaattaacggcagtcaatgatatttggatttaaatatataccgtaaaaacgccggacatttctcctttctgagtcctttcccggaatcgatgaggactccggcctttctcccatcgcaagacccccccggctttgatcgcgaacatttccataggatgctcaatgctacatattggattttctatgtactcatacacgttagttggatgacaacagcggctgtctaagactttgtttttcaagtcttggtctgccgctgtttgatttttgttcagtctaaagctttatttccagtgggtattttacagaaactgtattctttttgcagggctctctcagtgcatgatttctctcttgttcaccttaacacctgataaggattgatcaaacatatcgagaataaaaaggaacctctccgcttcacgaaatacatgatcggccaataaaggatggataatgctttttattcggcactcgtcgattaaatcacgcgctgttttcttaaaatcacgcaaggacttcacagagacacgattttcatcaacaaattgactcagaagtggaacggtttgtgactgtggccgcatatgacttaaatcaatcgcttgaaacatcagcatatcaaaatcattactaaactccctagcttgttcaaccagtttacgctcggatggatcaagcaaatggcctataaattttgcgtgatcagccatgatttttaagaaaaacacattttcgtcaataattgcatcgggtaatggttcaagctttcctgaattgagttctcctaaacggtttctgaaataattggcttcccggcttacgtgatctaccagtaaaggaaaattggtttgtccaggaagcttgcattgtaatataaggcccaataccattctcttaaatgcccaaatattcgtcgccgcattctgaacttccgtattaaactctttgattgtataaggatctgtctcggtattaaattcattcgaccttttctcaatatcctcaaaaatggcgtagaaccgattggcttctgttttaagttgagtatcttccgctcgaaaacctaaccccagaaaaaatgaatgctccttcataatcctggaccaaaatcgtatttcatctaatgagcgtgaaacgaatgcatccaatcatatccctcctctatgtgagcaaaaaagcacttacttagtcatatgggatatgccttgtcattatgaatatcgaatcctacgcctcatacaatctaattccgaagttgagctattgtgactcgtaactctgttgccttatttatgtacgtgaaatatttctctatactggctattgaccgtcggagttattagtcattctgggtcctctcctgatactaggtctattcgaaattcaagctggtctcgcataaaaattttacccgctatcttaactgattctggcttaacctcctctactactcccccataatcctcaaatgtcacacgcaattcctcatcaacggatacaacgtatacatgtgcctggactagagcagctccaaacaactccatgtctgtcttcaatactttatatgtgcgtttcacgatgatcacctcaaatattccattcggtgaacagtataacaactccttctatgacaaaaatttctttatgttcgtgttagcctttgttctttacgagattcaactggatgtcatagcgatcctctccttccaaccacagcagttcgttaagcaaaaaagtcatgccatccattgagcgtagctagtcaatggtttccgaaacaacctccatgaggtcacgctgaatgccttctgccaattgcagcccaccactgtctccatcgacgaataagcgtgtatgctctgggtgttctattctgcgtacatgacgcatccacaaacgtccgtcctcaatgtgaaagaagtagcgtccaccataaagcacaccttcatatatttcatacatatataaatggtcaaaaggtccatataccattgccgcccattctagtatggttgatttagtctccatttttctgcactccttcgtagtgttatccgtccaacttggtaagggcacctaatcgtaatgatagtgaatcgctgctacataacccattaggtaagaagggaatttagtgtttttgctatagagggggtaattgaagcaaccacaatttaacatatttatatcgaaaatacattgttataagcaaaattgggatttaaattgttaacagctgtgttcatcacatcaagaatatatactgcctcatgttcactcacgtagaattgcagatttacttgctgtacaataggaaagaatcactctgattagatgcgtattttcgacactacttatcatcaacgatgacaataacgagattgctaccatcgcataaatcaatgttacagtttaacgttatttcgttattcataatataaccatataacgttattgtcaacatctttttgcgttatcttttagtttcacttaaaatcaacacaagcataactaagcaagaatcaaggggaaggaacggtcggttatatgtcaaaaaaagctataatcgtggtcaagcttggaaagattctggagtcaaaaggaatgacacaagggactttatctcagttaacagggctacgcccaagtaccattagtgaaattgtccgtggctcccgtagtgttttgaataaagaccatctggcaaagattattgaggtacttgaaattacaaatatcggggacattattgaaattgattacatatcaaatgccaaggaaagtactgaataacccaaaaaggaccgcagatgctgagggtcctttttacgttgggacaaagcttctattattatagaacgatatattatcgaaaaggacattttgtcgatagtaaaataaactttaagttgaatccatcgtttagtaaaacaatagaaataaatcccaaacacgtgttcttacttagcaaatagtgatacaaaaacaattaaattagatactcccacaactaaactggatgcgaattgctcgtataatattattgtaggaaccttcgttattgaagatcattaaatataccctcgaacaaaacagaatcaccagaaaaataatagctaaaagacaccatttgagaataaataatctccatataattcgttaagcccttctatctcaaagtatccgatcattatctcaaaaattcaaaccctaaattaaccctttatttatatatataggaattaatgtttagacaatcctttttggcttttgtatgtttaatgagtaaataaaacaaaaggggatttaacatgaaaaaaatatttttctcgctattatctatctttttattagcatctgtgtttgcaagttcttcttttgctagctcaagtgatgttaactcaattccaaaaatgacatggaataacattccttctggaattgctagtgctagtagcagttggagtgatagtcaccaaccatgggccgtatttgatcaatcccttaatgataacgggtggtctacagctgcaaatggcatccctggatggattggttaccaatttgaaaaaccagttgttgtgaacaaatatgtattacaggctcgtggaggtaataattacaaggctgaatctccaaaagattggacttttgaaggctgggatggagcatcatgggtggttctcgatacacaaaaaaatcaaagtaattgggatcaacctgtaaaaaaagaatttacatttagtaacacaaaagaatatataaagtatcgtctaaatgtatcaatgaataatgggcaaaatattctgactcttggagcttttgaaatgtataatactaacccagttgctccatctactacaccggatccttctacaataccggatccttctacaaagcctgatccatcggatccatctacaaagcctgacccatctacaacacctgatccgtcagatacagatggggcctcccaaccaactggtgatcgcgccattctgactgtaacgatggacaatggatttgataaagaattcgatctgagtaaaaaagaactcaatgccttcatcgcttggtatgacgctaaagatgctggtagaggtgcttctttctttgccattgacaagcacaacaacaacaaaggtccattcagcaatcgcaaagactacgtaatcttcaacaaaattctcacatttgaagtaagcgaatattcaactaaataaacatatgaagggcttcatgtcggctaacatgccgatgaagtccttctttacatttactgtaatctcgagatcacgcctaaactgctatactggacgatacattttttctagactaaaggtttgcaaatcgtttgtttcaacaaaaaaagcacggcttccaaaaagcctggaagctgtgcttaagttaaataaaatattctcgaatgagtgtccgtggagtacaattcagtagtcttttccaaacagatagtaagactttacacttggcccccaactttgtttggattgagatcaatattttttgtgtacactttgttattaatgagactaatgatgctgttaactacaattgaagtaagtaccgttaacaacgttagccacaacaagatcaagatagataccttggggaagaaaacaatactctgaaaatagtaataacaaaaaaaggtgtgggttaaccaaatattcattgaatttttacctaagtaagcaaaaggtctggttagttttaatttattcattaaatgaatactaacgaggataaataaaggggcaattatcatatcaatcgttgtcttctcaaatagttgactcgtggtacgaaagcgaaataacactacaattattataatatcaaacagtatgttattaaatatgatggaattataaatcttattcatccatgaatacaatttatatttagcaaagaacaaccctatcataaacggtagctgccaatacataatactgtaataattgccttgtgaatatgaattataaaaaacaagaccggaaatgagtagagttacccatgcgttacgttgaatggcttgaaagctgaccggaaaaattaatagcagcagaatataatcatataaaaaccaccactcaccattatatgaacttgagagcgctataaaattccgcaaaaaatccattattgaattatgttgaaatctatcagaatttccaaagaagtatagaccagctgggataaaaagcaaaaaaacaacccagtaatttatcattattttgcttaatcttgtaaagcttttctgcattaaatgatgtggattttgaacattgctcttatataatccataaccacttagaaacaaaaaaatagatattgctatttgaccaaaatgtcctaaataaaattcccctctttcatgaaataaactaaataatgaaacatagtcatactttaatctatcaggaaaagcgaagaggtgatggatcaaaagtagtattacagcaataccttttgcaatatttgtttctgcaagctttaattccttgtcatggtgcacacaatatcctcttttctagttgtaattgaatagagatatattagcacaaacaaaaaatataaaatatttatttttttaaatactatttcaccctccagttttatacaaagaaatgcggccccaaaaacctatagaccacgctgtgcctgagtttgtaagttattggtgaagtggacaacccccgtgtatgcaacatttcccaattttatagaatgatccatttatacaatttttatcaacacagtatatccttgttgttaaaacttaaaagtattatgtattcaacattaatattcgataataaaggtaacaagataaaatgagcaactacctcaaccgatgaggatactcacaggagaattcgtcatgttaaaaaaagttctatccattgctctactttctgtagctctaacagcttgtggaagcaattttaaagaaacaacgacaaggtctgggtcttcaagtacatcctttgccactgaacaaacagcaagcaatgaaaatactgctcagcaagcttctacagatcatcaggtcacagataagcaatatttatttgccgaattcatgaaggatgggacaccggtgttaacagaagatcaagcttctatggaacaaacatcttatgacttcattgttaaaaacagtgacttatttccttctacaggtaaaagcaaagtcattaatctagtagacaaatctgtaacaacaaaacacttaaataaaaatctgaatttatacttaaacaaatttgtaaaaataaccggcgatgtaatagacatagaagaagataacattcctatagggacaacggcgatcgtttatattagtgatgaaaatgataatacagtaatggcagtttatccgggagcaagtggagagatttttgaaggagacgttgctacagttattggagttcctatcgctaatttttcatatgaaaatgtttcaggtggctatacgaatactacattgttagcagcttcttttctcacgaaggaaaatcaataaattttaatgtgcttggcagcgtctatagcgctcacttaaaatttttcaggaaactggtagtgtcaaaaccaaaaggttgccgatatgttgaacgcgaaagagaaactagccatcatcgcggagatcaaaagtggtgtcttaatctttattttccgtctaaagacatagtttgaataaaaacaatcccctccggccaagtatggttagcggggattgttaagttgtttttgagttgtatttacgattatcttttattgtggttttcaggctcgcgacgttttaaacctgccaatccaactaaccccaacaaaccaagccatccccaattatcattatcgtcatcattattattagtagttagcatttgtgttctaccattgtcgtttgtgcccatattgttttgactgttttcagcaaatgctactgccgctccaaagcttgaaatcattaatgcaacaacaaccattatcttcatttttttcaacatacctaaaccactcctttagatttgtgtttgcaatcaattttttaatgtatttagcatgcccagtagaacttatttcgtatacacacattaaatcttcactactgggaatcataaatttgtatatcattaaaattaaaaaaggagtggtttttataatgggtatcctaagcgggaatccaaaagacgagcccatgcattacggagaagtttatagtgtgtggcagttttcagcgttagcgaaaggcagcgtttcattttatcaagcatgtttaaaccacgcaggagacaaagagctcaaaaaagtactggatgatcttattgatcaagctaaactagaaatccaagaatgcgacgcaatgcttactgataatggaattgccccagctcctattttgcctgaaagaccgcctgtgaaacttgaggatatcccggttggtgcaaggtttactgatcccgaaattgcagctaaaatcgcattagatacctctgtgggattgacgtcttgcagccaagctatgggtcaatccattagagaagacatcggggctttatttgcgaaatatcatttaactaagactgctttgggagtccgtattctaaaaatgaacaaagaaaagggttggctaatacctccccctcttcaattaaaaagacctgaaccagttaaagcctaaaattccagcataattcttcaacacactgttccttagatcgttcaacaaaaatccccgccgaccagttaaggtttgcggggatttgctctgcttacgtttaagcacctccgatggtaacgtaaggctgaatactattgtggtggttataggcttgatccagcacagtaacaataaacaaaaagctagccgcgatgatcagcagtaccattttttcaacattggtcatccacaccttttcgatacatagctggcatattacagcatcctgctaaaaagttgcagactaatctgaacggcgacgttaagctaacgagcaggacagttccaatatatgctactcaagtctcaagacctactcaccaaataaatttaaaattgaatagattgtcacaatcaacattgatatgcggcgaagagggaatttaatcgaccagaagaggtcaattgttctctctcctattcagacatattacaaaagaaaagcacgttaaattactcagtcggaggaatcactattttgagaaagctatcattatttattgccattatcatgttaggtgcaatgttgtccgcttgttctgccattacatccaccgtggatcaagcgtctgcaggtgttacgtccggcgagagcaaagaaatcgaaaaatacaatgcgtatgtgaggctgaataacttgatgacaggcagaatcaacgaggttctggttcattattttgagaagttcggagttgattcacaccctgtagtcgagaagaacttcagcttcatcatgctcggcgttgctgaaactgagcgggaagttattgataaagcgaacggctataccgcaagccaacctgcttttgcgaacgcagaccccgtagtgatcaaactgacaccagtcatcaatgatctgttgtccgtcctcgacgagatgaaagcctactatgatacaaagggctacgtggatgatgatttcgcaaaaggaaaacagctgcataccaagctggtaagtgccaatctcgcttacgagactgtctccaaacaatacttcacggctatgcaaaagttgggtaacgagcaacgtctggctgaactgcaaaaactcaaggattcagaccagcagatcaggtataatgccttgaagttcatgatagatgccgaggctacggccattgaaatggatgagcagggtatcaccgccgacaatgtgctgcagcttgatatgacgaagtttaaagccaaatacgacattatgaccgcagatctgagtgcgctcatgacaatctcaaaagacaagaatcgagttcaaaaagaagggattaacagcttcagtatcaggaactatgttgattcagccactgaggcaaaagcggctgcttcgaaagtcattgaacgtatcaataagaaggaacctgtatctgattctgacctgaacggccagttcctgaacactacggatggcacacctgagaatttcaattataagctaagcaaggcagtcgaacgatataatgaaataaattaagcgaatctacgataggggctgcgaaaacaaatacggagttccggtaacgaaaaagctctgccaaccataaggttagcagagcttttgctttaaattcctcccatggtaacttgagggggaatactatgatggtggttaaaagcttgatccggcacattaagcataaacaaaaagctagccacaataagcagcagtaccgattttttcaacatttttacccacaccttttcaataagatttaaaagtgttaaaaaacattggcgattcaattacaggagagattcctaaataattgctctaataggaggttttattatgattaagccaaagatgacatcattatcaagcagaaaagcgaatccaagggtcaattcaagtaaagaaaggacagggttcacttcagaccgccctgtcctttctttatagatgaggataaacgcgtgatcagtttacggttcgattcaaggcttacagatcgactctccagttgcccatcatcttggcgacttccgggtcgcggtacgataagaaaagactttcccgcgtatcgagggtcgaaatttgttcgatatcgtccgcactcaactcaaaatcaaaaatgtcaaagttttcaacgatccgctcttttctcaccgattttgggattacaacgacttcacgctgaacaagccagcgcaatacgacctgagcgacggattttttgtgtttttttgcgatcgagaccagcacttcgtttctgaacatgttgttaagtccctcagcgaacggggcccacgactgatgttgaactctctgctctttcataaaagctgcgctctctgtctgctggtagaacgggtgcgtttcgatctggttgacggcgggcacgatttcgttatgaacgatgaggtccataaggcggtcgggtaggaagttgctgacaccgatcgccttaatcttgccttcgcggtacaggtcttccatcgcacgccaagcaccatagtaatcgccgaacggctggtgaataaggtacagatcgagatagtcgagttgcagcttcttcaaggatttggaaaatgcgagcttggctctctcgtagccggcatcctgaacccatagcttggtcgtgatgaacagctgctcacgcggtacgccgctgcgcttgatcgcacgaccgaccgcttcctcattcagataaccggcggcggtgtcgatcaggcggtaaccagccatcaacgcttcatatacggcgttctcgcattcttcaacatctggaacttggtagacaccaaagccgataatcggcattttcacaccattgtttaatgtcacggtttgcattctatttcctcccattgttcaaatgtaaagcaaacggccgcggaactgggaaattgggcacctcagtgggattccgcttacggtcgacctgcattacaataaacctatcgccttcgtgttacacgaagtcaagccgtcttcaaataaatttacttttccaaggaggattccacatgtatacagtcaaagaagccgcccagataacgggactcaccgagcacgctacgcttttacacggataaaggcctagtaccaagcgtacagcgcaatcaaaacaacattcggatgttcgacgaagaatcgatcaactggttacatggcgtcaaatgtctcaaacaatccgggatgccgattggagtcattaaaacgtacgtcgatttctgtctcgaaggggattcgaccattccgcaacgctacacactcatgatggagcataagaaagcggcgctcgttaagctcgaagaagccaaacagcacgttgcccatttggaacaaaaaacggccctatatcaggccattctggagcaccgttctccagacacgaccaatcctggcaactgggataaaattcagcatatgcatagtgacgttttttactcgccctctgttcggaaggctaaagatctacgtgaaacacaactgctcgaagaaaatactcttttttaaactcctggttggcttaggatgaacaagatttacatcagtctagattgcactaacacagaggcgttagttcaatgaaaacagcgacagtctagggctttattttcttcgtcctttgctgtcgctgtttcaatttctagagtcagtctgcttttttctaaacttatatcttaaattacttctgttgctctaatactacgtattttaaaatatatttcggtatgaataagcctgtagactacaatgcgtcgttaggcaataggggcctccgcaattgtaatcatagttgcaatgaattgtatgcaagcatcttttgacaagttccgtacatataaatcgtggaatagcagcatattacaattgaccgctaactagaagggaactgtattgctgtggttgataagttaaaaaaatggctgtttaaacagccttcacgatccaaaaatggcaagagtcctaaaccagttaatgacgaaaaatcgaatgagttatccaaagagctcagtggtacgcttaaggacaacgtgaccatgctgaagcacgaaataggacatagcacggatttcattcttcgttgcttgaacgataaacagggtaatccggttctcgctgtagcttttcttcagggcctgattgatcagcaaattttaacgacactgctggaggagctcactgcaggtattcgaaatggggatctctctgatcgtaatgttgaaagttggttaatggatcgtattcctattggaggcatcacttgccttgaaaatgagcaagcacttatccatgccgttctttatggacaggtggctctccttgtcgaaggcagcaccaaggcctttgctgtttctatcagcgggggggctaaaagagcggttgaggagccaacatcgcagacagtaattcgcggccctaaagaggggtttacggaggatatatccaccaatatcgcactccttcggagaaggatcaaatcaactgaactccactttgattctcgaattatcggatcatatacgcagacaaaggtatcggtggcatatattcgaggcattgcagatccggaggtggttaaggaaatctccagacggttagactccatcaacactgacagtattctcgaaagtggatatatcgaggaatttattcaagatggggtatggacaccatttccaaccattcataacaccgagcgcccggattctgtagcaggtagcttgcttgaagggctggtagcgatattggttgatgggaccccatttgcgctgattgctcccgtaaccctttttcggtttatcgcatccagtgaggattactaccagcgatatgatttggcatcttttcttcggatcgttcggatggcatcctttttcttggcattgctattaccctcattctttattgcaacaactacgtttcaccaggaaatgctgcctacaacactgcttatcactctggctgcacagagagagaatacaccattgcccgccctgcttgaagcaatgctaatggagctgaccttcgaggttatccgcgaagcaggagtacgaatgccgcgcgctgtagggcctgcaatctctatcgttggggctttggttcttggacaagctgccgttcaggcggggttggtttccgcagctatggtgattgtggtatcattcacggctatatgcaactttgtgttaccttcgatcaatatggcgggggctgttcgtttgctcaggtttgtactcatgctggtggcgggtttatttgggttgtacggcgttttgtcggccttggttcccatcctcgttcgattagtatctatgaattcgttcggtgttccttatatgataccgatcgcacctttctataagagcaatatgaaagacctgtttgtgcgtgcaccttggtggatgatgaagaaacggccggtaatgattggggattccaatccagtaaggcaggcaacggaacaggaatcatttgcagaacaggcaggggaacatggccgagatcccatggcgtaaggaggaaccggtatgtccctattaggaaggttttttatggtcttggtcgtgttattcagtttgacgggttgctggaatcgagtcgaactgaatgagctgtgggtaactgcggcttcaggagtagatatgatggacgacggacagtggatgatgtcctatcagattattgttccctccgccattgcaagtggaaccggaggaggatcgggaagctcttcccaacccgcatcccatgtattctctataaagtccaaaacctataaccaggcattatcgtacagcaatttggaaacttcaagacgaatctacatagcacataatcgtgttatatatatcggtaagagagcggctgagaagggaatggatcgtttaatcgatttttatcttcgtaatacggaagcgagagaaatggtatctataattataacggatggactagcatccgatctaataaagaaattgttgcctcctgaaaaacttcaaggcgccgccatggctgaattggttgacaaagagagcgatagtttatcgttgtttccgaaagttagggtttatgatttcgtattgagcatgaactcggattccaaatccattggggtaccagtcgccgaattaatcggagagagagaccatgagaacgagaaggaagcagagagtctggatgtttttaaaaaaacctcgaccccgctcaagctggcattgactaaattaggggtgtttcaaaacggaaagcttaaaggatttctcgacaaggaagagagtctgggagtatcttatctgtcccaaaaggttaacaactccgaaatttcgttcccatgcagcgaacaactcggtagggaaatgtactcttctctaacagtaaattctgcagatgtaaaacttatacccagaaaagcgagttctcattacaccatgcaggttagagttaaaattaacggaactttaaatgaaagcacatgcactaaggatatttccaagacgaaaaccatacatgatatggaaaaagagattggaaaagaagtgaccagaacgataaataagggctgggataaactccaggaactaggtgtggacgcaactggttttgctgaccggattcaccgaaggttcccaagggagtgggagactgtgaaaaaagactgggggcaggagttcaaaaagatagaactggatattcgagtagatgcacgaattcagcgtcctggactcctgcagaagcatatcggaagtcaaacctaacccatttgtaaaaaggggcctaaacagtatgaataaaaccgtcaccagggtatccgggttagctattgctttttccttgtttcaggttggcagtacaacattattcctattgggagctaaagccaagcaggatgcatggctagccatgctgatcggtgcacttgcgggcttcgtccttctaatcatgtatttatacatgcataaacttgatccacatcgagatttgtacgagctcctgtgccattattggggaaaatggataggtagtctggggggacttctgttcatcggttactttgcttatgaagcttccaggagtgtcagggacattggtgaactcggcgcattgacattgctgaacagaacccctaccgaagttattacgtttatagcgttaattgtctgtgccgatgtggtgtggtttggaccgagagtctggttccttctatgtcatatatttctgcttctattggcgtttggttacggcattctactagtacttactccttttacaggactcattcactttgaatttttgtttcctgtattggagagcggtttaactcccgtagtgaaggctgccattcccgagaccatatcttttcccttcggtcagacgattctttttctcgtgctattcaagatcgtcttggataaacgcaaattacagcggtcgatcatcattgtttactggatcactgctgtgttccttattataatgaatgaactaacaatcctggttctaggtccggaatgggcagcatcaaccacctatcccttatttgaggttactcaactaattcatttaccgaagatcgttgagagagctgatgtcctgttttcgatgattctatttattggaatcggagtcaaaacggctggttttatgtttggtgccgtcatagggcttcaaacgataaccccctttagatataagcctgctttactattgctaagcatcatcataggcgctcttacgtttctctcccccaggttaaccgaatttttgtggttcggtcttcatgtagccttggttcaagtctggcctatctttcaaattgctctgcctgtcctccttttcctgaccatgctaattcggaagaagaagagaagggcttatagttagcagctactgtagtcatgagcatgttgattttacgcaccggttgaagtggtcagtagaagtagaaatgtgcatgtctataccagaagtcaagcatatcagtgtattgatacaggcttggagaaataacctattttttccttttagttaataagcaggtaattaaccatctactattgagctagagggaaacgatagctcaataggcacaagaagatggcagccgataatgtagctgtttctgttctaacataaaagtaaaagacctccatatcattgaagtacaccctttagggaagtctcgttgcaactatacttcttctacggaaggtcgtgtggtgaaaatgcaccatcaacattaccacttttttcaacattatttaaccacaccttttcaatgagattgtaaaactctgttttggtttcaggaaccgcatgggctttgaaacgcacaaacaaccccatacaatttataaaatatgtctcattatttagtatatgcgcttttaccattagccgcatttcgtgcctgtgcgaataattcctctgcaatgtcaaatagtttgggcgaatagagtagattgtccatgatagctcccaccactcgacggatcgcatccaacttgtccaactccgcacagcgaaacaaaaatggctcgattcgtctcatattcagtgcggtgtcgatgatatagttctctataaatagatcataaaaatagccttctggtaaacccatagcctcagtaatgcgatctatctggttaacagacatagacttattccctgtcacaatagcacttactatccccctattcatgcctgctatatgcccgaattgcgttagactcatgccctcttgttttaagtatctgtctaattctgctcgtatcgtaggtgtatgcttcatgacatagccacctttcgcatagaaattccatattttataaaaacaaagaagattgtccagaatcacaaaaaagcgcgacctccaaaaagcttggaagccgcgctgtgcttgagttgatagctatgctggtgaagggaattgaacccccggcctacgcattacgagtgcgttgaaatagagttctaataggctttaaaaggctcctatagcctgtccaacaataaatagggttccgtcaggtattacagatatccgtatttcggtagaagatttggtagaagaaaataattgaggcaacaagtacaaggcagatgccttaatggtctcaagtccctccgtctcatctccagatccttcatagcagcatcctacggtcgcctgctgaaaactgtagactgaaccgcgacgttaagctaacgggcaggatagttcaaatacgtggtatcatgtggtgagtaattaatggagccctcttttacaatgttgagaatgggggaaatcgtggtcggcttggaatgggaaggtttgtatagagaattgttgggagatggaaaccaattgcatatggaaggcgcaatggatgtctgtcatcgcttatcaaagacccatcgaatgttcgtaatcacgaatggtatcactcacacgcaaatcaaacgcttgaagcagtctgggctatataagtttttcaaggatatctttgattcgcaaagcattggttatcaaaaaccgaaggaagaatttttcaattacgtcataagtcatatttcagaatttaatagaaaggatgcgcttgtcattggagattcattaaatacgaatatcaaaggtggtcttcagtcgggcattgacacctgttgggtcaacagaaccggacaaataagtccggcagaaattaaaagcacatatacaatctcaaacttaatggagctcacttccatctgttaggctgtaaaaacaaacgtttgtgccgcctcaattatcactttttggtgactatatcacaaaaaagtgggtactgtttttcttgtaacttttcccccatactatcgttcataggaggttcatgaagcagacagagcatcctataccatataaatcattataaaaggagtgtaatagaatggggaaatttgacgggaaggtagcagttgtaaccggaggtacaagcggcatcggtctcgcatcggcacaacagttcgtaaaagaaggggcttacgtttttatcacgggacgcagacaacgtgaactggatgaagcagtaaagcagatcggaaagaatgttacaggtgtccgaggtgacatatctaaatcggaagatctagatatattattcgaaacagttaagcgagaaaagggacacttggacattctctttgcaaatgccggactagggtcattgcttccattaggagaaattacagaagcacaatactacaagactttcgatgtcaacgtgaaaggaaccatctttacagtacaaaaggcattagctttgtttccaaataaaagagggtcgattattctaacgggatccactgctggctcgacggggatgccagcgtttagtatctatggtgcatccaaggcagcgatcagacagctcgtccgcagctggattcttgatatgagagggaccgaaattcgtataaacatccttagtccgggaacaatcgtaacgccggcgtacgatgagttatttggctctgaactagatcatttactggaacaggcaaaaaatgatattccgctcggcagagtggggcaggttgaagagatctccaatgctgtcatgttcctagcctctaatgaaagtagctatatgaacggcgttgaattattcgtagatggcggagtagctcaagtttaaccagaacataataattttcaaacgacaaagatttttaaattaacttaaatgcgattgtattatcccctccatgtaacgttcaatttttccttcagtgatccttgaaggatcaagcgatacatgaaggggatattcttagatcgggagatggtgcattgatatgaaaacatttttctgtgaactggaagttacactagaggttatcggaggaaagtggaaggggcttgttctgtactatttaataaaaggacctaaacggacgggagagcttaagcgactcgttcataatatatcgcaaaagatgctgattcaaactcttcgggaactggaaacagacggattaattcgcagaaagatgtacaatcaggtaccgcctaaggtggaatattcaacgacggaactgggtcaatcacttgaacccattttgagatcgctttgtgattggggggggaattacgcagagcaatccttcgctccgggcgagattgagattttgtatctggattaactgtcgggggacaagagcatagtcccatttgaagtcgctattttagcggcttttttgttttatcgttttacgttgatgttttcgagtgatgagcaatattctagtacaggttacttcgtaattaacaaggtgcactacaaaactaaggacacaaaacttgtctcagagattaataagtacgtcttggattatggcaaaagcatcatgccccagctgttgccaggagtctgagcaaacaggtaagcggttgaggctaatgacaatgaacccattacgctccctcgaagtgattaag

SEQ ID NO: 2611 - DNA, 258800 bp, Unknown
  Kingdom: Bacteria, Phylum: Firmicutes, Class: Bacilli, Order: Bacillales, Family: Paenibacillaceae, Genus: Paenibacillus
acaaacgggggtcagttccgaagcgacttggtctttttaagagataagtgtatttaatttgtcacataacttggttagatcattccgattgatctgttgctctgccataggaaaaagtacagtttcttcttttataaaatgtacagtcagcacttcaaaggcctctcccgcgttcttggctgcctcttgaatgtcatcaagcgtgagcaaactcaaatcgccctccgtctcatgaagaaaatgatcgatatagccctctatttcacggtgctcctcctgtataccgacgagcggtccctgctcaaaaccaatgtaggttcctagcatagaaaagaagtgttcttcttccttttcggtatgtttcttgaggggtaccctaaagtcgataatctgcattctcagtttttccagttgcttgcggccttcttccaaatctagtattctgtgctgctcaaaccacaatacaatggcatgccattcatccatcagatatgttagatatcgatgctcattttcaagaatacgcatggcaggtttggaaaagcgcaatttctcattttccagcacgcggatttcctccattcatcggctaaaaatccagcatttttttctttaatgcatattggaccagttcaggccggcttcttaaattcaatttttccatgatcttcgctttgttcgcttccaccgtcttgacagagatgaacagcttttccgcaacttccttgttaccgtaaccttttgcgaccagaggcagaatctccagttcccgcttggacaggatctcataaggatcttctgattgtgacgttgtatcttttttgatgaactcacgaacgagagaagtagccattttaggatggatataagtcccccccccatgaatggttcgtatggcaagtaatagctcctcatctggagcatttttcaaaacataccctgaagcaccattctttaaaatatgaaaaagatattcttcatcatcatgcatggtcagaatcagaattttagtatcagggtggtcttctttaatcttgcctgtggcgatcaatccactctcgcctgggggcatgctgaggtccatgatcagaatatctggacgatatttagctaccattgtatacgcttcaatgccgtctgcagccgttccaacaacctccatatccgattggaagttcaaaatcatggaaaatccgctccgtacaattgcatggtcatccgctaacacaattttgatcacgtctttactcctcctcatgtccaatcggaatttttaaaaatactttggttccttgaccaacatttgaaagaacgccaaaacttccacctaccagttctgctctctcctgcatgccatataaaccaagtcccgttccaataggattgctccccttttcaaagccaaccccatcgtcctctacagtcaaacgaagcgtatgatcgtgctcagtcaaagaaactttaaccatgtctacctgggcatacttcaaggcattgagaactgcctcttggcagacacggtaaatgaccgtttccttttcacttccatatcgtttttgggaaagatccgacacaaattcaacgacaagaccaaagctttgttcaaccctcttaaagtgggaacgaaatgccgcttcaagcccaaaatcatcaagtgtggcggggcgaagttccacagacaggttgcggatatcatccagcaatcgcgtcatggatgcttcggtctgcttcatgtttttgatgagctgttcatcattcgtcatgtattttaacacccgcagctcaacaaccgcactcatcaattcctgggcgacgctgtcgtgcagttccctggaaagccgtttacgctcattttcctgcgcttcaatgacatgcttcatcattttgttttgatacaatttttcctgcgtctgaaattgcggagtcaagtccctcaacatcaacacccttgttccatgttcagaatcaatggtgtgaaaagaagcggcataggggatcattccgttgctctttgtttccagataaacctgaaaagaagcgaaatccttggattctggcatattgaaataacaatcaaggcaggtacggggctccgtttcgcttgtatagcccctgcatgttccacacaaagctttttccttcccttcatagagttgaatgaggacgtcatcgctcacaatctcctccgctgccgggttcatagctagggtgttcccttgcccatcaaaaaagaaaatggcttctgtactgttctcaaacaacttcaccattagcgcattcaaagagccagtccctacagataatgtcaattacatcacttccttcccgttcaactctccaaatcccctatgcgccaaagcttccaaatcacgcatcatggctgcggtcatcagcagttcttcccgaaatccaccaagcagtacgcccgcgacgcgagcatcattccataggggaacagccccgagactcttgagcttctcggattgaacgatcgggtagttaaacaggttgtctgcccccacatattgatgaacagatggaatgaaaacggatttcccagttttgaacacgactcctgctatgccctttccggattgcagtacaattcgcttaaagcgatcatttaaattaccggctgcatttttccatttaattacgtattgatattcggccggttcaaccagagcaagcgccatgaaatcataaccgaaatgttcgcgtattcgctcaagctccctttgataatccatcctattattcatcgctctctcctaatagaattaggaaagaaggcagagcccgctttcctaattcgatttatgtcttctgtaaaggatataacttctgcgcacataattcaacggaacactccacacatgtacaagccgggtaaacggccagaatgcaaaaatcgcaaaggccataaggatatgaagcttgaaggacatcggtacgtctctcatcagtgtcgggtcgacacggaatatgaataaaccgcggaaccagattgagatcgtctctcgataatcgaattctggctgtaccgcattcgttacgagagtcgcaaacatccccatgcatacaatggccaaaagcaatacgtttacgatcaaatcagacgctgtacttaaacggcgcacattgcgtattgtaaaacggcgagaggtgagaatcaacataccgaggaacgtcatggctccgaatataccaccaatataaactgccccaatatgatacagatgatcatttacacccagtgcatgcatccaggttttcggtatgcccagaccagacacatgccccataataaccgggatgatacccaggtggaacaagaggcttccgatcatcaattgttttttttcaataaactcacttgatttcgctgtccaattgaactggtcgtttctgtagcggaaaatatggcctacaataaagacgaccacgcacatataagggaaaatgacccataaaaactgctctagcatcatcattgcgcggccgcctcctgttctacgcaagctttaagcgtttcgcgcagtcccttcaccagatgaaaataagggctttccattttttccagcgctttaagcaaatgatatgtgccgtcttccaggatcgcgattggcatgcggaagttttctgtcgtcttcggatcttgcgcccattcggcggcatacagaaattcacacatgagcggaaggtaatctggcagctctccatctggcatttcaagaccgtacatctcatatagcacctttaacttgaccaacatttgtccccgttcttttgcatcttcgaatttaaagtaagtcatatatagtgcacaattcttttgaaaatcaaaggtttccgtatacatttcctgaatctcttccatactgaactcttgcataagggaccagtaggtgttcgcatacgtatatgccggatggttcggatcaaacgatgcttccagaaaagctggatgaaaatccagcttttccgggtacatgagttgctgagcgaaaaacccgaatgatggcttgcattcatacaacttcgctacattaatcacgccaaatacccccgtagaagttttcttcatacatttctttgcccgttttcaaaggctcttccatccccatcgaacttgccatactacagccgtcacatccagagccagaacccatgtttcccatggtatcgccgtaaccagcagatccttgagcccggtacggattcgaatatccttctttatgtgatgtcggaatgacgaaacgatcctcatacttggcaatcgccagaagtcgatacatctgctcagtctgccgcggtgtcatgccgatgcgctcaagacggctttcatcgaaagattgtcctgtggattgggcacgcatataggagcgcatcatagccattcgctgcaaggattccttcacagtttgcgtgtcgcccgctgtcagcatattggcaaggtactgaatgggggtgcgcatctcttcgatagccggaaagatcatatcgggattctcaattgagtctttcccttcaaagtaattcatgatcggactgagtggtggcacataccagaccataggtaatgtgcggtattccggatgaagcgggaatgccagcttgtgctcaatagcaagcttgtagaccggcgagttctgcgctgcttcaatccagtcctccgagataccgtcttttctcgcttgagcaatcactgccggatcacttggatccatgaacaggtcgcattgcgctttataaagctctttctcatcctgcgtagaagcggcctcaagcactcgatccgcgtcatacagcataacgccgaggtagcgaattcgtcctgtacatgtctcggagcagactgtcggcagaccagcttccacacgtgggaaacagaaggtacatttttccgctttgttcgtctgccagttaaagtacacttttttgtatgggcagcccgtcatgcaataccgccatccacggcaggcctcctgatccacgagcacgattccgtcctcgtcccgcttgtacatggcgcccgaaggacatgacgcgacacagcttggatttaggcaatgttcgcaaagccgtgggagataaaccatgaaagacttctcaaagttaaatttaatctcttcttcgattttctgaatatttggatcaagcggacccgttacatgcgcacccgccagatcatcttcccagtttggaccccattccaaatccattttttcacccgttaccgcagaatgcgcgcgtgccacaggtgaatgcttctgttcgccagcgttggtcagttgctcgtaattataagtccagggctcataataatccttcatttccggcatgtctggattgtaaaaaatcttacccagtgctatcttggacagcttgttgcctgacttcagttccagtttccctttgcggagctgccagccccctttatataattcctgatcttcccagcgcttcggataaccgatacccggtttggtttccacattgttaaaccacatatattccgcacctttgcggttcgtccaggttgttttacaggtcacgctgcacgtatgacagccaatacacttatccaggttcatgaccatggcaatttgagctttaatcttcaagccagttaacctccttcattttacgtaccgcaacgtacacatcacgctggttgccgatcggaccataatagttgaatccataactaagctgagcatatccaccgaccatctgggttggtttgagatggattcttgtaggtgcgttatgactaccgccgcgtgtatccgtgatttcggagcctggcacttgaatgtgcttatcctgagcatggtacatgaacatcgttcctcttggcatccggtggctgacaacggtccgggcggttacgacgccgttacggttgtatacctctacccagtcattgtcggcaagatcgtgtgcctctgcgtcttcgttgttgatccacaccgtaggacctccgcgaaacagtgtaagcatgtgctggttatcctggtaggtggagtgaatattccatttaccgtgcggtgtcagataacggagcacgagtgaatcttgcccgccttttatttcccgatcgcgagggccgaacaccattggcggcagcgtcggtttgtagatcggcaatgattccccaaattgttggaaaatctcatgatcaatatagaaatgctgtcttcccgtcaaagtacgaaacggaacgagacgttcaatatttgttgtaaatggtgaatagcggcgtcccttcttattcgatccagtgaatactggtgtcggtataacttcccgtggctgcgccgtaatactttggaaagtgatcctttccgctgcccgatcggccgagatatctttgagttccacaccgtgaagctcttctgcctgctcataagccttttgcgacacccgtccattagtcgcggatgaaaggtgaagaattgcattggctacttggcgagctgtctggattttgggcagcccgtctttaatggattcatcgtaataaactccgttcaactttttcatttcctcatattcgtccgctacggagaagctgacgccatgcgcacctgctttcccactagtcaaattcggaccgagtgagataaacttatcgtgaattttagtataatcgcgttcgatgatgctgaaattcggcatggttttacccggagtcgcttcaatctcgcccttggtccaatcctttacaagacccatcggctgtgaaatttcccctatactatcgtgtgcgagcggcgcagtcacaaggtctttatatatgcctggcaggtactcttttgccatatccgaaaagacttccgaaagctggcggtaaatatcccagtccgcgcgggattcccacagtggattaacagccggattaaacggatgcacgaaaggatgcatgtctgttgacgacaagtctgttttttcgtaccaggttgccgccggaagtacgatgtccgcgtacaatggagttgttgtcatccggaaatcaagtgcaaccatcagatcaagctttccttctacatcttctctccagacaatttcctcaggtttctgttcttcgttcggccgggcaagcagggcatcagatgctccgagtaaatgtttcatgaaatactcttgtcccttcgccgaactggaaatcagatttgaccgccaaacaaagagtgaacgcgggaagttctcggctgccccaggatcttctacagcgaagcgtgtcttacgtgatttaatctcttccacagaatggttgatgatgtcctcgttggacttcttgcctaattgtgcagcctcttcggcgaacagcagactgtttttattaaactgtggataagaaggcagccaacccagacgtgctgcgagcacgttgtagtctgctggatgtctgtaactgacatccccgccaatcggtgacttcaaggtgtctgttccactttcttcgtaacgccactgctctgttgcaaagtagaaaaacgatgtagcattttgctgccgagccgccccttgccagtcttttgcaaaagcaatcgttgaccagccttcgattgggcggagcttttcttgacccacataatgcgcccagcctccaccgtttacaccttgggaagcagtcaacacgacaagattcaagatggaccgatagatcgtgtcactattgaaccagtggttgatacccgcacccataataatcatggagcgacctttagtatcgatagcattttgggcaaattcccgagcaatctgtaccacaacagacgccttcacacctgtgatcttctcctgccaggcaggggtataatgcgaagcttcgtcgtaataatttttggcgttatgagggctgtcattgcgtgcgacaccgtactggctcatcatcaaatcgtacacggttgctacataacgttccgagccatctgccaagcgtacttttttggccggaattacacgtttgaacgttccattaccggcgttatcaaagtaagggaatacgatttcttcccattgctcgccatgaccttccacagtgagcgcgggctcaacctttgttccatcttcccgttccagaatcaggttccatttcttatcctgctcccagcgctgtcccatcgtaccgttcgggaccagcatttcccccgccgcttcgtcatatatgaccggcttccagtccgcatgcggcgaagcatcccccaggtcactcgcccgtagaaaacgtccacctttccaggctccctcgtgtggatcaagcagaatcataaacggcatatccgtatattgtttggcatagttaatgaacatcggttcttggcgctctttgtaaaactcatccaaaataacatgcgtcatagcctgggctacggcagcatctgtacccggatttggggcaagccagttgtcagcgaacttcacattctccgccaagtcgggagccactgatacgacttttgttcccttatatcgtacttccgtcataaaatgagcgtctggcgtccgggtaagcggtacgttcgatccccacataatcaggtaacccgcattgtaccaatcagaagattccggtacatccgtctgctcaccccaaatttgaggagatgaaggaggaagatcggcataccagtcataaaaactcaacatctgcccacccagtagcgaaatgaatcgggctcctgaagcgtagcttatcattgacatcgccgggattggcgtaaagcccgcaatccggtcaggaccgtatttgcgaatggtatagatgagttgtgccgagatcagacgcaggacatcgtcccaagtgacacggacatgaccgccttttccgcgagctgatttgtagagcttggctttctccggatcttccacaatgcttgcccatgcttccaccggattggcatgctcctggatggccgcctgccaaagccgcaacagcttaccgcgcatataaggatatttcacgcgtaatggactgtattcataccaggaaaatgtagccccacgcgggcatccccgcggttcaaattctggcatatctacaccgcaggaaggataatcgatctgttgattttcccaggtaatgatgccgtttttgacaaaaaccttccaactacaggaaccggtgcagttcacaccgtgagtcgtccgaaccactttgtcgtgagaccaacgctgacgatatacgttttcccattctctatttttttcctcaaggattgaccaatttcccgaatagctttcgatcggtttaaaaaagttgaggttgtatttctttttcatcgatgaccaacactcctttttagaaagaatcatcccaacgcaagttccaagggaagactcattcgcttactctcattatgtaattcattcatctctgttcccattagggaatgtcctatagcgctacaggaaatccctcgttctatggaaagatacaaaaaagcctcccctgctaaagggaagcttgtatgaagtaattaattgttcttttgacccgttaacaggagcatgataaaagaaatgagtatgatagagcatgtccacgcccacgccataggaagatgaccagcatccactgcaatataaatggccgtcggaatcgtttgtgttttacccggaatatttccggcaatcatcagcgtagcaccaaattcgcccaggccgcgggcaaaaccgagtatgaaggcagctttaaaagaagggaaaattaaagggaaggtgatgtatcgaaaaacctgccattcacttgcacccatcgaacgtcccgcgttttccaagtcccggtcaacagaagacaatcccattctcagcgtccgatagactagaggaaaagctactaccaccgctgctataacccctgcccaccacgagaatataataggctcgccaaaccattgctccacaaaccgtccgaacccgctttttcgtccaagtaatatgagcagtaaaaaaccaacaaccgtcggtgggagtaccaagggcagcataagcacggtttcaacaaccgttttccctttaaataatcccaaccgcgacattgaccatgccacaagcaagcctaatatgattaccagaacgctggataacagtgcaacctgcaacgataatcggataggaggccaatattcattccaatctatatcttgcatgctcacttcggtatggtaaatccatacttatccataatattcagagattcttgcgattgtaagtatgcataaaagtcttcggcttcttgaatgtgctttgtagctttgacaatcccgattggatactcaacaggtgaataggttttgggattcacctcaaaggcgatttttgccttttgcgaagtcaatgcatctgttttatatacaaatccgacatctgcattcccagtttccacatattgcagcacttgtctaacgtctttcgcttgaaccagcttgttctgtaacgtgtcccaaagcttcgctttcgtcagcgcttcctgtgcgtagttgcccgcaggaacactttcaggaattccgattgcaactttcttcacttctttttttgttaaatcggtaacactcgcgatgttcatcgtcccgtctgcagggataaccgcgaccaattcgttcgtcagccacgttttttgttttttcgtatctattaattgctgatcaacaagggacttcatgtttttggtcgaagcggacaaaaacaaatccgacggcgctccttgctcaatttgtttttccaacgcaccagagccgccgaagttaaaattcaatttgatgcctgtatgggttgattcgtatgaatgctgaatctctttgagcgcatccgttaaacttgctgctgcggatatggtaagctcaatagtttcagccgttttcgaagatgtctggctggaagatccgttctgatccgcactgccaacatttgaatctagttgctgtttcgtaccgcatcctgataataataaaatgatggaaataaccaaaacgaaaacagtgctacttttaattaatttatgcatttggttcggctcctcatgttagttcatcatcaattaatcggtttcgctattagctgtgcctgtctcgtacgttcgatcagtgtacaattttcaagaagaatatgattaaaaatatctgcttccaggtcttctaaccgcttcaatacgagtcggtgcgtaccacaagcttcctgcatcggctcaaagccgtttgtgatcaagcgcatttctttcaggaattccaccaccgtttgatgctcgtcttgcaacttggacaaaattagattcaactcatctgctcgttccactgttgattcttgtaaaaatgcttcaatcatcggaaacacaaggtcctcctcattttgaatatgttccgataattcctgtttaagcaaggtgaacagttcattaactcgcttgagatgcggataacgttcaccgtgaacccgcgttagtttggttacatacggcgttaaggccgatagttcttcccgaagcttcgtatgatactcattttgaatataggcgattagttcttttggttcgagtgaaggaggttgcatttgcttatgctgtgcctgtttttcttccacttcatgtatctgcgtcagcagctcaccagcgtggaggcctcgattggctgctgcttcacggagcgatattttccctccacagcagaaatcaatcctcagtttgcggaacagatctcccgttttgggtactgctttcacaatgtccgccacccatgtttcttccgttaactggctcatcttccattcctccatcttatttcgattttatgcttaactttcattctacgtctcccttaaagccgaaccaatcagggggttccctctttcactagtggaaagagcctgattataaaaaatcagaaagcaattgttcagccgcttctttcccttgagcgatgcaatctggaattccaacgcccccatagccagcaccgcatagaaaaacacccggtaaatactgtgcgaagtcctgtctcatcttcgccatatgctctttgtgtccaatcggatattgcggcatcgatcgatcacacctactgacttcaacgaattctggttccgcttccaggcccattaaatctttcaaatctttgcgcgcgacatccacaagttgatcgtctgtcatctgaatccaatcctgtgcgcctgcatgtccgatgtaggtccgtaaaagcgtatattcttcaggagcagtatggctccacttcgtcgaagaccatgtacatgccgtaatctttttgccttctttgcgggggactagaaatcccgttccctcaaaagcaaaattaagatctgtgtttttataagcaagagcaatattggctacggaaacatagtgaatcttgtgtagccagctagcgcttgcaacgccggaaaataatgtagccgcttcaaaagctggaacagcgcagatcaccgcatccgcatctattttttgtccgtgttctaaaatgacctgataaccgctttccttccttacttcaactacaccttgccccataacaaaacgtacggtatccagcctttcctttagccgctccacgatcgtagataatcctagccgataagaaagaaacatactttttttagcgatatccggcagtttgtcttgtactgctggcttttttcccgcccctttagacatacccttaatcaaacttccatgcttttgttccattagtttaaattgagggaaagttgacataaggctcagagaatgagtatccccagcgtaaattccagacagcagaggttctgtaatctggtccagaacttctttgccgagacgccgtttgataaaatcacctagagattcgtccgcatcacctttcttcgccggaatgattaaatccagggctgcccgtgcttttcccagtggagaaataagtcctgtccgaatgaaaggagtcagctttgttgggatgcccagaatgaagcccatcggcattgtatgaagtttgcccttatgcaaaatacaagcagatttggctttcgggtttgtcgataccagctctgcttccagccccaactccatggtcagatccaatattgccgtctttctggccaagaaagcatccggtcctttttcgatcataaaatcgttttggcgaacggtttgcagctttcctcccagacgttcacttttctccaccagtgtaatctccacttcaagctgccgatcctcagccagctttttcacataaaaggcagcacttaaaccacttattcctccaccgagaataacgacttttttagaactttttttcatgaaaacacttttcctctccaaccccgggtatataagcgcaataagggtcactctccaaatagtctcctgttattgcaaaagcccttgctctggagcccccacaaatggccttgaattcacagactccacatttacctttaagtagggacttatctctaagattcatcatgatcggagagttgcgataaatatctgccaggctatcgtttcgtacattcccgcacatgagaggcagaaaaccgctcgggtatacttcgccgatatgactaataaaaacaaatccatctccatcatttacacctttaggagcacgtcctaaaatatctgccctcttttgtccgtctgctacactgctctcacctgcattgtgcttttgctgcagtacgaccctccggtagtggggagcttctgtagccttcacaccgtacggcatctgttgctgtatttgatacaaccatttcattacggcttcatgctcatcaggagtaatcatatctttctccatgccacgtccggttggaacaaggaaaaataaactccataacacggcctgcatttcctttaccctttctgcaatttgctccagatcatggaggttataccgggacaccgtagtgttcacttgaatagggatattcagttcctttaaataaccaattcctcgcatggttgtatcgtaagaacccaccgtaccccgaaaatgatcgtgaatgtctgcacatgaaccgtccagactaaacgcccaccgcgataacccaacttgctttgctttttctaccgctgctcgtgtcactttaggtgtggcactgggggtcatcgaaaccgacagatttttctcttcaattgcatatcgagccagttcaaacagatcaggacgcatcaaaggatctccgcctgtgaacacaaccaacggatgattcatttcagcgatttgatctatcagcttcttaccttcttctagtgtcagctggcgaggatccggtttgtactgagcttccgctctacagtgaagacactttaaagcacaagctcgggtaacctcccagatgactataaacggatcagtatgataatcacgcggcgttttcaaaggtatcattgatgtctctccttttagaagtataaaaacaacacaaaaacatagagcatcattgaaaatccaatttccgccatgccaacttgttttgcctttaatccgagtttaggaagccatatggcccgtatcaaaaaaatcaaaaaaggaacaaacagaggtaactttaagcaggtagcaaacaacaaaatcaccaaatgatagatgacggaagcataatggtaacgtatattttttctttcacgaatgatcgttttgacatacaaagcagttccgataaagtaaagcaccaaaagtaagaatagctctgttgctactccccaatcctctcctcctcccatataaataacagggtatataaaagaacaaaagagtagaattgcaacaatgtcattaagtaaagcacgttcatttttcgtttttgcaaaataaatattagccataaaaaagagcaatagaagagctccataccagatcaaggcaggctcaaaccatatcagtgaaattaacaaaggaagtaatatcactccgtatacaacggcgggtttgcggtatctttcactgctgcctgttttgatccattggaggacaggaaaactgaataagtagataaaaaaccagcacacaaatagggggatatgaatgagttcccctcgagaagcagctaaaccgaataaaaatggaagaatgagcatggcccaagctccatgttgattgggtatgtatctgctcatccccttcaaacccttgatccttttttcacaatcttttttatgtctgttatttcggttaatcgattcatcatccattcccccaagattgagttttatcttctaacctcattctaagtattatatgaaattgaaccaattagggagttcccttttccttaggggggaaaatcctaaccggaaaaataacgctattttcttatgctatactgtactaaaaaaagggtacaaagaaaggatgaactgttatgggaggaccttctttacgtcaactgcatgctcatcatgccattcatcaaggcgggctatctggcgctctagataagacgagagaagtagaggaattactcgaagcaaaagaattcaaggtggcgcgccaggctgccgaccacttgatcgaatattgggaaacccgcattcttagccatgctgatgcagaagaggaaggattctatcaggaaatggtcgagaaaaaaccggaactgcaggaggctgtcgtcaaacttacacgggatcatgatctgctccgaatcattgtaaaagagctcaaagccatgatccgtgaagaagggcttacgcctgaagttcttcagcagttgcacgcgcttctggttgtcaatgccattcatagtcgggaagaagaacgtttgttgtttgaggaaccgtcatgatcaagatgtggcataacgattcactttctctataaaaacgcaccgaagaaatagtccaacgcctcctgcgagtatccgtcatctccttgccaagctgctacggaataaaaatcatgattgccgtgctgtcgtttacgaggcgtgtcctgtggaaccagcagtccggcatatccccacacctccatgactacatcacgctcgtttttgctggatggaaacacatccttccagcgcttttccaattgacgtgcactgctttgagcatcacagttctgaacagcttcgagcatgttatgaagtatagtcagatcctcatcggaaatctgaacagcctcttcttgactgaacaattcaaggtccatccagcaatacagaaggtggttcagacgaataccgccccatttgattcgttcaaaattcagtacattcaaatcttcattgacatattccttatcagacatcaatttattaaaattacaatccccacagctactgtaattgggcaagacgacaggccgctcctcataggtgtgcaaaggaagccctgcggttaatgcccagctcgataaggcgcttcgtaaatgaacctttttcgtggaaagactgtgcaaaaacgctgctgccactcgctcttttgtagccttttgctggtgcagctcatgcagcctgtttataatctcgttatgtgtaatggtgatcggatcgaacatcaagcccttacttttggcatattcaaaatcctcacccgaaaaagattcccgctcctgcttccagccgctagaggaccagaatgtgttcatcagtatttttttcgcctttttatccacaacacatctcccttactcatccaacaccctcaccttcagcacaaagcgcagggttgtcgtgtattttatgtaagatcactattcatctttatacttaaaagcaatggccgtatttcccgaccgtgggtcaaaataagaagagattttcccccagttcagttcatattccatataggggtaaggctttgtttgacgatagcttggctttacggacaaatgttgctgtaacaaacgatcatgctccctttgtcgctttctctctccttcctcagaccaattatcccacgaagttggaaattcatctccctggagcgaaatctccacgacaattaggtttgtatccttaaagcatacagacataaaaaattgccgacacagcaaagaaacctgatcgaaatgataccagatgtagtcattccctagctttcttacagaatgaaaatatttagaataccaagtggtctctaacaactgatcttccgttaaagatgagtagatagcacgctcaccatcgacctgaatgattcccgattcccagtcattcattgctgtcactccttcagctattatgccaatctcctacagttactctctgtcctcatttgtccatatgattgaaaatggcctgccaggcccgatctagcacgcgtgtatgtaattgcttggcataaacatttctaacgatggcaagaacgatcacacccacgaatacaacactgagcaaagtgatagagggaacccaatggtcaaacatgacattcgccagcacttgcagcaaatgtcgttctggttgtaaatattccaccgccgcaacgatgcctgctgccagcaatatgatcacagatatgatcataagcattacattgattactttgtatttagcaagccctcgctgaaaaacgcgagttcccgcatattgctaaaacatcatatcttttcactccattttcgacagcttctaaactacgagtatattgggttgccatgctctacaaaacgatcgattccagactgctctctaaatgagcctattagtaaaaatcaaagtaaccccgccagactccttcattctgatgcttggcaaaataaaagctgcctccatccacaatattcaattgggctttggcatctgaggcaatctgaaacacaaattcatagccctcgccaaagtcgatgcctggttgaataaagctgggatagccaccgattttgtgaaccgcatatatttcctctacgatgtccccaaaatagtcgggttcctcctcgtccatctggttgagaacatcgccgtattcctcagggatatcttcaccgtcccagaccggataatcattctctttaagttcggggaacagcggaaatgctttgatttgcataaatgccggaccaaaatctttttcaaccaaatcctctaccgacgtatactcacgaatacacatatatccttccatgtcctcatgatccagtacatggggagacaggaagacggtcaacagcttgacactgtgcatagcttcagggacaaagggcaaggcaggcaaatacaattgcatgatcggagccataacattcccctgtacatcaatgggttgttcctccgttggcaaagccactgtaactctaccaatccagctctgttcaagggaacccgacggtctgcgaccccctgtatgaaaaatagtagcattacgttttagaatcgttcttagcttctcaatagagttgctggacaacgaaatcactcctttctaatctagaatagaaacgcaacaacatcctcgcctgctttaaatccaaactcacttaatcgatcttccatctcttgaatctgatgtagataatcttccggcatagctggcagaccctgttcattcactaatgtcccgccgagtctggcgcgcgcatattcggcacttttccacattgcctcaaacacagtttgcggctgcacggtccgtaccccatccatactgaaaatcaaatctgcaaagcgatcctccgcgagtgtactcaacccaaaaaagccaggctcggttcccgtatgtacgctaaatagttaagcatcaggctccacttgatggattccttttatggtcttcacaggctcatattccaactccacggcaaggatgctagatacatcctcactcccatgttcaggtaaattcatgactctctctcctaactagctgttttcactttacagtttcctataattctcaatatatattaaactataaatcaccaagcacaaaatagtataaaaacggtgctgggttgttgaacataattttttagaatttcaaagcttcgaaaggggagtactcatgatgcaaaaactttggcaaaaagggaaagatctgtctctgcctattatggtgtccgcatcgctgatatctggagcgctgtctgtaagtacacctgcggcgaatgcggctgcaaccagggaattgcttcagctatctggtcagacgacttactatggagaggttgagaatgggcagcccaacggacgtggtacgatcaaatggagccaatataagcagtattcgggtgattttgtgaatggcaagcgttcaggtactggaaaatatataaatcaatacacggatgcagatggacaaaatcataaaatcgtatacaacggcacatggaacaatgacacgatgagcggcaagggtacgcagactgaaaaagtgacgcaaatggacggaaccgtacgttcgaacgagattcaagtaggtacttttcagaacaatggattacagaacggctaccaagtgatccacgctgtggccgatccagactacagcttcacttataaaaatggaaaagaagtgttaaatatcttgcacagtaatcaagatctcgtccaaaggtggcaaaaaggagagctcttctccgtaatttataaaaatggctctgtccaaaaggaatactccatgttccctgaagagactgctaccaaagaacgtcaaagacaagcgtccatcaagtatttcaaaggaattaccgccaaggtcactcctcacttgcagcagtttgaaaagctgtccaagcagattccgctaaaataattaatacgacgcgaaacatgcattagcctctacgcaagaaggcctctctttctaatggaaagctccatttgaaaagaggggcttttttcgttttcgttatgaataacttataagaacttcggatcataacactcctacttttctcccttatgaatcctcaggaactcatacaaatgacttatttttcacttaaatcccctcctttttttgctaacccccactagattcactaaaatataagtaattattttaatcatccgaggtggacatcatggctaaaattatggttcctcctgagaaactagaggcggtttccaggcagttcgcacaggcacgtgagctgggggcacaaatttgcggacaactgtcacagcatattcagatgttggaaaatagctgggcaggaacaacacaacagcgcttttatcaggattttcataaagctcgtggacaaatggatgctttcactcaaactgtcggttctgtcagcacagagctgcgttccattgcagtaaaattcaaggaaacagatacccaagtagacacgggtattaataaaggagatcacagcggacagatcggcagcagtgaagggacaacttccgggaaaaaaggacccgatccagcagatatagccattaacagcatttcagaagccaataaatggcgcgggcaactgggatttgccggaacagctatctatagcggtctggcttccacacttgtgctcaccaaaacagtagaattcaagaaaagtctgaagaatcccactcgagcggttatacataatgcggcatgggtgaaaggcaagggtaacaatgcttttatgcgtaatttaggcaaaagcctaaaccgccaattcgccaaacccggtattgtgatgaaggggttaaagggctttgatcgattagctggaaagcttcaaatgggtaagctcggcctcggattcaataaagccaacagctttcctcagtggacgcggaacgttatcgccggggtggaaaaaggccgatatggcatagccacccgccaaattcccggcatgattgccaaaaagctgtaccctattaatgccaccatgaatattgtgggcgagggtatcagtctggctggaaaatggaaaagcgggaagcttaccggaacggatgtggctgtatctgcttctaacgtagcgattaaaaccgccgcaacttatggcggtgctgtggctttgggagccgtaggcggcgctatcggtggtccggtcggtgcagccgtcggtgcttatgtcggcggtacggtgggaagctgggcaggtggaaaagtcgccaaattcgccgaaaaagggatacgttgggccagcaaactatttaaatgacatacacctaacagatggataaggagcctgactatggataaacaaacggtaattttaacgcttgaggaactaggctttgccttgaccgcactgggcgcagaagatatggcttctggtctgctccaatcttattacggggaactaaccgaagatcgctgggaactgctttttcatgctgcaacgcatagcctgatatccaagggtctgatggaacaacgggatgacgagcaacaacagctcgaatttgatgagttcattgttgaaatgctagctcatctggtacaaagtcgtcagatgctacgtggctacaaggagcaacaggataagcaaaatacattaacgatacaccatggaaatgaacgttttctgtatcatttctccagtcacaatgaactccatttctttcgctggtcttctccagaagactggcatcatgacattgatcaattgttcggcctacttgcttcgaacttcaatgcgcacagccgatacgtcgatctgaccgaagaacagtggaatgagttaacctcatccaacttcagcatgcagcaaatgacaacgtggaagcttcatgagtcggcccaacaaataatacaagactggcgagaggattttgatcgtaatcagtgtagccttaataatttgagccaaatggtatacacggatacggatgaagatggtccttctgttacgaatctgctatttgttcttaaaggaatgaatgatgtgtggattgtaagaaatacagaactggatatgcaggccatcccatgtctgcgtattgaaagtgtaaccgaagctgactggagagaaaggataacatatttcattcaggagtttgtacgcgacgaggcggtattccgtggataaaattgtatatcgcagatctttggcattttggaaggccatgggcagcttgatgtttgtgctgatttgtctgtttttgctgctgctcatttttatcgacgaagatatctcagctctacaaatcttcttctttattacgtccgccattgtcggacttccttttttcggtagctatcttgtggtttgtttgagcagaacgcttcgtaaggatacccacctgttcatctttgacgaacacagcatttccgatggtattcgaactgtcccgtgggctgcaatcactaaagtcgaattcgaaggagcctccatccgcaaatggctgcgccctcgctttcccgcctttatttttcatctgaatgaccgcagcacctgggaagtcagcaccgattatgtgttgaacgatatggagctgaaccaagccgggaaacaacttcgaactctcattaaccagcatggcaagccaaagaaaaaacgttcctgaatagtgccattgaatatatcaaagcttgtctctatcatatgcagctacaagagccacaaccactgctgccgagttggccgcagccaaatcaagattggagtcaaaagaatccgccgcttctacaccggcaagatcagacaaagaacggacagccaaaaatggaacaccaaactggtacgcagtctgaacgaccgcggccccttccatatccgtcactttcgcttcaggaaactggctacggataaaatgggcgcgctcagcctgggagataaaagagtctgccgtcgtaatcaaacctttgacgatctgcccctcaatcctggtctctgccagcgcttctgtcgcaaaagcaagcagcgctggatcgacaggataacttgccggcatctgtggcacctgtccgtaggtatagccgaacgccgttccgtccacatcgctgtaagtcagctcggtcgccactacgacatcgccaacatgcagcgctggatcgagcccacccgcagacccggtattaatgacaagctccgggctaaatcgctcaattaacagcgccgtagtcgaggctgcgttcgctttgccaattcctgattgcagcagaataacttccttgccctcaagctggcccgtataaaaaatcccgttcgcaatctgggtcatctttatcccttcgatctgcgcttttaaatctgctatttcttcctccatagctccgataatcgctatactcaaagttcttttcccgctccctccatgaattccttgtattccagcttatacttgaaaaacacccgttgctgcgatgcgctgcaccgcctccagcagcctttcctcactgtttaccagactgacccgcacatgagaagctcctgcacgaccaaagccttctccaggagcgaccgcaacatgcgcttcgtccaataaaaagtctgcaaaggaagccgatgtatacccttctggcaccttgaaccaggcaaaaaaagacccttgaggagtagctacatcccagccaatacctcgtaacgctgcaatgagaacatcacggcgccgctcatatagcgccgcgagctcatgtaccggttcctgcgtgcccagcaatgccacagctcccgcatcctgtaccgctccaaaaacagtgctgtaggcatgcgtatgataatgcttgagcgcaccaatgatggacgaatttcccactgcaaatccgaagcgccatccagccatgttatacgttttggaagccgtatacgtctcgacgccatactccttgccgccggggatttgcaataaactaatcggcttatatccgtcaaatccaagagcaccgtaagcaaaatcattcataaccggaaactggtaccgagcggcataattcagcgtctttgtcaggaaatctgcagtagctactgctccagtcggattgttcggataattaatcatgagcaatttgacctgctctgcaatttcttccggcacggttgtataatcaggcaagaaaccatgcttctcatcaagcggaatcgtatgaattttggctcttgccagcgcagcagcggaataatattggggatatgccggatcggtcgtcaataaccaatcacctggattcaatagcgcctgtggaatccccattacgcctatggctgagccgttgaatatggcaatctctcggtcaggatccagttccacgtgatactcccgtttatagaacgcggcgacagcctccagcgtgcttttttttccatgaaaaggcggataaccctgattgatcggttgatcgaccgcttccttcaaagcgctgatgatatgcgccggtgtcggctgatccgggttgccggctgccaaattgattacatctattcccttacttttatgcagattcaccttgtcatccattgcgctaaaatagttgtcaggcagagccttgacgagatcagaggatgaaaaaatcacgttcatctccaccttctatccataagatacaggctgacaacgtcagcccgcagaagataataccctatactatttgaaatagcttggcagcttgtagccttcataatcaggattcgattggatgtacttttggaattcatctgaatgatatccttcaataatgtctttgacgaagggcttatccttgttcttgctgtccacagcgaccacgttcgtgaacggatctgtcatattttcaagctttaatgccgaggtcagctttattccattcgatacagcaaagttcccttgtatagctgcaaaatcaacatcctccagtgcacgtggcccctgtgccgggtcggtagcaacaaattgcagatgatgcggattagaggtgatgtcgttcaccgaggtttgcaatggatcgatattgtcctttaacgtaatccagcctacttccttcaaaatattcagcgcacgcagcatattgactggctcgttgggcaggttgatttgggctccctcactgatttcgtcaaggctagtatgcttgctggagtacaatcccattggaggagtcgggacctgcacagcaccaatcagatcaatattctcccgcttattcatagaatccaggtagagcgagtgctggaacacattagcatcaatatcccccttagccacggctacattgggctgaacaccgtctgtaaactctttatatgtaatcgtatagcctttcttctccaaatatggagccacaccattcttaaactgatcgctatatggaccgggattaaagctgatatgcagtgttttcttttcttcacccgcagcgttgcccgacgtattcttgctgccgcagcctgaaataaaaagcacgactgctcccagcagcaatataaatgaaatccatggtttcttcattttgatgtctccccctgctccttgatatcatctacttttggtgagttagaatgtttacaatcgctcaaaataccaagtaacttgatgcgttttatagatattacaatgattttttattcactgtcaacaacatttaattacgcatctgctgcatagcaaaaaagggggcacaacaggagatccccttgaaagcaaaacacttcacacgtttgtcatatacttccgttttaaatataccctataggggtacatttaaaatatgtaattaaaaccctaaaggagctgtaaatatgagaatgcaatgggctttgctcgctggtacaattatgattattttgagtgggtgcggaaacagtaacacgccaaaccaggagcacacgacaaacagcagtcaacagcacgacacatcggatatgaaccattccacttccagtgagcttcctaccggactaaaagaagctgaaaatccagccttcaaagttggtagccaagcgactattcgagctgaccatatggcaggcatgaatggggctactgccacgattgttggtgcttatacgactactgcttatacggtctcatatactccaaccactggagaagaaaaagtgaataatcataagtgggttattcatgaagagattaaaaatgcaggcagcgagccctatgcagcaggcacagaagttatccttgcagcagatcatatgaaggggatggatggggctaaggctaccattgactctgcagaaccaacgaccgtatatatggtagattatacgccgactacaggaggggagtctgtcaaaaatcataaatgggtgacggagagtgagctttcagcccattagacacttacaacacaggcgcttatgatagcaaaagggagccttacatcggctccctttatacggctttatttgggtttagacaaacctacttcgctaaattcagcttggcatccttgatatcatacaaagcccctttgttggtatctacaagctttttcatttgtttgttggctgttccatttgcaggcacgattgcattaaaaataacaccatttttctgtaattgctcgttgatttcatctactgaaaaacgggctttacccagatctgtattcttatcatgaactggtgcatctgtaatgaatatgatcgttttggaattagaatttttggggaatttacttatagctaactgaatagcttctaatcccgattccttcaaatccccaccagcggaagggcgcaacatattcaaattaccttttaacttgtttttatcggtcgtaaactccaaaaattctaaatctttatctgtcttcagattgatatcccgaaatgcaacgacagcaaattgggaacctgctggaacggaatcaacaaagcctttcaccttctgtctcacataatccagcgtccctgtcatactacttgtaacatctatgacgaacacaatatccgtagatttggagaaggtggtggatatctttttcagaatcgttgtgttggattgtgattcggaagcatcttcattttcctccattaattgttcactttcactggttgtcaaaacctgcggtggagcaagaaaaatcacaacgctctgagctgcaatattccactttaccttcgcacctagcgcctcgcttacaaagcgaataggaaccattactttgccgttaatgagcctcggcgccgcattgagacgcactaatttaccgttgatataggcatctctggagcctacagttaacttgatcgttgtatttcctttggttgcagtaacagtcttggtagctccatcccatttcactttcgccccaagcgcctcaaaaacggcacgaaatggcaccagcatacttccgctaatagaggtcgcaggctgctcatattgttgcagtttcccgtctataaacacctcaaccttctgagccttgttattatttatgggaacaaattggggtacagacgctgccgaatttcccgactggtcgatcattttgatataaaagtagtatccacccgtagataaattcaggttactcaaagggtaggtaaacgttgtttccggatcgaactgaatccgtttaattaattgagcatctgcatttttgaccataacgtatgaagtatacgtgggttgaatattttttattttcaaacgaaccgaaaatgacgtacctgaagagttgattgtaaatgtacccggaaaattttctccagacgggatagtcaaagggatttccggtgactcatcaaccgcttggtccactttaggctccacgacaggctgggttacttgagattcaattactttcggttcgtccacaggttgagcaacctcgggtttactgggagtggaaatctcttttatatgggtctccacctcaggctgcgttactttcggctcctcctcaagtggagttactgtagattcatcgactgactgcacagaccctttcatagttataggaagttctatatgattttctgatcctgaataaggtgctggtcgtgaatccgcaatcgtaattgtagagttggcataatcaatcgtaaagtcaccagaaggaatttcaatatagttgctatacagacgaattggcgtatcaggcttaatcgtaaacgggagatcgaatttaaacactctgtttactccattaccatcatcaagggtaagcttaagcttatctccatttctgaatactgtcgaattggcagcgtgaacactttctgtacacaaagtgaacaaccctacaaaaatcgttaaaaacgaaagtaggaacatcattcttttgagcttcattcttatttccccttttgcatctattcttgtcggtaaatcatagcatagggttagatgaagttcatgccatatgattacagttatggatatgcgaactcactttttccatcattcgcgctctgctcttctgttcaatgttcatatgtatcttcttggtccgcttcttcaacgtggcatacgtaatatagccgccttcagtgctttagtcccttcttcgcttttcaaataatgcgacggtgtttcgtggccgagtgcggggacttttcgatccatccaagtcagcaaatactcccccatatcgggcagcagcacaatctgaatctcctttggaattttactttcggccacttttgctcttatagccggatctacctgatcataccgctcctgatagagctgaaccatgttggcccagctctccggcttaaactctttcaaatatatgtctctcatctacgaatcctccttagggcctcagacaacgcttctcatgctggagcaaccattcttttctccatagccctcctgcatagcccgttagtttctgattggaaccgataattcggtgacatggaatcacaatgcttagcttattttttccattagcactgcctacggctcggatcgctttttcattcccaatagcaagagcaatatctttataagctgtcgttttaccgtaccccacggacaccagagcattccatactttttgctgaaaatccgtaccttcaaaggcataaggaaacgtaaactcaaagcgctcacctttaaaatactcgtcaagctgggtagcgcattccgctaatacttggattggaacctcttctatagccctcgttaagagctcattccgattagagaacataatagaatagacagcctcatttgtgccctgtatctctatctctccaatcggcgatacatacttcaatacgtatagttcgctcataaaaggatacgacctccttccttttctaatccttactcaactttctatactcactaggagaacaatggttcaagctgcgaaacgccttatagaaatgggagggactttggaagcccgtctcatagcaaatctcaagattcgtaagatttgtacttttaagaagataggctgccttatctactcttattttttccaaatacgtacgcggggtttcggcggtttcctgtttaaagatccgatccaagtaaaaggagcttattccgatatgatccgcaatatcctgcaatacaattttttccttgtaatgattgaccaagaaggttaccacattctgcacaagtctgatatacggcgaatggtctgtatggggctggcatcttttgcaagcacgaaaacccgctttttccactttgtccaaatcaaagtaaaactccacatttatttttttcggctttttggatcgacaggaaggtcggcagtatatgcgggttgttttcacagcggtaaaaaacaacccgtcatacttacgatcacacgctataattttctcccacatttcttcaaaagaaagactaaggttagccatgatcgaatgctctgtcctttctatagttcatattcatctagctcaaggattttgcaaaatcctcatataaatgtgatgtatcttgaagctctatcaactgttcggcattcttttgcaaagcaactattatcttatcagaaaatgcatttccaaagctaaaccgtttaacacctaactgctgaagctggtggacattcgtcagacccggcagggataaaacattaagcggagcatgtatatgaaacacaacttccctgatctcttcatcactctttaatcctggaacaaaaattccgctcgcaccactatccacatacgctttggcccgctctatggtctctgaaagtggggcatccatctgcaaatatgtatccgttcttgcgtttataaaaaacttttgaaacccacgcgcatccaatgctgttcttattttggacaacaggttgctgtgtaggcccacttctcgaagccccttttgcgttttcaaagaatcctcaatattaatccctgcaactcccacatcggctacccttaaaacatgctcaacaatcgttgctgtatcctccccatatcctgattcaatatctgccgacactggaatttgaacatgctcagcaatcgtccgaataacgcttacatgctggtcaaaatcaataagctctccatctgagaatccaagcgtattggcaattccccagctcgtcgtacctatcgccttaaagcctgccttctccagagccaccgcagatagcatatcccaggcgttccctaaaaataaaagttcctctgatgtgtgaagtgcatgaaactgatgaattttgttcataaatgtagcctcctgatatgtgatgtatctcattttatcaagagactatctttgtttcgtcctcattcttgcacttatggtctgtaggaatctgggaacaactaggtccatttattcacatataaatcataatttttgaaaaaaacggttatttaagctctattcaatcctatgcttcttatctatactcttgctaaatcaattcgagttagatgcaaatctacgcttttaggctttcacaattacattattataggaggagttatatgtataaaacaaagtttcttatgatcttgctaagctttactgtaatcgcttctttctctagcttgtccggcccttcacctagcaaggcttttgctgaagagaatggaaccccggtgcagaaaacgatcgatttaaatgagggcttcgaccattcaaatgaagctagtatagagccattatcccttaccagcgaagaagctactagccaagcaacggttacagctattgatcatgatgctaatttctcaccttcaacacttcagtttctgaaggctaatacaggactcgacggtgagcaatgggataatattatgaagctagtgaacaaaccagagcaagattctttgaaatggactgaattctatggctatgctgaagatatcggcgataatcgcggatacacaatcggtatctttggagcaacaacaggcggctcaaatgatacaggacccgatggtccggacttattcaaagcttttgatgctgctagtggagctagtaacccttccattgcaggtggattaacacgtgctggtctgaaggggaaaatgagtggttcgattctaaaactcagcgatagcgatagtgtaatcaagaagaagatcaacgctctccaaaacaatgaagcttggagagaagccatgtggcgtacgttctatgacacctatatcgaatacagtgtacagcaagcacagaaacgcggatttaatactgctctgacgattggatcatttgtcgacacagcacttaatcaaggcgctactggtgattcaggtagtcttgaaggaatcctctcacgctcaggcagtagtacgaatgagaagaagttcatgactagcttctatgctaagcgtacattggttgtcgataccaatgattataaccaacctcccaatggtaagaatcgtgtgaaacaatggagttctctcttagcttctggcgaaacagatcttaagaacgcagatgcagctgtgatcaaagcaacgaattgggaactgaagtaaatataatatacgtcattaggagggcatatcgtatgtcctcctttatctatttttcatgaacattgagttggcgatgactgctaacaacatcccattctcccatacagttcctctcatcattcgagtatgtaggtcgcgtgtacaaatagagagactgtcccagaagcccgaaagttgcaagctcctgaaacagtcttgtaaaatggtttatgaagtcgaaataaggctgttagatgattcgatagccagatggcagtctaccgctactgcggatattacggatttgctgcaacgtcaaacgttgattggtagagataatagattccacatcattcccgcgaatcagatcatccaggtcggcgatgttgcgattgcctctgaacacacggaagttacctctaaaccgcgtgccagtaaagagtacaagcgtagcattgctgctggtagaaaagaaacgcagactttcgatgccgtcgagaatgttatcggtattacgaatgcctaggtttcctctgaatactctcctggaaccccgaaaattttcttcgttgtagactgtaagacgtggatacgtttgggatacatatgctttgttgtccatgttgtaattcctcctttcaactttatcttatgcttcaccatccgattggcgcgggcctcgcagcatccatctaaaaatggttatatgattgaatagagcagacgcagacttgaaaaaggaacatatgttctgtataatctagcttagcaatttggaaaatcctgaactaacggagatgcggacatggacgataaatttattgaggaactacgtgaaattagcagaaacgacaagcgaagatccgaatttcttattaagggtatgaaggaaacacttcaggaaagaaaagaaaaaaactttatcgaaagatggatttggcgacaaaaaaataagaagcttatagcgcggaagtttaaatcctagtagatataacaactgaatcttcatagcattttacttttcatagcactttaaaagtgcttaggtcatagctcatttctgtcctaaatataaaaagccctcgggcgttgagggaatgatccgacaatccatcccagaggatgtaccattagttgcccagtttctagctggtttttcagaagaggctttaggtagttctatgcccgtatccatggctaatattgctcattcaaatcaaacaaggcccgcaatgttatccatcgctgggcctcctcttcacttacctttacacctttactccgtaacacccaatcctgtgtgaactgaggatcttcgtgaaagtaaatatacagctacaatggcgatgacgacaccggctgctccaaaccaagtgatggaagccagcgaaacctgaccaacaactacaccgccgattccggctccggctgccatagcaagctgcatcgtagactgattgagactcagcatcacaccggaagattcaggcacaagtgtgaccagattatattgttgagtaggtccagttgtccaggctgcgaacgaccaaaggatcaataaagcaaatactgcgatcagggaatgagcggcaaaaggaagtaagagtaaggaaataccgtgcagcaccatgcccccgaataatgtaaaggaaataccctttttatctgcgctgtatccaccgattttcgacccgatcagactggcgattccgaaggcaagtaatactgaacttagcatattatcccctacccctgatacattcagcaagtacggtgaaatgtaagtatacgcgagggaataaccccctccccaaaagaaggtaatagctaatcccaaagcgacttcaggctttttcagaagagcaaactgttgtagtaaggggatcggttgatctcctttcaagcgaggaagcgtcataacgataacgatcaaggcaataatccctgtcaacgcaatgccgagaaatacggttttccagccatacgcagaagatatcattcttccaagtggcaccccgataatcagcgaggctgtaaaacccatagtgactgtagcaatagaactggcctgtttgccggctggggcaatttttgctgcaatgctcagagctgtaaccacaaccatccccgctccgagggccataagaatacgtgcagcaataaacattccaaagcccggcagtgcaaaggacagaacattagcaactgcaaataatccaagggaactcaagagcagtttgcgtctgtcccatttagcggttactgccatcaggatcggcgttccaatcgcataagccagagaataaacggtaatcaactgacctgcagccgccactgtaattcccatcgtcgccgaaatctgatccaaaatacctgcgatgatatattgagatatgcctaccaaaaaactgacaatggccaaaatatacactttccacgtactctgcatttttaaataacgcctcttttcttttgatatttttatatttttacaaatatcgaaattaagactaaaaaaatttatgttattaggaacggggcatatttctgcgctgcttccacatccaagctgtaataaataaacgtcccctctttacggtatgtgagcagccccgactctgccatttgcttcagatggtgcgatagtgttgaaatagctacactgttcagcttctcgcccagcacagagcagcattggtcactttcctcttttagcagaagtgctattttgagacgagtgggttctccaagtgctttatatatttttacagcttgctgcatctctgttgtatctttcaccctgttcggctcccttctgttccagtcttaatttcgatgtttgtcgaaataaagttatcacaaacatttgtaaaagtaaacccgtttattataaaggtacagcttttttacactctgaggtgtgaatgatggtctttctcatccgatgaataatcccccatccataaaggatggagggaaaactgatctgagtagagagggagaatcatggatgccatggcgttaattcgggcttgccgtgggtctgacaataatttcattaacatctacatccgctggctgctccatggcatacagaatggaacgggctatggcatcaggcgaaatcgaaatacgacggtactctttcattccttgccgggcctcttcatctgaaatactgtcagcaagctcagattcggttactcctggcgataccagcgtcacacgaatatctccccccacctccatacgcaacccttcagaaattgcccgaaccgcatacttcgttgcgcaatacaccgctgcagttggggttacactatacgcgccaatagaggcgatattaataaactgaccaaatccttgctttttcataatcggaagccctgccgcaatcccatgcagaacgccccgtatatttacatcaatcatgcgatcccattcctctaccttcagagcttctaattttgaaagaggcatcactcccgcattgttcaaaattacatccacacgcccaaatgttttttccgcgtacttaatgaacgcttccatctggtccctcttagtcacatccagttgctgataatcagccgatccacctttagaacgaatctcggatgtcagagcctctagtcgctctgtgcgtctggcccctaatattacatgagccccatggtgagcaagtaaacgggcagtagcctcaccgatcccactgcttgcccccgtaatagctacgactttccctttaatatccaacatacttattcctcctttagtttaaaaacggactgaaacagattacttttttacttccctgtaaaaaaccatccctgcatgatacaaaacaccatttttgaatacaccatctgccgtaaatccggtgtcgtccacatattcgatatagtcatcttctatgatatagctgcctgtataggcactttgtctctgaccccgtgcttcatcataacggccataaggcaagagttcttgacggatatttccgtcttcagttacccacatccctatatagggatgctgcgaagcgtgtacacttttttccgctttgttactctccatgactcccactcctttgtccttctatttttttcaattgctcattaggtgttgtatctgcatcttattatgagaggaatgtccatcagcccggtagaagaatcagagcaaattattgcctaatcctccaaagacccttaatatgtaataaactactggaaatgaaaacgggctgctttgcaaagaagggatgtgtcatgatgggggcaaccaaaatagagggttctaccatggaaaaacaagccgagttggcaaggctcatagaacgattttcaaatcaggacggagttctcactacagccataccttcgcttcacttcgtccgaagttcaaatacaaccgttccgatacatcaagtccatgaacctgccttatgtattgtggcacaaggcagaaaagtcgtgatgctcgcagaggaaagttaccattacggcacatccgactaccttgttgtgtcggtggatttgccgatctcggggcaggttatccaagcgtcagcagaagctccttatttgtgccttcggctcaattttaatccacatcaggttttggacctgatcaaagaatctgcttttcccacaagcccaatgcctgattccagacgaggcttgtatgtaagccaaaccaactctctactgctggatgccgtgataaggctagtgcatcttttggaaaacccgcaggatgttccggtgctggctccattagtcattcgtgagatactgtataggattttacagggtaatcagggggaatctttaaaacaactggtcatgaccggcagccattccaaccggattgcagaagtcataaagcggattaagcaggattatgataagccgttgcgtattgaggaattgtccaaattagcgaatatgagtccttcgtcactacatcgacattttaaagaggttacggctatgagcccaatgcaatatcaaaaacaattacgtctacaagagtcccgccgcctgttgttatccgaatcagcggatgcggcagatgtcggttttcaggtaggttacgagagcccctctcaattcagccgtgaatacgcccgcttgttcggcctgcctccaattagtgatatcaaacgcttgcgctcggatcaggatcacccgaccatttgaaccgttgttagatgaacatctgaaactactggtcctactaacgcttatcccaatcatacatggcagaatgtaaaaaaacagcacaaaacagccgctcctccggtagagacgcggctgttcaatatgttcctctatgcatgtggtcatcactatttgagcatcaatacggattatccagcttgacgaacaaggctcgaatgacatccttctctgccgaagttagcttttgtcctgcctgccattgttgaatctctttcttgacttccttgggttctctatagctgagagcatacccgatgcttcctataccttgtgtgcggttggttttgtccatatttgccaatgctcgagtcatcgcagttctatctcttgtaaacaaacctcccataagaccagcatagctttcgcttaaagctccatccaatccgtcagaagcctggatcacatttgcaaagctttccgatggaataaaagcacgctgcctatacagatattcgataatttccaggctttgatgttcattgattttgttcatctttccccattgaattcctgctaaatggtccgtcatatgacggacttttgcttcatcactgagggatgaatccttataaaaggacagcactagctcctctttactttgctgggtatgctgcgtattgactgcaatttgcttggactccccattgtttgccccggacggcgccgcagtttcagcatcctgtcccactggatggggagtgcaccctatggttacagccagcaatagtgcagtacaagctacagatacaaacccattaccttttaacatgaatccactctcctgtctgaacaaacaatggtcgttataattgcccaaaatccaatcataccctactactcatcacgccctaccgtgggcttacggatcacagagacgctcgattccctcacgatcagacgaggctcgaattgcacacgctcataatccccaggtgtctgttcctgaatccgcttgagcagcagctccgcagccaaccgtgccacctcttcccccatgatggaaactgagctgatctgaggggtcgttaccatagcccacaaattgttatcaataccgactacagcaacctcatctggcacctttacacccaaatccttaaatcgattgacgatccctatcgccaccatatcattaaccgcataaatagcatccggcatatgtttcaggctgtaaaaataatcggctgcacgcagccctgtctcaaaggagaaatcatcgccaaaataaacgagtgaagggtccacatgctggagagactgctcataagcgaagtatctctcctcgattttgtccttcgcagcgcctgcataggcaattcttgttctcccgattttaagtaaatgctccatcacaagtcttccctcttgtcgggccagactgacgatatccgctttgacatcttcgcccagcttcttgccatagttaataatggacacgggaacgctggctttgttaatcagatctaccaacattttgggatacgccagcggcataatgatgagcccgtcgacatgcagcttcttgacctcacgaactgtttcaagctccattctggcattcccggcggtattgatttgcacgacccggtaaccatgctgcttggcggcctgctctacggaccaagcgatctctggaataatcgcgttacgaatgtctggcacggccagtgcgatttgtcgtgtctgacgaactttcaagctctgagccgaggtgttgggcgtaaaccccatctcttcaatcacttgcaaaatcaaggctttcgttctcgggctgatgccctcactatcgttaatagctctggagacagtcgcaataccgactcctgcccgcttagctacatcctctatggttactttcttttgatctgtcacgcccaaaatcctttcaagaacggaatcgttttctgaccttctaaaataaagtcttaatgttgatattataccacagaatgtgtgtctaaaaattgaagtcgttttcttcttgtctttgcctcacctaaaaaattcgcaaaatctctttgtatgaaagtaaggagccaaatatagcactgtagtcacaagtgattatattcacaaaaaagtcaagtgctttttgcattaaattggtttgacaatgtgtaaaaattgtgacatattatttttcggaaacgtttcctaattcattcacttttatagaggcaatgatcatatattcttcaaggagatgacaaacatgcaagcattgagatggcatggagtaaaagacttacgtttggaaaacattgagcagcccgctgctctggcaggaaaagtaaaaatcaaggtagaatggtgcggcatttgcggaagtgatcttcacgaatatgtagcaggaccgatcttcattccccaagatgctcagcatccattgactggcgaaaaagcgccgatcgtaatgggacatgaattctctggacaagttgtcgaaatcggcgaaggtgtaaccaagattcaagttggcgaccgtgtagttgtagaaccggtgtttgcatgtggagaatgtgatgcatgtaaacaaggcaaatataatctttgcgataaaatgggcttcctcggtctggcaggcggcggtggtggattttctgaatatgtcgcagctgacgagcacatggttcacaaaattccagaaagcgtatctttcgagcaaggtgcattggtagagccttcggccgttgctttgtatgctgttcgtcaaagccaactgaaagtcggcgacaaagctgtagtatttggcgctggtcctatcggattgctggttattgaagcgttgaaagcttcgggcgcatctgagatttatgcagtagagctttccgaggagcgtaaagctaaagctgaagagctgggtgctatcgtgattgatcctaaaacttatgatgtggtggaagaactgcacaaacggaccaacggcggtgtagatgtagcctatgaagtcactggagtacctcctgtgctgactcaagctattgaatctactaaaattagcggacaaatcatgatcgtcagcatttttgaaaaagaagctccgatcaagcctaacaatatcgttatgaaggaacgcaatctgactggtattatcggctaccgtgatgtattcccagctgttatcagcctgatggaaaaaggttatttccctgccgacaagctggttaccaaacgtattaaactcgaagaagtgattgagcaaggttttgaaggtctcctgaaagagaaaaatcaggttaaaatcctggtatctccgcaagcctaatatcgaaaataacccagatgtctgctctatgcagacatctttttataaaaaaacgctctccttcctgcgacatactgtcgtcaagaggagtagcgttttttgattaccatttggattactgagttacatttttcagaacatcgtcaatcatttgactgtttgcaattgtacctgtatacaaccagctggaatccttaccaaaatcgtatacatggccttctttaacggctggaattcccgcccatacaggatcttttacaatatcttctttacttacgtttttgctgttcacgataaagatataatccgcatccagctcggccagcttctcaagcgataaattactccagttcgccttagccgttttggaaatctcctgtacaacttgtggaatcttgaatcccaaatccttatacaatacatcaccgctggatagattctggtttacgacatacacatttttatccgttacccacaatgccgccgcagttttttgtcctaccgtctgactcagcttggctttagcctctgctgcttttttgtcgtagttgctcaatgcctgcttcgcttcactgctcttattcagcacttcacccacggtcagcagctcttgacgccaatcattgttcatattagtgcctaccacgtaggttggagcaattttagagtattgattatatttgtcgccttccaccatgctcgcactgtccataatgattaaatcaggtttgaagttcagaaccgcctcaaacggaagatctgaagcaatggtaggaacgtccttcagttctttttgcaggtaaccttgaactgaatttttgcctaccgaccattgggctacaggtttaacccccagcgcaaccagatgatcctccagataagaagcgatcacacgctgaggctgagccggaattttcacctcatgcccaagtgcatccttcagcaccctttcctgtgatgttggttccgctgatgtattattggtcccttgcgaagcgccatcggttgccgtaggactggatgtgcctgagcacgcgctgagcagcagggtaaaactaagcaataaaataaatgccatggaatgctttgcgtttctattcattcgtaaaatcccttcatcatgattttgataatgattattatcctcaataacagtatgcagggcgccacttatcgaatcaatggaacattcggacatgcttaatggattatccagactggtatctctcacaaaagcagatgaatataggctgtcccggtaatgaaccggggatacacccgtatattttttgaatgcccggctaaagaaatagacatccgggtaccccacactgacagcgatatcctgcaaagtcgcatccgtcttccgcaaaagctccttcgccttgtccattcgcagttgaatcaagtacataatcgggctacaatccgtttgttttttaaataaccgggtcaaatgtctcggactgcattccaacaatccggccaaacgttccagcgttatggactccgcataatggacctgcataaatcgaatcgcctgtgtcacgatatcccgcgcagaagttcgagccttcggttcctgcaattgccgtatacattcatatgcaaaatcatagaaccgaccctgagcctgaatcttggatagcgcctcttgatcctgccatgcttcatccagtagttgcagcttttgatacagtataaccggataaggcggtgcaaaaccatgaactatcgaaggatgattatacatcgtgtgtcccgatagagaagtcgctttatatagtacaaggatatattcaatccgttgcgagggtttcatattcagttcaaagcctttgctgccatgcagtacgtaccctgaatgtggcgtatccttccaatcaccatccaaacgcacgctaccctgcaatacaaatacaaaagcctgcgctggaagacgatacggttgaagcaactcttccggctccagtcgaatatgccggacatccatgacacggatcgacgaatggagccatagggacagcagtttgtttaactcatcagcttcatgtcccttgctcatcccgatataggaacctgcctgcttttgccgatcctgcttcacgtatcaaagcctccgcttcataaatatcatacttttttcccaaaccaacctcattatatatcatcttttactgcgtctaccatgagacaaatattcctgcacgaaacaaggtgaatataccatttccatggtacaatttgtataaatacaagatttaaaatacatagggggtttgacagcatgagcggttccaacattgcattgtgtacaggagctaatgcaccattcggtaaggaagatacagtgcgggtcaccattacatggaaacatgcacctgccgaactggatgttagctgttttatggtaggagcagacggaaaggtttcctcagatgactatttcgttttttacaatcaacccgctgacccgcacggccatgtacgattacagcgtccaaatgacagaaccactgagtttactgtagcgctccaggaactggaacgaaccggggtggaaaaatgtgtgtttgcggccacagtggacggcccaggtacttttgccgatgtggtcggctgctcagttactgctcaaggcaagcaatcccatatcacctacagcatcaccgaagccaccagtgagacatcgcttgtgctggcagaggtgtatcgtcatacttctggctttaagcttcgcgcagttggacgtggtttcaacggaggactaaagccgcttgccgaggctcacggtgtcaccgtagaggaaacggaatcgccagcagcaccgtcagcggataaagctgacatgaaagaaacttctcctgtgagtggaagaatcaatctgcacaagcagaatgtacaatattcactaaaaaagaaacacatagactgtgaaaaggcacgggtagcggttgtattcgatgcttctgtttctatgttcaaattgtacacgggtgggacggtgcaaaaagcctgcgaacgtgtgttggctgtagccgcctgtatggatgacaatggtgaaatggatgtatggttttttgcagacaaagccaagcgtgctccaagcgtcacagagaagaatttcgagaattacattcatatgaattatgctgagcctagtgaagatagtgagctagggtggggaaataacgaaccagaagtcatgaaggatatcatactaaaatatacaaaagaagatcccaacgatataatcccgacctacattatctttttcagtgatggaggtatttatgaacagaaaaaaatagaacaactgctgattaaaagctcaagcgccccgattttctggcaatttgtaggtcttggtcaagccgattacggaatccttcgaaagttggataagatgcgcggacgcgtagtggataatgcagatttctttgccttggatgacttcgactcggtgacggacagcgaattatacgaccgtctgctgaatgagtttcctggttggctcaagcaagtgcgggctaaaggaatattgcggagctaatccttcaccgcaatgcgatactcctacatgatcacttaaatatccaccgagcagagcaataaaggcagaatgaccgcagatagagcaatcatcagcgccagcattctgcctctgttttcttcagtttgtcctctatcgatttcaatctccctaccagatcctatttctttcatttcctaattggatattttcatgtagtataagtctaattgaagtaaccctgtttgggctatgctgaagctatacactatatgaaggaggatttcatattgaaatcaaatgaagcaactttgcacaaaaagctgctcccacggcatattacctttatggctatgggtggagtcatcgggacgggtatttttaaaggcagtaccgaaacgattagcttggcggggcctggagttattttatcctatgtcttcgcgggactcctgctcttggtcgttatgggcgcaattgccgagatggctaccgtctatcccaacatgaatatgaaggattttattcgcaaagcttttggagaacgactgtcctttattatcggctggttgtattgcttcatgtggctggccgtctgtatcattgaggtcattgctgcgggaagcttcctgcaatattggttgccagatgttcctctatgggtactcagtttagtgagtgcagctttcattattgtcgtcaacatgctgagtgttggcggttttggggagctagaattttggcttgcgggtattaagattgccatgattattatcttcatcgccttgggtggctgtatactgttcgggattattcccactgaaactccaccttatctaagcaactacgcgcagcacggcggatttctacccaatggctggttggctatcttttcagcgctgctggtcgttaccttttcatacggagggtccgagctgattggactgacgttgacggagacagaaaatccggaaaaggtactgcctagagtggttaaaagctttattcttcgcgttgttttgttctatacgttgcccattctcatcatttgtggcttgattccctggaaccaactggatgcgaataccagcccgtttgtacaggtattgtcttctgtagggcttcaaggctcggctcatgtcatgaactttattctgattactgctgtactgtctgccgccaattcggggatttacggggctacacgtatgctacattcgctggctatcaatggagaaggtcccaaatcactcgcccgcttatcttcaaacggggttccggtaaatagtctcaaattgtgcgctgtagtcctgattgtcggttccatggttgcttatatcgctcaggacggactgttccgtattttgatggctgtacctggctttgtcgtgctgctcgtctggagctgcatttgtctgtcccaattgaaattgcgcaaatcttatccagtggagcctactttcaagatatggggattcccttatgtaacggcgcttacagtaggatgcctatgggtaattgcgttcctattcttgcttgacccgcaaaatcgcattagcattagcgtgtgcgtggctttcatggcatttctgatcatctggtctttggtgaagttccggagaaagcaggcgtaagcagcacatgattcaatcgtacctatttcctgtttcgtatgcctttcttgcgtttccttttgctgcgttattgtttacactgccttttctaatcgtgcaatatcgcaggcatggctatattcacaaggctagagcatggctgctttacttgatgcttttatacttgatgaacgccttctttctggtcatactcccgcttccggcatcgcgtcataatgctgcattagccggaggagcgttgcaattgatgcccttgcagttcgttcaagacattataagagaaacatccgtctcacccgctcatccctccagctatgttcatttgctgaaggagcgcgcttttctgcaagtcgtttttaacgttgtgatgaccatgcctttcggtatgttcttacgttattatttccgtgcacgatggggatggtgtctgattctgtcctttatcctctccctcttctttgaggtaacgcagttgacaggactgtatggattttttgaccatgcgtatcgcgtgttcgatgtggacgatctattggctaataccttgggcggcatgctaggctttctattaggcgaatggttttcacgcttcctgccccgcttggaacatctggacaagcatgtggacatggcaacgaagcgagtgtcctatacccgacggggcgtagcctttttcgtggattctatcatatggatcgggctactcggcatcatggagtctctgcatgttcctgctgccttctgggtttccagtggagtctactttatgggggtcccttacctgacgaatggacgaactcctgggaaatggctggtgcgtattcatcttacagggacgggacaacggatttccctatgggggctcatcaagcgttacagtctcttgtattggttgtattttggacttaattacgtactgggtggacccgtgctgtggtctcaagtctctccatgggtaagtgttctgatcagccttttgttgttggtgatgaatggatggttctttttccatctggtcatacgtctaatcaagaaagccccgttattttatgaggagcttagccatacttcgcaccaaattatatggcccaagcattatcatcaccttcagaatgacaccgttgattcggcagagacgccgggagaaaataccgtgacatgataaccgaaagactgacaacgtgataagcacccgcgatctacgttgcatccaagcaaataaaaaacaggcgaagcaaaggaatttcctttgtccgcctgtttttttatgttgtgtatagatgttagttcgttttgcttatttccactgtgcaatttgatcaataggcaatcgtgtggacggatgaccatcgttgatacctttacccatggaaatgagcataacagggacataacgatctttttccagaccaaaggcttcagcaatttgatccttttcaaaaccgccaatagcgttggtgtcgtagccatgagcgcgtgctaccagcataagctgcatggataccaagccaccatcgatcaggaccgtttctttgttcacaactggatcaagcgctgcaaaatgggctgctactttttcctgttgcatttctttaatgtcttttggcatatagcccagttctacagcttctccgaaaatttgttcgaaattatcaaagttgttcaaatctccaaatacagcaatcactgccgaagatgtttctacttgacgttggttgaaacgggccaatggtgccagtgtagctttaccttcagggctgtcaatgacaaggaaacgccaaggttgcaggttaatggaagatggtgcgcgtgtagcttccgtcaaaatctcggtcatttcctcgcggctgatcttcacggacggatcgtatacttttacagaacgacgtcccagggcgatttctttaaaatcattcgtttttacagtactggatgtattcgtattattcattccaatctctccttgtccctctgtgggtatagtaatgttaaaaaaaatgttgtcagtccatatcagatatgtgactattcatcacttgcagcatatcagctagttggtgccgttgggtctcgtcgaagctctgtagtagctgagctacaaactgcgagcgctcctgcttaaagatgacaatgcgtgcacgcccataatcggtcaggcttaccaaggtaaccctgttgtcctctggcttcgtgcgtcgtgtgaccattgctgtcgcttccagttgtttcaaatggcgcgttacggctgcagcgtcaatgccaacctctttttgcagcagagtttgactaatctcctccacttgatacaacttgcacaatagctgcaatctggatgcgctgactcctgcacaacgctcaaacttggagctaatctgcttgttcagcaacaacagcatgtcaaaaatatactcaggctcggatggtgtctgggtgatatcaatctctcctcccttaagcatatcgctgggcttcatgatccgacctttgatccatcaattattgatctatcaagtaatatacatcctctttaaaaataaatcaagtccctgagaaaaataaagtgctctttgcaaataaaagctgagcgactcacacagagccactcagcttttgtttcattagcttacttattcaatcatcatgtaatagcagataagggttggtataccgttaagttaaacaatcccgtgggacagcattgcgtcggccacacgcacaaatcctgcgatattggctccgacaaccagattgcccggcacaccgtattcctcagccgccttcacgctgttagcatagatatttttcataatatcatgcagcttggcatccacttcctcaaaggtccatgacaggcgcatgctgttctgagacatttcaagcgccgagactgctactccgcctgcattggcagccttggctggcccgaacaaaaccccattgcccaaaaacacttcaatggcctgtagcgaggatggcatattggcaccttcgcctacagcttttacgccattgcttaccagcagctgggctgcttgctcgtcaatttcattctgtgtggcgcatggcagtgcaatgtcgcatgggatcgaccagatccccgaacagccctctgtatagattgcgcctggacgctcttgagtatactcgctaatccgcagacgattcacttctttcagctgctttaccagctgcagatcgataccgtctggatcatagatgtagccattcgagtcactacatgccacgactgtagcaccgagctgctgtgctttttcaattgcataaatggatacgttccctgagcccgacacgacgacgcgttttccttcaaaggacgatccctgagcctgcaacatctcgtttacaaaatatacacaaccgtagccagtcgcttctgtacgcgtgagactgcctccgtaatgaatccctttacccgtcaggacgccaccttcatgtcctccgcgaatccgcttgtactgcccgaacatgtatccgatctcacgtccgcctacaccaatatcccctgccggaacgtcggcatctggaccaatatatttatacaactccgtcatgaagctttgtgtaaaacgcatcacttcgttatctgatttccctttggggtcaaaatccgaaccgcctttaccaccaccgatgggaagacccgtcaatgcatttttgaaaacttgctcaaaacccaaaaatttgacgattcccagatatacagacggatggaagcgaagtccacctttataaggccctatcgcactgttaaactgtacgcggaagccgcggttgacctgtacaacccctgcatcatccacccaaggtacacggaaggtaatgactcgctccggctccactagccgttccagaagcccctgctgcatatacttaggatgcttagccaataccggaattagcgaatccaatatttccttgacggcctgatggaattcattctcatgaggattgcgcgcgataaccttctcaaaaacggactgtacatattcggctgctgcttgttgactctgctctggacggatcatggtcattatttaatacaccccttttataattagcccctctgttaaatgacggaacgacgttattctgcaccttcgagagtggaactttatgtattcataaaatttagttaactatacatgattttttataataatacatctaattcgcctataaaaaatttttgtatccttcatcaaataactctatgaacctctcattgcctgttagtttattaaagctaaatcccttgattcacgggcttttttcacgatttctaaggccctaacaccttaccctacatggcattataatgtgaacaaattgaaactaaaacatacagcacatctggaaaatatggaaataaaaaagaggctgcgcgcagggcgtagcctcctttcccattcttttacacataaaaggcttcaagctgacgcacaatttctgcctcgtcatgctctaccacctgctgatgctgcgatttcgagaacaattgttcaatttgcgtcgggaactcctgcttgatgtccaccagacggatagcttcatcaaatttggctggatgcgctgtcgcaaaggttacacatacttcgtccgcgccattatacgcctcatacgcggcaataccgcaagccgtatgcgggtcaagcaaataatcgtattcggctttgtattttttgatcagctccagacactgctcattcgaagcaccgagcgcttcaaaatcctgctgcacccgttttaaatcctctgcactgatcacaatccgcccctcggtcttgaggttattcatgtattcagataccttggctgtatcctcaccgaggaagtaatacaggtatctttcgaaattgctcgccacctgaatatccatcgaaggactgtatgtgcttttaaagtcacctggcttgtattcgcctgtcttcacaaagcgctccaaaatattattttcattcgttgcaataatcagcttatggatcggcaagcccatttttttcgcaagaaagccggaaaagatattgccaaagttgccggatggcacgctgatattaatctttttcgtaccggcagactcctgcgcccggaaataagcatagaagtaatatacggtttgcgccaaaatgcgcacaaagttaatcgagttaatcgctcgcaaatgatgtttacctttgaaatccagatcggcaaacaggtccttaatgactttttgacaatcgtcaaagttcccttttacggacagattcaatacattttcatcgtctaccgtcgtcatttgcagctcttgtaccttgctcaccttttggtgtggatgcaaaatacagattttaatgccttccttgccacgcacgccctgaatagctgctgccccggtatcgcccgaggttgcacccaaaatgtgaatgatctcattctgctttttggacacataggaataaaactcacccataaattgcagcgccacatccttgaacgcgaacgtaggcccgtggaacagctccaaaatagacagggaatcgttgatcttcttcactggcgtaacttccgggtgacggaagctcgcataactgcgctccaccagctgctccaaatcttcacgaggaatctcatcattgatatacagcgcaaaaacttccagcagcagctctctgtagctcaatgtagcccattgctctaacgtagctgccgacacggtcggaatctgctccggtaccatcagacctccatcgtcagctaaccccatgagcacggtatcaataaatcccttggcttctactcgacctctagtgctaatatatctcatatacatcccccaataaaaattcaattcgaaccttttttcgaatatattattgtctataataccctgtcgcggtgctgtaaccaagcctttttttcatatttcaaagactttctcctactttaccataccctaatgcatcaggcatctgtaatcgctaggcaatcggaacgtcagaaacaggccgtgagtctgaaaaaagaaggctgctccagtcattaggaacctgaaatcgagagtgcagccagcttgagcgaaggcgatgtacagcttcccgtaaaacgtaaatcgttgccaacttcctctacctgctgcaacacatcaaagaagttgcccgatacggtgatctgattgactgctctgaccacttgcccctgttcaatccagtatcccagacaagccagcgaaaaattaccggacgccgtattcgtacccgcatgcagcccctgcagctctacgatcatcaatccacgatccgtcttgcgaatcatgtcctccaacgtagacgtgcccggttccacatacaggttatgatacgacacaccaattttgccgttatagctgcccttggaagcatgagaggtactttccaccccagccttgcgggccgtctttcggttatggaaatacgtccgtagttctccgtccttgatgatctcattacgatgcgttgcgctgccttcggcatcaaacgtactgcctgcgggaacgttctccatcagcggatcatcaatcagcgtgatatgtttgcttgccaccttttgccctagtttcccagccaagcgtgaaaagcctttatccaccgactccgctgaaaataccgacgtatacgcagccagcaattgcgctgctgcatcatgacggaaaatgaccggatagttatccgattggatcgtgtacgcacccagcttggaaacagcctcttttacggctttacgcgccacatccacaatatcgatttcctccacgctccgcagggaataatcatgccagcccccggtaacggtctcgtcatggtctgctgcaatcacatacacataagcgcttgccagacttttgcgacgatggcagtgcaatccttttgtatttactatcagaacctcattttcacgaatgctgaccgagcaatgccgagccatcacaatccgtggatctgcggcaagcgctatgcgctccatttccagcgccgcttcgatcagaatctcaggagccgtgtcagccaacgctgcggcataggcaggctgctcagggtagctctcagagcctgcgaacagctcatcttgttcctcgctctccaatatgtccgcattgctgcgtgcctcttccaataaaaagtcgatcacgtccggttccagcttctctgtagaggcatagcccattttcccgttaatgacaccccgaaaggaaagcccaccgttctccacgatggtatattggtcaatctctcccttcagtaccttcactgaggtagagcgtccatttacatagtagatttccatatccgcgtagccaatttcccgacctttggtgaacaacgcttcctgaaattgctgaatattcatcgcctattcccccttccgtccgccgacggtcatctcggacactcgtatcgtaggctgtccgcagttgaccggaagacttccgctgaccgaaccgcacatcccctgaccatgatccagattgttgccgaccctatcaatattttgtagggtttcaatccctttgccgatcaacgttgcgcctttgaccggctcggcaattttgccgttgcgaatcatgtacgcctcttcgaccgcaaaattaaactcgctcgtcgaggtgttcaccgaaccaccgcccagcgatttggcatagattccgtactccgtattggcaatgatttcttcacgggtcgaatctccgttcgcaataaacgtattattcatacgggaagcaggcgcgaatttataggactgtctacgtcctgaccctgtcgcaggcacacccatctggcgcgagcccatgcggtcgatcagatatccttttaaaatgccgttctcaatcagtacgttacgctgtgtcggcgctccttcatcatcgatattgagcgagccccatgcattcggaatcgttccatcatctatagctgtaacgagcggtgaagccacctgctgcccgatcttattggcaaacacggaagttccatgggccaccgccgtagattccagcccgtgtccacatgcctcgtgaaaaagaacgccaccgaagccgttctcaattacgaccggcagtctgccactaggcgcatatcccgctttgaccatcgtggtcgcaatccgagcggcgtgtctcgcattttcttcgatattcagattctccagaaattcagtccccgcatacgctcccggcccacggaacccggattgtctatgctccccatccgtcgcaatcgcgcttattctcatacgtgtatacgtacgggtatcctccaccagtagcccgttgctattggcgatcagcacgttctggatcgagttactgatccctatggaggtttgcgtgatggaaggatcgtattggcttgccgcctcatgcgcccgtctcatcatgtcaatcttggcacgtttctgtgaaccgtcaggaatgatcgcaatcggatgttggttagggatagcatgaggatggagtgtaatggtgtgtgtacctggcactccacctccgcgaatggccttggcggccgatttggccagtcggatcaggctctgttcgctcatatcactggtgtaggcatacaccgagaaatgctccttcataatccgaataccaatcccaaaatcccggcctgacagcgccgtatccacgattcccccggtcatgcccagttgtccattggtgcggtcctcgacgaacacctctgcaaaatctccgcccgtctccagcgcggcttgcagcatatcctgaatctgtgttggatgtatcatcacgttcctcctcgtttttgccatgtttcttattgtacggttattcgttcaagataatatgcgggttcatgtttatttcccataactttactatacatgatgttgggagtgggtgtaactatctgggtggcaagtggtttggaggaggtgaagatttatgcgcggggattaggggagaaatgagaaaaacccgattagaccgtgaagggtcatgtcgggttattgagacaattgattactgtttgggttgagcaagtaagtgcatatgaggccactacgtagacggatcattcttccgatcgctgttgcccccagatttttgtgattatattttaacggtaaaaatccgggttcaaaggcgaacgctccgcttcttcagaacgattccgtccccttcgctgctatgcttgggtttgcttcactttgttccaatctctaactggttagttaaaatacttttttctaaacggatatagtacaaaacatggtttagttcaatctccgttgagtgtaaataataagccgcttccttaactgaatccatgctcaacgctcctgctttggcagcgataatgttaaacgcatctccaagtaatttaatacaagtttgaatcctctctgtgtattgcttttcaagttctactaacttttcatactccgctaccatgtcactctgagaagtcaaaatattccccaccttttggtacgtatatgagtaccagttttacaaaaattatatgttacgtttatgcgtatcgtcaagaaaaatttgtaaaataaggtgggaactctaatggcaaagaaagtagttgtgaaaataaacgaaattacgagaaaacacaatatctccttgagagaactctcacgtttatctgatgtacgacatgctgctctaagtgaacttcaatccggtaaacgtgaaagtatcaattttaatcatatcgaaagaatagccgaagccatgaatattgaagatattcgggagattattgatttggttgatgaggtagaacaagagtagttatcatttgctattattccttacccagaaacccataggtatgccgagcaacctcttgaccattagtatttgaatagagtactataaagcccttttccagcaaacgtttgagtttgtcattattctctttaccacgtccacgtccagtttcgatggtcatgattgggaagagatttttctgaacggattgctattattggattttaagttgaaagtatcttaaatggttatgtattctgttctagcatcgaatttcttgttcattatttttcgtgcaaaatataatacatgaaggtttcacttgtttgtttagcatctgttaaagtgtatgccagcggaaattcgccagtttgctctgttacatcgtcaagttgatattgccatatatggtattgtctttttttgattacgttatcctccgatattttagtttaaacatagaactaatgttcttattttattgtatcgtatacatgttcgtattaaaagagtttactttggaaaaagcgttccttaagagaagaaaagtttatgttttgaaaacaagtgagaataggacgaaaagacccagcacatgctactaggccgttgaaacttgaaggttgtcccgaggccacctttaaaatcatgaaaacagaattcgtaaaccaaatgaactttcatagccttcgtcacttggaactggaattctgtgatgatgtgaacttgtataacaaacaccagatacatggaactctggattatatgacatccatcaattacagaaaatagcccttaaaaaagttgtttaatttactgttaaaaatctaacacctcccttttgattagccagggcgattaccttggtcatcgcatttcctcccttcgacgtaaaaaagccgactgcgctgaatttcagggcaatcggctcttaataaatatctatataaaaagagagcgtccggtaatcctggcgctctcctggtcacacgagatgattttaatttcaagataagttattcctctattttaaataacttattttcctgagataattctacaacaatatgggctttatcaagtaggcttacaggcaacttatccttcagaatagaaaccactaattgaatattttctttacttacataatctgcaactttaatcagttgattatcatgcattaattcttttttgtcatttagaaggaagtgcaaactcggtattttttcctcatcagcaaataatatagctgcaagatcaaagcataaaatctcaccctgttttttgcctgagcttaaattagcattgaatgcgctgaatttatatatctgctgctggctctttttatgaataactttatcatacttcaatgcatacttctcaccgtacaattcaaaagaaatttcagaaaaatgtttattaaacttatgaatttggcctcttaacttttcttcaaaacttcctgaaaataaaacatcatcaattactttaatttgagcatcaatctcactaatattttcctctacttcatctaattgcgagataatactctcatattcacccttaattctatacttatcattcaactcagttataatcttttctaactcctcaaaggagtcacctttagatatagtcattgccaactctctctcctgagataacaatgtatttaagttcttttcttcagtctcaatttttacagttaaagaaggtaaatcagcagttataaacttaattttttctacaaccatattgttgtggtacgctactaactcttcaaaggtcttttgtaagttagaaatatttgcattagcctcagcatacagtacttccaattgcttcaagtcaatattagctttgctattttcaatctcttttttagcctcttctatgaggttctttctaattttcattttacttatgtttgaactacttttatttatttgaaattttacaaagttaagttgatctaactgattttcaaaattttcgttcaaattgaaatttgattttttctcatttaattgagctatttctgcttcaatcatttctaaagcaatttcataagctgtttttgtttgctttttttccagtctttccttgaaggcttcttcttgttttatttttgccactaatgcttgcttctttgccccttcatcaaagtcacaacctaataagaacaaatataaagtctcatattccacatcagaggtatacttgtccaaagtcttaagtgtattacttatattctcatccttgtatctaatattgtgagagatgatctgtctgaatgtgggtttctcagccttatggtcgggaaaaagaagcccctgtaactcgtcttcaaaatccttatcaagtattgacttcccattaattttcctaatgttcttttttcttggcagaaaattgcgttcaattactacttcatctgatgcctcatctgataaatcctcaacaagaataagagtaatcaatacttcttcggttacaagaaaatctttaaccaactcatagacttcctttttattctctgtatcagaatatattattgaagcgttagaccctaaacaaaagtcaattagctttaatactgttgttttccccacattattcccagtagatttatcatcattggatggtgtttcgtcaatgattaggttcaaaccggattgaaaagtcagctctcttattgtccctgcgcgactcgttattttcagtgtttttatgaacataattccacccatccatcatcgtctatctttgcagaatcaattagataaagccaatctaaacaaagcatgaaagtgggaaaagacatgttatattggcttttaatcctatgatacagatcaaatacttgttgtttggcatgttgtttaagttctttcaaaactaaagatccattatagtaaatgctaagctgtggatgtatattatccggcaataacatggctatatccctccggattcttaaaaattttgcatcgtataaaagcatctacgactaaaatacagacgcagagttccaattcttcatacggaatttcaatataatttttgctctcgataattatcttggttatgttatcaattatactgtagaaaagttctttagagttagctttttcatgttgatgcattgtatactgctttttgataatttgaaaaacggaaaagcttttattcgagccttccctatcaaactcagcatatttttcatctaacttttggtaaaatatcttgtaatcatcaattgtgtctttgacatccgataaatcattgaaggttattttcttatcaatctcaaaggaattaatctctggcgattcaatacagttagcaagattctcatttgcaagtatgtttatgatggtcgcaagattcgtatctactttaagtagatcaacatcatttccaagttccttttttacaaactcaaatacctcacgctgtttgtcgatttccatgctcagtataacatttaataatgtgtttatatccacaatgtcatccgtgggagaaaaagcagcattatgtggattaataaaacccatatcccgaagtttggttgcatccttagcaattgaaacaaaaatgaaacggtaacctgaatacctacggaatatatccttatttaacgagccttcaattttttgttttgtacaggttgaagatacttgagcaacaactttgtggtttacatccaccaaatcaataccttcaacattctgtttaagtatattcatattaaccaacgtaagtccaaacaataaattcattaattcggcaaaaaacgtctctgaatatatattcaaatccaataaattgatctttcctcgtttttcaattcgtcttgccaaaacctccagcttttcttctatataattgaagtatttacttcgattcattagtcatacatacccctattcagaaatgattttaaccacgttcattgactattcgacaaatcattggaaattcctcttcctattgaagttcaataaaaaaagcgtctaataaagacgctccatacactttactacatgtctacacactcgacgtcaaaaaccaaggttcagcacgaccgaaacctcgattttgtccttctcaccttattttgaaatcagcgccatccttcgtgaaggtcatgaaacccgcaaagtgttgaaaacaaaggatttctacgtatctattcgtttcccgtgccccttatgcatgaaaataatctatgttcccgcactcaaccctaaagcgattttttgaatgcaggaacatattcaaattaccctctagccctcgtacatcaatgcttattatcccgatatattactaccacgcacttcacatgtatcgagatgatggaagggatatactacctatcacctcctacttatatgttttttctactttacacttctctcctatatcacctgcttccaaaaatacacatagtaaatcccccaaccaatgggccattctgtaaactaaatctctcttttaaccgataaatacatatgctgggttgtttattaaatatcacctctaaacctgtatagcgcacaaaccttgtaatacatatctatcttgactcacagttcaagatgacgtgcttcacttggaaatacccatcacatatagaaaggagttatgaactcacttgagcgtattattagatgggattggatatgaaagcctacgcttttatggtccctttcagccactacacattgaacaacttcaaataacacgcgccattaacgatcatgcctatttacatatcagtggcatgctctccgaagaacagggagcagcttgtatcggtcaaaatatggagcaagagccgattgtgatccgtcagttgaatgatcagggacaatcgttgagaagactgtttcatgggattgttacacgtatgtccgtacactgtgtgcgaggcgtgtatacatttgaactggaagccgcttcccattcgtaccagatggatattaagcgtaaaaggcgctcctatcaagatattcaccgcacctatgatgatctggtcactgcgctggttcgaaaatatcaatacggagatgccattgatacggtaagcaactatgccaaactagagacatttgttttacaatatgatgagaccgattgggcgtttttaaaacgtctcgcttctcgctttggttccgtacttgtgccagaggtaaccgcagcctcgcccaaggttttcttcgggatgccagaaggcaagcagcataaggtggaacgggatgtattttatcgagtacgaaaaacgtttcatgagctggatgcggaaaagcccggagaacgtgctggctcgtatgtcacctatatgatcgaaagcctgcaattttatgcactaggcgacctcatcacgttacctattggacaagacaaagagctggtcgtggttcgagcagtgacaaccttagcagatggcttactgcgtacccgttacgatcttcaagccgaacaagatatccgctatgcgcggtatgaaaacgatcaggctactggaatttcgctgacaggaacggtgctcaaggtacaacaggattttgtacagcttcaactggacattgacccgaagcaagatcctgccaaagcgtgctggtttccggtgtccacccgttatgtcgccgaagaacatagtggctggtacgatatgcctgagatcggggaacaagtggaattgtatctgcctacccaccgcgaacaggatgcctatgtcacggactcgctccgacaacaacgccacgcgaatggacagcccgatatgaaggtgtggcaacacgtgcaaggaagcggcatagaaatgtctgagcgagaactgaccctgtccacctcggatgaattttcaattacactaaatgaagatggtggcattaccgttaacagtccggggaatgtgcagattcagggtggtcatgtgaagctgggtgcaggtgaggaactatcattggaagctggcacggcgctatacttaaaaggtggagccagcagcatggtattggatggtgagacggataccaaggctccggtgatttatcaggaaggtacagtgaaggctcctgttttcgtagccgacctccctcctgttccagaaccgccactcatgagcataaaagcatatgaagcagctcaatcagcagccagggattcatctagcagccaagcctctacccctaaagcaaaagtcaccagtccagcagagcttcaacaggcgaatgccaagatggggacagtatccaagctattaggctccattccagtaatgggaaaagtggctggcgttgttatgggagcactaagtggacctgctgcgggtgtgattctgcaagccaccgcagcaatccctgttcgtagcaaaggaacacctaccgttagaaacagtagcaaggggaatggagttcatccgttaaaatacttggctggtttaacaatgcagggactggtcagtcaatacgagtatgagcgagctcaggaagcctattataacaagtggattttggggaaagtgtatacaagtgctcgtcatgtggctcattccggtggaacattggagctggttcaaaacttgctgaaagagtctaagatgatggttcatgcgtatcagcaggttcctaaaagtgttcgtgaaaaatggattagggattatatgaagcaacaacctcctcctaagccgctttccccagaagaagaaaaattacagagagcaagaaagtatgcgcaaagtattcgtgactgggaagctaatcgtcccgaaccccctaaaaaaagcattggcgaggaaaccacactctttttccagggcatggaggaaacagttcaagcgaacgttgaaggcttgaaacagttaaaagatgctcttatcgagcatcctgtggatactataagtactatagtgtcgggccaatatgaagaggcaaagggagatttggtatttgctaaaaattatgttttggatcaggaaaatgccagagatgagtatctcaaaggtttaaaagaagacgataaacggatgttagagaagggccaaagttacatggagggtgagacattagctgggatgctaattagctctcttctgggtaagggaaaaataaaaggtggaaaagggacacatcataattccaaagatgtttcagaaccaaaacccttgaagccaacgaatgagccgaaatcgagtctaactaaaactgaggggacgggtaaacctaaaaccagaatagatattatgaatacggttcaagagacattgagtcctgctgcgaagaaaataaaagaattagacccggatgctaaagtggggtataggggttctttggcaacaggtcagaaaggcccacataaggggaacgcgccatttgatccaacggactttgatattgatgcatttattgtcagtgataagctggcttcaaaatttcggattgatgatacatggaggtcaggggcaaaaattaaagaggttgaacaattacaacggcaagccgataaaatccttaaagaatctttagatggtctaaggagagtggataagaaagggagaccagacaagcttacttttcgtatatttacgcaagaagaatataaccaaaaaattaaagcaggtactcaaataattgatcatgattaggagaaaattaatatgaaaaaatacccttactttatttgttccctaccaatagaatctgaagaagatatctttggtgttgcaaagattatttcagataaactggttggtggtattccatttggtggattagaagattacatttatgaagaagttccggcagtatatattaatgcaaatatattgggttttgagttagttatacaagggtatggaggagatggtggatatttattagaagtcaatccaagcccatacaatgaaagcccagacgatactgaaagagtgacggtagaaataacaagatacattgcctcacttttagaaggaacggaaaaaataaaaataaaatatgaacaaattaatgaacagaactatattgaaatttctgaataggtcatttttttacgattaaaaaactacccaaagcttattcctacttgaattatgagtggggatgggctttttttatgaaacaatgacttgtcatccctctccatcagagttaacatacacactcaaaccgcaggaggggaagagaatatggatgagaaaattaatttactatataaaatgcgttttatggaaaacgagggggacaatatagaggtatttgagaatattctgaatgaaatgtcccttgaaggaacgaatgatataattctcgatctctgtacaatcttcgaagatgaagttgctgaaccgctagctaatgattatcttattgaaactatattttatattgcaaaacgtaatgatttagaagaaggcttatacaaattggctacgggtactcccaacatgttaccccatgcggaattttgggcagagagaatccaccggacacttttaaattcaaaagaattagtaatttcttacggtaaagctttggagaaactagaaaattcaactaaacagacaattaaagaaattttaatggtgattaagaatgacgctccagatttatatttagataaggctaattctctattagaaaaaataagttgaaaatggggatctggctgaattgtatatacacagttagccctataatagatttttcaaaatatcgtcgtgatcacgatcacggtttagactgtaaatttaagttaaaatacaaacaattttaattttatttcatctaaaaccaaagataccgtgatggatcacaaagaaaaaacaaggaagtgtacaaagatgaaaagaactgatttacctcttgtctattcatgttctggatgttcctccgcagcacaaaccgctaacatgatcgctatacaaatggatcgagaaaaagttgcagaaatgtcctgtattgctggtgttggtggtgatgtcaaaccacttgtcagaacagcaaaatcaggacgtgacatcattgcaattgacggctgtcccttgtcctgttgcaagagttgcttagcaaggcatgcagttcaacccaaacaccatttcctgctgtctgactttgacgtacccaaaataataggtgaagatcctaatcccgatcattataggaatgcttacacacaaatcttagaacaaattggacaataattcttaatcaaaataaaagtgtgtatcgaatttttactggtggctcctaacacatctttaagggtcaccagtattatttttatacagcaacatctttttaataaggggaataattatcgaatgtttaaatgaatttgtctcacaatttaaaattgacaaaattcctatgtgtccttgttcaaaagaagattttttatgtaccagacttaaagagcaattagtttgttaactgttcccaaactatcaagctttatttcttaacgtcaacatgtaatgttccattgatcgtagtagtatatattgcccccccccccagaaacctggtacacaaattctcaaaccgacgttctaaaggagtggatgtaatgtatgaaatactaaataaaatacaaataaaaacttgatatatcgctaataaatcataaaaagacacgaaatacggtttttaaatggaaagtaagccatgatccagtaaagtataagcggaaacagcagcatttttacaaaataaaaaaacattcaatttcttcccttatcatatgataatttgcttcttacctcttcttgaaatgcagtatccgttaataatttgtaaaaaaacaaatccagcttctgcttgagccaaatatgatccaccccagaatcatcttgaataaacatggctagttgaatgtcatttccttcccgatccgtacaatataaagcctctgttagaacagaaatggtagatccacctttgtttccaaactctattaacttggagttatccacttgtcgctgaattagcatttttagatatggatttatagtagaaggaaccaactcccccttgtgtataagcttcatgaggtaagcatattctttagtcgttgaacgaggaagtttgcgcgattccagcacttgaagctttcgtacataattctgcctggtgttccatttctgaatacattctatcccctgatcacgatttaaaatctgatgaatttcaatagattttttcatatattcctcgtagctcatctcacttatcttttgtatcgactctttaaagcctatgttttcggtctcttggatataaggagacatgaatcccgcagatgaaaaaggaaagattttatcatgggaagaaagtgagagcttcataatattctcatttatcttatccaaacccattttttccatcagaaattctgtattggcattggaactatatgctaacataccgtgagtaatatccaataacgtaattttcccttgaacctctttatggtttgagcgaatggatttgatccagttatgatgagcgctaccatcggaaccagggatataaaatttatttaattcctctaaaggaacaagttcctgctcgtctaatattttcgctgcaacttggcgagcaaattcgatagcaatgatcactttggccgtgctggcaagcggcattttaacttctgagttatagctgattttctccataccatttttgatcataaacaaagatgctttactcggattttcctttaaaaaacttagaacatccatttctgtttttttattattttggcgctttgcaatgaacaaaaacagaatacatatgagaacaaatattaaaattatagctactaaccataaaattattttcatactttgctccttaatggacgcgtttagactgaagttcacataagtcgtcacagctccccacgggaatcacttttcttttagaagctatataatcatacaaataaccacctatacccatttttttgaaaataattataaagggaaccgcccaccaaagatacggtattcttgtacaaatttgtgcaatagagtcaattcaacgttgtattttactggaatcattcattgagaaactatgcattcacctttctaattcattaacaaacaggacaccaaccatcatagaaaaccagaatttgtttgtgttgaaagcttacatatcctaatcttcttgtttttcttcgaattgtaatggatattttccggaaactgatctttataaaatggtataaatttttatattttcaaatcgaaccccttttccaaactttttctgctatgcattaatcgttattattgctcttcaagccttatgtaccagacttgaagagcctctctccatttatcaactagatcctcattgaagagcaaaataccaatgcttcctataacatcattttagcagatagtcactttaatacactttaccaaaaaagtgattgcctttattctccactaaagcttttagcccattcagcaaccctacgactactttcttcttctgacaaatcctcgatcctggtcataatagaccatcttactccacaaggatccaatatacttccgaatcgatcacctgaaacaaagtttgtaactggttcccttacttttgctcctcttgctaccgcattttcaatgacctgatcaacatccactacgtaaattccgaaagaataacacgcattctcttcatctggcggcaaaaccaattgatatgccggattcgctgctcccagctgcaaaaaaccatttccaaaatctaattccgcatgaacaattattttattgccatgctcatcaggatattcagtaatatccttaacccttgcattgaaaaccgttttatagaactctattgcttccgaaggattcttcactgtaataaaaggggtaatagatgtaaagccgttgggtgttcccttctttgtatatttacctgacactcctgtatattctctgctttcagtcattttgactcctcctttaaatgatcgtaacagttctattttgtgcttatacctttattggattgaattcatcaactcatagtaatatttggatgcgcgagtcttatttagactataccaggcttctaatgttttagaagaaaacacacccagagctttcaagacgtgtacggaaaattccaacggagctgttccagatgcagtgatcagttttccatccgttacagcagactccgttttgtaatacttttcgcccgtgtaggtgggacaggtcattttgagatattccaggtcattgcttgtatgccaacgtgaattcagcaatcctatctgggcaagtcccatggtagcaccacaaatcgccgccacccatataccttcctctaaacatctttcagcaatttttaagatcggttgatgaatggtttctgtccatgtatttccaccgggtaaaatcaatatatccgtactctcaatgctgcactcatccagtttgatgtcaggcaggattttcaatccccccattgtggttacaggagtcttttctattcccacggtaactattttggatggaaacagcccctttttataatatctccccgagttcagttcggcagttaagtaaccgatctcccagtctgccatggtgtcaaacacataaagatataccgtactattcattcacaagttctccttatttaataatttatcaagtgataccaactctcggtaatccatgattatcctcattataaaaaagcttcactgacatctgctgtcagtgaagcttttaacgttgataatattccattaactccgacgcaacagtaacaagctttttcttcaaactctgtggttcgatgacttgaatggacttcccgtaggttaggagtaaataagggacatatgtatgaagtgatttttcctcaagcaaaaagattgcctgattggatacccgctctttcagatgatgccccaaaaaccaatgcagacataagtcatccaatgcctctgacctgcctccgatcgttaaagaaattaaaccgtccttacccactaaatcaggtaacagatttttcataaaaaattcacgggccgaaaaagcttcggaacgcttaaataggattggagtacgcttgatttgtagaatccgatctgcccgaaagctacggatctcatttcttaggtgacaaaatgcaacagtgtaccatttgttgttccagtaaaccattccataggggtctatcaccctattcttgggttgttcttcatggcttgtgcgataatccatttctacagagaattcgttggctacagcttgctccaattccgccaatatcggctgaagagaagggtctcccatgcgattaataacttcaaatccggctaaatgacggctaagtatactttcctgctcttgattcgaatacattttcaattttgatgttgcattgtctaatgcctcactcaaagggtatccagcctcttttgcaaaaatagcagcatgaaggagtgcctttttttcctccatatcaaatagtagaggcgctctgataaaattattcagcaagctatacccgccattatgacctgtgtcggatattatcggcactccactggcacatagtgcatcaatataccgatagactgtccttatatttatttctaacttttcggatatttgttttgcagtcatttttacgcccgaattcagcatccatagaatggccagcatattatcgttttttggcataacatgaatcctcatctctcattaaagttcaatcttttataaatatctttttatactctctcttactacctattatatgcttttttccaccttatacttccctctcatatcttctaattccagatttacacatagtaaataccacaatgaatgggtcattctgtaaactaaatctctcttttaaccgataaatacatatgctggatttatcaataaccacattactagctgggaatctcataataacatttaccaaaaacaactatagaaggagagatctatggataacatcgtgacatacggtcatatcgaaatcatgccttatgagttcgtccgccttcatgaatttaaaatcttaaaaacagtcaatgaccatgcccgaatgatctgtacaggtatcatttcggagaaaaagcgagagctgtacgtacgtgcttcggatgaagaaactcaggtcaaagcttttgttacggacaaaaatggcaatcgacagcccctttttcgaggcattgccttggatgtggaggaaaaagtcattcatggggtccattacctgaccgtcgaagccatatctcatacctacgagttagatattaagcggcatcaacgctctttccagaaccccaagctcacctatacgggtctgatcgaaagtattgtatcggactactccaaagccgaagccatggatgttgtgtcccataagaagcccatcggcacctttatcatgcaatatgatgagaccgattggcaatttctgaaacgtatggcctcccacttctactctccgctcattcctgcggtgggctatggagtgccgaagttttattttggcctgcctatgggactcagtaaaggagaaattaaatctaccaattataaggtcaccaaacgggttgcggattttcaaaccgcttcagagaaccatatccctggcgtacgtgatgctgattttatccaatatgaggtcgagacggagaaattactggaacctggctatgaagtaacctttcaaggtcataagttgatcgtagctgaggtgctaacggagatgaaagacggggtgctgacccataccgccaagctgtcaccacgaagcggcttacgtccaattaaagactacaatcgctccattatcggcgcttccattcatggcaaggtactgagcgttcgtcgggacaaagtccgcgcccagctcgatatggatgatcagcaagacccgaacacggattactggtttccctactctaccatttatgcatctgcggataacacgggctggtattgcatgcctgaagacggagacagcatccgcatctattttcccagttataaggaagaagaagggtacgcgatcagctcggttaaaagagaaccacaaccttccggtggaaaagcttctgttacttctggacatgccacagcttttgcttcgtctgctggatcaaagtcttctgcggcagctcctgcgccagatcgaatggctgaccctgccattaagacgctgcgaaccaaatacggcaaagaaatcatgctcgctccggatcaaatcgttatttccgggaatggcatgtctattatcattaacgataaaacaggcattgatattgtaagtggaaaaaatgtgagtattagcgcggcttcggatattgttatgagttccggtaacatccagctttccgccggaaaaatcgagctgtctggtaaaggcaacacgattacgctggatgacaaaaccaccttctccggcacggaaattaagatgaactaacggaaggtgagaactagcagatggataaacaagcggcgttacaccattttaaagagcatcactttacacctttgctggacattcagttggacatgctggaagccatgtttcatcgctaccaagctcaactgattttcgatttcaaagaatcgttcagggatttgtgtatacacattctgagcatgcagcaacaaggtcaaaaagaacccattggatatatccactactcattcttgcgcactcaaatgctggagcaatcctacctctatatgatcgatgcttactctgctgagtggtacgaagatgattccgattgcaagctaacctatgacgcatcatgggcttacgcaccgatgagtaccatgttggaaaccttggagcaggaacgaaaaatatatatggggacgatcacttctgtggacgttgaacgactgatgctggaatccgctcctttttttcaccagtttgtgaactccctcctgcgcttagggatggcagaagtggttcaaatgcctgagtatctcgccatttataaagctaatcgtgtagctatccgaacgggcgagtacaaggatatcagcgagaatctatatgtcgaagatcaggaagcacttcttgcagatcatgtgaaagagcaattgatacattccagtgaagaagaaccctatgtttacgaaaacctaaagcggctttctcttccccaccttcacctgatgcaaaaggatttgcgctataacgattttagccacagtgacttacggggaagccagtttcacagctgcatattgatcggaagcatctggcaacgagcgaatctggaaggaggccgctttgggggatgtctactgaccgatacggattttagatatagcgatttgagaggtgctaacttcaatagtgccagcggacagccttatcgggaacatggagttcgggtgccggggctatgtgggcttcatttcgaacacgccaacctggatggggctgattttacagatgtacattcgtttgaacatgcatattttgagggggcttcgatgcaaggaactcttgtcccacgaaagtaccaacagtattggaaattaagcgaagcacagcgtcaatctattgtgtggacggaataaggaggaatgtgtatgcgccattattatgtgctggtcgatgatcatcgtatttcccgaaacattaaaccgatgaatttagacctttttaaaacgccatttgttggcatgcctccggctcaggttttagatgttcatgcgacagaagatgccgagtacacggactggctaccgttttcaccctcacaaccgctattttccgattctatgaaacggattctagaactatacaatacacaagctcgttttaaacaggtgtatatcgtgaaccgggaacctagccgtcaagaattatattggatttcatccgttccctctgtggatggcatttcagaacagactgaattttatgcgcacgaccaaaccttaaaacgacttgtgctggatagtcaaaaggtgaatggacaccatttttttcgactgtctaacgtgagggaaccttatttcattgttagcttggaggctgctgaaagcttactgcggcggagtttgagtggttttcggctacaaaagctagaactcttataaggaggttcaaccttgacggagcattgggataaattttttttgaaactgcatcatcaacaaatattgaaagagcaattaagtacagcggaaaaggatgaaagctggatgatggtaactattgaagaagcgatggagggaatttcaaaaggctcgctaaccctatcggatcaacaggaaatccggtttcaaacccttcctgtctttgaaaatcaactcactatttccctgcctgactctcttattccagaagttcgggctggacagacggtagatccgtcgaaaagcttcgttgttcaggacaagctgggtggaatcctgttaggtctgcaccaaagcaggcaagaactggaccccacgcaaatagaaatctatcaacagcagatgattgagcaaacgagtcgcgcacaaccaagtatgaagctcgtggatgaaaaggctctttctattcaagataccatcattggttgttatgaagctatttttctagtttccccctctccctattatcagattgtctttgtgcgttcctggcatggcaaggctgtgatcggaagttgccaatttaagctggaggatgctcccctctgggttcccttaacctatgccatgctgcacaccgcaacatggtcggagctttcttgattttataccttttattcaaggaggtacttgtatgtttttacctttacttattaaagctctagctcaaggtgcactcagcggagaacattcttatgtggtgagaggagccaagctacagtgcagtcaaggcacagaccctggtgtgctcaatatgatgtacagtcacggtgttttcattaaagataaacccgttctgaacgtggacgatgccatttgtggagccaatattagcaaaatcaatgcttttggattgtgtaaattgaagcagggtcttccctgtgaaccggagattgcgtttgggtccaagtggacaggcggtaaggaagacgtattgattgagggggcgcctgccctactcaacaattcgaccttaatgtgtagctgtcaaggtgtacaagaggcgatatcctccttttttggtgcagacagcacgggatctggtggtggaggtatcatctccattacagatgacggacaggatggttgattttatcaagcaaggagattaaggatgaacatcgtagcgaaagaccgctttacctatcagcacttacatgtcacttggccctatggcaagctgcgtcttcacaacgtccatatgagtcacgagctgggagaacatgctagactggtgatcacgggtagtctagaagccgatcaagcagacacaatcattaccaaagcaagcagtgacgacgaagttgagctatggtattccgatgccaaagatcagaagcatcccttatttatgggacaactatactgcttagatgtggagcacagacatcaggagatcgtggtaactctcgacgtcatttctcatagttttaaactggatacgcagctcaaaaaccgctcctttcagcacataaaccagaaatatgttgaaatcgtcgacgcagtgctggccgattataagggctcggacaagattgatgaagcttttgagaaaaaagcgacaggccagtttatgttgcagtatcaggagaccgattggacttttttaaaacggctggcttcgcatgtgggagcccttctcgtcccaaatatcgtttcacaccatgcacaaatttggatcggtattccgcaagcgagacagcatattcatttgaaagaggttccttttgcgttgcagcgcaagattgctccctatctggatcaggaggcgaatggctggaaatctgcccatattgcagactatactcgatatacctttgagtgggatcgaatgctgcaattgggagatgaagtggagcgcaatcacgaaacctacgtcatcaccaaacgtgaaggacagttgattcgcggcttaatgacctggtcatatgaatgcgcattgtcgcaaggcttgaaggttcccaaaatatataatcgaacgatcattggcgccgctattgaagggaaaatactagatgtcagccggaatcaggttcgattgcatttggatatagacgatcagcagaatcccaaggatgcccaatggttcccctattctgctgaaggtaatcaggtttggtatctgatgccggaaaaaggtgcgcaggtgaagctgtattttccaagtgctgacgaagacgatgcgatggtcatacaatcggtccgaacgaaaccatccagcgttgctgtcccttcatctcacgcagctcaaggtgccgtggtcgaatcgcctgcagtacgccaccagcgtaaaacagccgatcccggggtcaaatcctttgcgaatccacagggaaaagaaatttccttagggaactctgaactgtcgatgagtgcgcaggaagggtcgctgtacatctccatgaatacccataacggtgtcagtctgaacagcacccaacgtatacaaattcaagccacaggcagtcttagtctttcggcaggtagcatcctgctgcaaggaaccaacggcttacacttgaatacaacaaccgatacgttggatttggagcaggaagtcaacagcgtcagctctgagattcaacttaaagcttccctccatcaatactacccagaaccgattttgtctgactttgagaagcaagtcgctgaaaagggaatccaaagtgtgctcggagcacgtgttaaggaaaacgtaggcgccacgctcaagggagaatgggatgcgggtatagagtttttaggcggtgtatgggactcagttgtcgacatagcggatatgggaaccatggtaatgactcctttcgttatgccgggaaattacactggtaaaggttttctggaacgcaatgagacgctcgagggtattaagggcggtgcaaagtttggctgggactatattgccgattcattccaaggaaaaaaaacaaagaaagatgtggttcacgaccttgaaaccgtgtgggacggcataaaaagcatacccgatccgattgagcgaaaattgaataatttcttccctaatccattgaccgataccaaacaggaaagttacgacgcaggatatgacagtatcaaggccgttgaacgtgtagcagatatttatgggtttgtcaaaggcggcgcaaagttagttagaaagctgggtaagttgggtaaagaagaagcctccttatctaagggactcaaggaagctgaagaaaagaaagccggtaaaggaggaacaccagggttattcggagattcagcaaaggccgactctgctctagccaaggttggagatggaaaattcaaaacgaatgccatccgttttccaaccaattttgaatccttagggagttacttgcaaagtgtagcaagaaagatgaacttccgtataactaaaaggttacccattttcgaaactgctggaggtcattatcggtttcatgatcctagtcctgacgtcccacattctaaaggttccggtgcaaaaatttcgcctgagagacaaaaacaaattgatgcgttagaatcaggagagtatacgggtaagagcactaagggaccggagaaagagcctaatgtaagctacggaaaagtatatccaacaagaacaattgatttaaaaacagaaggtcatattatcgatagagtaagagatttaagaactagactctcaaatagattaaaaaaagatggaaattttgcatactctgaagtggacataccaggaatagataaaaaagaattttatgcacacagtggcttaaatggagataataaagcgaaagactatgcagatttctcattaaagccaacaaaaaaacctaaatatgaggcaaccaaagcgccggataaaagtggacgtgtatataaaagagacatggacactgagtataaaatattaaatgatctagcagcaagattagataaactaaaagactcttcaaatgttcgtgggaaaataaaaatgttcactgaaaaagatacttgtggtagttgtagtagaattattaatcaattccataaagattaccctggtattaatattgaaataatccacaacaatgatgatatgattatcccataaaaatagaaaggtgatagattaacatgaaaagaaactatgaagctttatttggtgccttttatgagaaatactttgattttaaaattgaaaaaatgagtgacgctgaggccgtcgcaagaacttctggagaatttgaaggtattttaaacaaaggcgaaatggagaaagccgtagtatacattgctgaaggaaagatttatttaacgcattcgaaaatattttttaaagcaaaagaaagattagtagaggttttaaattctttaaatctagaaaagctaaaattagagataacctcagatgaatatgaagatttattagaacgtagggatatggtcttagatgaaattgataataagcagatcgattatgatccatttacgagatggtattatcatgatatggaaaaggaagtaagacacttctttagtagcattattactgagattcaagataaccatgaaattgttgagaaaataatcgaacgatttgaaaatgattgtgataacacccttagtgaaaatattataattaaaactacattagcggaattattaattaggaataatattaaggtagatgaagatcttcgtaacataaagagtgagctagaacagtttaatattgaagatataggactacaattatcagaagacgagaaaatagatttaactttacgcattaaagaaatattaagtaaattaagtgggatttagtataagtgacagcggccagtcgtcggaaataaaccggagactggctttttttattttgtacgagttgggttatattatgttacatagtctcgaaggtctcagactttagcaacaattcaatggaggtgttaacaacgggtgttctcttttcgaacatgtctatgatcatcattataaatatttttaagttgttaacagtgagcacctacttcgaaataattctattctctgttttagcttgtatacatgtttaaatatccatttaagtgtccaattcaatttaaaatctgactttctatttaatacaatccctcgatatcctaatctacatccgttatgctgcttcttagcgatcaaggcagagcgtaaacatatcaagctagaataaaataattagcttggcatcgtcaagttccatctaaaatgcacttgtagttaatagtacagcagaatttgaaggctatacaagtcatcactgctctactttctctattcaacttagaaggaaaataatatggaatttgcgctgaaatggtcaaataatatatccggacgggtaaggctcaaacccgaaaagatattaggaatactgttcaagatacactgagttctccagtgaagaaaatccaaagaaattgtccctaatgccaaagtgaaatatagaggttctttggctactgggcagaaagatctacataaagggaatgcgccatttgatccaactgactttgatattgatacttttatcgttagtgataagttagcttcaaaattctcttctagctctactttttggagagctgggaccgacctaagagaagatagacaattgcagaaggaaattgataaaacacttaaagaattttgggatggcttaagaagagaagataaaaaggaagaacggacaagttcactcttcgcatatttacgcaggaagaatacagtcgtagatatcaaaaagggggtcatttcttttatttggggtgttccttttattggattagaagatcatatttacgaagaagtgcctactgtatatattgataattctattttgggacttcagatagttttacagggagccggaggcgaattggggtatactttaaaaattcgttctcacacagataatgatgagccagatgacgcaagtgagatagagctagatataatagggtatgtcccctgcctttttgaacggactgatcaaataaagataaagtgtgatgaattaataacaaggattacattagtataattgagtaaagaattcacagtgtctctgataaaaataaagtgggtttacatctaaaactacaagatcgtacactacaacatatcaaacactttaaaaacttgacaaccatttgataaattttcaaaggcttattccaacttgaaccgcgagaaggatgagctttttttctacgcaaaacaatacatgcacccctcaagaaacaggaagaatgcagttggtagatgagaatgttcatggtaaagtaaatcatactgatggaaataaaatatggggtaatggcgattaaacctctaataaattaaagggagaattaaaatgggatatgagctaaaatggtctgataatataaatttagatgaaagcaaattgagaggtcttgaggagcgatggaatatccgctttcctaaagagtatgtagaaattgtgctgaatcatgatggatcggtaccctatataatagatcaaaatggtgaagagattacgggcgttgtagaagtacctgggaaattaacatggtctatacaactattatctctaatagaaaaagaagttcttggagaagtaatttctccaattgagctggcgtatgatactttgagcgaggcgttaccaaaaaatatatttccctttgctattaatggatctggagataaatttttatttgattttcggaaagataaaaatgaaccccaaattttgtttcaaaaccatgaagatttaattttagaaagtgaaataaccgaagaggaattagaagaaaaatcacttgaagactggcaagacgaaacattagattttgtatgtgaatcattcgcagcttttcttaaattaatttctcctagagactaaaaggattactctttaaagctactgccctaaacatagctataaataaatgaacttaattatatagattcgggagtgaattatttagagaaatcattattaaatatatattaaatgcatttactctttttttaagatgggtcactctaaaattttgaaagtccattccaatttgaatcataagaggaatggactttttcaatttaaagaagaaataaaaaatagcagccccaccaatctccctgcaccaaaacaataacttgccatccccctatcagagttaccaaccacatcataacctctgatggattcgcaattggtcggcatcataaatatcaacatgtttgctcatcatttattttcagaaaagcttaaatctatggattttccacttcatttatatattcccttgaactcaaactaaactcaacaaaaatacatcccctagtgtagacatcggacaaaccgagaggtttgttccaatgtttacactagagggtactcttctaaccaggggaatttgttttaccccttaaccgacccggctgcgatcccttccacaatccggtcactcatgatgaggaacacgagcaaaatgggcaaaatgctgatcatcaacgtagctccaatagctccccagtcggtcgtatattgtccgataaagttctggacaccaacggtcagtgttttgttttcgtccgagctgatgaacgtattgacgaaaataaactcattccagttatagatcatgttaataatagatgtcgttgccatgacaggggttgtcattggaagcacgattcggaagaacatccggttgacggagcagccgtccataacggccgcttcttccacttcacggggcaaggcgtaatagaagcccagcaagatcatcatcgttgtcggtagattaaaagcaacatacgacaggatgatggagagtgaagtatctgttaaatgcagtttgagaaacatactgaacaacggaatcaaggtggaatggactggaatcattagtccgaccataaatagcccgagaaccagctgacttcctttccaccgcatacgcgtaatggcaaacgttacaaagctggccagcagcaccgtcaacgccacggatatgaccgtaatccacacactattgaaaaaataccgcccgatattgccgctggtccacacattcatatagttctcccaatgcggctggggcgggagtgcaaacggcggaaggttaaacacttcctgattatttttaagcgagaacagcatcagccacaccagcggtaaaagctgcgtcaccgccaagatgattaaaatgatatacaaagcggcataaccgacccgagttaacattttgccgcgggtagcgactccaagcggatagttggcggctgcctgggttttcatatccgttcctccctcttcctgtcctttgttaccctcatctattagcaagctgcattatgaatactggatggtgtcactcgtagccgtaaccttgcggatcagccacgtagcgattagacagatgagcagcagggcaaaggctgtagcactgccgtatccaaaatcaaagctgcggaatgcctggtggtacatgtaagaggccatcacttcactggctccattcggtccaccgtccgtcatgacgtagatgaggtcaaaatatttgagcgagccgacaatggacaatatgatcgtaacgttaatcacctcgcgcagcaggggcaatttgatacgagtcgcaatctgccaggcactggccccgtcgattcgggcagcctccatcagcgtttcgggaatgtttttcagcccggcataatagatcaggatataaaagcctgcatattgccaaataatcggaatgaacaaagcaaacagcaccaaggacggattagctaaccattcaggcggattgtggactccgaccgacgccagtatggaattgaacactccgttcgttggatgatacattttgagccacagctgtgcgatcgctacagatgacaacagcatgggaatcagataaattttccgcagcagattcgctcccttgatttttcctgacaaaatcatcgcaatgaccagataaccgatcagactgatgcctgaaaacaaggccaacagcagcgaatgccaggcactttgccagaatgcactgtctgtgagcaaatgttgataattgtccagccccacaaaagtcatagagccgattccattccactgatttaggccgtaatagccggttagtacgatgggtacatatattacggcgaataacagcagcagagaaggcaatacatatagagcaatgacaagcttattggacatgaccttttccacggttggacctccttaggtggtcaatttcaatttcctttctcgatggcagccttatgccgctcggcaaattgttgcggtgtcaccgctttaccaaacaacgcctgaatcatattcaaatgtacctgtgctgcattcggcttcatctgtacatcggcgaacaaggtaatgctgctggcttgattcagtccgttcagcaaatcgacatacagcttgggcaatttttctttggaggtgtccactttcgtcgccggaattacgcccgcctgtgtgaccgattgctctccccacttgactacgaagtattcaacgaacgctttggcctcttcttttaccttggaattttccgaaacgaacaaacctactcccggacctcctacccaactgttctcgttgcccttgccgcctgcaaccatcgggaatttaaagaagccaatttgatctttaaatgcttgcgggattgcaggattggtcgtaaaattcggcaattcccaagtagccattaaatacatagccgctttgtcgttcataaactcggattttccctcatcattggacaagccgttaaatcctttgttaaaggcattcatatccacaagcgtctggacttcggaggccgcctgaattaaaccagggtcatcgaacgatcctgagccgtcaatcgcttttttcagcgtttcgttacctgctatacggtccgccagatacatataccagagcgagccggtccagcggtctttattgcccaatgcaatcggtgcaactccatgatccgtaagtgttttcacaacttgcttaaactcgtcaaatgtcgcaggtaccttcaagttgtatttttggaatatggctttgttataataaataggtgtaatgttcaattcaatcggaagcgcatacgttttgccattcagcgcataagcttcggtcgttcccggtacgaatttgtccttcagcttggaaccattcaacaggtcatccatcggcgtaaataatccacctttaacgtaaggctccataaaacccgctgcccaggtgatgccgatatccggcaattcattggaagctgacaggactttgagtttgtttttatattgttcattctccagcacttcctgctgaatgacgacattcggatgatccttttggtattgatctataatctgagtcacaagcttgctctgctgtgccgaacttccctctggccacaggtgcatcattttaagtgtaacctttcccctttctccactggaaccgccttgaccatccttgccagcaccgcaaccggatagcaccagcataaatgacagcagcagggtcaacccagcaaaccatttttgatgtgagcgcttacgcaaaccatactcgttggacatcgttagacctccgtttattgtatttatatttttgtaaccgttatcatttgtaagtttagcacttcattcctgcttccaacagggtacactcattgggtataattccacttttattgggtttgatctgcctactgtcagtcaatattctctggtcctgtacgcatctgctgcctgtagcggctaggacttatcccctcggtcgctttgaatactttaataaaatatttatctgtccggtagcctgatcgctcgccgatttgggcaatcgtcaactgggtatgcagcagcagctccttggctcgttgaatccgcagtcgatgcagatattcgctgaaggacaaaccactttgctccttgaataaaacactaaaatagctcgcattcaggtgtgaatgcgcggcagtctgcgccatcgtaatggattcgtgaagatgctccgccatataggtgaaggcacgtcgtaccggatcactaagagtagccgcctggagatcaagctctagcagaacagggtcagccagcttgtccagcttctcgtaccgctgccgctcctcttccagccgaagcgcttcattgaccgcattcagcagctcctgcttatcaatcggtttgagcaaataattgacggctcccagacgaagagcctgctggacataatcaaactccgcataacccgagatgacaatgatcgctggtcgtcgtgaatcccgttccagagagcggattaaatccagaccactgaattccggcaaccggacatccgtaatcaacagatgaaccgtctccgcacgcagtatatttaatgcttccaaaccattatcgaatgtcacaatccggtatttcccggcggcccattgctccaatgtctggtgtatcccctgacgtgttcgctgttcatcgtctacaatgacaatggttttggatgaaacactcattcctaccgccctccatattcatcaggaatttcaaaagcgaccacagttccttcctgctcagcactatgtatcagcataccgtccgttggataagatgtgctgtcataatagagcgcgagcctgcgctgcacattcactagtcccataccggttcccttgctttcgcaggctgctccccccatcaacgctgtacgcacagctgcaagttcttccattgtcattccaggtccgttatctatgaccgcgatcttggtccaacccgatctggtcgaaggagtgacactgatttcaacgcggccgttgccgatgcgattttcgacaccatgcaaaatggcattctctagaataggctggatcagcagcttaggaagcggaattctggctgcctctgaaggcatatgaatttgccagctcagacgttcacccagacgcatctccatcagttccagataacgacggatttgcgccatttcttccccgagggtcacccaagagtcatggtgagccggttcgatcacataacgaaatagccgcgacatagacaccatcagcccggcaagctcctcctctcccttctcctgtagcgaccagttgaaagcatccagcgtattaaaaaggaaatgcggattgatctgcgcctgcagagctttaagctcggtctggctttgtaaaacctccttctcgtaaatgacatggatcaattcattgatatcgacaatcatcgtattgtactctgcgttcaattctcgcagctcgaccgctgctgccggttctggattcagagccaacgccccttcccgtgaacgacgcatcgcctgaatcaagtgacctatcggtcttgtaatcaacgtagacaacataaaggacataaacaggaatagcacggcaccaagagatgcggaaatgataagtgtagtccgtaaaaccgtaattccgtctgtgacgacgctaaccggaatcagaatcagcagcgaccagcccgtccgctccgactgctgaaccgccttcacatattcccgctccccaatatgaaccgtctgtgtcttgctatgcagtacacctgacaaatccgtctggttcattggttcacccgacagaagctggccttgacgatctacaagcagcatggtttcatccgcttcttcattgaccgctgacgcaccattcagtccaaaataacttcgctccatacgggtaatcaagtaccctccacgtgagaaccagcgatccaccagacttacctgccgaattgccagcagtgaccgagggtcttcgggatcaataccgatccagaccagtcttcctttcatctgattcgcttcacggatgtctgcctgtccgatacgttcctccagactgccctctctaatcggaaacaacatctttccttcggcggtatacagctccagcgagccgacactcggcatatatgcctgatagctatgcatcacttgcagcagggattggcgctgtccgaaatttaccttgcccccgttacgctcctccagcaaaatatgctgaacagacgggtgattcgcgacctgctccgtcaagttgtccatctggccgattaatgcatccagcctaccgcttgcttgtaccgcggtctgaccaatatgtcgctcggcactgtcttttaacaggtgagatacattgagataaatgaacgcacccgccacactcatcataatgagcatcactagtataaatccgataaaaatctgattacgtaatgtgtttaatggctgaaaccttgaccttgaacgcatatgccttctccccctgaaccatcgcagaaaaaatgggtgctgataacgctttccttttcctattctatcgcatcattcgtctttgttggcgtattttcagcagagattaatcaaaatgggcaggaatgctatgaaatagaaagatcgtagggtaaacgaaagaaatgactcccgacaaatgcaggagccatctactgaccagtttaaccgaagcttctttcaaatcacccaaactaaggtaccgtccaggctccaaagcttggatataaaatagatatcctattggagcgcagccaaaatgcggtcgcacagttccatcgttttcacgttgtcccgtccacttgaatcaggcgtccgtccttcttggcagcagttcatgaaatgtgcgatttcaccaacaaaaccgcgcaagtacaaatcacggtatccgcccgacatcgcggaggctgacggtgtcagaaccgtatcgttttccgcaagggatttccaaggaagctctgtatgactctccgacttgtgaatgatcagtgtattcacctcatccgcgttcgcaaaaccgtgatcaaaggttaccgtgatcccttcactctcgcgtgtccatgctgtcatacctgcgaagtatacgctgcccactacaccattttcaaatttcagggcaatcgtatgggaaatacactcaccgttatcgttcgcaaatccggtaacctgtaccacttccccgaacaaataacgtaccagatcgaccatgtggaccgccgccagcttcatgaaatcttcgccggttttacaaaacagggtactgtccacgagaaatttcgcctgaaatgagcgtgcggctccaagcgagccaccctcaattaattcttttaattttatgtatacaggtgcgtagcgcttcatgaagccgaccatcaggacaacgcctgctgcttctgccgcatctgcaatttgggccgcttcttgcgcattccaacccagtggcttgtctacaaaaacatgttttccagccttaatgcagtccagtacgagcgaaggatgatctgccgcttgtgcaatcacgacaactccatcacagtcttcctgctccagcatagccttgtaattgtcataaggtgtgccgctgcttccaaaccgctgaagtgctgtcttcgatctgcttagatctctagtcgcaatcgcctgaatttcagcacctgccccaataacagcaggatatatatttgttgaagcgtgaaagcccgccccgataaaacacagcttcgccttgctcatgttagtccctcccatgtacacactaaaataatccgatcccatcgtaccatattgccgaagtatatatacagtgtcataaagataaagggcgtgattcttaaggagaacaagctaaaaaaaccttaacaaagataattccttatccttgttaaggctctgtctgcatcaccagtaatgatccttaaatacacattcaattacagggttcagacattatcttgtagataacgaagcccatttttgctccagccactgatcaaattcagcacccttgtcgccttcgtagatgtcataaatatcgactctcatcttgtgcagcttctcgcgaaaatcgttataggtatggtcggctggcaggctttttttaatccgcaccagaatcttcgtcagacccttaacaagttcaccctctttgcgcacaggcggctgtacattctcgccccattcctgaagtctgcggtaagcggcttcctgaacggcatataccgtatcattattcaaacggtgtgtcagcaagtcaatcgtctgctgattcttccatgcacccagatcatttaccgcggctaggcgtgttttccaatcggaggttcggtttgcagctactttaagctgctcatatacttctgcaaattcttgctgagtttcattgttttccaaaatcatctcatccttttctaaaaatcactatattactgttcatcacgattgccgtttgttaaatataacatacttgcaggtcttcttctaaaaaagataaaaatgaaatgtatcggacataccagaaggcatcatccgcctcagttgactgccgcggaaaggcttcgtaaatccctccaagtctcggggtagataaaccgtattttgtaagggaatttacagaaaatctgcacgtgctggtgtaaatgcatctagcagaataccgccatcctccagtgggatacagccatgaagagtatcggatggaaaatggatgctgtctccttctttgacggtctgcacttccttggtttcgccattatcaatcatgaactcaaaacttccctttattacataagtgacttgttcatggacatgcttatgcaacaggatctcccctgtttgggctttagcaaacatcactttgacatacataagctggtcgctgtgggccagcactttccgggtggtattactgtcaacgatgtcaatttgaatatcttggtcgttaaaaaacatggataattcctcctctttttaagcacaaatgatttagataagttattttgaaaaaactcataaatcgatttagtttaaaaccagcgaaaaataagccaaagtactccggaaagggtagtaaagtcgggatcggcgaacgttaccccttcggcacccaaaaaagaaaagagcggcaaggtgagagccggcagcagacagagcaagaatccattaagacaactggaaataacagctcctctgaaaccaccgctggaattgccgaatatcgcggctgcaccaccagcaaggaagcaggccatgatccccggcacaatgacaggcaatccgataaacgggaaaagaaagacgcaggcaacgcctgtgaagaagctgaccaagaagcctaccaacgcggaattgggtgatttatcgaacagtaccagaacatccacaccagggattgctccaggtgcgaacacttgggagaagcctttgaaagcgggtacaatttcagttgtgaacagcttaacacctgcttttgcgatatacaagccggcagcaaaaatagctgactgttcgaggataaagacgatatattctttcccatccgataatttgctgacataatcagaaccagcaaccagtccagataccagtaaaagcacaagcatcgtcaaggtcgttgcaacattggggtcgcgcaaaaaactgatgcggtcattaatgttcacattttcggtgtcattttcacggttgccaaaaactttccctaaataggtacctagaatgtaagaggtcatggaagcatgagcaatcgtatattcatccgatttaataatgtttttgctggcattccggaggaggtaaggaaacaccgccatatagctcccaattaccaaagaaccgacgatgatcgtagtcagcgaactgagacccagacctttcataacggctgtagcggcaaagctcataaacaaaatcaagtgaagagacaaataaatgtacttgaacttggtcaggcgtgcaagcacgatgttaaggatcatggaaaagagcagaatgagcgcagcatccgccccgatctgatcaatggtcagtgccataatggcttcattgctgggtacgacacctttaaggttgaacgcataagaaaaaatttggctgaagttagtgagaacgccacctaaaatgccgccgccgaccttgatcatggtgaagccataaaagaaagggtagttcccgtaataatttctgatactttctttctctggaatataaggccgagtaatgtcacaatcgcgataatgatggatggctccctgataatgctcataaacatttccatagtgatctccgactttcttttatttattttccatccttactaaatcgatttagtaatacacgaaaaaaatttcccttccgggaatgtaaaaagaagcagaatcatttttgtgaattaaatcacaattcactccatacattattcgtttaagctccattcctcccctctctacaatcgcaacatcactaaaatcaggacatacataaatgaaagggtattcatgactcgaatcataagatcattatagctctttattttctttttacaatagaattcataaaaacgttttcaaaaagataaaaaggacttattcaatcattcagttcagtttttggacagattctctgtggttaatgaccggattcattcggatgatttctgacagttcctcatgatcctgttctttttgatcaattttctccagcagtagccgggcacttcttttccccatttcaaaactcggctgggaaacggtggtgatcggcgggttataaaaagacgcaaaggatacatcatctatgccaatcaaggaaaaatcattaggtatggtcagatgattattttttgcataaatcagcacctgctccaaaatcatgtcattcgtagcaatgattgcagtgggcggattctccatgtggaatagttgtccaatcagattgggcatttcatccgatctgccgcttttgatatagttttcattcactggtatgtcatgtttgcccaacgtatttcgataacctgacagtcgctcacttcgtgtagtgatcgcttttttgcctaaggggaacgtgataatcccaatgttgttatgaccatgctcaatgagtgcttcaaccgcaagctcgctggccttttcattattcaatagcaccgtatctacgctgatttcatcgattttccggtccacaaacacgaaaggatagccattcttgacaagggaaacatataatttcttgttctcttccgtcgggaaaatgataagtccatccacttgccgagcaatcatcgactggacatactttttctctttgagcgaatcatcatcggtattgcagacaatgacctggacattttccagttggcattcatcttcaatggcacgcacgacttctgtagtaaatctcgataaaatggttgaagaaataactcccacaatgaaggtcttcttctgcttgagactacgtgccacctcattgggtatataactgagatcctcaatcgcttgctcgatcttcttcttggtgttttcactcatatagttgtatctcttttgtagaaactgcgaaactgtactcttcgacaccccggcacgttctgccacttccttcatcgttgttaccataattaccctcctttctttttctgcatgtcaggcgtgttattttatcaaatatatattctgcaacctgtatgtaaagtgaatttcactttattatataccttcttttacagcaggaaaatataataaataaagagttagagcgagccatccagcccataaacaaccgctcccacaaaagctggacacttagcttaaccatccgttgttacgaatctattgaattcgaacgaaatcttagaaagatacgaattttatgaacttgtttgatggaagatttgaacataaaataaaaatgtaatcggttacaatttcttttaaataaaggaggaagcagaattatgaagaaaaaaggaatgaaaaaaacatttttcgtcattgcctccctcgtaatgggcttaacactgtatagctatactcccgcttcagcagatgcagccagtgtgaaaggatattatcacacccaaggaaacaagattgtagacgaatccgggaaagaggcggcatttaacggtctgaactggttcggtttggaaacccctaattacaccttgcatggactgtggagccgctcaatggacgacatgctagatcaaatgaagaaagaaggctacaatctgattcgtctgccttacagcaatcagttgttcgattccagttctcgtccagacagtattgattatcacaaaaaccctgatctggtcggattaactccgattcaaattatggacaagctgatcgaaaaagctggacaacgcggtattcagattatccttgaccgtcaccgtccaagctcaggtgggcaatccgagctgtggtacacatcccagtaccctgagtcacgctggattagcgactggaaaatgttggctgatcgttataaaaacaaccctaccgtcattggtgcggatttacacaatgaaccacacggtcaagcaagctggggtacaggcaatgcctccacagactggcgtctggcggcacaacgtgcagggaatgcgattctgtccgtgaatccgaattggctgattctcgtagaaggtgtagaccacaatgtacaaggcaacaacagccaatactggtggggtggcaacctgacaggtgtagccaactatcctgtcgttctggacgtaccgaaccgtgtcgtatattctccacatgattacggccctggtgtgtcttcgcagccatggttcaacgatccggccttcccgtccaacttgccagcgatctgggatcaaacctggggctacatcagcaagcaaaacatagctccggtactggtcggtgaattcggcggtcgtaatgttgatttgtcttcttctgaggggaaatggcaaaatgcactcgtagactatattggtgccaacaacctgtactttacgtactggtccctgaatccgaatagtggcgacacaggcggtctgctgctggatgactggactacctggaatcgtccgaagcaagatatgctgagtcgaattatgaagcctgttgttttcgtagcggaacaagcgaaagcaaccgcagaataggcctgtcgcctgctccacgggtatatgacaacggcccatcctttgggcatttgacacaggacaggctgcccatgttttttgctaattatcgtgaatgagtaactacgtagtatactctcattgtaaaagccgctttccctccttcaggatcaggtcatgccagacctatggaggggtgaaaagcggtttttttaggtaaacttacataaacgtataacagatattgaagattgacaatgagctatttactaaattatcattaccttttaatgtatttcataatgaagaggtggtgctcaaaaatgtttggaattgtaaattatgaagtatttttgcttactggaatcctcctaaatctaattcctggtgcagacacaatgtatataattggaaaaagtgttgcgcaggggagaaaagccggtgtgtattctgttttcggtatcattagtggttctttgatccatacgctgttagttgcttttggtttgtcaattatacttacaaagtcaattatcttgttcaacatgattaaaataattggagttatttatttagtttatttaggagtaagaatgttattggataaaacaaatgcaagttttagtgcctctgaatccaataaacaacacagtaacagaaaaacatatttacaagggatgatgacaagtcttacgaatcccaaggtttctttgtttttcattgcctttcttccacaatttattgatacaaaggcttctggtcccattccatttatcattttaggacttacattttcgttcaccggattattatggtgcttgtttattgcctatttttcctcttacattacccaaaaaataaaagtcaaccaaaggcttggcagctatttaaacaaaataaccgggataatcttcatcggattaggattaaatcttcttcgagcaaaggctcctcaataaacttgattaattgttcacagtgttccactaacaggaacatttttgaattcatcatatgaccacctacatagctaaatggtggtcatatttttttcaaaaatcgacacaataaaaaaatagcaaactaagctttccctgtgctagttgtatggaaacggggcaacgttatcgatgggaacccagcacagtctgttttttatccctatgcattattggggccctgccggtctagcgatcggatttattttaatcgttgcatcgatatttatataacgttgattgcaaacatgagcgattccaaacaccgcaatgcgagctagttgctcccgatgcggtgtttttccttttcgcaggtcaattatgatcagataccaccatggtttacctgtagccaatggatttggggcaggcaggtgaaaacctagctcatgtttcgccccagctgctccaccttgctcagccaatcgttgcgctgctgatccgataatttattcatgagatcaatcgcagtagaatgcactggtttgacgccacatagatgcagcgtggaatccttcatcattcgatgcccaggctgtccctggaaaaatcggtagtaccagtgtggaccgtccatcgttgtaatgaggcgggccgttcttccttttagaagcttgtcaggcaggggttttcctttttgatacttaaacgcaaatcccggcataaaggtgcggtcaatgaatcctttcattaatgcaggcaagctgccccaccagatcggaaagacaaaaacgagatgttctgcccatttaatcgactcctgtgcttggatcaaatcaggctccagcggcaatttattacgatatccacctaatagatttggattaaaatcaagctcggatagctgcaacaaacgaacctctgcccctgcagccttcgccccttttacataggattgagccaacgcttctccataactgccagcgacaggattcccttgaatcaccaatatttttttagacatataaaccacttcctaccttcatattatgattttagttagaaaacactaactttatatttaaaaagaaaaggtcactactgacctttacttaataaagcagttaaacgttgtttgacctctgttgcaaatgggaccaactgctgtggaagttcaccttccaggctggacacggacaagcgtgtaatagctccaatgatgagcacaccggatagctggacatcctgcttcggcagttcaccttgttgaatcccacgttcgatgaattcagtcaacgcctccagcggctgacgcacattctggctccggcttgcttcaacatacagctcatgatgctgtgatagtagaagcaagccatactggtcctcatcatgcatattcagcacttcatccaccagttgatggaaacgactgacgaagctcccactctgcttgcgatagaagtcaattaatgtggtgtagctattgcaatattgcccgaatacttccaaagccatcgcatctttactcttaaaatgcttataaatcgcggcatccgtcacaccggcagcctctccaatttctttgactgaaatcccgtcaattcctttggttgcaaataagcacatcgctgcctgcagaatatctttctttttgctgtctatatgtgttttcttattcataagcttatagtaagcgataactaactaaaatgcaaattatatttatgcaggctcattcccctttcataccttcatttaaaatatattggttttaacctaaaatatatgttttataagtgaatgattataaataccttaaatcatacgtgtatcaccccattttattcatataaaatagatatgtaatcgaataaaacgggcgctagaacaggtgggactcattatgcttgagatgcacgcagtcacccagcagggaaaagactcaggcagtcttagcctatggagcgacgagcacatttccccgctgcaaaaaagtcgtgcaagctatccatgaccaaggctccaaagtcggtcttcagctttggcatgtcagacgcaaaggctcgttgccccaagaaacagctgtatctgtctctgggttgcctcaccgcaaaccgtatcatccactggatcgcacactaaattggacaatttccacaataataggtgtgccgaagagaattgcctctccttcgttaaggcgaatcgtcagcgatgaaggtgttaggctatacaatgtgctttcttgtatcatgccattaatgtatagattggcgtaactgttgcttccgacattaaaacgctgaaagacctcctgtacaccatctactgaaaattgatctgccataatcgtgattgaagattcaattgtagcaggcgcaaaataaaaataccgctcagccgtaggaacaatttcaatatttgaaatgtcagctgccgggccggttgggcctgttataccttgggctccagtagggcccgctataccctgtactccagtagggccaggtgcacctgttgcacctgaaataccttgaactccagccggacctggcactcctggcgctccccgtgttcctgctggaccctgtattcctggtattccttggactcccggtgctcccgcagttcccggtatgccttgcgctcctgctaaacctggaatgccttgtactcctgtcaaaccagtttcaccctgtaaccctgtcaaaccgggaatgccttgtgctcctgccgaacccggaacacctcgccttcctgtctggcccattcttttcctccgcttgacaggaatatttctacaccgtcgttgcatgattagttttcgatgctttttggcatggaagcccgtttttgttctacctttgaatgaataacttgttttacactttttacgtttgttgatcttgcaatgtacggttctctttccttgccttcttagtgatgaatcgcgtctcctcataccagccgtatacacctccttctcacatgcttatttatgtattgtatgcatatccccctttagggttttaggcatttgtagcatgccgatcccaagtatccgcttccatttatatatttgtagcaaaatagggcttctccatttaccctattattaatagaaaggttaatatgccgtttccaaataggttgaaaaatcatttattgattatgagccagcgaatggctcattaccagtaaagaaaggagatgagaactatgccaatcataaaacctgtgttcacagcagtagctacagctccagtgtcaacaggtggtgccgtaaccacgactatagccccagccacgactcgcttttttgcaaccattacagccgggatgatcggcgcaacaacaacaactgttcctgccgcaagttttgtagatgacgcagatgctccagttgttgctttgccgacattagcggctacggattcttctaattattatattaacggagttattcagcagagctccttattcactctaaccacagcaagtttggtcattgcctccgtagatattacaccaggtgtcccagttgttatagaaataacagattttagcagtacaacctccaccatatcaactcagcccaccatctctgcccctaccgtaacgattatcacttaagacgtttcatcattttgattcaagatggactgaacggtcattcacactgtacattaccccatataagctagaaaagaccgattcagatgtcgatatctgaatcggtcttttagttcaagatgattatattatcgtttttaaatgacagtgtacctgtatggttaaggtaaaatagcaaaggagcgcaccggaaatccgggggaatcctgaacgctcggaacgatattatatataaccgcgcccgtcgggggcagcttgtccaaattcgtcagcacctcaacttgataccgatcctgctccaatatgtaatattcacctaccagcttgccagcattgcgataagctacagaggaatcagtatctagtgtttcatgtccaatggcagctacattccgttcttctagcaaaaagcgtagcgcttccagcgaccagcccggacagtgtgcatctccagcgtcgtccttgtttgagaaggcatctgaatcaggccaacgtttgctccaatcactgcgaaaagcgacaaaggactgatcagcaatgcgtccatgctctttctcaaagtccaaaatatccgcaaccgtaagttcatagtcagaattggctgcaacggctgctgaacggtcaatgacaactagcggcaaaaccagttccttcaacgaaagctcatgcaagtaacgtttgcccttcacaaaatgaacgggtgcgtcaatatgagtcccatactgaccgggaaagcagtattgttttacaaaaaagccatcgtcgtgggtaaacagggtatccacctgaacattatcgaatactggaaaatgagggatttcaggataaaaagcgtgggacaaatctacccactctttttgcttcaacaacttcaagatatctgctaaatgctctgccatgatgcccattcctcctcagctttattacaagccattttacctgaggattcttcaaaaatctataaatcgaaatgaaatcgttaacattctgagaaaaacacataaacaattccatatattcatatatacatttcctatttcgtgtgattgttaacgttttcattattacatatacgtattgattggaaaaagaaggggtctattgaattatataaaaaattcgacaaaaattttagtatgtaacttttattatattaacaaatactggaacacgaagtatgatagaaaatgtagaaaccacaggagcacccgggactcccttcgttcatctactccattaatccaatatacggaggtattttatgaaaaagagattttcactcggaatcgcagcggctctactgttcactactctggctcctataggtgcacctgctcatgcagccagcgatattggcaaggagacgctcggcagcaaaaacggatgggcagccttttctacaggcacaacaggtggagctgcggcgactacctccaatattttcaccgtaacgaatcgcaaacaacttgtcgatgccttaggcaagagcagcaacacagcgcctaaaatcatttatgtcaaaggaacgatcaacgccaacgtcgatgacaataataaaccgttaggattggacgactacaaggaccctaaatataattttgacgcctacctcaaagcgtatgacccatccacatgggggaaaaaggctccgtctggcacattggaaaaggcacgcgaagcttcacaaaaaaatcaagccagtcgtgtcgtcattgatattccgtccaatacaaccattgtcgggctgggtagcgacgccgtcattaacggcgcaaacctccagctaaaaaaagggacagacaacgtcattatccgtaatattgagttccaggatgcctatgattattttcctcagtgggacccaacggacggcagcacaggcaactggaattcggaatatgacagcattacaattaacggcgccacacatgtatgggtagaccacaataccttcaatgatggatctcaccctgatagccaaaacggtacgttttacggtcaagaataccagcatcatgatggacttcttgatgtgattaaccaaggcgatctggttacggcttcttacaatcacttttacgatcatgataaatcgtcgattattggcaacagcgacagcaaaacagcagatgaaggagctttacgtgtaaccttgcatcacaactattatgaaaacacggtacaacgcacaccacgcgtgcggtatggacaagtccatctgtacaacaattactatacaggtgatgtaaaacgctccgaatatccttcactgtatatatggggtgcaggtaaatcctccaaaatcttcgccgaaaacaatgtcattgacgttgccggtttatctgcagctaaaatcgtgactgtctttggaggaactgccctgtcagatacgggcacaatcctgaatggacaaactgttaacgcaggctccagcgtgggtcttagctcctctgtaggctggaaaccatcgctgaacgataaaatttccccatccgccagtgtgaaggcagaagtcacttcccaagccggttccggtaagctgtaagcactgcccgctaacaccaataaccacaggctcatacaacctatgattttacaccaaaaaggctgtttcctccgtagaatgattccacacggagagaacagccctttttatttctcattggtttagttataaattacgttgcgtattaactgccgtattgttctaccaaaaccggcttttcaaatgcgttatccagcttacgaagtttagcctttaccgcttctggtggctcaaccgcaggcgcatctggatgcagcaaccatgattttacaaagtgcgtatcggataattgaaagagtggaggctctttctcaaagtcaattttcatagcataagaactgcgggctgcaaaagcatcccctacaggtgggtgaagcagatccggaggtgttcccggaatagctgccagcttctgaccatggctgtccaaacttggcatagaagcgagaaggccccatgtatatggatgtttcgggttatagaaaatttcattaaccgtacctgtttccacgatttgtcctgcgtacataacggcaacacggtccgccatcttcgccacaacaccgaggtcatgcgtaataaagatgatggaagtatcgatctttttctgaagatccttcatcagctccaaaatttgagcttgaatcgttacgtccaacgctgtcgtcggttcatcggcaatcagaagtttcggattagcagccaatgccatcgcaatgacgacacgttgacgcataccgccactaaattcatgcggatattggttaaaacgctgttcaggatgtggaatacctaccagattcagcaactcaataccccgcttgcgagcagcatccttagatattttttcatgcttgaaaagcacttccgtgatctgcttgccgactttcatcgtcgggttaagcgaagtcattgggtcctgagaaatcaggccaatttccttaccacgaattttttgcatctgtttttctgttttattaatcagctcttgtccgtcaaacataatttgacccttttgatagatgcccggaggggtcggaatcaacttcataacagcttgtgaggttacgcttttgcctgagccggattcgcccacaatcgccagcgtctctcctttattgacatgaaagtttacgccacgaatggcctgcactagtccctgacgggtcttgaaagatatcgttaagtccttcacttccaaaaggcggttcatctcatcactctttcatttattattcatcactattattgaccactatctaaaaaaacgacgtccaggagtcaaggtatatacaattaattttactcagtttagtacctaccagtcaagctatatctaaaatatcaccaaaaacctctcattctatgttagataaatgggatattaggccgaaaaaacgatcatttttaaccatttctgtacttatttataacatgtgctggatatagctgaagcgtgctccacccaatggcgaacgtgtgcagagtagttctccgttcaatcgggtagcaatttgacgacaaatagccaatccaagacctgtgacaccattcgagcccgcatagaatcttccgaacacctcggctgcctcttgttcggtcagtccttctccatcgtcatccacatgcataacccatacaacctccggtgttgtccctgtctccaaatgaatgacaacctccgtagaggtgtgccgaactgcattttgcaacaaattcaacatcatacggaacaattgctcggccggaacggccacatgcaggccctctccctccactcgaagcgagatagaacgttcagcagccaccggcatcaatagatgaacagcatcctctgccatgcttttaagatcaaccagagagacaggccattcctcattcagcgcttccagccttgatagctgcagcagcttttccaccatgtcaattaaccgctgggactgcactttgatgatactcagcccctcgtcctgggataccacttgatcctgaatggcatatacatagccttgaatggacattaacggtgtccttagctcgtgagatacattttgtagaaattcaatttgaccctgatggtgctgctgaatacgggcggacatggaatgaaaggtaccgatcagctcgccaatctcacttttatccgcctgcggaaaatcactatcctgtggctgattcggttcgtagttgcctaccgcctctttcaatcgtttgagtggacgcaccagacgtgagacaaccatcagaccaatgacgagaatcaccaaaaaacccgcgatgatagacagtaatgtggttctcattaacggtacatacagtgctctcaaggaagataagggtgagtatacaaaaatacgaaaaggttgtccgggcaattcttcattcgtaaacagtacctttttaccttgaagcacagctatcccttcatgtgttgcggtcagatcctggggagacggatgaaccgatgcaaaaaatccctggcggatcaaaagcaaatgctcgatctttttgccttccattccagagacgcttgagtcgatgatgcggttatccgtgcttaaaataaagtaatcggcagataaaagcacgcccttgataacatagttcaattcagcattatccagtcgatcaaagcctccgtcgctcataatatggacggctttgcgcgcctgctcatgaagcttggatttggcctgattcaccagaatgtcgtcgataagcctgatgaataaaacgaccgtaatacagacggtaataagcatggcgatggacagggaaagcagtattttagctctcatcgtacgcatggttacaactcctgaactgttgctttatatccgaaaccccatacggtgttaatgacgagcgtagagtgatattcagctaactttttacgaatccgtttgaccagatcatccacgactctcacatcacctataaaatcatagctccacacctgctgaatcagatgttctctgccaaaaggtctctccagatgattcgcaagaaacagcagcaggtcgaattcacgtgaggtcaaatttagctcttgtccgtccactgtgactttacgaaagtcagcaaaaatacacagattgcccgcatggcaaagatctgcgcttcctgccgcttgtctatcgtccgatgcagacattccggccttgctcagcctcagcatcgctttaacccttcctaccaactctcttggattaaagggcttggtcaaaaaatcgctgcatcccagctccagtccgtgaatacggtcgttttcttctccacgggcagagatcataatgatcggcatttctgtaaaatcacgaagctgagtcagtagagaaagcccatcaatgccaggcatcataatatcaagaacgagacaatccggacggttcgtacggatatgctctaccagtgttttaccactggaaaaggaagtgacctcgtaggattcttttttcaaatattcagatattaattgcaaaatgaacacatcgtcatccactactactatttttgtcatggccttaaccccttgccgttgttctggatgcttccatcctctctttaagcttaacagaagcccagcagaatagacaaaagacgggtataccgttcccggtcccgtctttcttatcatgaatcgctgctgtatatgccaggcgagctgaaagctaattacacatcaatcttatttcttggttgttactactttagcagctgtttttggcgctgttttcactgtttttgctgggactacttttttaactggagctttgtgagtcacttttttagctacgacatgatgtgcacgagttttatgagctgttgctttgtgtttaacaacattatgtttttttgcatgatgtttaactgtacggtgctgcactttcactgcttttgttttgtggctagccacttttttcgcaacggattttttagcaggggctttcttcgcttgggttgttattttatgagctgttgcagcttttttaaccggtgcttttaccacaggtattttcgtcactggtgcttttgccggtgttttggtagctggagtcgtaaccgcaggagctttgatcgctggtgcagtgctggctggagtcgttgttgctgtagcggcgaatgcactgcttgcccctcccagtacgcttactacggtcaatacggctgctgcatttttagtccattttttcatgattgaatcacctctcctttaaagtatctttagcttatcaggagaattcgggataattgtggagcaaatgtgtgaaaagtatatgaaaaagcgtgcagccctgtatttagaaaatacatgagtctgcacgctatgagttctacaataaccatcttcaactagccaatggcgatccaggaaataataccataattatgcgcggtttcgttccacttggttacgacgatcactgctccattcgacgtctgagatttcagcgtcgcatgaaagagagggtggttcgtcatcgctaccaacgtgtagtctgggtttacaaaaggctccccgaatacaatggtcacttccgtctctccttcactacctttcaaaagaaacggcgctctgccaaactgctgcaatgcgggctgattcgcacaagtacggaccggagtgatgctcaaatgctccggcttcactgcgtttagctccagctcacgtgagcctacagagccttccaccagatgatgaccttcaatgctctgctctgccacatgatggctttgtaccgcagcagcctgcagatgctctggacccacagcttccgggctcagtacctcgctgtcgacggcctgagcttgcagatggctgcgagatatactgtttgcctgaagtctgtcgccactgacaccttcctctggcaaaagtccggagagatgaatatctgtggacagctgagccagtgtcaccgagcccggctttaggtgatgcgaatcaataacttcctctccaatgtggtggctttcaatagcttcctcagccacatggcgggactgtatcgttccatttgcaagcttgctggacgtcaccgcaccttcctgtatagcatcctcagccaccgcctgccagcctacatgctgtggctgaattgcccctgcttgcagatgttccgactggattgaatccagcgcgatatgcctggactgcaccacgccctctgccagtgctgacccttggatcgccccatcggccaaatgttgagcgtgtacggcatgctccgtcaaatgcacggagtttacgctggcttctgccagattcgaagcacgcaccgcccgaagcgcaagcttctcagcgttcacgctgcctgcctggagcgcgtgaaccgatacactcccgggggcaatatgccgggtcatcactgccgaagcctccaaatgagcagaggtgacagattcaggagccagatggctcgactggacggcctcttctgccaaatgattggcttgcaccgcttcgtccgtaatatgccacggctggaccgaatgaggagatattttggcagcagtcacgccatcatccgccagtttgtcggacgtaaccgactcatccttcaaagcatcagtcgatattgcttgtgatgcgatatgcacaccctgaatggttccaaggtgcagatggtgcggctgaatggactccggtgcgatatgcacggacttcactgccccctctgccaacgctctgtcctgtactgcgcccgttgccaagtgccggggatgtacggcatgctcagacaactgcgaagggccgacgctgccttccgcgagattcgtcgcttgcaccgagcgtgccgccagcttttccgaggtgacgctttctgcttgaagcgcacgacctgacacactgtctacggccagatgtctcgcaaacaccgaagaagcctgtaaatgatcagaggtgacggattccgaggccaaatggttcgactggatggactcttctgccaaatgattggcttgcaccgcttcgtctgtaatgtgccacggctggaccgagtgggcagacagcttagcggcagtcacgccctcatccgccagcttgttggacgtaacggagtcatcctgtaaagcatcgttcgatatggcctgtgaggcgatatgcacaccctgaatggttcccgtttgcagatggtgcggctgaatggactccggtgcgatatgcacggactttactaccccttctgccagcgctctgtcctgtactgcaccgggtgccaaatgccggggatgtatcgcctgcgcagacagatgtgaagggccgacgcttccttccgcgagatttaacgctcgcaccgagtgtgccgccagcttttccgaggtgacgctttctgcttgaagcgcattactggatacgctatccgaggccagatggctcgcaagcaccaccgaagcctgcaaatgggcagagctgacggattcccgggccaaatggttggactggacagcctcttctgccaaatgattggcttgcaccgcttcgtctgtaatgtgccacggctggaccgagtgggctgacagcttggcggcagtcacgccctcatccgctaatttgtcggacgtaacggactcatcctgcaaagcatcggtcgatatcgcctgtgaggcgatatgcacaccctgaatggttcctgtttgcagatgatgcgactggatggattccggtgcgatgtgcacggatttcactgccccttctgctagcgctctgtcctgtactgcgcccgttgccaagtgccgggtgtgtatcgcttgcgtggacagatgtggagggccaacactgccttctgcgagattcgtcgcttgcaccgagtgtgccgccagcttttccgaggtgatgctttctgcttgaagcgcactactagatacgctatctggagccagatggctcgcaagcaccgctgaagcctgcaaatgggcagaggtgacagattcccgggccagatgattggactggacggcttcttctgccagatgtttggcttgcaccgcttcgtctgtaatgtgccacggctggaccgagtgggctgacagcttggcggcagtcacaccctcattcgccagtttatcggatgtaacggactcatcctgcaaagcatcggtcgatatggactgtgacgcgatgtgctctccctgaatggttccaatttgcagatgatgtggctgaatggattccggtgcgatgtgcacggacttcactgccccctctgccagtgctctatcctgtactgctccagctgccagatgccgagtgtgcaccgactgcgcagaaagatgtgaagggccgatgctgccttctgcgaggttcattccttgtactgagcgcgctgccagcttttccgaggtgacgctttccgcttgaagcgcacgaccggacacactatccggggccaaatgtctcgtgagcaccgaggaagcctgtagatgcaccgaggtgaccgctcctgcagccagatgtgccgaatccacggccgccacagccaaatggttgctttgtacagcttcgtccataatatgtccggactgcacggcatgggcagacagtttggtgggagttacgcttccctccgacagtttggcagaggtgaccgattcatcctgtaaggccggagtcgctatagcctgcaatgcgatatgctctccctgaatgaccccgctttgcaagtgctccgattggatggattcgggcgcaagatgtacagactttacagcgttctgggctaattccgtctcctgtactgctcctgcagccaaatgctgagtgtgtacggcttgcgcagccaaatgtccgggacccacgctgttttctgccagattggaagcctgcacagcacgggccgctagcttctcagaggtgacactttctgactgaagtgcatgacccgatacactgtcgggggcgaggtgtttggtttggaccgatgcagattgcaaatgattagaggtgacggattccggagcgagatgattcgcctccaccgcttcaacagccagatggttactctgcaccgctttatccgtaatatgccacggctgcacggaacgagcagacagcttagaggaagtgacactaccctcagctaacttaggagccgtaatcgccaaatcattgattttatccgtggccacactttccggcgatagtttcagtgaagtaacggcatgatcctgcaaatgatgggagtacaccgctccgctggccaaatgcgcggtttgaacagcgccttcacctagtatgtccgcagtaacggactgttcttgcaaagccgaggttccaacactgtcttccccaagatgtttgctcagcacagaactctgggccagatgggtcgaatcgacggattgagcctgcaatgcctttccacccacactgttgtcggcaaggtggttttcacgaattccccccgttgcaatgtgtgcgtgtgtaatggcttgaggggcaatcttatttccagttaccgctcctgtggcaattttaggttctgtcactgcttcgtcagcaattttgtcagacttaatcgcgctcgaggcaatgtgattttccttgatagcctgattcgccacatggtgttccagcactgctcccttccctaatttctcgctcgtcacagccccggaatgcaaatgttgctccgtaaccgcctccgatgcaatatgatcttttcgaatgatttccgactggaggtgtacggaagagactgcctccggagaaatttggggaccttgtatggctgctgtagcaatatgtctggtaagtaccgcctcgtcggcaattttgtgtggtaaaatgctctgatccgatattttggatgaagtgacggattgatcgacaatttgcaatgagcctacagattgatctgccagtttattggactgaatgctccgatccgccaggtggcgggctgtcacttggcccgttccaagctgctcttccccgatggagccaggactcagatgctttctttcaatcgctccagcctgaatgtgcgcactggtcactgcctcagactccagatgacgcccgctaacaacgccttcctccaattgttccttacccacaattccattggatagctgcttgcgattaatcgaaccgggggccagatgccttgcatgaacggcatgctcggtcaggtgtgcactctcaatgctgccagcttggattttagctccatccacagcaccatcccgcagtttggaagtggtcacagattgatcacccagcttggagctgtcgacagcttcattagccaaattgttcgattgaatcgtaccactgcgaattttatccgaggtgaccgactgatcttgaagcatatctgaagacacgatccattgcttgaagtgacggctctcaatggagccattcgcaatatgatcaccgctgataatcttatcagccagcttctcaggagtgatgctaccatctcgaagtttttcaccgccgatggagcgatcctgcaatttactgcctgacaccgatgcgtccgacagatgttccaccgtaatggagtctgcggcaatcttcgaagaagtcacagcaccgtcggctatcttaatcgtttgaacggcataatccgccagagattccgtgtggatgctttcttgtttcagcttgctgaaatctatggaagcgggagcgatcttctcacccgtcacagcgaaatcgctcaaatcgtctgtatagatgaaagcattgtttacatgtggggccttcttattgctcaaaatttcctccacatcaattggatcaggttctggttctggctccggctctggttgtggttctggttctagctcttggggttcctctatcgacacttgagtctcctctgcatccgcaccttcaacctctgtctcatgcgaaacctcgatttcaggttcgacaacagtctgtagctccggctcctctttggttgggggaggcggagaagcaacttgatgaagtcttgcttctgtctccctccccgcaggctgtggcttcacacgctgtatcatacttaattcattcatatccgggtcaattacactatagagcggctttttgtttcttatggttttgcggctcttattcttcaagcagctctctcccttctcgtatttatcgttacagcatcatatgcaggcccttaggcacttgccaccccgtgcaaggatacacttttgggtaaaaagggtacttactgaaatccacgtttgaaaaaaaatagttaaaagttaaaatagtaagggtgaagatcgctacaagaagagaggaattacaataacatgattatcaaaccaagaacacgtggctttatctgcaccactgctcatccggtgggctgtgcccaacatgttcaggagcaaattgactatgtacaggcccgtcctgctatccagggaccccgtaatgtacttgtgatcggggcatctgccggatatgggttggcttctcgcattactgccgccttcggtgcgcgtgccaatacaattggtgtatatcgccctagtaatgctacggccatacgtacagcatcggcaggctggtacaattctgctgcatttgaaaaagctgctcaggaagctgggcttaaatccttaagcgtgataggcgatgccttctcggatgaggtcaaagccaaaacggtggaagccattcgcgaagaactgggacaagtcgatctggtggtttacagtgtcgcttcaggtcgccgtacaaatcctcgcacaggcgaaacgtttaattccgtgctcaaacctattggtaagccttacacaaacaagaccgttaacttccacaccggggaagtcagcagcgtgacgcttgaacccgcaacagaagaagaagtacaagcaactgtagaggttatgggtggtgaggactggaaattgtggattgacgccttgcgtgaaggcggtgtattggctgatactgcaacgaccttctccttttcgtatattggttcagatattacgcaagccatctacagagaaggcagtatcggaagtgcaaaggatcatttggaggagacagcgcatcagctgaacgatcagctgaaagttacaggcggacgcgccttcgtcgcagtcaccaaaggactcgttacccaatctagctccgctatccctgtcgttcctctgtatatttctgctttatataaggtaatgaaggaaaaagggctgcatgaagggtgcgtagaacagagctaccgcctgtttgctgagcgtctgtacgcaccagaaactcctgtagatgaagaaggacgtattcgtattgatgattgggaactgcgcgaagacgtacaggcagaggttgagaagatatgggaggcgctgacgaccaacaatatctacgaattgtcagatcttgaaggatatcgtcacgaatttttccaactgttcggctttgagttcgagggcgtagactatgatgctgacatcgatcccatcgtaaatattcctaacgtgcgctaagtcttttcatatcgtcattatgtcagaaaaacaaaaaaagctgttctccagcagagaaacatttcgttctgcatggaggacagcttttgttttttaatttaaagggacacttgtatccgcttcgaactgcaaaatgaagcaaacattgcaattttaaatttcatttgatattgtacaagtaggcatagcaaaatccctcttcctaacaagagggtaaacacagttggacaagtcctaccttgactgaccgtgatactatttgctcagcccatcacaaccatataaggaggtgtacaacatggcaaaagacgttctgtgtgaagtcaattcatgtacgtactgggcccaagaaaataaatgtagcgctagctccatttatatcgtaagcaacagacctgaagacactcacaaatccgaagaaacagactgcaaaaccttcgaagccaagtaaatctttgatttcagacctagttttataatgaaggagcccatgcccgggttccttctttcttatgatattctaacaagaatgataattattatcaagttctttttttgcagtaatggattgaatctttcgaagcacaaaagaagcgttgcctgaacgattcgctccgcttcttttgtttttctgtaaggtcaattactcaacgggattaccatttctaagtttttatggtatgttttgacctctttaccccgggcatccttcataggcgtccacttcttgttgacggtcagcgtatacggcctgatggtgatggatgagggtctggttgcaaacggagcatacatttcaacttcgtgataattgagcgccggagccttattataaattcccatcaattcttgagcaatcagtttgccttgcgggtccgcaatgtcataatacatcttggttgcactccaatttccagtctgtttggatgtactcggcactttaccattgctgtcaataatgatccgggtattggtcgaggagagctcaatctgcttgacggtataactgaaatctccgctgctctgcgttttttccggcttaaggaccagtttgtccttcaccgtattctgcacaggcaccttaaatgaaaacggttctttaatgccgctaacattgatttttaatgccatttcaaatgagtctggcagatttttttcagataatcctttgtctattgcgatttctaatgtattatccaacatttttttattttcgtcgaataccgcgtttgagactctcaataaacttattttttctccattaatagatatttgaggatctattaggtaacccttttctaacttccgggatttgtccttgctgaaaggaggcattgtactgatcttgttgatccccttgcgttcaatttgcacggtcagacgaatcccgtcatatttcacctttttgaccgtcagtgtgacgccatcccgtgtcagactacttgcgcttgccgccggggcagttgattgtgcagctgctgcctggatttgccatgcagtatcggaaatcgttactcctgtacccataatcatagttactgaagctagaatagccgatttgaatattatacgcttcattttaatatattgcttcattcgtatttcctctcctttatcgtccgggttgggttgttttatcattgagatgggactgggatcgtcatttccaaatccttatgatatgttttggcccaatttccctcttgatcctctatcacagaccagtccttcttaatcgtcatagtgtacggcttgatcgtaatggaggtcggtgtttttgtaaatggactgtatgcttcatcctcatggtattcggaatcaggactgcgatggaacagacctaacatatgttgctccagctgatttccgtcctgatccacaatgtcgtaatacattttagtcgcacttaaatcgcctgattgctccgcggtgctcggtactttgcccttgctgtccacaataagacgggttgttaccggagtcagctcgatctgcttcaccgtgtaactgaacgttccgctgctctgtgtcttatcaggcttcagcaaaattttgtttttggataaattcttcaccggcacctgaaattcaaatggctcatggaagccgctcacattcacttttactgtaatctcaaattcgtcagatagatttttctccgacagtcctttggtgatttcatacatagccatattgtcgatgagcttgccgtcttcctttttgccaaccgcgtccgtaaacgaaccgtacaccatcttttgtccttcaataaagaccttaggtgtgaacaaatacccctttttttgcttttccacgggtaccttctccaatgtattcccctcgacactcacggcttcctcgggcaaataaggggacataatcctctcatcttctaccccttggcgttcaatcatgaacaccagccgtgttccgtcaaacataacctctttgatgttcaaggtcactccatcgcgggatacactcaaatggggtgtcgtcgtcaatccagatttactggcttgctgcaagcttctgtcaaaattatattggaatacgctgccgatcaacgggatgttttttaacgtttcggccatagctggggacacaaaaccgcttcccaacaccagtcctcccaacactgccgctacagacgcactaacggccactcttttggtccatgtgccttttttgtacgttaacttcccgctccccccgtccatttcccccaacctcttcataatgtcatccgtatagctaacctgaggcatcttcttattttggaccgtgcgacggatttgctccatttgctcgtgttcagtttgatcctgccatgcgctcattcgttagccctccttttttcattttctgctgaatcagctttttgcgtaaccgttcatacttttttcgcaaagtcgcgggcttgcaatccataatttctccgatctcctcaaagctgtactgctcaacagctttcaacagcacaagatttctttcttccgaattcagattcattagaagctcatcgacttcgcgttcatcatcggatggatagtaatcatctagatgttgctgttgctgttgctctttttggatcgatattaatcgatgccagcggctttttttcctaatttgatccaggcagtgatagtacgctactttataaagccacgccgaaaaggaaacctgctgtctatatttacctattgcctgatatactttgataaatatatcctgtaccgcatcctccgcttcctcgcggtttttcagaatgtaatagcagtacatatatatctgcttttcataagtacgtatgatggtggcataagcctgttgatcgccagctttgacgcgttccacgacggattctacatgttctgtatggtcgttggccccggggctgaaccgttccataggatcacctccttgtgtgtccgtcattatctgtataacgaatactgtctcctgattgtgacaacttctataaaatcaaaaaaattctcgctaaagacaaaaaaaagaagcgtcgctctgaacgattcgcttcttgtgcttgaccttttgtaattgttcttgcttggtcggcttcattcgtatgtgctgtgaaatctcgccataatggtcattcgttttgcggctttgtgccgcgcaatagattccagcgcgctttgccttgctcagcgctttttgtgtttgagtacgtgccatacggcttcactctccttcattggactccttttatcataacatccaatagtcaaatcgtgaatggtttgtctgactcaagcattcttcaattcattaaatgtctgaaaaaatatccggatcgccactggaggccgctacaataaaaacaataactataaaaatgatgatcagtgtataaatcagtgtaccgataatactacataccaatccagcaatggccatacctctgccttgctcgccatgacggttaatttccttcagggaaagactggacaaaataatacccacaattccgataatcaacccgatatagggaatgaccacagataaaatcccgagcaccatcgaggcaacagctttactattcgtaggtggaactactgggggcgggttaaatggggcgttataatcgttcgtctcctgaaaaggatcggaagatcgaggctccttgtacaaatcactcatctgttaaattcaactccaatacgaaaaatagcaattatataagttctagggtaccacaatcttacaaatcaggacagtacttatttcaattttttaaattagaacgttaaaaagaagaaacatagcgatattagcactttttgaggtaaccgggcatacagtattttacctgttacagatcaattgcgctccatgagagcatcctgccaaggaggtcggagctatgctatatcgtgcaacatcccgcagaaagggctcgcctcacaaacgtttaaatgcagaaacacttaggaaaatatccgctgtcatgctgcccttttacaaagctattgcaacccgacgtgcttttgccgtccaatggtcacgagctgtcgttcagggcaatttggatcggatgaaatcccttctctgctcagtagcgccatttgccgccaaacaaggcttaggcacgaatggcatcggctacttcatttcctttttagctcagccaccgatgctctattatacgaatggaacgacgattccaccagggactgtgcagtttacgtttgagccgagagttcatcgcgccatcgcaaaagccgtttttccgctgtatcgcgaattggcacgtaatccatgttttgcttctgccttagctaaagcgatcaacagacaagaccagcgtgcagttcatgtcatgatccgtagtttaattccatcctctgcgctgaaatccgtacaaattgaggatgatggctttgccttgctttttaagtatccctttagcaagtatccctatcgcaatctgctctttcaggagttcacttaaaaaggtcgctactagcgtgcttgcttgagttctccaatgagctcttttcccagttgtatagccatatctgtcagcactcggatttcatccttggttgcatgatccaaatgtgccccgcagcaaatggcaaaattgcccgcaaactcttttcgcaagcgaactgcaatttcctcggtaatataaaattccttatggttttgtaattgcacagtttgaatcggctcgagcctggcccctgctgtaatcgttcccaaatggggctgatcaccgccagaaatgagtacaatgatatcttctcccataaaataggcatccagcacaagacggatacgtccgctttctttttgcaaatgaatcatataatcctctcctgctaaaaattttattgtgaaacgattcactttatgagcattattcattgtatcgcttcctgaacggctcgacaattaaaaatggcccacagcagcctctataaaccgtggcttgctgtgggccttcattgctattctaaaagaagccttccctttcctactggctgttaacggattgtgatcgtatgcacagtcttaccgcttgcgccgtcattatccgtcaccgttagctctacggtatacgttccagctgtggtgaatttatgcttcaccttggaaccgactgccgtatcgccatcgccaaaattccagctgtagctgacgatttcaccatctatatcacgggaagctttggcgttaaattgtacatttttgttcttcttagctgattcattagcctgaataatggctactggcttttcattggatgtaggtggattcggatcagggttctgtcctccaccattggttacatacaattttcctggcgcctccgtctccacttcatttcccgctgcatcccttacccggatcacgatgactccgccttccagattcagagaagatgaagtgaaataagtaccttcatagtggcctgacgaagtttcatttaatggaatatcgttgcggcccaaagtggacaggttgaaaggcagctccacatggaaggatgcctccaaaccggatgcactgtcaaaggatactcgtaccggctgccctggagtaatacgcacatcctcagcagggctaatgttttcaagcttcggcagagctgtatcgacatacaccgagcgcgtaacggttgtttcgttttcggcaagatccttggccgtcaccgtaatttgattttcgccttcgttgataagcaatcgcttgttaaagctgccatcacttccaaattcagcgggctcaccgttaatcgacaattcggtgaggaactcgtcgtacacggtaccgataacactaactacacccgcgttcgtacgggctccttcatcaggagaagtcaggatcaggcccggtttagtctgatcgagcgtcacaactactgtttcggaacgatccgttaatttgccgtataccgctgcttgaacacttagcggattagcacctggctgaagatcaaccgacaaactgaactgacgatccttcactttcgttgtgccagccagctccttaccgttaaagagctgaatatcggctccttctgccggggaagttcctgttacggtaatcgactcttcctgcgtatacgtagccttcgtaggagtcgtaatcgttggggcattcaccggatatctgacgatagcccggatcatgtagttcccttcctcctcaggtgattggctccatgctccgcttacaccttgccagctgcgaagtgcattcgggccactctcatctgtagcaagacccggcgactgtgtgcctacagcagactgtgtatatacgatgtagaagtcaccttgaaccgtcaccggctctggaagctgcaccgtcgtccattgtgtctcatcccttacggcagtcccgtcgaatggaccagccagtaatcgtccaggtgctcctgccgcaccggaggcgtcatagatagaatattggaatgccgttcctcccggattcgggaaggcagagttccagaacaaaagcgatgctcctgtcacttgagccacttccgactcaggcgtcattctgactgcccatgaattgcctgccgcgttaaaggctctagcattttctcctgtcccatcatcgtaggcaatgcctccctggaacccgatgaaaggtttcaacgtgacattcgctaccacactaccgttcggaggagcagtaacggatacactgtcgctataataattctcagctgaaatggacaatgtgtatgttccttccagcacgtccagcgtaaattctccagcctcattcgtctctactggagcaatacgcgcatcctccagcaccaacactttcgctttttggatcggttcaccggattgcttgtcggtaatgaccccatgaatcgtaccgtgaggtacggcctgaagactaaagtttgctcttatgactttgttattctcaatcgtgactgctttcgtttgaggcacataaccataggcttcagccttcagcgtatagtcgcctgccacatgggtgaagctgtatttgcccgtggtcggatccgttttcaccgaacgtccggtttccaataccgtaaccgtagcgctggctggaagactgtcgagaccgacacgtccactatccaccgttgtttctgccggcttcactttctcctggaattcactcttttcagtgcttgtaattttgtacagcgggaattgttcttccgctttttccagcttgatattcgactcaggtacgatgtccttggtcactgtcgcagctggaatgcccagcacacggaaatcgtcaatgtaccagccgttcttgttcacactgttatccgatttcaaacggaagcgaatttgaatctcattgccggtgtagctatccagattgtaataaactggagtccactttttcccgttcgtgttgtgagagaacttgcccagctcgctccacgtgtcgccattgtttttggacacttccacataaccgtaatcatagccggcctcgatttcaaaccagtgattgaaggtcagtgttgcgtttcgtacagcctgcaaattaattttgggagaaaccagcgaaaattcagctccgttctcataattgctatccagatcggttgcccacacattgggtctggacgctgcgctctctggtcctacttccttgggaatgccgcgttcccactcatccttagtaccggaatgagtccagccattatccgagctgccgtcaaaatgatcgctatacagcgtatctggcacgtctactcttagagaagcctcattcgacttgattccttcattgccactataatcctcagccgccactgcataatgataggttgctccaccaaccgtgatggtatctgtgagtgtcagtgctgaggttgtaccgatggaagtataatttttgcctgattgggtagaacgatacaccttgtactgctttacatcctcatcggaggaagcattccaggccagtgtgacgttacccacagtatctgcttcagcagtcaaattgctcggcgcagcaggtgcaacggtgtctggctcctgaatcgacagatcgtcaatataccagccatctttcacaaccgtattgtcactcgtaaagttgaacaggaggtataccttttgacccgcgaatgcccgcaaatcaagatattgtgttttccagccgttgctggtgccggtaaacgataatacctgctcaaacgcattctgattgtttgtggttgctacgtacactttgccgaaatcagaattgttttcaagatcgtaccaatgcttgaagctgaccagtgccccttttgagctctcggtcagatcaatcggaggggccataaaataactgttggagttggcctgatattggccttcgagattagtcgcgatgacctttgtacccgaatgtgcgcttttagggccgcttgtcggagttccccatttccaaacactgccctgtccaccgatattaataccggcaatgtctttttcgaagtcttgtgtgtagcctggttttacgcctttggagattttaaccttgtatacttcagtttcaaatccattattaccataatcatttacacgaatatagtattccagaccagcgctgtccaccaaaaaagtcgggatagacgcttgatatgtaccatctttgctgtcgccggaggtccgttccaacggaatatatacatagtttggcgtacctgctgttttggcaaatgcctcaacggctgtcacgccgacatcatccgttacatgagcagtcagaggtatatcaataccctcgaatgccgctgcgggcggtgtatgctcgagaacaggtgcttccagatcgtcgccacccgttacaactttaccagacacggaacccagaccttgcatgaccgaaccgactgcatccagcgcattaatgacaccatgtccgtagccattgtttggcgaagtaggatatgtgctgtccgtgcgcggtgtagctgtgttcatcaagatttcctcaagctgatctacggtaagcgaatgattcgcttgcagcaacagagctgcaaggcccgcaacatgaggtcccgccatggaagtaccgttatacccgcctttataggcgccaccagcgacagatgaccggatattcacacccggtgcggaaacttctggcttcacctcaccatagggtgatggtcctaacaatgagaagctggccagattatcattgctatccgtggctccagtagcgaaggattccggatagttcgccggattggctaccgaggcaggtccgcccggattggaaagagaggtattacctgcggagaattcggggaagatttgagcatcccgccatgcctgaaccacaggccggaaccattcatcaagacccggtccgcctccccacgagttgttcactacgtctggagcaagctcgggatgaagattcccttgggcatcttttggcgcaagcagccattgaccgccatccagtataatagcatccgtcgtttccggattaaaaatccgaaccgcaatccacttcgcaccaggtgcaacgccaactcgattcgttccgttttcttcagagccgaccatcgtgcccatcgtatgtgtaccatgggaatcgtcttcctgatcgaccggaagcgtcgcatgactatgcggatcgtaccagcttagctcgggattcacgacattgcctgccgcgtccaaaccccgccatttgcgatgaagggccggatgtgtataatctacacctgtatccagattggcaaccacgattccggttccgtcaattcctttttcccacacttgtggtgcgttaatatgggatatgttccattccaccgtagatgggtctacagcgttcttacctgcattgccaggctttgccgatgttttgccatcgtccttctccagctctacagccttctctaccgttgcagacttcgccgttgttgctgtggctgtttcagctgtttcagccgttttggcatttgctccctctgcttgcttgtcaaccgtcaccttttgcagataacgcgtttcattaggcaagactttatcgacctcaggcagctgtgaaatatgatccagcacctccttggtgcttgttacagccaatgcattgacaataaaaaagcttttatattccttcactccgccgctctctgattgcttatccaaataattttcaagcccatattgggttcttgaagccgtttcacgcagagaactgatcacatggctgcgtgcagccattttggcagcggaaggtgttattttctcaagcgaggccttttggagtgcatttttagaaaccttgttggtgtctacctgttcttttaatttgaccagataggtaacatagttattctcctcaaactgtttggtcagtttcggggataccttcgcggtcgtgaccttgtgcgaggctgatttcagctcaagcttggagccatccggtgtgttattcgccaaagcaggttgaacaaaggaaaaggccattagcaaagatagtccgatagatagtggtttcttgaatcgtttaggtttaatcaattacttctccactccttttactaggtttaatgtttctggaataacctgtacagagtaagacctcataccttacacatcaaacacacgggttgcgcaacacgatgtggttggcgaccacctccttcatagaatatagaggcacaaaaatatttggctgttcatagatggtggtacttcataggtgagtttactatcccaataggaagcgatgaaattcagtagaaaccaaggagaaaaagcaggagaacttcgaagaaaaacatattatatcattacagtttatattaaaaattgatatataatcatatattatggaatagtataaagttatcaaaacagatatacaagtcatttttttgcatttttcttgaaattctatgacttttatattcttttatgtacgaaaaccccttttttgcggctacgtaatagtgcattacacggttaacaggtgtatgcaatctctgtacgagccgctcaaagggattttcggggatctttcttaatcctatctttcgctctatatcttgttcattggaagtcgcttatgggatttttgcaaaatcctcacttaagtacggagttcaccgcagcaagcgcgtcgatcagaccatatccgtaaccattgttcggtgaagtccgatactggctgtctgtcagcggcgtcgctgtttttgaaataacatcctccagttgatccacggtcaatgatggtttggcctgaagcagtaatgccgctaatccagcagtatgcgggcctgccatggaggtaccgttccatcccccctcatacactccgcccggtacagaagaacggatgttgacaccaggagccgaaatctcaggcttcacttcgccataaggagaaggaccgcgcagcgagaagctggccagcttgttgttaacgtccgtggctcctgtcgcataggcttccggcagatttgccggattggctacagacccaggtccgcccggattggacaatgttgtgttgcctgcggagaactcagggaaaatctgagccgctctccacgccttggtgactggacgataccattcatccaggccaggtccgcctccccaagagttattcaccacatccggtgcaagctcagggtgctttttaccgtttttatctacaggagcaagaatccattgtccaccgtccagtaagatggagtcggtcgtatctggattgaatactcgaaccgcaatccatttggcgccaggggcaacaccgatttcattcgtaccgttgctgtccgagccaacgctcgtacccatcgtatgtgtaccatgtccatttgaatcagtcggcagcgatgctccgtcaaccgcatcataccagctcagttctggattaacgacctgaccggaagcattcagaccacgccattttcttttcaacgccgggtgagtatattcaacgcctgtatccagattggcgactacaatgcctttgccgtcaatgcctttggcccagacctgtggtgctttgattttagagatattccactcgacacggcttggtgttaccgcatccttatacacggattcttccactgatttttgcgcattctcttccgtcacagccgtatctacagcggcttgatctgcaactgcttggtcagctgtagattcctcaactacgggctgggcatccttatctatttctaccttttgcagttcccgcttttcatccggtaaaattttgtcgatctcaggaagtgtggcgagattatccatgacctctttggtgctggttaccgcaaatgcgttcacgataaagtaactcttgtactttttgacgtttccgttattgacttccttctttaagtattcctccacggattgttgcgttttttctgctgtatccatgagagagttcacaaccgttgtacgtacagaaagcttagcagcagcgggtgaaatttgctctgcagaggccttttggaaagcatgcttggcaactgactccgtatccacctgatcttttaatttaaccagataggtgacatactcactggcactgaattgttggttcagcttggcagaaaccttggcggaaatcgtcgatgctcctgctgaggtggttgtgctggaatcaccatataccggagaaatcagagaaaaagcaagaagagcggtaaaactgaccgacagcgtctttttgatatttttcgacttaatcaatactttccatctccctttacttggttttttaattctcaaggacaaccttccgggcagctacgtcaaaagctcacaaaatagcctctggtactcacctcctttaaaaaatatagattccgccggggtgatatccataggtcatcattctgaggtgaacaacccttggtgcagaccgtaaagaacgagcatcgggtagaaacaggtggacaagtttgaaaatgataagtgaaaaaaatgaagagaaaggtaggataagaaatttagaagtaatcgaggaggttaatgtgcaagtattaaaatacaatttaaaacaaaagaatgaaacatatggtatcttttgaatctagtatagtgtcataaaatcagatattcaagcatttttttgaattttattcctttttttcttgaagaagagaaaaatctcttccattttcgaagcaaatgcaagtctttgttatgcacttggtttcaaggattagaagagatttttcggcattcagcaacaaattttatctgccgctatttacaggtatgggaaccgaaacggctccatctggaaaggatgatttggtttgctgcgatctgcggcacagactcgtacattctcggaaagccatttgcctacatccacagcaatgatcctgattcaccagcgcaagggcagccgtcagggcctctcctgtatgttcgaaaaaatgcttttgtccaatcatgtcgtagcatccggttttctgtagtaatgccagcggttgaggctggagcccggaaacaagcaccgttccgccagactgccggtatttctgaattaatgcggtaaagttaccttctcccgtcatatccataaaagggaccttccccatacgcaacaacaaaatcccttgtaggtggtcagtccgacctcccacacctgagttttccaataccgaggctgcaccgaaaaataaagggccttccacattgtaaatagccacctgtggacaatcatgctgatctgtgaccatatgggcgcctactttttcatgttttacagaaggatcaggaagtaccttatctactgaaagtgtactgctcatacgtttaacaaacaatacaactgccagaattaaacctacctccacagccgttgtcagcgtcgtaaaaactgtcagcaaaaaggtgacaaccagcacaatagaatccgctgtccgcgttttgagaatgtgtgcaaaatgcttgcgctcactcatattccaagctactaccatcagcaccggagccatactggccaacggaatgttggacgcataaggtgcgaaaagcaccaggatgaggagcaccacgaacccatgtacgatgcctgacataggagaaacagcaccgttacggatatttgtggcggtgcgggcaattgcacctgtcgcaggaatgccaccgaacagcggtgtcagcaaattagctatcccttgtccaaccagttcacgattgctgttatgccgggctcccgtcataccgtcagctaccaccgctgaaagcaaagattcaatagctcccagcattgcaataacaagtgctggcggcaagagtttcacgatcaaatcccacgtcatcacaggaatatgtagctcaggcaaagatgctgaaattgcgccatacgcagagccaatcgtagccacctgccctggaaaaagtaaagctgccaccagtgttgacaagagtagaccaaccagtgagccgggtatcttgggccattttttaggcaccaaaataagcgcggcaagacagatacaagccgtcaggatactatatacattcagtgaaggaagccgatggatgagctctgccatggaaggcagaaaagtttcatgccgctctaccccgcgcaagccgagaaagttagcaatctgaccgctgaatatcgtcacggcaattccggccgtaaagccaattgttactggcttgggaataaacttaatcagtgcccccagccttagcacacccattaaaacgagcataatgcccgccataaaaccggatatgagtaggttctcataaccgtattgcatgacaatagccagcaaaatcggaataaatgcacccgtaggtcctccgatctggaattttgaccctcccagcagcgaaaccaaaattcccgcaacaatggtcgtatacagcccatattccggctttactcctgatgcaatggcaaacgccataccaagcggaatcgccacaatcgctacaatacttccggaaatgagatccttacgcaaagcccctgcgttatagccttcgaaccttcctatccacttcattcctgtaacccttcttttctgtaatagcattacttctcgttacgtataccttccagcaacgagatcgcttcgaccaaatgattgtcaaaaatccgccgcgccaccgcaagcagctccttcaaaagcggatcacgtagtgaatacacgaccgatgtaccttccttgaagctgttcaccaaatttttggctcgtaaaacggccaattgctgcgatacggcagaaccttcggaaccgagcgcagtctgtagctcgttcacattccgttccccttcactcagcacctccaaaatgcggatgcgcagagggtgagccaatgctttgaaaaagtcggccttaaatttctggagatctccttccatgcctgctccgtccccctcacagaattgtcctataaacgttcaacaatatctgaatatttgaatatttagtacaatatcagctttgggccaattgaactatgatgttactcacacttcaccgtgagtaaagtcacatttccccacacttctatctttcagggttgacagcttccacaggtttccattaacatagcaattaactttaagaaaagggggccgacagacatgactgagctttacatgataacgacagacagacagcatgatacaaccacatatttgagttttcgtctcatcggccccgttcgggcgacatgatgggtgatatcacgctgtctgacggcgtgattagccaggcttttttatttttttatgctattggaagaacaggttattttacgtatttatgatgtgttgatcataaaatgtaatgacactttcggtgcaggaagccgtagacgacaagtctgcggcttttttgtttttttatatctttttatgcaagtatttatgaatttacttgaagaagggaactacccatttatatgaatatacaacatacaaccgactcgtccttgcataaaggaccatacagccatctgatgaagcttccggcaggtgatctgaccgtatatgcttctcagcaacttttctcctcactagattacaaggtgttcgagatggctaacaacaatttacaaattccgggcatccgctatatgggatacacaccagatgtacatgtaggcgtcggaacctgcatcggtacgactgctgtatggggaatggaggacggctatgtatctccctccatcgttggcagtgatattggctgcggcatgcgcgtacacctgaccaatctgcacaaggatgctttgaaggaaaccaagctgcgccgtaagctggtcaaaaccatcgacaaatatttgcctatggaagcccaccagcgcgggcattattcggatatccgactggagcatattgtacgcaagggtctgcacggcttacccaacaaatatattccggacagctacactcctaagaaatccacctcactcacccatgtagagcacagtaagttctcctttgacgaggaggtgctgaatcttgtcgaagatcgtacgtggcatcgggctcaccgacagcttggcacgctgggtggaggcaatcacttcgtcgaaattcaggcgattgaaatcgcggaggaaaaccgcgaaacagctgaagcttggggtatgttcgacggtcaggtggctgtgatgattcattcgggatcacgggcttggggtggagcagtcagccaggccagttcatctgccattgccaaggcaatgagccgtctcgggctcggtacctccgacccaagactagtattcgcaccgctggatcaccccgaggctgcacattatgtcgatatgatgtattcggcgctgaattatgctgtggtgaaccgacatctcatcgcttactccgtgcgtgaagccttccgcgatgtctttggtacaaagtgcgagttgcgtactttgtacgatctaatgcacaattatgcttgggaggaatcccatccggatcacggcagcgtgttcgtgcatcgtaaaggtgctacgcgtgctcttccagcaggacaccccgacaatccgcggccttatcaggcgacagggcatccagccctgatccccggctctatggggacagcctcttatattatggtaggtttaccgggcggtcaggataacttccactccatttgccatggagcaggccgtattcgctcgcgttctgcgaccaaacgactcgtcagtgtggacgattttgcaggggccctgggtgtagggacagacgatgaaattgtggtcaatcaggcatcacttgaaagcattatcgacgagtctccacaggcctacaaaaatgtagatgatattatcgtaagtgtcaccggggcaggactcgcagcagttgtagccaaatgcaagccgctggccgccctgaaaggagccaaataatttgagtatagacatcccagctatttacgaatttgatgaacgtacagatggacgcattaccggttatgccgcttatgcccgtctgatcgacggtatcagtgaagcactctataaccgctacggcgtaaaatacgtgctgtatgccagtgatgatcccaatattgagtattgggatctgctggaggaggacattcgttcaggtagccccgatctggagcatgtggcacgagttttcgatcgtttggaggaacgcaccatccagtatgacgatgacggaccgactcctgaatacggcgtgcatctgtcgatgcgtaataatgtattcgcctaccccaagtggggcatcgcgctggcgcgagttccctttttccgtgagaatggcgtgtacaatgaagattacgtatttgcgataggcgaccaggagctgcaaggcttcctcgcgggagtacgcggtcgtgaacgtaagcagaatatgaagcgtgtcaccgtttttaccgacacaagccgtggactttctcggcaggcagagccgataacccgcgcaattacgcgggatgacgtgattttgaaagcggaaatcaaacgggatattttccgatcactcgatcagttttttgaagcggatcgtaccttctatcagacttataacattccttataagcgtggtattttgctatatggccatccgggcaacggtaaaacaacacttgtaaaatctattgccagcagtgtaccgggtccggcagcctactggcaaattacggagtatacaaccagtgaatcggtcaaagaggtgttcgaggcggctactcgcctggctccaatggtgctagtcattgaggacattgattccatgcctcaggaggtgcgttcctttttcctgaataccctcgacggtgctacatccaaggagggcatcttcctcatcggaacgaccaattatcccgaaaaaatcgacccgggtctgatgaaccgggcagggcgtttcgatcgggcctatgaaatcagtttgcctgacgaagcgctgcgactggcatatctcaagctgcgtaacttccttgtttttgcaggggaaacaggtacacagaaggcggcagccatgactgacggtttttccctggctcagctcggagaactgtatgtcagcacggctctggagtggcatgagcagggaaaagccgatattgaactgattatcaaaggtatgcgaggcgagctcgataagagccgtaagcaggactggttaaaaaatgtggccgaaggacgtgttgggttcttctgatttatcctctcattgccttataaagaaatttatgctatgttgataaacaataaagtatcgaaagggtgaccttaagccaatgatctactaatcctattccaccaaagaaataatcgtaattttacgaattttctggataggattagtgtaggctttgggtattcacgataagcgcattgcttctttgacgggagcagtgtatcttcttgttcgtacgtctacctcctatccagaaaccaatggatcaggaggttttttgcatgaaaagaatacttggaatcctaatgattaatatcttcatcgttatggtcggcgttggtttaattacccccatcctgccagaactgatcattgaatttggtgccagtgggcgggcgatcggtttattggtagcagcctatggagtgacacaattccttctctctccaatgactggacaactgtctgatcgatatgggagaaaagcattcatcgtcgtaggtggcattgtttttgctgtagctaaatttatctttgctatcggagatgagttatggatgctgtatacctcaagacttctggaaggaatggcagcagccctgattattccgcccatgatggcatatgtggcggatattacaacaaccgaagaacgcgccaaaggaaatagcctgctagccgcagccatgtcattcggatttgtcatcggtcctggacttggtggtcttcttgcaggatatggaacgagagtgccgctgtatatagcaacgggtgcggctattattgcagttattttttcaatgatttgtttacctgaaagtttgacgaaagaacaaataaaggcagctcgggcaagaattactcggaaggaatctatgtacaaacaatatgtgagatcgttaaagtcaaagtatgcgatgctctttgtacttgttctggtgatgacctttggactcgctaattttgaatctgttcttggtttatatgtaacgaaccgcttccaattctcgccgcaagatatttcaattattctaaccgcaggtgctgtgatcggagtcggtatgcaggcactagttgttgctaaaataattaataagtttggtgaacaaagggtgatcaaaggttcgcttcttttcacctcagctgcttatattttgtttctcttcgccatagatttttggagtatcttccttctcacttcccttattttctttgctaccgctatgcttcgtccagttcttaatacacaattatcgaagatggcagggaatgagcaaggatatgtagctggtatgaataatgcctatatgagtgtcgggaatattgtcggccccactctagcgggatttttatttgatacaaatatgttcgcaccattcatagcaggctgttgtattctattgggtacttttttgcttacattaaaaatgaaataaaagaggacaaatgatgagtaaaaggcagctacgggtgcggggcttatttttcaatgcccgcctgtagctgcctttttattcagtctaatcgcttatatttaacaaacactcaaattccctttattctgcttccccgcttagacgattcaaaaactgaatagcccgcgaactggtcggctgctccaggacctcatgcggcgtaccctgctcaacgattacaccctgatccatcaaaatcacatggtccgccacctcggctgcaaatttcatttcatgggtgacaataaccatggtcatcccttcagcagccagttgctttatgaccttgagcacctcgcctactaactcaggatcaagtgcagaagtcggttcgtcgaacaatagtacctcaggttcgaccgccattgcccgggcaataccgacccgttgctgctgtcctcccgataactgatgcggataggattccgctttatcagccaaccccacttttttaagcaactccaatgcacgtttgcgcgccacgtccttgctctttttctgaaccgtgacttgtccctccatcacattttgtacggctgtcatatgcgggaagaggttgtaggattgaaataccatccctgtccgcttgcgcagcgccaaaatgttttcttgccggagcttcgttcctttcgcaaaattcagtgcaatatcccctacttggatctctccttggtcaggaacctccagcaaattcaagcagcgtaaaagcgttgttttaccagagccggaaggaccgatgataacaagcactttccccttatccaacgtcacgtcaacacccttaagcacttccagcgagccgaacgatttgtgtatattccgaatttggatcaccggtacaatctcctttatctgacggaaaaacggcctagtcgcttctccaggtaattttgcagcacagtcaaaatggtgctaaacagcaggtaaataactcccgcctcggtatacaccaatagcggttcgtatgtggtagctacaatctggttagccgttctgaacatttccacataggtgatggtcgcagccagtgaggtatccttcaccaagctgatgaatgaattagccaacggaggtacggacacacgggatgcttgcggaagcacgatacgacgcaatacttgccagcgcgtcatccccaaggagtaccccgcctcccattggccttcctgaatggatatgatagccgcacgcataatttcagagctataagcccctacgctgagggtaaagccgatcactgaagcaataaacgggtccagtgtaatacctacggaaggtaaaccataaaaaataatatacaattgcaccagcaaaggagttcctcgaatcacccatacatagaagccgaaaatcagcttgagtattctccatttggacagccgggccaacgctgtaatcagcgccagcacgagtccaagagcaaaggagataagcgtgagcggaatcgtaaaagaaacccctgcttttagcagaggcaataatgaatcgataatgatttgtatttggcgatcatccattgtacagacatcctttgaaaagataggtttgagaagattcggttcgacttggcgaacgttgggtcttcatttattatttggatacgtcggctccaaaatatttctcggaaattttcaggtacgtaccgtcagccttcatatcagccagcgctttgtttacttcattgatcaaatcttcgctgcccttattgaatacagctgcgctgtgtgaagcatctgaagattcgtccacctttttaattggtgcgtcaggcttttgcttcttcagatcaagataggataatccatcattgacggtcgcatccacccgtttggaagtcaggaggtcaatggcttggttgaatccctctgttgccacaatttctgcgccgttgcttttcgcgatttgagtcaggttactggtcagggactgcccagcctttttcccttttagatcagcaaatttctggatgtctgtattgtcttcgcttacgatcagaactgccttggagacaatatacggatcagaaaaatcatatttttgcttgcgctcatctgtaatggatacttcattgaacaccgtgtcaaaccgcttggagttcaaccctgcgaatatgccgtcccattgcgtctcgataaactccggttgtacacccaggcgtttgctcacttcagtcgcaatatcgacatcgaagcctgtcagtttccctgcagcatcatggtaggtaaacggagcataggtgccttccgtgccaattctcagcttgccgcttgcttttacagattcaagagtagctgtagcagtggtatctgcttttccattattagatccgttatctccggtagatgcattattggtactggcgcctttatcgttgttaccgcatgccgaaaccagcaatgccatcacgatgagtacaatcggcaaaaaactaaattttttcattgtatccacactctttccctttttcttgataacctaacacgcggctggtcattgaatagtacatcattcattttcacgcgtcaatgcttttatccaataatccctatgcataaggtaagttatatatctttgcaccctgaagttattctaggttgactctttcattggcaggctattcattacaactcccctcacagcaactttttctgtacccttacgttagagatttcgtataataggttttaatatgcagtttagaaatataccggagtgtgatcatggatacccaaaattcaaccttatcctctacatcacctgaaggaagtcactcggcctgggctaccttcacttcacctttaaaacaatccaaagcgttcaccttgttgtggcttggacattggatcgcaatgttggggagctcagtcaccacagtcattttgccactggttatctattccctaacaggctcgactactatcatgggactggcgatgactgtttatatgttgcctaacgtacttattctgcctttcgcaggtatgatcgtggatagaattgaccgaattcgtctccttctgtttacgaatatcgcccggtttggactgatgttcattgcggcggtattgatgtttacaggcgggatgaaattgccggttctattcgttggcctagctttgtacggattgatggacggtatctttaatcctgcttattctgccttacgtgcacaggtattcacacctgacatacgcaatgcagccaacgcgtttagtcagatcagtatacaagccgtccgtctacttggccctccgttaggaggcttcattgtatctttttcctcacctggtgtcggctttggactggattctatcgcttatctgatatcttttgcctgcttttggatgctgagcgctcatttggcctccatcatcggcaaaggtcaggtagatccagaacagcaagatcagggtaggcagcattttctcaaggattttatcacaggctttaccattctcaaaagccatccttggctatggattacgattctcgccttttccttcattaatatttgttattcaggcattatcgctgtactcattccgtggctgttcaaggttcatcatggctacaatccagtcgtatacggcattgcgatggcaagtagcggcattggcgctatgctgggggcctttgtgtatggatcacgcaagcattggaagcatcgcggtctactcgcttacttaggagcttttgttagcggtcttgctttactactgttgtctgtagtcacctggatgccaggactgattatgagcatgatgctcgaaggatttggcattatgatatttgcgattatctgggagacaagcctccaggaattagtcccagccgagtcttttggacgtgtagctagtctggatctaatgttttcctttgccctgctccctgtcggctatctggcagtaggtgctgtggcagataagcttggtggtatgttcacaattggcatgtttgcaaccatcggcatgtgtatcgtgctgggcgttctaagtgttcctcatatcaggcggtttcaataggaaaaattcgtcattttcctcaaaaaaagctgctcccacaggttcattttcgaaccttgcggaagcagcttcttttccattttagccttgcgccccatagggctagtctattcaatgattcgtaaagttagcctctactccgtccaacggaacggaagatcaagcttacaatcacgaccagcacaatcgcaccaattaatgcaggaacgatgtagaacgatccgatttcaggaccccagtctcccagaatcaagctacccaaccatgcaccgataaaaccagcgatgatgttacctatcacgccacccggaacatcacgacctgcgataattcctgccaaccaaccaataataccaccaacaatcaatgcccataaccaactcattttgcgtcacctcgtttaagtttttatcgttgtgttctattattaaccactcgaactccttttgaacacacagaagacaattggttaatattaccaccgaacgaaacactgatttaggggctatgataccatcctacgtgcctctacgactatttatacaccccttgtgtgaaaagtgtgtctaatatgcgcttatccttgtattcctgctttttttgtgccatcctcacattatggcttcattaatgtcacttcatgcataagttacaaaaataacagattaattaaggagtgaccccaactggagtgtcgagtaggatgtgccgcctgctgtattgccattacgatttcttcccctattcctggcatgccagatggaaaaccagctggtgttccttgccctcagttaacttccgattaccgttgccgattgtttggcaaacctgagcgcccagttgtatgcagtggattccatgctgatgaggatacgtgtggaagcactaatgaaagagcatttgagctgctaagagagctggaggagtcaactttaccgggtaaatcttaaggagaagttcattctatatgaaggagaattttaattatgaatgttattgaaaaaagaattgccgaattgaagcaatatcggcccgatcttaccgccccgaaggatatagatttattctgggccaaaacattggaagaagttcacgccaaacctgtacatgcgttcaaaactctcgtagaaacgccatatcctcatattcttgcttaccgagttacttttgagggtgtcgatgatacgcctctgcatgcctggtatgtacgcccccgatttgccggagatcaaaagttgccgtgtatcgttctgtttcatggctatacaggcggaaaaggctatcctgaagattattcctcttggctcatgcttggctttgcggtattggccgtagatgtgcgtggccagggaggagaaacgggagaccgtctgggtgatcctcatggtacggttaaaggctgggtaacgaaaggaatattggacaaggatacctgctactacaaaacgattacaaccgatgcccttagagccgtagattgggtagcggagcagtcggatgtcgattcggctaaaatcgcaatcagtggcgccagtcaaggcggcggactttcattaatggtggctgcgctcagcgataaagctgccattacggtagcggatatccccaatatgtgtcatatggattttggtatgatgaattctaccagttccctgacggaagcagctgaattcgccaaccgatttccggagcatttggagcaggtactacatacattaagttattttgacgtgatgaatctggctcatcgcattcgtaccccgatcatggtatcggtagggttcaaggatacggtgtgtatgccagagacgattttcgccgcttataaccgtattgaatcaccgaaaacgattgaaatttatccgtttaccggacattgggttgaaggctttcaaagacgcaaaacggcagaatttttagttcagcatttttcttaattcgatttccaacgctcgaaagtacaatatatagaatgattcctccggtgcacaaaaaaagaacaccacgcatcaaactgcgtaatgttcttttctactgcatcggggccagtcccgcttacgcccgacaaactcctcgacaactcacacgaaacaaatcttctaagattacgatgcagctcgctgttctgctgccgaatcccctgcccattttcgcacccaaacaaaatccataatcatcagaccaaacgggatgaaggaggcaaacataataaaaagaggccgccgtatagaccagtgcagtgctgtttttccatagattaaagcaacgaggagcaacaaaaagctcacccggtatatgttaccaatcaccataaccgcctgggtcatgcccgcagcttgcaggggctggtgggtgaatagtatcgccaaataagctatagcttgaatccagagcatgagtcggacacgccccaaaggtgttcttaacacaaatttaatcccctctccataagcaaggatgttctctcatcctttacacatcctttattataacgaaaaggttcccaaactccaacctatccatttttgagttttgacctaatgagttgtgtctgatacagttgtgtaagaggtgattataaatgcttaaattgggtatattggaccaatctcatattcctgaaggcggtactgctcaggatgcattatccaatacaacagatttagcgcgtgaagctgatcaactgggatatagccgttattgggtatccgaacatcatgcgtccaaaacactagcgcactccagccctgaggtgctgattgcgcatttggctgctcacacatcacgcattcgtgtgggttcaggcggtattatgctgccacactatagcgcgtataaagtcgccgaaaacttccgcttgctggaggcgctccatccaggacgcatcgacctgggaatagggcgtgctcccggtggtttacccctggctactcgtgccctgcaggaaggcaagtatcaatctgtcgaacaatatccacagcagattctcgatttaatcgattacttccatgattcggtgcctgacaatcatcgatttgccggtcttcatgcctccccgatgatatcgaccgttcctgaattatggttgctcggctccagcggagagagcgccagattggccgcgatgatgggtgcctcctatgcctttgcccaatttttcgggactccaggtggtgtagaagctaccgcacgttaccacgagcaattccagccttcgatcctgggtgataagccccattccatggcggcagttacggtggcctgcgcggaaactgaagaggaagctgagcagctggcgtccagtgctagtttgtatttccttttgctcatgcaaggtaaagaaatgagttctcttccgtcggtgaaaacagcaatgtcctatccgtacacggagttggatcgtgagcggctgcgtcagtctgcagcctggcgcgttgttggtacccctgaacagtgtaaagaacaactgctaagactggctgagcagtatcgtaccgatgagttactggtcgtttcatccattcatgactttgataaacgtattcagtcctaccgtctgctggccaaagcttttgctttggtatagacgcaattgaacggaggctgagcttctgaaacattaaaacccccgcctgcctatgatggcaacagcgggggtttgtcgtagagaagggttcattggaaccaacccctctgcactatggaagtaattcaagcaccacaaaagtcgaatatcatatggtactttggtagtatataaaccgacactaaagggtgggtcgtccactcctaaagttccagtatccatataccaaagacgtatgctttatactccaaagcttagaaagattgcaccctaaagtcccatatctttactcgtttcgataaagttagtaacggttaaattctaaggttctataccccaaaccagcttaccctgctgatatacagtgccatggtcccagtctgcgaatgctgtttgggtagcaccataggagtaatcgttggtctcatcaaaattgctccaatttgcagcatgaatccggggttgaatttctccactttcctcgccaggctgaatcgttcccgctccatctgtgaaagaaatctccacatatttatcagccttggactttggattcggcaatgttacaaaagttgcttttaccttttcagtgccaatcctagcccagtccacaaaaaactgttgagcttgtttgctttcatctgtgtaatagtagcgaatttttagatcactcagctttacagctgtttttcctgtgtttttgatattaaattcaggacggattgcgttatccttggcgttcgtgtcaccagtgcgatactgaagcacaatcccttgatcgttactgcctggtgtacttcctccgttgccgttattgccgccgttgttgccaccaccgttatcaccgccagtattgccagtattgccagtattgccatctccgccgttatccccaccgttgtttccgcctccaccattgttgctggagccttccagaatcgcctgttttacgaatttgccggaagccgacaattgcgaatcaggccatccgcccttacggtcagcaccaggcaacagcgcagcagaggtctcatttttatctgccaaagaccagttagtccagctgattccacggcttgcaagaaaatcagtccatactttggattcattcaggaacggaccaccgttacccgaagcatcgcttgtaccccactcggtagcaaatatgcccacgcctttgttcagcgcataatcgacccgatcgcgcaagtactgtccatgcgtacccgcatagaaatgtacggtatacattgtattcttgtctggaagtggatgatctgctgcatcatgtacatcctgactccatgtgcctgttcctacaataataatattgtccgggtccttagctcgaataacctgagatacctcagacgcataaggtcggatttgattgttccagttcacattcccattcggctcattggcaagttcatagattacgttaggcaaatggccgtactgagtcgaaaattcattaaaaaaagctttggcttcatttttatgaatgttcggatcgccatctgaaagaatgtgccagtcaataatgacgtacaagcccagtttctgtgctgcctcaatcgcttccttcactttatttttcaaagaagggttggcaatataaccattttcttcagtgtacagtgcaacccggaatacggaaatgccccaatcgtcccgtagccatttcatagagtcctgatttaccagatccccaaaccattggacaccgtgagagctaatccctttgagttgtacaggtttaccgtttttatccaccagtttaccattctttactgaaagttgtccgtaacgttccacaggggtcgtcccggcagcctccgctgtttgcgtattccagttgaatccgttcgttaacgttaatagcaatactgctgttagcatcaccgctactctttttgcgatccttgggaggacccattgcccattcatcatttacacattccttcctttttataaagtagatgagacttatcagtacgttgttctccgctctttcgccccctccttcatacaacaagaggatcaggtccaaacatcgatgtcacttacctgtatatggatgatactactattatagttagtttcatgttacatttcgactctatgattgaaaatgaacaggaagtcacggttttgggatgagttctgcttggttggctactatagaatactaaagggacaaaagactcatttaccgatagcaaaattcggagaatttttagttgtttgataaaaaaagactgcttcccgtgccttggctcggtagcagtcttatagatgatcttatatgtgatcgaataatgttacaaatttcgtcttaacgtaggatctccctattacccctgagcagttgcttgaggttctttggtcgtctgatcttccttcatatcgccgccatccgtcgcttgatctgtcagtacagtctcagatgagttacctattaccttgtcaataagttgcagccaaggttcttcactacctccacagctctcaatatcaccgagcagggactctagcgtggttccttcttctggcaaatcaataactaaactgtcttcgtcaacttggatggtgcagcaggttttcattgtaaatccctcgcttaattcatatttgagcatgcagtaagctagctcagatgggatgaactcccatggattccgggataagccctttgaatccgtctgaaattataaacctaatgcacatcaattgcaatgaacaaaccttgaacttttaagaattagcgagtgttacaggcaggaatggatatctaaacgaagtattcgcgccagtaattttggatttatagaattagttcaaacattcagcaagctccgtaaaaatcactccaagcgcataagcccccgcgtctggataaccaaggcttctctctcctaccgttccggcacggcccatgcgcgccacgatgtcttccgtctttttggcccctgatacagcggcttgagcacctcttacaaaggctgtcttcacgtcaaaatctaatttcgcgctctccgcccagctatccgcacatggcactaatgcatctataagcgttttatcgccaacggcggctcctctgccgaaagaacgttcgcctgtcgattgtatgccttgcaccgcagcctgcatcatatttgcgaattcagaaacggtgagttcggtgagtttgcccgcagatcgtgccgctgcgcgaaatgctgagccccagatcggacccgaagccccaccgcagtactccatgatgacgagcgagcatgaatgaagaaaggctcccatcgtcaaagaatcttgattcaggatgtctctccattcccgtttcagctgacgaaatcccttagcaacgctcattccaaagtcgccgtcacctgcatgagagtcaagatcgcagaaagatacctcattcttgatgataacctcactcatcttatcgactaggtagataagattgttcaacgtaactttgttgttctcaataaccgcgaaggcagggtccgtttctacctcaaaggatacttgccgattttcgtctgctacagttgaaatatccatgaattcgacatgatcaacaggtccagccaccttgaacgcaggtgcgttgctttcataggagaggagcgttttcagttcgttgtccagcttcatgatggaaaccgagatacctgccatatcgatactcgtcatataattgttgacaaaagtgcgatcgatcgtgatccccttcgctgctagttcgcgagtgaccgaatggttgaaaaggtacagttcttgcagaggcgtaccgccgaaaccattgatcaacagggcgatttctccgctgaagccagtttcgatctgcatgtctcgaaggagatcggttaccattctgcctgccagcgtgtccgcatccgtcagcttctcgcggctggtcccaggctcgccgtgaatgccgacgccgtactcgatttcatcatgcccgagctctactgttggcgtgcccttcgccggcacggtacacgaagtcagggcgaatccgatactgcgtacattcgcagcagctttctcggccactgctttaacttccgccagactccggccctcttccgccgctgcacccgcgatcttatggacgagtaccgttcccgccaccccgcgccgtccgactgtatataggctgtcttctacagcgatgtcgtcctcaacctttacatagtccacttccagaccgtcttcagtggccaaatgggcggcgtttctaaagttcataatatcgccgctgtaatttttaataatcagcagcgcaccttttttcccagttgttgctcggatggcctgatatacttgaatttgtgaaggagaggcgaagacatcaccgcagaccgcggcatcgagcatccctttgccaacgaagccggcgtgggcgggctcatgcccgctgccaccgccgctgatgagcgttactttctccgcgttcaattcctttttcttgagcactttgtattttggcagaaattccaattcgggatgcgcaagcgcaataccactgcacatctcaaggaccaaattttccgcacggttgatgacctttttcatgctactttacctccgctttgtactggctcccgatacggtcggccgcagcgattgccgctgcaacctgctccactgtgaccggaaacggcatggaatgaatcgattcctccagaatgcaagcctttgcagctacttccatgagttcttcctggctgatatgatcgacgccgatatcagccaagcagaccggtaaaccgacggctaaacagaaatcaaggacctgatgtaattcttccgtgggtgcgttttcgagcaccagctgtgcgatcgtgccgaatgcaactttctctccatgataataatgatgcgtgccttccaaaatcgtgagtccatcatgaattgcatgggccgccgcaagtccgccgctttcgaagccgaggcctgagagtaaaatattagtttcaatgatattttcgagtgcttgcgtaacttggttttcatcacatgccgcttttgctttggcaccatctttcaacagcatttcatagcatagcgttgcaagtgcagtcgccgcattcgtacctactgctggcgcacactgtccttcgcgcactccgttaggcagtccggcattgaccctggagtaagaacgagaagtcgcacgggcttcaaagtaagttgacagtgcatcacccatacctgatacaaggaatcgggttggtgcattagcgataacggtggtgtcgactaatacgacactcggactttgcttaaaataggcgtaatcgtcgaaagcgccttctggggtgtaaagaacggccgagtggcttgtcggtgcatccgtcgcagcaatcgtcggacagatgattagcgcttccccttgagccacgcatttcgccgcgtcgatcgcttttccaccgccgagacctacgatacaatcgcatccgtttgcagtagcaatttcctgaagtctggacacttcctgtctggaacactcacccataaaaccgctttcaataaaggttacgttatatttacccaaagtggaatcaagcttatcttttacccgcgccacatcgtcaggatgcgcaatcagtaaagcggatttgccgaaggtgctcacatagtaacccaaattcaacaattcgttttcaccttgtacatatttgcttgggctgataaaagcttttctcatctataattcctccttatgattgtgttggcttcgttctgattaagactataaccgaaccatgtaaactttacattggaggaatcaaggaatatattataatttacaatcgtatttttttgcactgaagatcacgaattgtacttttttgttattgcttacagaataatttacctataagggatgagaatcttgatacgtgaacatttgagcatccagaaaatctttgatttgaaaaagtgggagcagttgcaagattcattagcatccgttaccaaattagccattctcaccgtcgattataaagggaatcccgtaactagccacagccaatgccaatcgttttgcaagaaggttcgccaagatgagaatctccttccctactgccaaaaatgtgactctcgcggtggacttgaagcggtgcgttccaacaaaccttatatttatctctgtcattatgatatcatcgacatcgcggtaccgatcattatcgacgataagtacatcggcgccgtcatggcaggtcaggtccgcttagccgatccttcgagcgccttacatctcgagcaaatcctcacctcaaaaaatgaaaaactgtacagttccaaatgggaagaacttaagaacgactacgccgatctgccgtccatgacctatcaggaaattcagacgatctccagcatgttatccttattgtgtaattatattgttgaagaagcgatgaacaaaaatcttctcgcagaaatgttcgagaaggcgtcggccacacagtccactccacagttgtccgagatccttcctggctactcgttggagcatatcgaaaaccttaagaaagaaatgaataatttcttagcagatgcctatctgaattcctcaggagatgtggatatttcgtgcggaaatcccgtactaaaacccgccttcgaatatatttttgagcacaaaggtgaaactttttctctgaaagccttggctgacttatgccacattagcccaagctattttagtcggctgtttgcgaaggaaacgggagagaacttttccagctatctttcccgcctgaagattaaatgggcgaagcagttgctcgaagctacagatattccggtatcccagatcagtagcgagctcggcttcaatgagccggggtatttcattaaaatattcaaaaagtatgaaggcacaacgcccgcggtgtaccgaaagtattacaaaggataaaaaaaaacgaaaaacagatgattcacgggcctaacgtcaccatgatcatctgttcatattgttctgctcaagttgcgtatccaggtgtgcttccaggctgcctgagattgtgttttgcgttcaataaccatcccctttttatcagcaattttatggagtgtttcgttactgtagtgtttctgactgatcctgaacgttcgtttcattgtgcatggattcctatttatgaactcctaaaaagggcttattccttgatacgacaaccccgttgacttctagcttaatttcgaacacatccgtcttgcataaaaatgtagaatttcagcagattaaggaatgcataattcatataacaagcgactttagtcttagtgactttttacctgtttttagatatatgtcaactttttatttaaaagaatgcataggctttcatagggtcgaattatttagaaagaagctaattattgaaaaaccccatacaagtttactgcttgttttgggactagagttattcaccagtatttgatagtgtcaccatactacttaggtcatccagtcgtttacctttcgtttagtcgtctctatcggaatgtcttttcacgtttgatagcactttggactatattgggatgactaccatagcacacaactgttcattctcttcaagtaaaaaacttatttctctcatttttcgagtgaaataagttttttaaagatcaattataatttttggagtcaattaattgagtaacttcatttcacaatctgttatttttgctctctttaattagctattaacatccttgtttacatgtatttaatctattaactttaacaatatcatttacgttataatcatcaaacttttcaagaagagcatcaaagccttgtgataattgatattccatttcttcctggtatattggacaaacaaccaaaaattgtattgatttgtcctcacttaacattaacgaactaaatccttcatcttcacgaattggaggtaataatagcatacaagtaaaatcattgttatttgcaattggttctggaggatcgccattaggtatagtgtctccataacaaaaccaagtgcttctttcattcgggaacttgccaagttttcttagccaaccaaatggccaataatctttaaaatctttaatatcctctttagccacaggccatgatgccggaagatacatgatgagttctgtatattcccaatctttattatcctctgaaacttgtgcaggtaataagctcattcctgacgttataagagtatgatagtctcgttgttcgtttgctcgaaaaataattaagtttatattcaagctttctgaggcggtctctatgtttattaaatctggctcaccaatgtatttcttataatgttctaataattgaacatttatatccaatattttcacttcctcttctaagcaatctctttatattaagtctccccataggttgttagaataccaataggcttccttgaggccacttccccttccaaccacaaggtatatgccctgaattatatatttccaataattctgtatgaaaacctggttttacatacgtgctatatgcatattccatcattgcagtaagcaaatcccactcaacgctctcatatatacaattatttaatttattttcttgtataaatgtagaaatatttttaaggactccgttcttaagtaataatttagcctccatagtaatattattccactgtctgtactcttctcgccagttctcatgcagagtcgaagttaattgatttcttatttggagtctaacattatcccaagtagaattgacttttttttcaacatcaacccagttgcgtacttgcgtaacattaacattgaatgtagcattaatagcatccccacagttactgaaaaagtcaattttagatattttattatcataaaaatcctttacttcgttcattgtcttccccttattttagttttattttttaaaacaaatatttatagtgcgaccttgctgcctatttttggagtgctctgattatttttactaaggcttttagatatacaaaaagcttattcctctcatttttcgagtgaaataagcttttttgttttttaagtatttgtttaagtttggtacaacgttctacttattgattgtatctacaatcccttagtcaaaaaaacaatagtaaacaaaaacattactttttttaagcaaagtaagcaacaagttttccttcttctgggtaatcaccatcccacccacatggaaaaccaccagccttatagattctaaaaatttgttcgtaaaaattttcaatctcaccatttattgcacgatttattgcgcagtttctcaaatctactacaacactttcaaaaaaatcactataagagtccgttatttgacttctaagaccatcagctattaatccagttaattcatccaagccactaggtttttgggaagaatctaatttatacaacttccccttaacttttcccatttcaagttgtcttatatcggaccaagtatattcatcttcaccgaaaacttcagtaatggctagccttttcgcctcttcatattgattaattgtaacaatattttgaggcctctctgtttttggaaaatccatcatagaatttgagaattgaataacatcttcaactaaattactgtgtattccgtacttcataacttatcaaaccacctttcccacaaatctattgttgcgcccccgcctctgtcccaaacaggcttaattttatctttgtttttagctctgtcaagtaaataatcatccatacctttggattttatttttttcaattctttttgtagataatcatctgtcatatatagtggtagccctttttcttgaagcttcctcaacttttgttgtaaatcaaacacttgcttttcaatagcggctatatcttggtttatatctattttattaagtttactctctacaaaatcgctataaactgaatggtaaccttgatgcctcgaggttgagcttgtatatttatctggaacgcgaaggaaaaaaccattggaggcatggtccatatccattcctatttttccaataacaggatgttcgttaaactctgctggaataatatgctgtgcttgatagggagtacgctttgtagacctgcgtaaccccatctcttcaaacatattcttacctaatttcgtggaacttccccccgttaccttaccaggagttcccggaatcaatctcttagattcgccagttccatcaacctttttcgccgcgctctcttccatttccttcatgaccttgttataattcttctgcacatccgtctgtggaagtggtccgctgtccatcttattaacgtgcggaactggcgctccgttggctgtggccaacttaccggggttgaggccgtctgccattttacttagttgctcattgaacttctgacccagtttactgccggtctgctccagtttggttacagctttaccaaagcctgccccgaccgcatctacacctttgctaatccattgcggtgtaactttgctgcttaccttttccgcgaatccgccgatggccttgcctactttggaatccagtacgcccacggtgacaaagcccagtcctgcgtcttttgctactgagccccagttgatcttttcaccacttagcacctgactcgccaaattttccgcggcatttgttacaccgccgatcgctgcttttcttagcaacgttcctcctacaccgagtggaccaaagatcgctccagatactgccccgatccccgcttcttttaagccggtcagggcatagtcactaaagtcgctcacttcccctcgggcgatatccgatgccgccaaactcgctacgcccaagccgcctgcaagcagtgctcctccggctaccgccgcaatgaccaccgtacccgctccaagcgtcgctaccgtaatggccgccaccacggctacagctgccacaaccgccaaaccgcccaaaatattcatccccagcttgccccagttaaacggttcagggggtggcggcggtggaggtggctcgccttccttcggttcatcatcaaacggcgggtatgcagttcggtcgctaccgtcagcccagacgttcactcccaacacgtggtattcgttttctaccgaaagccccgtgcttcctcccgtctgatacgccatgacctgactggttccgtcaataatgattttcttcggcgtattcagaatgatttcctgctctgcttctaacgataacttcttgggactagttatttcaatcccagtagcatcatccagactcatctgcaatgtcccacccggatcacccatgatatggatgcgacccggtgccattttcagctcacttccatgctccgtaccaaaatatcgatcattgggattactcgttttcgcgcaaccgtctccatttgtacgaaccgcacccaaaatcattgctctggaaccagacgcatctggaaaatacaggcttgcctgtgttcccaccttcggcatactgtacatcgcacttcccgttgggggagcgaacgggtaccaatgcggctcagataccccgtcatccttatcaatcgccagccgaagcttcacttcctctccccgtaccgccagaacctctccttccagagaaattccgattgttttgggattggggatgaaatcgctgcgaatgccctccgcgcgagccaacacataactgaatagcaaatgccccttttccatgcggcttcgcaattcagttacaatcatcgttttctggcgaaattgcacctcgtctccaagagcataccgttctccgctttcgatctcgtatttgaaaaagtcggtatcatgtagcccggctgacgttccgcctgcccgctgatagccctttaaatctttactggccgtataaggcgtatccttccgaatcgttcgctgggtgccagctggcatgccgaaatacagcttcggcgcggcggactcccatatgtcgctgaccaccactgtatgtaaacggctcgccatccgtttcataagctcccagtcggtttcatcatattgtaaaatggcttcgcctaccgactgctctccggtctggaacaagacatcacttcgctcatagccttgagcaagcttatgcactaactgtttatatgtttgtttttcctcaggaaaagaccgctttcttttaacaatatccagctcaaatgagccactaattccttccagggtaagtgtatatactccattatggttctcaacttccaccgtatggacgaaacccttaaataagctgatttcctcttgtccattctgcgcatacacatgtaactgatcctctgaggtcgcatctagcgcagccgtggcatgactcgactccttacaaatgcctgtgagtataatacgcccatgctcactcggcttccactcgatctgaacatcctttaagacctgaatggggtagggggaatctattcgaatctgatcatatcctatcatgttttcaaacctcccttccagctactcctcctgctggccattcgtatgaaattcgataaatccatgatataaacaagtctgaaatgaagaggtcgtcaaggctggctggccttccacctttgtctgttcttttgtgtttttccacttatccgtcagcatcggcatgcatggctttcctgagattgtggagccatcttcggcgatcagatatatagtctcggcactcggctgttccggactgttacaaattccaaaatgagggacattctcaggagaataatctccttcattcatcatgggtttaccattaacaaaagccccgtggctgttcggcaaattgatctttcgaggatgggtcccgcaagtgcaacgcatacaggccccccgtacgacataatactcattgtctgacatgtttcctttccctccctatttcacctgtacttgctccaaagcgatcccggtataatcacggcgcaatatactttccgccacgtctaaacggacaatgatcatcgaggtagcactctcctggattctaaatatcttgtggccccgaatagcatctgcacgtaataccagctttcgaaacacactttgatccaaattccattcgctttctggatgtactgctgcaagccgctccataaaaggaatatagtaattcttctgtatcttctgttcgatctgtgtaagtatggttaatttcaatggcagatccggcatataggcctggacaagacgctttaaagcatctgaaataagaggaatgggaccttctagataatcaataaaaatactttctgcatctgccttcacgtgaaacatcaatggtttgacaatatcctccggctgcaaatcatacagcttccacggatcaatcgtttccatcaccttttgtaacgtaggaacattggtataccgcacatcctgctttaagaggaaataatccatgaagattccccctctcgtatctcagctctctcactacgcgtaaaacggcacaatatttcgctatcatctcgatattctccagcaaatatcgtgcatgcatttgcttttggcatcctttctaacgaaggggaagcgataaaaactggcatctggcttttcaagaactcaacagtgagcagatgatatttaaccgcctcaatttgttgaatttgttcaatatccatcgttgtgatcttacgggcataatctgatttaagctgttccagcttagtcatgcgattgaacagaggctcgaaaacaaagtctgccgaccattccacagcgcattcagtctcatccagaaaccaattttcatcataggcatctatacgataaaccgctttatttttcataacacgagttctgagtaaggagatataaatatatcgaatatcccccttacgaccttgctcatgctgaagggtagcgagctggcatagcgactctaaagctactataagctcgtcttcaatggcttgctggcgcgtcagaaagttgttttcaataagagccaaatcatgtatccattccgtgaatacgtgcttttccagcaaatcctgcaacgcagcatcccgatccatgagcttcattcaatgttcaccttacccccggttaatctcacatcgtccatgatgtcgagtttggctccggattgaataaaactcacgccttctttcccctccataataattttcgctccacctgtaatttggatatcctcctgagcagacagggttatttttttgttactgttaatttcgatcccgccttcatccgtgaggcgcatgagcatttgcccactgttgataatttctactgcaccaggcttgaaaacgacttgtttgccgtacttggtgctgatacttttgaccgcaggatcacttcttttaacgggatcagaggaggcaagatcgacagaactggcggcaaaagcatgctgctcccgttcatccggaaagtacagacgaatttgatcccctgcttccggcataacataccagccgctgccatcaggagaagaataaaccgtagaatagggaaaccacatagccccggatgcagtcgagccttgatcaatttccagcttgattttcactttttctttggaaatatcaatcaccttgccaaacagagaggctcctgacagatcataggcatagacggttgagcattttaacccatgtgcatcccgtaaaatgtaacgattaacaatcagatttccttctgtggtcgtctccgccctagctatgtaaagcgttcttttatgaaaaatgacagagctaccgagctctagcactttgttgctggtcacttcatagctcaaactgttagactcgccatattccggcagtccgttacgggacatgagcttgtgctccttcaagtctttttttatggaatagttatgttcgttcagcggttgaggggcactagaatgggggacaccaatcacatatttcagtccttgttgcatcgtaattggaattaaagcagcatgcagccgagatgcaattcttttgacaaaagcccagtctgtttcattgtattgcactaataattcaccgatagctgcgccatgagaagcctcatcaatcacttctgcatcagtatatgaacttgtaacatgcgaaaatagattgttatatgattccgctgttttttggaatgaacgacgtttggggcgaatgtccatcattaaggtttcactgctagcctcaatcgtaagctcgcgtactccgtttacagcttttacagcaatattcgtgacgattccctgaaaaaaccggatctccttgccttcactttttaagaagacttcgatgtgctcatcttcatctgctttttctacgtattgatccagcttgtcctccgaaacaattccacgtatgcagaagctcacatgttcgtttaactgtttaatgagatggatacttaatacacgctgaaactgataaggggccacctgaacatctgctgtggtgtaaatggggttactcattcatatccctccttttctgcctcgtcaaccgtttgaatggtacgaatcatctgcagggcgacatcccgccattcagcatactgcttatacggacaacaaaatgttcccatgaccgtctttccttccagctcaaagtagaacatattgtggtagatgggctggtccagcgcaggacttttaaagtcaaaatagccaatctgcttaccatgtacctcttgtattttttcttcataaaatacatgggcaggattcatatttttcatcattgccttcatgccagaagtgagctgttccacccattcatcttgtagcgtctggtccacccgattcagggtaacatccacactgcccaaatcattcgtcaaaatcatttctggacgttgctcatgaggatatttaatcttttgcaaatgcttgggcattggactaaagatagagggcacatgcattttcagccgatctttaaagaaagatcgctcttcaaacacataggattgaccgtcaatgattatgggtcctgctaaaatatcgttaggccccttcagcttctccatctcgcggagctgatccaaaatcttttcatcctcatatttcataatgcacactcctctacctgattttctaatccacaatcatccgtccggcgccgccgccctgccaacggcctgctgttcgttttccacgtccggcgccttctagaataagaactagctgtctatgcaactgagcatgagaataatctctgtattccgcaccatttcggtttgcaatgtaatgctgaatggaaactctgtctacggcttctgagttcaggcatatgagcgcaaacatacaatccatcggatctgttgcaccacttttaagcagctcggatgcgaagtagcgcatcgtctctgggcgcaatgtactctgcttcaaacccgcaaaaggagcatgaatatcactccatgtattgaattcggttgccatgtcggcaaaatcctgataatccgagcgaagcacggctccatctttgagcttgaatcggcccagctccatcttatccagaccgatctctgcctcatcctccagcacgatatctgcatgatgggctgtgaaatccgggcgatctgtttgttccaaaaagagcaacttcaacaccgatagccgccccgtggccgcatacggcacttcctgctcctgctccagcaggtatagtctatccttgtgcttcacgatgcctctaccaatggtcagcgtgttctccccgacagttacgttcattccggtgataataccatccgaaaaatcctgataccggatatccagaaaactgcgtgggtagtctcgcaggttctccagcatctcggtttttagaatacggcccttctcaaacttcggcacgatatgggttaacatgtggtttcctcctctcttcgctctgcgacgtcattactgctcttctttattcaagggaacggacaaccgatttacgccgggcgcaggagccggaacagtcacctctggaatctgtgagttaagctttatatactccgagtaattgagccattttttgtttaccacataggaacaagcgattttgtcatgcagcgcctgcttcttcgctgtgaaggccaccatgatgtaaccgacaaatatagtgaccaagctaatgatcttaccccagtagcgggcgttggcccgtccgaaagatattttttcattattttcatccacaacgacaagccccgcagccagcttgccgaccgttcctctgcattttgatgattccatgatggtgtggtaaagccaatccaataaaagagggccaaaaataataatagctcccaaaattctcaccgacacatcgtctaagtgtgaaacaaactccaaaaaattcggcatttttacgaacgcagagacaaaccctatcgtcacaaacggcaacgtatcaatcaaacgaatagtcacaaataaaatagtataatctagcaaatgggctaaaaatcttttccaaaaaccagcgtacatcctacagttccccctgtttaaaatccacctttacatcccggctccgcgttgagcctgctcacgaaggatatagtccagctcgcgtttgtccacaacataggtacgggcaatcagatcgtggagggcctgttttctcgccgtaaaggctgccataataaaaccgacgaacaaaatgatgactgatagaagcttactccagtagcgtgcacttgcacgtccaaagctgagcttatggttaaactcatctaccacaacgatgccgagagccagcttgcccaccgttgctttgcatttggacgattccataagcgcataatatagccaaatagctccccaattcagcaaggtctgtcctattgttttcattgtaaaaatataagtcgatccatctgagagcaaagagctttctgccggagacggtacccaatcccctaaggtccgaatcacaagccagatcaatccaattattaaaaatacaaaccatacaataaggctatcgatgatataagccaaagttcgcttccaaaaacctgcatacagcacgttatcccctccaagtgttgtgtacttttctgatttcagcattttgtgaaatccttaatttactatttcgtgccgtcaaagaaatccagctcggagagatcattttcgaaagcaaaaaagcgtttgggtcccagatgcagcaattcatctcggcgggtaatcgggactacataaaagccccagcggctatctccgacaaaaacaaaatatttcgtttccccattacggatggagtccgtatcatcctgcgggatatcccgcccgtacagcacggcaatttcctcatacggcatgggttcaaaagcttctggccgactacggtacacatgacgctgacgcagcttgccgccgtcggccgttaggaagaactctacctcagccgcatgagacggccgggaaatagaaccgcgtacccggttgctttccaaactcgcaatcagctctttctcgcgtcccgtatgcgtccatgcgctgaccgtgtacggaatagccggaatatgattggtaatgacaggctcaatcgtgcccatttttttagcgttcaggtaacggatagccccgcgcagacaggccattttcaactcaggtactctgctgaggtcctctgccttttgacgaaactcaatactgcgccccggtacaaattccttgagtgcttcgcgaaatacgtcaatccggcaggactgcccggttagcttgataatcgaataatcctgcaagcgcccctccagataaaactcatccagaaacttgcgcacaatattgtagatgtctgccttaagaagctgctgtatctcccgaatgttaaacaccacatcaggcaacccatattcatcacgaaatcgtccgttctcgatgactgataccagccaacggtccatcactgcaatgttcaggtcgctttcagcagataatacctgctcggattcgaagcggctgcgtaagattcccgtacgcagaaaaaattcctttttcatattttctgccgcgctccataacagatgaaaattactcagtacccgctgatattcatcccgtgtagcatgttcatactgtttgaacgcggtgggcaagatggcctctgcctcacggtagcgttcctccagtcccgcatatacagcatctacaccaaactcatccacatgacggtataaatctcccgaaggaatgccgatcagggcatcaatatcggtgtcaggcaaacgagtctcggcagcataataacctgcaaatacaattttcataaactgcataatccgatacgtcagattgtttccaccaaaattggtatccccattttcatacgttgtgtgaatatccagcttgtaagcaatacgtccgtcctcaattcggaatcggcaggaagacaaatctgtcgtgcctcctccacaatcaatgacaagtgcctgatactcctcaccgtccgcaaaagtccctcgttccatctggtctgccagcgtgttgtacagcacagccagcccttcgtccaacgcatcctccgcttcaatctggtaatccggcaaaatatcgctaaacatctctataaactggggctgcagcttgaccggagcagaaaagtgcaggttgcggaaccgacacttaaattgctgctcggctgtagcaatcacataacggataaaagcagctaaaatatcgctgcgggaagcagttgccgtattcccctcggaatccattaattcctcgattcgcttataatcgttgacccaacgcttgatcccccgcaatactgtcgcacggctgcctgccacgtcagatccacgtagtgcatcctccccaaatacataaaggatatgttctgcattggagcagtctgcgacgcgaatagcagtcggcaatacttcaatccagtcgccttctgccccttctgggccggggaatgacacataattgatggcgttcagccttaccgtgctgctcatacctgtatcaggagccgtaacgtaggaactatccaaataagcacctgctgtggtgttcgaggtgccaaaatcaatcgcaagtaccgcatctgttgtttccgtgccccgaatgatcagctctgccaccggaacccggtgaccttgaagcttcagcggcagcattggcttatctccatagtagaggttataaaaatattctgattcctgtcttcgcagaaatagcaggctataactatgattggacgtctctcgcagttcagcgtcgcgatgacgagaaagataatatacgcctgctcgtccctcatccttcaccaaattcaaaacaccgcacagttctcctgtcgcattcaccagcagcacattagatgagctcagccaaggcaaatcggattcgatccggtagttgtccatgcgacctgtgcgtacaccctgatacagtgtgattttagcgggaacccggataccgctgctctcctgccgacggtcgttccagtttcgctgtagtgccgattccatgcgttcaaaaccatcaggattcggccttgtgatgagtaaatgctcttccgcactccgaaatcgcaaaatcacgcgaatcaattcttcacgtgccaggcgattggcaaagccctcgaccagtcgttccttatcgcatattccgcgtaactgaaaggtcgtcatttgctccaattccgcccgcgtgtatttcgccgtgaagcgtatgctttttcgatcggtgagcgggtctagcaacctgtatgtatagggtccgttcatcgttcacatgtcctttcttagccatttagccttaatagagggcgatagcgtctattttcatcgtaggatcttcctctaaaatgccgaaatgacttgtccaatacaattccgtcgtaaaacgtgccggaagaaacaaatccagaatcaaatccactttaatccgtgacaatggcgtctcctcttggccgatatagatgagtagttcgtctttttcctcacaattggtgtaaatgattgagcgatgaaagacgcgccgcatcgtttcttttagtagatgtacggcttctcccgtctcatacaggcgcagcagtccttcagcaatcgcgtcctgatcctcacggtttaattgtccaaagccttcctttaccttcaggccaaaaatgccctctgcaatatcacgccgaacaaactggatatggtactcccgccgattcatcccctgatacaagtccatttccgccagaaaatgcatcataatatcaaatagcgattctctcagctccagatactcttcagcatccggtggaaacagatcccgaaaaatagaataaaagcggtagtacggattgatttccactacctgctccaaatgggaagtattcaactctgccagactaagctccatatacggagagtagctgacagcgggtacgaagcggaatttatctacatccagcccctgttccctcgcgcgcatgagcaaatcccagacgtaattcacacccattctccttcacacttgtactccggaaaatacatctgcacttctgataccagaaagctcatcaaatcggataaaatataagcaggcgcggtgggcaaaacatcgtcagaaccacgtctgaaccccaaacgcatgatctgcttgccttcctctgtccgtacgttatcgctgacaaacggatttaacggatatgtctgggttttggttacaaggttgcttacatcatttctccctgcgcctccccagatgtccacacgttccagctccagcccttgcgctgcttcaaacgagtttacgatgcgcatgatttccgccttggcacggacaatcacggcctgttttcctgcatagcggcccaaaaagctgtcctgtcgccgattggacaataacggataagtctgacgactaagtctcgttgtaacaggcttcgtaaccttcaacacattccattcgccagacttatcacgtggtgtgacaatcgtcagttcctcttctgtacgcttgatataccggatatcgccttcagtcccatcaatcaaataaccatgctcaggacctgtttttcgcaaaggcagcacatgctcatagttcacacgatccatagcgggtataggaaaaccgctgttctttagagatagcctttcaatgttccaaagcggaaaaacgtcgcccttcttaaaaacgtcgaattcctccaatgaaattgtaatttcatgaatttcttcatgggcggccggctcgccgtctccaccaatcaatacacagtccacaaacttataagcgtacgggtgattaattgttttccatggcataccattttgcataaacgtgtgatataactgctcaatttccaaaatataagaacggttatgctccagacgaaaacgaatcggataattgccggtttccgtgaccaacattcctgagaaaattcgcttgctgcgcaccagcgctgagatacgttcggtctccatctcaagaaaaagcgtaaacagcggcatcgcaccgccttcgcgtaccacctctgccacacggctgatgtccatctgcttttcctccgtatcagacggtaacacaggatataaaaattcatgaattgggtcatagtcctcacgcgatgtcaatgacacgtacacatcaatcttttcttccgtattctcaatttcctcaaatacccgccgttctagctggcgggtcatttcttcctgatattcgacgaggttcataaatacccccgccatcatatttttcagtaaacgtctctgctctaaatcgtccatcttgctcaaacggtcctgtaccagctctttcacgacgtctcactcctttccggctccagcattcattgaacatgaaaaacttaacctccgttcgcagcagcccgatcttggttctctgaatcagacgcccctgctgctttagaagcggaatcagcagttccttgctctttgttggtatccaccttggccgaaggggcagttccatcgcctgtaccactgctctttgcagccgaagaggcttccttcttcgcgggtgtagttcccgctgaagccgttggcgcagccttcgtttgcgattctgcagcaggggttgcagcagcggaagataaagctccacccgctgtgtcccctgcgtccgtgtcgttcaatgctccatcagacaatcccaatccagcaggaagctgaccatttttctgctgttccgcgctctgcttttcctccgccttggcaatgctccgctccaatgccagaacactttcgagcttatcgatctcctgataaatttcctgtgccccgctataggcatcaatggctccttcataatcgagatccttcatcatccgatcccctttggcctgaagtttgccagcttgaatctccttgagctgctgctgaatagctgtcaatttatcgttggcctcggtaattttcttctccagttctttttgcgcggacgtataaccggattccatcgcagctttgtttgctttcttgtatagcttaagcgcattcgtgtaatcgccgccctgaaattttaaatctccgtccttcatccagctcgctgtctcggcatagctgtccaattggtcgattttatgctcaatatccttcacattaaacggtggatatagcccggcgcatttccgtgctttctcgtagctggcttcagctttggtaaagtccgccttttccacgtagccgtctccgtccaccagcaattgagatagtttctgctcggctgtatacagtcgcttatgaatcttatcgttaattttaaccgccgcgtttttcgcttcgctgtaggacttgagcgccttcgcataatctcctgtccttgcataatcatctgcggcttgagctgattcgatcatcgtttccagtgcagctgccttattcgcagccatacgagccagcgtaatccatgctcccccgcccacaacaataaagacaagcaacgcaatcaaaatccgtttgatcaacttgcggcggtttttaggcttttcctgaaaaactttatttacataaatggccgcagccgtgtaattattcaccgtccggtgctgtttgcttagcagaacctcttccaaggtgtccgtcagcatgaccgggtccttcgcttcctccagcgcccccagcatttccgccagctcgacgtcctcccacatccctgaggtggcaagcaggattacatctccatctgcaagctgggtctttttggcgtaatgggcatgaactccattcggatttcccaagtattccagcagattacctcgttcctcatgtgtgctggtcgcttcgtctggaatgcgtccatcatctgccaatgactgagccagactatgatccttactgcgaaaattaagccttccattgcgaaaatgatatagccgcacattaccgcacgaaacatacaccattttgttatagttggtcactaccatcagcagactggctttgagccgaacgcgacggctttcaaattgcagccattcctgcgcttcacgcagatctctcatcaagcgccgtttggacatggaaggcttctccatgaagttttccagcaccgttttgacaaccatttctgcgctgcgcagctcctgatccgaatccagaccgtctgcgaggacataacaggccatgtcgtccgtctccatgaatgcaaaatagtcccggttgtctatgtaagagcccgcttccgacacaaaggcggtactaaaatcgctgttgtccttgcgcatcgctacccccgtctttcttgtttcatcctatcgccaaaataagtactgtcgcattatcctgacttttaaagcctttatcattaatggcgtcgatcatggcatccgctgtttcctgcggtgttccacccttgcgcataatctcttccaattcaatctccgtcagcgcctcctgaatgccatcgctgcacagcagcacatgatctcctgaatacagacgaatcggtgcattacccagttccatgctctcaaagccctcatagcccaagtagttgaccagttgattgcgcactggactcgttttggcttcctccgaagtcatttgtccagcaagcactcgttcctccagcagtgtttctgctgtatgcttggaattgactgtctggaaatgaccattgcggtaaatcgtaatcagactgtcgcccaccgctccgtaatacagctgatagccgcacacaatgaccgcagccagcgtcgttcctccgccctgtccattcaaattttgcaaaatgccgcgattactttgagttgccgcctctgcaaaatatccgttcaaattcgttgcatcttccagcttggcaaacgccttcgtaaaagtcgtcacagccaaggtgctggacatacgcccattggccagcccactgataccgtctgcgacaacagccagcgtaccgacaggtgtcgtcatactggcgaaataatcatcctgctcgctccggctcccgatcgtttgaccatttccgatctcaattccactcatgatacggctaccggaacttcgcgtcagtcgtatacggatcatgagcagaacagcgaatagtaccgcagctccacttacaacaaaataaggctgcatatcattacctccctgcaccattgcccaattccgtcctagttttcgttatcccactcaaaatgggcgccacacagcgggataaagataaatttgctatgtcccagctgaatcacgtcataggcagccagctctgctggtgaatataccgcctcgttattgtggtacgccaaacctgatgaatcgcctggcagcaagtaaaagttacgtttcttcggatcatacacaatgaccgcatgatttctacgggaaatcgtgttgtccccgataatgcggacatgcatttcctctgcgcgcccgataaagtttttctccgccataatgcgataatcttgacccacctgtgctccttcgatgcataccagccatccggttactggatgaatgcccaccgtctcgcccaaatacggcattgttttgtcgttatctcctgcgacgtttgttttcgccactggctctgcgctcttgggtgcagctacatttactaccgtgttgcaataaggacacgtatttccgtgctttcgtgtactgaacatgtgtccgttcgggcatcttgtcaaactcatagtcggttccttcccccattgtcatgattgtcttttcagcgatctgaggattttgcagcatccccatctatttaacgagcagtctcgtattggcaatatataataaatcacctgagtaaatccggtatggctcaccgctttccagcttcttggttacactttcgttggcagaccgcaagcctgtaccattaccggaatccacatcctccacaaaccagtcgctgttcacccggttgagtaccgcatgctccacacttaccagggaggcataatctgtacctaccaaatcaatatccgcctccgaacgcgacgttgttttaccaattaagagcgacgtttcgccttcgatataccattctttaatggactcgccctcttcatcaatcaacaccagcttggcaatccgctgacgttgcgcctttggcttggccacgggtacaacggacaccaggttgcgcaatatgtatacaagcacgccgattccaatacctatcgcgaccacggttttcaaaccgctgtagcctgtacgattaaacacataaaaggcgatcgccagcatcagcccgaacatggcaacatctatgatgaaaacccatctgttctgcgccgttttcactgcttgcttcccccatttctatcctgaaatcatcactttttacgaataccgaaaaattggttaaacatcgcggaggtatccgtcggatcaccgggttttttcgtttttttccctggtgagccctccttcgttttcggatgaaaaccaaaaaattgctcaaagtcagttcctatatcagccggattgaatcctttggctgccgtacgcgcaccgctggaggatgcagaccctctccctctctcttgctgttccccgccagctccctcagtttttcggatgagctcggcatcgtatgcctgccgcaatgcttcgtcacgcaaggtattgtaagcctcgtgaatcagcttgaacttgcgcgttgcttcctcgcttccctggttggtatcaggatgatactttttggccagtttacggtaagcctgcttaatctctgcctccgaagcatcccggctgacaccgagcagctcatagtagttggtcattgtgtgatgttcccctctccgaaaaaaataaatattaagagacccgtaggcctcttaatatttatccaccctgcacttgtgtgccgggtgagtgtgtttttaagctgcacttaacgtgaagacgttaagcttaaaccggatatccgccgtcgattgtagccagctcggttttgtctttcttttgtttgatgtagagtgtaaatgcacctacaccttctgtgtcgccgaagtgctcggtgtagtctacaacgaaagcattcgggaagtggattttacgcacaacttgatcagctgcgataacttctagtgttactttacggtagctgtctgctttttcagcaggaaccagagaccacaaagccagtttcagcgtgtcatccgcgctgtcaccgtctactgctgtgatgattttaccgctgatgcgcagcgtggagcctacgtcagtggagcgtgcattggaatcgtccggtgtatcggtgtcataaataaccgtttggatgttatccaagcccagctcgattgtttcttgtccttctactttcaatctgaatcccatgtgtgttgcctccttgaaattaggtaatatgatggcgggagatgcaaagcttctccgcgatttatgtataaaggcggttctggatagaaacgcctctaacatctttcgtagtgctcggatcatgatttgaccgagctggttcccttagtgatcatgacttccaggttcttcacattaccgttgaagaccagatcgatatggcacatattgcttttctcatcaataatgaagctcatatcgtctccgtcctgaatgatcgagttaacagatcctctgctgctcagccacttgctcttctggctactcggattgttactgaagaagcggacgatattttcgtgtttgaagtcccctgtctggtagcgcaaaatacgttcaatgtacgtgctgaccagcgtcttgtagatggagtcaaaaccgtcctcggacatcgccatgcttctcgccttgtagacggtaatccggcggatatccttatcctggatctgagcattctccgacgagaatacaaagccgaagtttttacggttgatggcatccttgatcgtgttggtgaatccggtgatttccttggccatcgtcgttaccgtgcgcaggctgttatctcctgcttcgatgtcgaagcgtacgccagggaagttcttattgacggttttaaacgtctcacgcaggtattcaggacactgataggaagcgaccaagccagcagcaacgtaggctgcacccacataaacgccctcgatccacagcttgagaatatcctctttctccttagagagctgtacaccgtcttcggtctgtagcattttgctgtcgataatgacacccgatttgtccttcggaataatcgtaaagttcggtacacaaggaatggcaaattcgctatattctctgcgaacgagactggcgcatttatcgacatatttgtcgatgcccgctgtcgccatactgttgaaagtcgtttcttcaccggattcaaagttaaagaacatttgaattttgtaatccttcacgacttgcagcagcatcgagagcgattccatagaatttccgccctgctttacgaccttctcgttgcccttgaagcgttcacgtgaaacctttaccttaccggctgcctccagctcgacagatggaacgataccgaaccagatcgtgtcgctgaattcattcttagcattcacagtgttcaggtacgtttccaggcgcgggatattgctgcttttcaccagcatgtccagcttgttgttcgccaccagcattgtcggcagcatgcctttgctcttcgttgcatattgatcgaagaacattttgacaccgaggattttctctacaagcggcttaaccgcctttacgaaatcgtccttggcatttttatagaactccagatacgtgttgtagttttgaacttcaaccgctgtatccaccttcgtctgaacagctggcagtggcacaaatgtgcgaaccaccaaatccttcacatagtcagaaggcgtatctgtgatggagttataatcttcttcgaatacttgggagagatcgccagtgctgttttcatcgaacagcatcagctcagtgctgtcgctcttcggcgcttcaataattttcagttcgccgctttccccaatggagagcatacccacctggatcagctcaccggagttttcctcttgggcgccaccgagcagaaggcgggttttgatgtcctcaattgccagtgggagcatagccataacgttgttatagttctgactcgcttcctcgaacattccattcagcttgtcacccatgtcgagtttcttcggatcgccatcatccagcttgtcgtattcaccgtacatatagtgaatctctttgcggacttgacgaatatcatccataacctttttcggtgaaatcatatccagcagattttcaaatttgaaatctacattggtgattccttgactgcgcttggtatcaatgagcgtaaacaacattttcagaaaatcattactttgatttacacgaatttcagaaatgctatcctcatcaattccctctggctttttaagggtgtagacgactttttgattggccgcgttaaaaaacgaatacacggtcggtgaaaacttatccaaaaattcgtcaaagctgcgcaccagaaggtgctgattaatttccttgatcttctcatcgctcaagctgtcaatacccttcacatcacctacaatggtgatcaggtccagcttttccgggttaatctcttcaaaaagcattgtccggttggtttgataaatgatttccatcgctgtcggcaaatgaacaaagtatgagttataggtccattgctccatatacggacatgggatgtccaatttgaaacggacgaaactcatttttagttcttttgcctcctcccccctacttaacatttaaattcgtcaaaggattgagcttataccacatttaaggtacaggcatgtaacctcgaaaatcggtccgaagcgttattcggcttttaacggcaaagcatgcaagtgagatgtatttccaaaataaaagtcagataacacagaaattttaaatttatgatttcgtattcctaacttcaatcccaatttttgccgttgatacgagagctatcatacaaagcacccttcagttttgtcaatttctgtagtctcagattgaaacagggcattttgactcattttatgcgtgaatacgtaatttttatgatatgttagacctgtttcttcagggaaatattcacaaatggaactcaattaccgatagaagtccattggatatttctgataagcgtaaaagaatcaaattcatggctaatgtgagggttatcagctattttgatcctttatcccttatatcccaaggattaggagagctgatccccccacgttggcctcggcgatggaggagcttatgttcagaataaggaaactagggattatcgttttcgtgacttttgtactatttttacaaatgagcctaaatggggtcatttgcactgtaaatcaggctaatgcagcatcttggggtgctgtcccgatcgagggttatgatgccgtttttgtactggataccagttattccatgagggataccgatcctgaaggcattgcggccgaagtcatcaatatgtttatggatttgagtgatgcagaccgtacgcgcgtcggattcgttgcctacaatcaccacgtggtcgcctcgaaaccactaacttcgattgccgtggcagcgcaaaaatcccagatccagcaggaaatcagaacgctaaaccgttcaggttatacggatttgggacttgggctgcgcaaaggctcagagctgctagcggcaggagcatcccaagggcgtcagccttttatgattctgttgtctgatggagagactgattttggtgcctcctctggttcacgatccaagggtgactccaataacgatgtgtcctctgtcatcaaatctgcacagaccaagggatatccggtgtatacgattggtctgaatcatgatggcacagtgaatcgacaagaactcgaacggatcgcttctcaaacgggcggagcttcttttattacgagtagtgccgaggatctgccggaaattctgaaccgtattttcgccagtcaaattcgttccaagctcgtcccaattgctgcaattacgactactggcgagatgcaagaattaactgcaactctaccggactctagtatggaggaagcgaatctggtgcttttgtcggagcatccccttctggaaacacagctatattccaattcagaaaatgtccgcaggtacaagtcgagccgctatgcgattttaaaaatcgagcatccacaggcaggtaaagtgaagttgaagctacggggcatacgcggagatttggtgaaaatcaatttacttggcagctatcgactggaagccgaagctaccatgggagcaaagcaagcaacggcaactcatggcgacaagcctgtgcagttgctgaaaggtcaagcgacaccgtttcaagctcagcttctgttgccggacaatcaaaagcttacagatgaagccgtatatacgtctctccaagcccatattgtagttactcccaaggggggcacagccaaaaaggtgcctatgacctataagtcaggagcctttcataccgaatatgcgttccctcaaacaggggattatacatggcagctatctctggatagtccgcaatggtaccgtaagggaattgtacataaggttcacgcggccaatgcagcaccacaggtcttaaaagacctgacgattcacctggtaaaagaagacggcgattcccgtcgaagtttatcagattttattgttgaccccaatcatgacaagctgaactataagctggattcagaagtcgccgggggtacggcccatgctgagattaacggtaatgatctgctgctatccgagctccacacaggtgactctcagctgaagattaaagctaccgatccggaaggagcatccagcagcgctacactaaccgtttctgtacaatcccggtatacagccattaaatggacagtagccatcagtgtcgtagtagccgctcttctatattggttcttgcggccgaagccgcagtttgccggaagaatcgaaggatattttctcgctacagcaagtggacaggagattccggtaaaatcttggccgctcacctcctttccgggtcgtaaggtcagcttgcaggaattgttccgtacgcttgacgttcacgaaccgttgccagaagcggaacggatcgtattttccgcaggtaaaaaagggagcctaatcgtaaaacatgatacacgctgcgccttacagcatggaaagatcagattagcccgtaacaaaaaagcggtcatggagtacagcgacaagctgtacattacattcgaggatggtgtcactgaaatcgagctgcgatacaaagcgattaaaccgaatacttcagtgtacaccgaccatatccaagctacgacaggataatgtccgtcacaacgtaaaaaaagagaagcgtcgtctcttacgattaatgaaccgtaagagtagggcgcttccctttttttatccaatattccgcacgtagtgcggctttaaaccatcgaagtgagcggcaacgcttgttagcctgtacctccagacctcgccgaatgacatacggcagcagagaaagtcccgtattttcaatctgaatccgctcggaatgatctgcaaacaatcggcccggcacatctggcggaggtgttcctttttggcaataatacagcgtggcggccaaactatagatatccgacacaggcccctgctgcgaacgattagagtaaaattccagcggagaatagcccgccgtggtgaagatcggatgctctttgccttcaaaatgcacagccgaaccaaaatcaatcagcttgatgttgccattttccccaatcataatgttgcccggcttaatatcccggtgaataattcctttgtcgtgaatgtactccagggcatcaattaaaggtagcaccgtgtggtacaaaaaagtgggatcagatgttggcacagcttcttctttcatcattcgatccaatgtcttgcctgcacagtattccatgaccagataggcagttccattttcctcaaagtgatctatataaccgacaattcccggatgacttaactccttcaacatttgcccttcacgcaaaaaataatgcataaactctacgtatttggattgcatagaagcaccgcaagtgaccgtttttcgatccatccctcgcaaagccagggcattcggaaaaaattccttcacaatgaccttttctcggttatccaacagccttgccgtatacacgatggccagctcactgcgggacaaggcgcttcgaatttgatatgtatttcgcagcttcgtattgcgggcaagcagattcccgcttgtatccacgatcatgactcgtcctcctgtcaggttcttagcttatgttttttgtatatatcggcttattacacatctttttattataccgtaaaatagattattggaaaaacaaataacctgccataatctcccttagagaaatgacaggtcttttggcattcatctggttcttttttctcaaatcgtttaacccagtttcgttccaggcttcatgctgcgcacactgttcgtatttttcttccgttcactacgcagtttgcctttgccttgttctggagtgcgaatggtgagggcaattaggaacgatacgacacacagcacagcaatcgtggtaaaggtcgggatgaatccaccgagcaaggctgcaataaatgaccccgccagcgcacccaggccaaagccttgatacacaataccatagtttttgctttgatttttcagaccgaagaaatcagctacaatggcaggaaagactgtaatgttgccgccgaagcaaaaagcaattcctgctacacaggcaaaaaacaaaccaaaattcagcggtaccaaactcagtactgtaactgcgaccgccgttgttaatagagcacccgctactactttcagacgacctactttatccgatagcgcacccagtatgatccgacccgccgtgttgaaaatagccaccatagcgaccgcattagcggctgttgctacatctaggccggccatccgtacgccgatatctttgacgactccaatcaggtagagaccactcatacaagcggtaaagaacattacgaacagcaggtatgcctgcttggtgcgcagcatttctttaacggtgtagtcccgctgtacaactccattttgtaccgaaggcttgttcacgactacagcttctcttaccaggaaggaaccacccacaatcataatcagcacgatcattccccaatataaaaacgcttgcgatacgccaacggactgaatcaaagaaccattaatatacttgaatataagactgcctgttccatatgccccgaccgaaataccggaaataagtccctttttctcaggaaaccatttaatcagattcgacagtgatgtaatatatgccgttccatccgcaaaacctacgacaatgcccgccaaaatgtaaagcagtgacagcgaagttacctgcgaactgagcatgagaccggctcctaacacgacacctgcacacaaaatcagacgacgtaatccccatttatcctgtagtttgcctgcgaataatgtagcaaacgccagtgcaaaactggtaattgaaaatgtaatggcaaccgaactgaggttccagccaaagcggtccaccaacggttgattaaataaactccatgtgtaaatggttcctaatcccatctggacaataattgttccaagtacaaccagccaacggtttccgctgtttgttttcatataaatctcctcttttcattccggctctacagcgtcaatttgttatcatgataaccgggaatccagtacgctttgcgcctgtggaggagcaagtcggtaaggattctctctacatggattattataacgctgcatgtcagccagaaatcatttgaggaatgaaatgcacatatagcggaatgaagtgcctttaaagccgcataatttgccgaaattccttggccttgctgcggctcaccggaatttctgcttctagtccacgcaaacgtaggagatacgtatgattgaaccaaggtacaatttcacggatctgcgacagattaaccgtgtaagatcggtgacagcggaaaaagtcctgctgcggcagccgggcatgaaattccgaaatgctcatcggcatcgtatattcttcgtgccttgtaaagacacgggtcaccttttcctgcgcacacgcatagtaaatatcgtttgcatccgttacgatgattttgtcatttttcagcagattaatacgacctggcgcagcaatggtgctggcttcggcagctcggggttgcgccgtctggacaggctcctgtattggaacgttctgctgctcataagcattttccagcttacgcagcatagatgcgatccttttttcatcatatggtttgaggatgtagtcgaacgcctccagttcaaaagcctgcgccgcatgttctttataggcggtcgtaaaaataatgtagggctttttggcaaatttgctaatgttctgtgccagtagcatcccgtccaatgaaggaatgttaatgtccagaaagatcgcgtccgtctcctgatcttgcagaaaccgaaacacatctagcccatcctcgaaactatcagtcacctcaatgttgctatgagtctgaataagatactccagctcttcacgtgccggaagctcgtcttctacaattatggccttcatgacttctcctttggtatgtcaaaataaacttcggtgcccggctcatgctttagaataataactccctcgccgtacataagcttgagtcgtctgtgcacattgtacaagccgatctgtttagccggaacccgatcatgatagaggttatccacaacatcatcccgtatacctaccccggtatccgccacagaaatacgcaccttttctccacgatcctttacagaaatagttactgtacctgacccctttttcttgaggattccgtgattaatcgcattctcaaccaggggctggataataagactaggaatacgcacagacacctcatccattacatattctacctgaagccggttgccgaagcgtgctttctcaatttccacgtaatcagacacctgctgaagctctttatgaatttcgatcaaatcatcattcagctccaaattatagcgcagatagcccgataaattaatgatcagctctcgtgccttatccggcttggtgcgtgtcgtagaggcaatggcgttcagcgcgttaaacagaaaatggggattaattttcgtttggagcgcctttagctcggctttattcgccgcttccttaatttgctccacacgcgacacttccattaacgtggaaatgatttgagacaagccaatcgccatcgtttgcaacggatacgtgattttataagctttgcgatagtaaatcttcaaggtgccagttacctctccccgctcctctaacgggataatgagcagagactggatttgcggtgttttatcgtctgcaatgtggttgcggatcgtgattttaccgctgcggatcgtcgatttagtcacatcgctaataatctcatctccgatgtgataacgctcttcgccaaaaccgacataggccagcacatctctggtatcggtaatcgctaccgcgtctgccctgatatcttcttttatgatcgaacaaatggtatgcaaggattccgcattaatggagcgaaaataaggcaacgttttgttggcaatatccaatgccagcttggcctgtctggccgcgatattctccttttccccttccacactctggattaatagaacgattaaaccgatactgacttctccgataatcatcggtagaccaattttggaaacgatgtccataccaaggccatggggttgtgccatcaccagaatgagcagcatcgtcaatgcttcgcagaccatacctgcggcgataccgaccagccatctcttggaacggttaaccctgcggccgatatatcctgacaccacacctgccaaaatactcgtaatcagacacggaatcgaggtcactcccccgatatcaattagataacgatggatccctgatacaatacctgtaacgatcccaacccagggtccaaacaaaataccgcccgccataattgcaatgattcgaacgttaaccagcgaaccttcgacttcaatcccggtgtacgtaccgaacagtgcaaacatgcaaaaaatcaacgttagtaaggttagctctgccggggaatgactgttcttttgcaaggtttccttaaatcgtgggatacgtgtaataaaaaacaaacaaatcagtaacaacgctgcgcgctcaaatagctgcatcagcatttccaacaaggcgttcacctgcgttcctcccaaataaaaacggatatgcctacataggttgtgttatcgtgtacgtcgttcatacacaccatacccaagtatcatcaagccacatacgaataaaataataacaaatatattgtcaacaaaactcggcatatcaggttctgacatagagatgcccgaactatttaatttaacaggtacggaattcgcagcccattgaatgaccgatataaagcgctccatcgtataaatcactccgctacccaacaggctcaacacgccgatcaacaaatatttaagctccataagaatttattcctccttaattacaaagcatttaaactgccacaaattataccatcaacttccatctaattatagcgtctagaaatcccctcttcatttcccttcttcaaacgcagtaaaaaaccggagagtaccgcttgatagcgataatccccggatctctagtccgataatgaagtatttcggttatttgcttttgctgatttcggtaggaatgttgtcctccttctgatcatataccagttcttttaactgaataatcaacgtctccagctcattaaacccggtcaccatattggaggttatatttcgttgttcctctactccagccaaaatttgctctgacgctgcactcgcttgttctgtaacgcttgaaaactcctccatctcttgaacgacctgagatgagaattgctgcatactattcgtactggcttccacctccacggcctgcagcagcactttattggcattttgcaggatatcctccagtacaatttcggtcgaatgggccgattccatactctgctgtagtctttgctgtcccatgtcaaattggcttacgacagaatccatctgagttctcagttgggtcaaaataccttccattgccaccgaggtattccctaccatttcagccaaattacgcacttcgccagccacgatggcaaacccttttccatgctctcccgctctggcggcctcaatggatgcattcaaggacagcaaattagtttgtttcgagatttgagtaatatctttgagcatggcagacatattatcactttgtgttttaaactcgtccaattcttctttggtacgactcataaccagacccaaatccttaatttgagacgttaatgcaagcagttgattgctccctctgctcccggcacttttcgtatcttcggagagctgcttcaattcccgggaatgatcggcaacctcgcgcacgtgctggtcagactgagccaagttatccgttacctcagtgatattcgaagcttgcatttctacccctttggcaacctcctgaaacccgatggcgacttcattcgtcacgctgccggtagcatccacttgattcctgaatcgttctgtgaagctatgcaatccagctacagcctgtctcacttgttcaaacaaaaattcaatacgttgccttgtggcatccatatctttattttgctcttccgttttcttaaactgcttttgatttaacaccgataccactaacaatagcaaaccaatcagtaaaacaataataaactcgtgcacataacgcaaaggaccggtagccggaggagttgctggcgtaccgatggtaatttgtataaaaatattacacagatttaagaccattgctatcaaaaaatatcggtaagatgggtagagcaacaacaatgaacaaataaagatcgtagtcattgcctccatgctagataagtttacaaatatacatattaatacgctatacaacgtaataatccaagggataaggcggattcctttctttttcatattcagaatcgtcaaaactgcggcgactacaaatcctacaccactagacatccacaccgatggattagataatgccgggatggtgctgctcaaggtcataatccaaaaaataatgatcaccaatttgtttctttgccacaacaattcatttgttctgtccatgattgtgtacgcgctccttagatatatattaggtatttataaaataaaaatgtaaatgccatactatatatatcgtcatatcagaacgcgtattgaatgaaaatcgtacgaacaccacgttcccttttaaacaccaaatcacaacaggacaactttttaaagagaaagagtatgtaagtgtaaataaatgaatgtaaaaaatcgccccctagcagggagcgattttgaataccttttggatgatcttctgcaattgaaaaagattcataaaccaactgaaaacattaggattccttattttcggaagcctcttcagtgccttcagttgccgctgcatcaccttccacagcagcattttctacttcaactgcacgcggaacgataatagaagcaagcagttcttcttcagggacgtgcagtgttactcctttagggagcttcaagtcgctagcgctcagcttgtcgccaacatccagtgcggatacatccacctcaatggtagatggtaaatcagcaggaaggccttcgacttcaacttccgtttcctgaacttgcagaataccgcctgtttttgtacctacaggtgtaccctgataatcaatagaaacacgcacgcgaagcggtttgtttttggcaattttcaaaaaatcggcatgcagccattggttgtcacgctgttgataatctttaataataaccggaatggtttctccaccctctacagtgaggttgaacacctctgaacgtccagttttgactactttattaaattccttggcatcgacatgtacaggggttccttcaagctcagagccgtaaaccacagctggaatccgtccttttaacctcaattcacgaatagccgaacccttcttctctgttctcggctgggcggtcagttgaatacttcctccattagaactcatgatatacaacctccttcaggttaccttacaaatgattttcctccaagaatcttgcctgtttaccagtcgtactacaggatataagccagcaagctggcaaaactaaacaagtccataattctattttaccccttttttctgaaactgacacacgtttacataaaaaaatagcatttctcgaaataatcgaaaaatgctactttcgtatatatagcgaccaagcatacaagtctatccggcccgattatcatttaccagtagcaaatattcttctctgccactatgaatcaatacctgcatcacagactggtttaggtctatatcaatatagcgatctgcctcaacatccttggcatcccagtgattaagccggacaatgtagccaattcgctgtatatcaggagacacctgaatacgcgctattgcacgaccgtcatccaaatcacgaaattcgacatgtccgtcgcggtacccagttccccatacccatacgttccagccagtgtattgtcgatctgcacgctcgtagatcagttcaatcgtgcgaaatggagcgacttccctatcgtttccaagctgcacatctgtcaacgtcatagctgtacctgcaatttcttgatctgttccctcatccgagtcttccaattcgttctccgcctgacgattaacctgatcttgttcagtcaaaaaggagactcgtgcaggttcttcctgatcatataacaccatcatcgaccagcgcgatacagtcacacgatggcctaccacttcataccgtgtctcattaccagccccgtgtgcgtccacgaccacatgccaacgatccgattccgcaggcaataatatcgtttgctctgtatccgagccgttataaatcaccacaatatgattccaggcatcgccgttagcatggtgcctcaaagcaaaagccaccacatgcccactgctttgcagcacttccatatgctgctccaccagttcacaatggtccattcggaatgccgggtggttgcgccgcaatgcaattaaaccttggtagtaatcaaacactgggcgaaacctcgccttgttatgccaatggatggcattcaccacatctgggcttcggtagctattatggtctccatatttggagcgcagcagttcatcccctgcatgaataaaaggaatgccttgcgatgtgagtaccataccgttagccaacagggacttgcgtacagtttcgttctctagcaagttatcttcatccagttcccaatacgggtctgcttcggcaacagcttgttccggtgtcctcccatcctgtggcttcccctgctcccattgtggaaaacgacagtgctcccgcaaatgtcttactgtcaaaattttatcccacagattgagattatcgtgggcagttacataattgacggtctccgatggctgagctgtgaaatcatgaatagccccaaaagcacctttgagcacctgttcatcctgatgttctgcccccgtggcaaacccgctcccagtaccgtcgctatctcccttaatagcagaacggtagttgtcgttaaaaacggcaaagcctttgtcgcgttgcgttccttttagcgtaagcaagggttgcggagattctcctcccgtccaaggctcaccatagatcagcagatcgggacgcacttcagagcgaagctcctgggtaagctgctctacggtcggtgtatccatcagccccatcagatcaaatcgaaagccgtctatatgatattcctctgcccaatagcgtagtgaatccttgatatacttgcgcaccatcggacgttcggttgccacctcattacctacacctgatccattggtgagctgcccttgctcatccgtgcggtaataatatccaggtacaataggctcaaatggcccctgttccaccgaataagtatggttgtacacgacgtccataatgacaccgatgccgacagtatgcaaagactgtaccagcagtttcagctctcgtatgcgtgtatccggatcagccggattggaagaataagacccttccggcacattataatgctgcggatcatagccccagttatattcagtttctaattctgcaaagtcattcaccgtatgaaaatcagccactggaagcaaatgaacatgtgtaatgcccagctccagcagatgatccagcccgatgctgttcccctcagtatccttcaatcccgtatacgtaaaggcctcaaaccgtccctgagcagcagataagtcttttttccccgtattaaaatgggtatccatcgaaaaatcacgcacatgaagctcatagagaatggcatctgtcggccgcttaagggtaggccccgcatccaattcccatccgtccgggttggtttgagccaaatcaatgatcgctgtacgctgcccgttggctgatacccctgtggcatatggatcggcagcataatgaatggtgttgtccgcccactccagcctgtacatgtaataatatttgttccagtccccttccagctctatagaccatacaccttgatcaccacggctcatgagaaattcctgaccaccgctgtgctcctgaacgttcccctcctgatcgtacacccccgcatcgttatacaacgctatatggacctgctgcgcagtcggtgcccataccttaaacttgctgcccgcaggcgtataagtaagacccaaatcatagccttcatatatgggatatgttgtgtgctcaagctcattgagctgattgaaatctgacattcctgttcaccacccatttctgtacatcggcttacagcctctgttcatccatcatttatgatgtttatgacttgtcaatatacctcaggattttgtaaaatcttcacctaataggctatcaaaataagacaagtttgaaaagctggatgatttaaataaggatgacgcttccatttcaacgcacactccattttatgacataactatgaacaggctacagcttttgcccttaaggtataacaatagttagaaaagtcaggacaatctacggttattcatttcaaaaatatcgtctgcaatccgcatggtagaacttcggtgcgaaacaaggacaatcgttttatcttgctgctgttcctttaacgattttaaaataattgcctcgttcaggctgtccaaattgctggtaggctcgtcgagcagtaagagaggcgcattatggacaaaggctctggccagtcccaagcgttgacgttctccaccggacagcctgtcccccaattctccaactcggctgtcatacccttgaggcaaggtcataataaaatcgtgcacggatgccttacgtgctgcttccaccacctgctcatgtgtagcatcaggctttccgattttgatattagctgcaattgaatcatcaaacaggaacgtatgctggtctacatagctctgtaagcctctcaaatgtcgggtcccaatttccttcaaatcgtatccggatagcaaaatttcaccttgctgcgggtccctaaatcgcatcagcaactttagcagtgtagacttgccagagccgcttttaccctgaatgcctaaaatccgcttatgcggtatcgtgagacttacatcattcagcaccgtttgaccatcgtatgcaaaagtcaccttgtctactcgtgccccagtaaaagcaacgctcatcccttcgatattttcctcaacctccggggtttcctccaatagactcaacactcgttccccgctcgccagcgtttgaagcaaattgttggacaagttgctcagtgcgacgaccggaccaaatgaactaaacagtgcaattacagaaattagcatacctgtaaagtcaacctgaccattagacataccgtacaagccagccagcagcatcaagaatgagaatccaactacagccgcatctgtgatcgctcttgtgatgccttcatgatgcttcaagtccttctgcctggcatccaattgatccgtacgacggttaatctcattcaaacgttgttctccttgtccatattgcacaatttccttcatcccccgtaagctgtccaaaaagtaactgctcagcttgccaaagctgcttcggtattccatcccctgacgtttgcccatacgtgacgtgagtaagggaataaataaaccgacagttaggtaagcaagcgcagcgacccagcctaatagaggctcataagaaccgataaaaaataccatgagcagtgaagtgatgatgccgatcattacaggcgctatcgtatgcgcataaaatacttccagcagctcaatatcactcgtaatgagtgatatcagattccccttgtccttgccttccaatttggctggagcgagtctgcgcagggcttgaagcaccttgtcacgcagtacagccagtagcttgaaagcgagataatgaccactcatttgctcgccataacggaatacgccgcgcagtacggcacaaaccacgatcgccgtcagcaaaaacgacatggtgtagcctgtcgtgatgcccgttgctgtaagcagagcaagggctccatacactataatgccaatagcacaaataaaacctagcactcctgtcacaatcgtgatgagcagtacaggtaaaagaggtcccgccaataccaataattggcccatgatccgtaatccgtgtctacgcatatacagcccctccttttgcaaactgctctacccggtgttgactgagatacatatccgcatagtgcccttgctggctcaacagttcatgatgcgttccggattctgccaccaatccgttttgcagcacatagatacagtcggattgaactaaattttccagtctatgcgagataagaatcactgttttttgacctgccagcgcatgtattacctccataatgccttcctcactctcactgtcaatgttagaggtggcttcgtcaaaaatgtacacacgactatcatgcagcaatgctctggccagtgctagccgttggcgctgtcctcctgacagatttgccccctgctcctccagttctgcttccagtcctccttctgaaagaataaaatcatacagcttcacttgtcgcaaagcttccagcatttgttgctcatccgcgtgctcattgcccatttttaaatttgcttccactgtgcctttaaaaatatagctgttaaaaccaatccaggtcatgtgacgcatgcggctttcttccgaaatatcggtaagctcggttcctccaatcgtcagacttcctcgatacccctcgtgatgcccaacgatcaatccggctaccgtacttttaccagagcctgattccccaacaattgaaaccaagctgccctggggaatatccatggatatatttcgtaaggtatctctttcgtcgtaggcgaaactcacctgtttcagtcgaatatctgtgttttctatgctttcttgtccttgtataagatcctctgtactcaacatttgaaatattttgtcgcttgctgccattccgttcatggcgatatggaagtaagaacccagtaaacgcagcggaatgaaaaattctgctgacagcaaaacaatgatgatcgctcctgccaagccaatatgacctgaagaatattcacttatcgcgaccagtacacccgcagcagcaccaccaaatgcgataagatccataatggccacggagttaagctgcatagtcagcactttcatcgtcattttgcgaaagtcctcagctgctgtgttcatttcctgatgtttatcctggtctgttccatacattttgagcgtagtcagaccttgtacattctccaaaaagctgtggcccagattgacgtaactgccccaatatttctgaaacagctttttagccatcctcataatgacaatgatcgacactggaattaagggaacgcagatcaatagtataatggctgctttgaagctgacaaaagagagcgtgatgaataacgttacgggggcaagcagactgtaaaatagctgaggcatatatctaccgaaataggtttcaagctgctctaccccttctacagcaacctgaataacccccgaggtggaggtatgatctgtatatgcgggtcccatcttcagcaacttgccgtaaatttgcgagcgcagcgtttttttagcatttaccgaagcacgataggataacatactggctgcataattgctcaggcagcgaactgcaatagcagcaataacaatgaccgtcatagatagaatcagcttgcgagtcacttgtccttcccatgcctgctgcataacaaaggccatagacaacacagcggctatactccccaaaagaccgatccactgcacaagcacacccaatacgatatatttccgagaatgttccactagaccgagcagacggctatcgaccattttagaccttttttttggagtaggtgtaggtataggttcggatgaagatgaaggcgttatttctgctgcagcatttcttattgttccgatgcggaatataaagtaataatatttaaaaaggatgactaagacgatgagcgctttcccccacatattaggggtgaaaataaagcctgtaatcagcatcgctgacgctaagcccaatgtcgtgattttcgtagacagcttcaacgatcttgtttgaacaaaactctctagatgcttttggtacagagaggtattcgaaaaccactggtgaatcctttcggacccccgcataaagaaaaaggtcgctagcagcagaaacggtgtagtcggtagcaacggtagcactacaccaataactccaagcgccaaaaataaaaaccctaaggtaatatagatcggtttcactataatcctccctaatagttataatagtaatgatttcatttcacagataatgataatcattatcaatataaacaatttaagcaggttgttatgtgatgtaaatcacgtatataaaaatcctcttgaagcacatctctacagaacacgttagtgttgatgtgaatgctttgtcttcaagaggattatcgaaagtagatgttgataattcgttgttttatgaatttataatatcatattgctccaatacctgccgatgtaacgggtggtctgcggttatggaagtataacgcgtcagcgccgcacccagtccttcactgcggatcacctgctgaagctcgactgcctcggggtcttccgtaatatcaaatttacaggcagcagccattcctaacgccagatgatccgtagggatgccatactcctgcgcttggagcgcgggacgtacaagacgatcatttggagacagcttgcgcaacggtgaacgtccgacccgagtaacatcgtctgtcagattaggattgcggaagcgatccaaaattttagagatgtacttcttatgctccccttgatccaaaccgaagcgcttcacaagcactgctcctgtctcctccagtgacccttgtatcgaatccaccaccttgctatccttcatggcctcctggatggtagcgtaacctgcggtataaccaagataggctgccacgcaatgccccgtattcaccgtgaacagctttcgttcaatgtaaggctctagatcctgcacgtacaggatgccttcgatttcttcatgctcaggtgccatttgtgaacgatccaccacccactcgtaaaaaggctctacctgcacatgtaacgggtcctcgtggtgttggatcggcacaatccggtctacagcagcattggggaaatataccgaagcctctgccttagcacgagtcgcctcatccaatagcgcaaaaacatgctctttcagttgggcgctgcctccgattgcattttcgcaagcaatcacatgcagcgggcctgcccctcgctccacccgccgcgctattccctcggcaatacctgctgcaatatgcctgaggatgctaacccctaccgcggttgttaccagatcagcatggtctaccgcatccgctacagcggatgcatctctgccgtcaatcgccgttacattcgtgaccagctccgtatcctttgtatcattggctaactctacggtatattgtttacgacggcgtaactcggatacaagggtgtcgttgacatctgaaaagacaacctcatagcctgcacgcgacagaattaatccgataaagccgcgaccgatatttcctgctccaaagtggacggctctcatagctccagctcactttcaaacagatctataatttcctgtggggtcaccgcgttgcgaagtttatccatattttcttcctccgcacacaccacagcgatactcgtcaaaatctccatatgatcgccgccttgtgctgcaatgccgatcaccatatatgctttctcttccccaaaatctacgccttgcgggaactgaacgatggagatgcctgtggattgaataagcgtcttggattccttggtgccatgtggaatagccagcccattcccgatgtaggtagacacgatctcctcgcgttccagcatcttgtcaatgtactcacttgaaatatgtcccgcatccagcaggatttgtccagccatacgaatcgcctcatatttgtctttggcggttgcgttcatttttattttgtctatcgtcataatactcacggtaggttcctccctgtccctaatttactgtggaaaaattcagccagctcactcgatatataattgacaatatgatccctgctaccgtgttccagtagcgtaaccatgtcttcctgcaagagtaatgcactaatctcgctcaatacctccaagctttctctcggcagctcacgaggccccaacatgagcagcacgcattctacctgttcacctgtatccgccaacagcggctctgccagcttatataaggtaagcgaaggcttgcgaatataggggctgcgcgtatgaactaaagcaatggaggtatcagagatcacctgactaccttggcgctctctttccatgagttgtgcagcaaccgcagaaggctctgtaacatttccccgccccgcctccagcatgcatatcagctctacggtcgccgccatatccatcccttgattttccagcggatatacttgaaattgctgtacaatgtgtacaatttcctcgagacttttccgcagaccggtaagccactccatatcctgaccaggctgaacggcctgttcctgctgatgatcattgagatgatggagtgtaatatgctggatgaaatgacgtagacggtcactctcctcctgcgttagcagcggactgatcttaagataccgatctggttcaagcggtagctctactgtcgaaatgatcagatcataatcctccttgggaatccgcgccgcctcgtaccatgaagccctatccacaattttgatctgtgggagctctttggcgagccttgttgccagaagtctggatgatccaatgccgctcgtgcagactacaatggcccgcacctcccgacgcaattgtcgaagccgctccagcgaagcgccgaaatgcatgacgagaaatccgatctcttcatcaggcactttcatttctgtcatgctcgccgcagcctttttcactgagtcaaataagctgctgtaatccttgcggatttgctgaaggagagggttacgaatcgacctgccttccttcaaacgtttgaataccggagccatatgggcaatcagtccttcacgcagaacacggtcctctttcaatggcgtgcctgtctcttcctccacacgacgaatcaactcatgaaccgactccaacagtacgagatcatccaacggcagtagtcgggtagagtgatcttcggcatcacgaaatagcagcctgagataagatcgttccggctctggaaattcaatatccagcgcctctgacaactccgtgcatatgcgttccaccatagctgtgcgaagcatgatattttcatccgaatctgtttttaaatacgagagaagaggatctataacatacccgagtcgcagacgtaccagcaaaacgcaaatttgaatcagcagctccatgtatttgctttccaccatgttttccaaccatttttcatgaggctgccagagggccttttccacaattagcaggttatctctgccaatcatctccagcaacttgtcggcaacacgggttacaggacgaagttcttgccgggctgaaaacagatcggattcatccaaatattcgagagccagctcggaaatcgcccgtcttttgtctgtctcccgccctgtaatctcgaccccgtacccccgtctgcgcacaagcatgagtccacgttccccaatccagtcttgcaattcgtctagatcatgactgaccgtagttaccgtgactttcagatctgaagccagcgccaacagcttgaccggctcccgtgtatccagcagcatgcagagaaccacgatctttctctcctcagccgaatattcgtctgacttcgtatgcagcaattgttttcgcaggcatacaagccgagctggatcagcatctatacagataccgatccctgactttttctccagcttcacctcatgagctgccagccaatgctcgactgcacccagttcccgatgaaccgtccttgtgctgacattgatcttcgtagcaatttccccggctgtaacctctttggactgctccagaagatattccacgatgtcacgttgtcgtttcgtaatattcataagcgcataccgttccttcccaagctcatccctccagcaggagacgtacattgcatacagtccgcctgacttcgatggggattaagaatcggatttcagacgttcaaccagcgcttcgtattcaggactcttcagaaaattgtcaatggaaatgtgctcagctttcggagctactgttttagcccggtctgtcaacgttttttgcgtaatgacaatatccgcatcctgtggaatttcactgattgccgtattcgtaactgttacgcccacacccgcctgcttcatttttttgcgtaaaatcgaggcacccatagcgcttgaacccatacctgcatcacaggaaaagacgattttgttcacttcggatttatccttgagcgttcgatctgcagcaatttctgcagcacgatcagattcgtggttatcttccattacagtggcgttagcacttgcactcttgctttgatttttcatatctttcaggcgggatgcagcttcctccagcccctcttcttgttgcttaccagtcttgagtaacactgcggcaacagcaaaagatacgaccgcagcagcgatcaccccgcttagcattggcaaatatccgccttttggcgtcattagaaaataggcgatgatgctgcccggcgaaggagcagcaaccagtccggcacctgtcaacatgaaacagaaggttcccacaacgcccccagctatagcagcaagaatcaaaatcggcttcatcaaaatataagggaaataaatttcatgaatcccgccgaaaaaatgaatgatgactgcgccaggagccgacgacttcgcagagcctttaccgaacaggcagtaggccagcaaaataccgagccccggcccagggttggattccagcatgaacagtacggattttcctgttcttgcagcttcctccaacgcaatcggacttaatactccgtgattcagcgcgttgtttaaaaataatacttttccgggctcaataatgaggttgacaagcggcagtagccctgcgttcacgaggaactgtacccctgccgacaatacttgactgatcatttgtacaaccgggccgatcgccacatgggcaagcagtgctagaatggcaccgataatcccggccgaaaaattattgaccagcatttcaaagcctgatctgactttgccttcaatggcctcgtcgaacttcttcaatatccacgcagccagcggaccagcgaccatcgcgcccaggaacatcgggatatcggctcccactatgacacccatcgtcataatggcaccaatcacacctccacgttgtccgtgaatcatcgtgcctcccgtgtaaccaatcagcagcggcagcaaataatttttcatcggatcaaccagttgtgcaaaaccttcgttcgggaaccacccggtcggaataaagagtgccgtaatcaatccccacgcgataaaggctcccatattgggcataaccataccgctgagaaaacggccaaaacgctgtacggcgacacgagtgcctccttttgaacttggctttgcgtccaatgtactcatattcaaatcctccttgtaggtaagcatcactaccttttcttaaaattcatactaaatgacagcgctatcttcatcaatgaaatgaaaacgtactttcgtcatgaacgttgatgacaacatttaaatttaaattaaccgagaaggtattagacctgcataattcttcttaatatgacctgtagctatagaaattagtcgaaaaaacactgttgtaaatctacacaattttaaagtgttgctctcttctaagcctgagaagacaacgtaaatccgtcttctaaaagacaacaaaaaaatagtcgctatgtcaggtcatagcgactatttatacaaaaactgagcggactaacgatgctcttatttaattcaatatccatataaaaaaccagaataaagcgttattatttcatgctgtattgctcattattgcacatcagaaatcaactgctcgtattgatccgcagacagtagcttgcccaatgcttcctccacatctttatctatctctacttcgatcatccaacctttttcatagggagattcattcactagctcaggcgtactttccagcgcttcattcacttttaatacggttcccgtcaccggagcaaaaaggtcggataccgtcttcaccgattcaatcgtaccgatttccgctccctgctcaatcgttactcccgcctcaggtaattctacaaaaacaatatcacccagttgatgctgtgcaaaatctgtaataccaatccgcaacgttccattctctgtgcgctgaacccactcatgttcgtctgtataccaaagttgctgcttcacttcacccattttgttcccctcgcttccatatgaataaaatcgcttttgctcacctgtattagacaggttaagattatgacaacaggaacactcatgtcaataatactaacaaaaatacttcatatgacctcatatggcgtactatataaaaatatgataacttataacaaacgcttacatatccttatttatatattaaatgttttttatattgtttttgatgacatttttattgacattttgaatgaatttgcgtattaatgggttatagcaaatgctttgggaaacaccccgacaactgcaaacgcggatgaacgcggagggagagactgccaaaaagattcgcatagctgttgccgcttatgagacagttgtgcacgcgaatcggatcaagttgttatctgcaaagccaggtaatatactgttgatcccgaaggtagcgccgaaggagtaagcctgcattgcaggtgaatctctcaggcaaaaggacctctgccggacgcatctctggagagcattcgctattggagcggatcacccaaggggaaacccggtacataccggggtaactttctggtatcaaggacagagctgaaaaaagagtgtagactgccgtctatacgtttttttcggcctgtcttttttgtttagccgatcacaccgaataggagtggaaaaatgactaatttgcgaaaaacaccgctatattcgtcctacgggacgcagtctggggttcgttgtattgactttggcggctgggagctccccgttcagtttagcggcattcaaaaggagcatgaggccgtccggcaacgtgcgggtttattcgatgtatcgcatatgggcgaatttttggttgaaggcaaagaggccgaagcttttctgcaaagtgtgaccacaaatgatgtcagccagttggaaccaggtcaggcacaatattcactcctgtgttaccccgatggaggggtagtagacgacctgcttgtttactgcaaaggaccggagcgctacatgctcgttgtgaacgcctctaacatcgataaggattgggattggctaattcgccatatacctgcatccgttcacatggagaatgtgtctgatgcgatagcattgctggcgttgcaaggaccggaagcagcacgtattgccgcaaccgtggcagatacggacattacgaatctggcatctttccgcttccatgagaatgtgccattgttcggagcaaaagcactcgtctcacgaaccggatatacgggtgaagacggttttgaattttacgtacctgccgcggaagcaccagccgtatgggagggtttgcttcgttccggtgagtcgtatgggctgattcccgctggacttggtgctcgggataccctacgctttgaggcacggttgccgctgtacggacaggagttatctgccacgatttcaccactcgaagccggtctagggttcttcgtcaagctgaataagggagattttatcggtagagaagcactgcaacgtcagaaagatcaagggattcctcgcaaattgatcgggctggaaatgatggatcgcggtatcccacgcgcccattacccggtattcgcagaaggacaacgcatcggtgaggtcacaacggggactcagtcgcccaccttgaagcgtaatctcggcctcgccttggtagacagtcgttttagcgccctctccacaccgctggaggttgagattcgtggcaaacgcctgcgtgccgaggtggtgacagcacccttttataaacgcccgcgctgatcttaaactctcctcatttctataaagcaaacatgtcagatatgtacttccgggttttcatctcacacttttttattaactaatttacgatttaaattttgattttcgaaaggagccagaacctatgaagcagcatcgttatctccctatgactgaacaggatcaaaccgaaatgctgcgtgtggtcggcgcttcatccatcgatgatttattcagtgacattccagaggccattcgatatcaaggggaactccctctttcttctcgactcggcgagagagccttaacccgccacttggccgagcttgctggacacaacgccaatacagacacacatgccagctttcttggcgcaggaatttatgatcatcatattccgtccgtcatccagcacatcacttcacgctcggaattctatacagcctacaccccctatcagccggaagtaagccaaggcgagctacaagccattttcgaatttcagtcgtatatttgcgaattgacgggcatggctgtagctaatgccagcatgtacgacggagcgactgcactggcggaagcgggctcactgtccgccgcagctacccgccgtaaacagcttatcgtatcaaggtccgtccatccggaagcacgtcaggtattggcagcctatgcacgcggattggatttggacatcgtggagatcggctgttcggacggcgtaacggatgctaatgcgttagcggcggccgtatcggaacagactgcggctgttttggtccaaagccccaactttttcggagccgtggaaaacctgaagccgatggctgatctcatccatgcgcacaaaggtcttttggtcgtcagtgccaacccactggcacttggcttgctggagacacccggcaaacagggcgcggatattgtggtaggagatgcgcagccacttggcatctcctcttctctcggcggtccgacctgtggatactttgccgtttctcaggcacatatgcgccgtatccccggccgtattgtgggtcagaccactgaccgtaacggtaaacgcggcttcgtgctgaccttgcaagcgcgggaacagcatatccgccgcgaaaaggccacgtctaacatttgctccaatcaagcgttgctagctttatctgcatctgtatacttgtctgtcatgggtagacaggggatcaaggaagtagccgagctaaatttgcataaaagccgttatgctttagagcaattgctgagcttgaagggcgtaactgtctcatttaacgcaccgacctttaacgagtttgcccttagactgcctgagggtacggatatgagcaaactccaggccgaactgctagctgctggatttatcgctggctacgatttgggccgggactatgaggaacttgctggtcacatgttgattgccgtgacggagcaaagaaccaaagaagagattgaccaatttgtacacaccttggggggattgctatgacacacaccggacaggatcagaaacaagggctgttgaaggaacacgatcaagcgctcatttttgaattgagccgtccgggtcgcatcgcctattcccttcccgagtgcgacgttccccgtcgcccggtggcagagcttttgccagattatgcgctgcgcagcgaacctgcggcattacccgaggtatacgaagtagacgttattcggcattataccgccttgtcccggcgcaatttcggcgtggacaacggattttatccgctcggctcctgtacgatgaaatacaatccgaaagtgaatgaggatgtcgcccgatatacaggcttcgccaaaatccatccatatcagcccgaggagagcatccagggtgccatggagttgctgcatacgctccaaaatgatttggctgcgttaactggcatggatgccgtcacacttcagcccgccgcgggcgcccatggcgaatggaccgggctgatgatgattcgctcataccacgaagcacatggtgagcgacgtaccaaggtgctcgtgccggattcctcgcacggaacgaaccccgccagcgcaaccgtcgcgggcttcgaaacagtcacccttccctccacccctgaggggctggtggatctggatgcgctgcgtcaagccgtaggcaacgacaccgctgcgctcatgctgaccaacccgaacacgcttggactgttcgagaagcaaatcactgacattgctgccatcgtgcatgacgcgggtggtctgctctactatgacggggcgaactccaacgccatcatgggaattactcgtcccggcgatatgggcttcgatgtagtgcatctcaatttgcacaaaacgatgagtacccctcacggcggcggcggccccggcgctgggcctgtcggcgtaaagcaacggctcatcccttatttgcccaagccgcttgtcgtacgtgattcgcagggggtgtaccactgggaccgggaacaaggagattcttttggacgggttaaagccttttacggcaacttcggtattctcgttcgtgcctacgcctatatccgtagctacggtcctgatggcttaaagcgtgtatcggaatgcgctgtgctcaatgccaattacatgatgcatcggctcgctccacattttgacctgccctaccctggacattgcaaacacgaattcgtaatgtcggggcgaagcttgaaaaaatttggagtgcgcacgcttgatgtagccaaacggctgcttgatttcggctaccatccgcctacaatttacttcccgctgaatgtagaggagtgcatcatgatcgagcccacggagacggaaagtaaggaaacacttgatgcttttgtcgacactatgattcatattgcgcgggaagcggaagagaaccctgagctggtgctcaatgcaccatatactactccagtcacacgattggacgaaactaccgcagcccgcaaacctgtactgaattgctcatgcagttaaaaacaaattctacttaaaggatgcaaaaaagccggtatctaaatagataccggctgctgtatgtacacagcaatttttttgttggaaaaagatataacctttgaaatgtaatacccttccttagccttcgatgctttgaaccaattcaacaacctgttctgctgtttgcatgtccagagcttttgtagccagtttttccatgtccgcacgggacaacttggagatttgactacgtgctggcagaatagaagttgcgctcatactgaactcatcaagtccaagacccagcagcaacggaattgctgttgtatctcctgccatttcaccacacataccaacccaacgtccttcacggtgagcggcatcaataaccattttcaccagacgcagaatggatggattgtatggttgatacaggtaagaaacccgctcgttcatgcgatccgctgccattgtgtattgaatcagatcgtttgtaccgatactgaagaaatctacttcttttgcgaattggtcagccaataccgctgtagaaggaatttctaccatgatgcccaactgaatttcttcagatacggatacaccctcggctaccaacttttccttttcttccaacaaaacagctttagcttcacggaattcgttcagcgtagcaatcatcgggaacatgatgcgcaggttaccatgcacactcgcacgcaacaaagcacgcaattgagtgcggaaaatatcctggcgatctagacacagacgaatagcacggaatccgaggaacggattcatttctttcggcaggtccagatatggaagttctttgtcgccaccgatatccaaagtacggactacaaccggcttaccttccattctttccagaacggttttgtacgccgtatactgtacttcttcggatggaagcttatcgcgtcccatgtacaagaactccgtacggtacaagccaacgccttcaccaccgttgtccagaacaccagctacatcattaggcgtaccaatattggctgccagttcgacatggacaccatcgacagaaactgtagcttcgccgcgcagcttgcgccactcttcgcgttgcttgtcgtatgccacctgtttagcacggtattccgcaacaatctcttcggttgggttcacgaatacgtgaccatccaaaccatcaacgataatcaaatcgccgcttttagcttgagacaatatatttttcgttcccacaactgcaggaatttcaagtgagcgagccataatggccgaatgcgaagtacgtccgccgatgttcgttgcaaaacctttaacaaattcacggttcagctgagctgtgtcggaaggtgtcaaatcttctgcaagcacaatcgtttcttcggcaatttctgcaggactaacaaaatgaacaccaagcaggtgattcaggatccgcttggttacatcacgcatgtccgatgcgcgttcttgcaaataggcacttttcatgttttcaaacatggaaatgaactgtgtagctacttcattcaaagcatagtcagcattaagctgctcgtctctgattttagctttaaccggatcgatcaattcaggatcattcaggatgagcaggtgagatgcaaaaatttctgcttttttctctcccagctcctgaagcgttttctccttaatcgattccaattcggtttgagattgtaccaaagccgcatccaatctcgcgatttcagcttcaacatcaccaaccgcgcgtctctctacagcgtaattcggatgctccaagataaacgcccgggcaatggctatgcctgccgaagcggcaatcccggaaattttaagcatgaacttcgcccagcccttcgttaacgattacattttcaagagctttcagtgcttcggctgcttcagcgccttcgcagataatgttaatagtatcaccttgttccagacccagagacaatacacccagaatggatttcaaagttacttttttaccgttagcttcggcaaaagattcagcaccgctgaatttgttagctgtatttaccagtgcagttgcaggacgtgcatggataccgtcttcatccgtaattctaaaagttgtttgcataatttgttcctcccactttcctaaagataatatttgtttacacgcagtataccagatcattgatgagacggcctaagccgcctaatcaactaatccgaaacacatagagtttattttatcgtaattataccatcttcgccagccttcaatactccagttttgtttaaagttaccgaagaaccttctggaaggttggtaaaaatgacaggtgaaatgatggatttagcgtttgccttcacgtattccaggtctactttcataataggctggccggctgacacaagatcgccttcgttcaccaaaacgtcaaatccttgccctttaagcttcacggtattcaccccgatatgaacaagcacttctttaccgccatcggattgaataccaatcgcatgcttgctcgggaatacattgaatactttaccataaacaggggacacaatcgttccatcatttggcacgaccgcaaagccgtcacctgtcatacgttctgcaaataccggatcgggaaccgtcgagatatcaaccaattcgccgttaacaggcattacaatatcttctacaataatggtttgttgttcttccccagcttccttctcctcttgtggagcaggttgcgccggagctggtgcaggtgtacgtccagccatgatatctgccatttgagttttaatggtgtcggaacgtgtaccgaaaattgcctgtacgttgttgccgacttcaaggacacccgatgcgccaagttgcttcagacgagctttgtcaacgttcgatttctcattaacctcgatccgaagacgtgtgatacaagcatccagatgcttgatatttgatgaaccaccgaaagctgccaaaatgttgtgcgggagctcatcactactaccggctgctgcaccatccacattttctgtagcttcttcacgtcctggtgttttcaagttgaacttccgtatgatgaaccggaatccgaagtagtaaatcactgccaaaatcagaccgacgatgattacataccaccaaggcgtacgggttggaataatcccgaaaatcaggaagtcaataaatccgcctgagaaggtcataccgattttgacatgtaaaatttgcatggtcataaatgacagacctgcgaatatacagtgtactgcaaacagcagtggagctacgaacaggaaggaaaattccagtggctccgtaatacctgtcaagaacgaagtcaatgctgctgaacccatgatacctgctacatattttttatgttctggtcttgcttcatggtacattgcaagcgctgctgccggcaaaccgaacatcatgaatgggaatttacccacttggaacgtacttgctgtcaacgccactccatcacgaagctggctgaagaagatctgctggtcaccgtgaacggtttgacctgctttgttaacatattcaccaaattcaaaccagaacggtgaataccagatgtgatgcaaaccaaatggaataagcgcgcgttcgataaccccgaacaggaacgccgacaaagtcgggttggaatacaccataaagtgagatactgcgttaagtccttgttgaactggaggccagatcagaaccagcgcaagcccgacaatcagtgaggacaccgccgttgcaattggaacgaaacgcttacccgcgaaaaagcccagatacgaaggaagctcaattttgaaaaagcggttgtacatggccgcggccagtataccgatgattatcccgccgaacaccccggtttgaagcgttggaatacccaacacgttcgcataacccggtattttttgagcaatcagaccaggtgtgacacccacggctgtacccaaagtaatgttcataacgaggtaaccgatgatggcagccaaaccggctacaccttcaccgcccgccagaccgacggctacgccgactgcgaataacagggccagattatcaaaaacgatttgtccggcattcatcatgatcgtcgctaccgattgaacccagcccgcatttaatgccggaatgtactggagaaaatcaggattgaccagcatgttaccgatacccaacaaaagccccgcagctggcaaaatcgctacaggaagcattaatgctttaccgacacgctgtaaaacgccgaaaagctttttaaacataccttccacatccttctctgaaatttagaacagaggcaaaacaacaaaaaaggcatgagccgatttaagtatgtttgaaaacaaccttgggatatagcttgccccagtaggctgtaaacaatcataacttaaaacaactcatgcctgatcgaatcagtaacacgttaaatgttcagttgttgtcttcctcattgcagaattgattatagcaccccgctaaatgcgaggcaatacttttttattccggttttatcactcttgttgctccccctgctctttgcgttgggacaaccgttgcagatgcattgtcaaataactaacctcagccgggtacacagatttacggagtcttttctccataattttcgtgagcttccaggccagcatatacatttccggatactcctcattcaaaagcttgtccaatcgataaatctcctgcacaatttctccccggcgcacacgttcaatcgcaaacctcagatgagtcagcagtcgagaataatcaagggattgaagaggaatacgataatccagtgtcgtctcgacaacctgaaccatatcagcaatcagacgagaatccttcctaacctcggagatatgctggtttgtcatggcactataaatatgcagggccacgaatccgatttcatcttctcccagatctacatccatcttatccctgattaaagcaacagcctgctcagccatcttgtattcctgaggatatatttccctagtctcatacaaaaacggattatgaatcgtaattccctgtttatgacggttgatggaaaaagcgatatggtcagttaaagcaatcagtatgtgctcatttagaggcttcttagcttgaagctgaacaagatgaagcacctcaccgatgacctcaatgagcttttcatccagctcaggaagcaaccgtttgtattgctcctgttcttcatggctttttaatataaataatttttcaactgaatccaacggcataagatcgccgggtctgcgattgaaaccgattccttttccaatcacgacaacctcatcatgctcgggatgcatccctataatcacattgttattcagcgctttggccacttttaggctgctcacatccgcacctcttttatcagaaccttgatcctaagaattatagcatgaagctcagaggaatccacgttaaagtaccaaatattcggctaaaggtcaataaaaagaaaacgcttttcatcacattgccgggaaatgctgtgatgaaaagcggtcttttggttagggataaatgctccccaaagacttatcgttattctttatctgttagcgctacctccaccgaggctggaagaggctgcttattcgcttcaccggaaggcggcacggaatgaatgccttttttccccgtggtcaaccccttgattaactgctccacatcaataccggatacactcttcagcatctcgggtgccgtagccatcagttcggtgacataattgctgacacgcgctgctccttctccttttcccgtatcaactacggtgagtttatcaatggacgcaatcggttcggcaatacgtccagccagatcaggcaacattttcacgataatatcgagcacggcggcctctccaaacttttggaacgcctccgccagtttttccttggcctccgcttctgcaagtccacgcaaacggatgacatctgcgtccgccgtacctttggcgcgttcggcatccgcttctgcttgcccgttaagacgtttttgttcagctgacgctttagcctgtgtctcaatcgagtattgcagcgattcagcctcacgcattttacgcgatttatctgcttccgccgcttgctcgaccgcataccgatcggcttctgccttctttttcacttccgcatcatattgcttttcacgtacctgtatttccttggattgaagatcaatttcccgttctttgcgcaccagctcgaccttcatctgctcttcgacagcagtctgcttggcacgggcctcctggatgtgataagcttgatcggcttctgccttcgctgtatcctgttctttcttaaacgaagccactttcagttccttctccttggctgcctccgcaatgttggtatcccgcagcagttcggccttctggccttcctgttccgcacgtgccttctgaatccgggcatcccgcacagcctcggcttctgcaatctcagcatcccgtttcacagcggcaattctcggcttaccaagcgcatccagatatccgtgcttatcacgcacatctttgatggtgaatgaaacgatttgcaagcccatctttttcagatcacgagcagccacgccctgtacttcctgcgcaaaccgatcccgattacgataaacttcttccactgtcatcgaaccgaggattgcgcgtaaatgtccctccagcacttcctgagcctctcctctaagagcctccaatggcttcccgatgaactgctcggctgctgtagccacatcctcaatggaactgccgaccttgataatcgccacaccatccgcaatcacgggaactccttgctccgtatacacttccggtgtggttacgtccagtttatgggacaacaaagagatgaattcggactgctggaaaattggccaaatgaaggcccccccgccgcgtacaattttaattttgcgtccagagtcatcctcggaaatatttttatttcccagaaaagagcccgtcacgatcatcccttcatccggtcctaccgttttgtaacgggcccaaaaagcgatccctaatataacgataacgatgacaacaatcccagggactaacacaatatcttgcaaatttgacactcccgatcacgctcccttcaagataatcgaatgcgccgtctatgtgtccaggtacgctacgcggacgacgccctctgcgacctcaaccacgacgatacgggttcccgcagcaagcggtttgtgatcgaagctcgatgccgtatgtatggtgttgcctgcacccaagcggatcataacttccccgtaaccaacctcaggtacaggaatggtgacctcaccgatccggccagtcagctcacgcatggagaagccgctagatacctccgaattcgccatgggtttgataaacgcaaagaacacgagtattccgatgacaaacgcaatccctaaagcaagcacgacaacccaccccatgctcagcccagtatactttgtcagcagtactccagctccgccaaaagcggtcatggctccaagtaaaacgacaggtctgaaccaatcgaggcccggcaactccaatgcaccatccagccaactaccgagtacatctccaatcagcacactgactacggtaaagatagcgccccctgccaataaccaccaaaatatggtttccatgcgactcctccttccatgtccttttcagtctggtttccagtctataactatgtttacgtattcaaccttaaaaagtttcaaaattttcctccgatatcccagatcaaacccaaaaaagcacgttcgtacgtctaatgacgcacaaacgtgcttaaaatgatacaaatatcggtttacagagaggctttgtaaatttcgactacatcttcgcgattaagcttgttaaagccaccaaaagatccgaatttcacagctttatcagccataacatcgatttgggacgcatcaatatcgtaatcagccagacggcttggtgcaccaatcgagttccagaaatcacgcaacgcctgaataccttccagcgccacttcttcatcactcttgccttctgggtttacatggaatacattgacggccagttgtttgaagcgttcaggcttcacatgcagattgtgcttcatccagttcgggaacagaatagccagtcctccaccatgtggaatatcataaacagcagacaccgcatgctcgatattgtgagtagcccagtcacctgtcagccccatgttcaggaagccgttcagcgccatcgtaccacaatacataatcgtttcacgcagctcgtagttttccagatcgttgaccagacctggagccgcatccatgaccgtacgtaaaatcgtttcgcaccagccaagttggaccggagtattggattccaaatggaaataatgctccagcgtatgtgacatcatatctacgattccgtaaacggtttgattttgtggcagtgagtatgtgtttacagggtcaagaatagaaaacgcagggaacgcaaatacgctaccccatcccaatttttcctgtgttttttcatttgtaataacagaacccgcattcatttcagaaccggtagctgccatggtcaaaactgtacctaatggcaatgctgcctgtggtgccgctttacgctctgcaaaatcccacatgtcgccatcatattttgcaccaacagcaatggctttggaacaatccagcacactaccaccgcctacagccagaacaaggtcgatttgatgttttttacacaattccacgcctttatgtactgtagataagcgaggattcggttctacaccagccagttccgttacctctgcaccaatttcaccaagcaaacttattacattatcgtacaaaccgctgcgcttaatgctgccgccgccatatacaagcagtacacgtttaccatatttaggaacttcacgcttgagagcctccaattgtcctttaccgaagatcaattgtgtaggattataaaattcgaatgctttcatcgcaaacgctcgcctccaatagttctaaagtttaatgttaagaaactactctattataaccttttcggttacaggaaacaaatatgctttattttcagaaaaaaaccacactccttgaggagcatggttccatgtcatatcttgggagggttctcgtagtgtattatgtgctgcaccagcgattttattctcccaaagtatatcccaattgtttcataaaacgaccaaacgcctgctgcccggactcattccgtttatacactcctgcatgctctaaaatttcactgaatttcagtccaacctcattttgtacggtacgaacagccgtttccttgtcaggcaaacgaccgaaccgagtgtttaactgataaatccagtctgcatgcttaaacagtggatgtccttcctgctgcatagccacagccagtttgtcatccccacacaaaatatctgcaatcccatccagttcatccttgagccgccccggtaatatggcaagtcccataacttcgatcagaccgatattttccttcttgatgtgatgcatctcgcgatgaggatggaaaataccttccggatactcttcactcgttcgattgttacgcagtacgagatccatctgatacctgccttcggaatctcggcgcacaatcggcgtcacagtattatgtggaatcgtttccccctcctgctctgtatgagagaggacatcagctacaggatcactataaactttccaggcttcaaaagcagcatttcccgcctccaacagcgcctcggcatctgttgacgtaaaacggatgaccgacatcggccagtttacaatccctgctgtaacctgcgggaacgcttcattatggtatacaccgtccacacccgctttttcaattgggaatgtatgacgaccaccctgaaaatgatcatgggtcaggatcgatccgccgacaatcggcagatccgcattggagccaataaaataatgcggaaacgctttcgtaaaggccagcaatcgccgcagtgtatccttcgtaagcttcatcggtacatgatcatgatggaacacgatgcaatgctcgttgtaatacacatagggtgagtattgaaaaaaccacggctccccattcaattccaccggaatgatacgcagattttgacgggacggatgatttactcttcctgcatatccgacgttttcacggcataattgacacttgggataaacaggcggcggcaaaagcttcgccatcgcaatttctttaggacttttttctggcttggacaaattaatcgtgatttccatatctccgtaagatgtcgactgattccagtacacattgctggcaacccgatccattcgaatgtagttcgaatcgatggataattgataaaaagcatctgtcgccgcctctatgccacgttcatcctccgtttgatgaaagtcacggatgacttcagacggtctcgccatcaacagtcccatgattttggaatcaagcaaatcgcgatacgtatctgtgttttcagggataagtcctatggcaaaaccataatctatcaatacattaagcacaggctggagagcttcgggggccataatgccccctgcttccccacctgaataaggctccgaaaacccaaactgctccaacagcagattacggctgtaatctgtatcttgcggaccgatcaagcccttgttttgtgcgaatgcaaccagttgttccaccgcatatagagccgattgctgcacagtttcgtcgatgtcatgggccagatgccgggaatgttcccggccttggcctttatctgtggattggcgctcgctcatatgtcatcgtctcccgtctattcgtcgccgtagccgtgagggtgcgactgatgccatccccatgctccgctaataatatcctccaattgggtacgtgctggactccagcccaacaccgaacgagccttgtcagaagatgcaaccaatatcgctggatctcctgcgcggcgcggctctgtaacaactggaatgtcgagtccagtgaccttgcgtgccgtctcaataacttctttcacagagaagccctgtccattgcccaagttgaatacgttgctgtcattgccttcgcgcaagtaatttactgcacgcacatgagcatctgccaggtcactcacgtgaatgtaatcccgaacacacgtgccgtcaggtgtcgcataatcctcaccaaacacagcgatgtgtggacgttgcttcaaggctgtctggagcactaacgggatcagatggctttctggtcggtgatcttcaccgatcttgccgctctcatgcgcaccagccgcattaaaataccgtaaagacacatatttgatgcctaaaactttatcaaaccacgacatcatgcgctccatcatcagctttgtttcaccatacacgttggttggctctgtacggtctccctcttcaatcggcaccttttccggttcgccgtaggtagccgcagtagaggaaaacacgattcggcgcactccagcatccttcatcgcctccagcaagctcagcgtgccaaatacattgttgtcataatatttaccaggattttgcatgctttctccaaccagcgaattggctgcaaaatggataactgcatcgatactattttcagagaacagtttggacagtagttctttatccctcaaatccccttcatacaacttgcctccaagcaatgctgctttgtgcccggtttgcaaattgtccagcaccacaacttcttctcccagatccaacagttctgctacggtatgtgaaccgatatatccagctccacctgtgactaaaatggccatgttattcgtcctccttcagttcttttactccgtctcctgccttgcatacataaaagctggcttccagccctgtgcgggtctgataagcttcgccgacttccttcacaaaacgttccacatcgtcctcatgaaccaatgaaaccgtacaacctccaaatccggctcctgtcatacgagcacccagcgtgccaggaatgcgtcgtgcttcttcaaccatgacgtccagctccgtgcagctgacctcatacaaatcgcgcaatgaatcatgagaagcattcattaactgaccaaaagctgcaagttcattcgctgcgagagcatcgacagaggccagcacacgagcgttttcctccaccacatgctgtgcccgccgacacactgtttggtccgcgatgtgatgctgaagctctccgaaacgtgcctcatccagctgagcgaggtattccaatgacggcttctgctgctgtaaaatggacagtgcttcggcacactggctacgacgctcgttataggctgagtccaccaaaccgcgacgcttgtttgtatttccgatcacgagcttataagcccccgtgcggaatggcactttacggtactccaacgtatcgcacatcagaagaattgcatgatcagctgctccgttcgctacagcgaactggtccataatgccgcaattgacaccaacgtaattgttttctgcccgctgggacaacaaagcgatttcgaccgtatctgtttcctgtttttcgatcgtgagaaacgcatatcccgtaacaacctcaatggaggctgaggaggataatccagcaccattcggtatttctccatgatagagcaggtcatatccgttagacggatgaactcccttttcagccaactccaccagcacacccaccggatagtccatccactcatccgttttgtttttacctatttctccacgggggatagacacttcatacgacaggtttgtcgaagcaaaatgaatttcatcatcattgcgcgcacgaaggattagcgtcgttccgaattccagcgcagccgggagtacataaccaccgttatagtcgatatgctctccaatcagattgacacgtccaggtgcatgaaatatccgcagttcattgctgctttcaccatatttttcaataaaatgtttctttaattcagtagaattcatatccgcatccacctcatataccgttagtaaaggccctcctgatttccctgtaacatcttaatcaggttgacatctcttatgatttcagtataaatgaaagcgtcacacaatgtaatgcatccatgtgtttaagctatggataaatgtgacttggatatgtacaatgtaagtataccgcatccgctaaaccattcacaaatgcaggaaggatgaccctattttgcaagcgtattcatatagttatgccgtcgcctctaatccggtgttttatgaaaatagcccgctgcatgtgctttttgcaggagagagccaaaccaaatccggtcatgccgtggggccgaaaatctatgattactatctgctacactttgtagaatcgggcagaggtatcttccgaacggaacagcacacatatcagcttgaagaaaacgattttttccttattcatcccggtcagctggtgagctatacctctgatgaagaggaaccgtggcgttatcgttggtctgcgtttaccgggcaccatactgagcaggtggtgcaggaggccgggctacgtgttcaccagcctgtctttcatgcttccgatcaaagtcccatccccggttatttggagcaaatgcaattggccttttatagcagaaaatctagttctcatctatcagccttgggctatttgtatctgattatgggggaagcaggcaattacctgagtgactggactgatccgtccggggcggattcgcaaattcaacgtacagtcaagcagatggttcaatatatgtccactcagtacgcacaccccgtttccattgagcaaatgtctgaaggacttggttataatcgtgcgtatttgtcacggatattcaaaaaggaaacggggatctcccccgtcacctatctgcttaagctaagaatcgacaaatcacgtcaactgctgcgtgaacgtcctgaactatcggtagagcaagtggccgcttcggtgggactaaccgatgccttatatttctcacgtcaattcaagcgcttctgtggtcagtctccaaccgagtaccgaagcaaggttaagcagtatccacagtcgtaaaacagacttaaacagcccgcatccttcaaacggatacgggctgttaatttatattgtataagagaacacgaaattaggccgatgactacaaattaactttcgccattaggctgtgccgccgtcctgtcagttcccggcattcagaatcgaatcaatccgatccaattcctcctgagaaaagtccagattggataaggtagcaacattttcttcaatttggcttacacggcttgccccaatcaagacagaggtcagacgttcgccgcgcagagcccaggccagcgagaattgagccaaactttgtccgcgtgcagcagccatctgattcagggcgcgtaccttacgaagtgtctctggcgtcacatggttctcattcaggaaaaccgaagtactcgctgcacgtgaatcctcgggaattccgttcaaatatttattggtcagcaatccctgcgccagcgggcaaaaggcaatgctgcctaccccgttttcgtccagtacatcttgtaatccgttttcaatccagcggtcgagcaaggagtatttcggctgatgaatcagaagcggtgttcccagctccttcagaatgcgagctgcttctgctgtttgctccgcactataattggacacacccacatacagcgctttgccggatcgtacgatatgatccagtgctcccatcgtttcttccagcggcgtatcaggatcaaatcggtgagagtagaatatatcgacatagtccagtcccatccgcttcaggctctgatccagactggatatcatatacttgcgagatccccagtcaccataaggtcctgcccacatattgtagcccgctttggtggagatgaccaactcatcccggtacggtttcatatcactggctaatacttgtccgaaaaattcctcagctgatcccgcaggagggccatagttattagctaaatcaaaatgcgtaattcccagatcaaaggagcgagtaatcatgctacggccattctccgcgttgttaatcccgccaaaattgtgccataagcccagcgaaatagcgggcagttttagacctgatctccctgtacggttatatttcatagtttcataacgatcttcgccagctaaataaaccatgctatcccagcctctctcgaaacattgtaatgtccatcacaacatcatcatagcgcttttatccaggcgttgacaagaaaacgattacagacctaattgatgagcaagtttttccataactttaccaattggatcggtgatcaaaagatccgccttatgatcatacgaggtgggatccgtattcagcagcaccgtatgtttaccacgaaaataagtaatcaagcccgcagcaggatgtactgtcagcgacgttcctccaattaacagcagatcagcctgcgagatagcctgaacggattgaataatggtatcctgattcagctcctcctcatataaaacgacatccggtttgataattcctccatctattggacatttgggtacaacctcagagctgttcatcacttcatctaggctgtaaaaacgtccacattccatacagtggttccgatgcaccgagccatgaagttctagtacattcacactgccggcagcctgatgtaagccgtcaatattttgggtcacaaccgcttttagacggccttgcttttccaatgacgcgaggaaatgatgacaaccgttcggctccgcatcgggatgcagcattttgctgcgatagaagtcgaagaacacttcaggatgcttcacaaaaaatgaacggctcagcataacctcaggggaataaggcaatttctcctcactttgatacaggcctgctgccgaacgaaaatccggaataccactttccgtcgatgtgcctgcaccgccgaaaaaaacaatattctgcgattgctgtatccattccgccaacgtattaactttcataccctacgcacctccagctcttcatatccacgaacaaccttatccgcatccagcaaatgaccagaacgttctgcttctggcgcaaatccaatagcgagccgcactccggcacgtttgcccatctgcatgtccccattgctgtctccaatgactaccacgtccgccggcgacaagcctagtaatgcgcaggctttttcagccatttccgggtcaggcttaccatatgtaaccctatcatgtccgataatctcatcaaaataggatgtcagccccatccactccaaatgctcctgtgcagcctctgtactgtcagaggtcacaaccgctagcttcagcccggcatggcggctttgctccagcaatgtccgcaaccctggaaacaccttcgctgcccgatgtcgccgaatatcagccatcgccgttttattaaagtcgcggacaagccgcacagcttcattccacggtacaccagcattataaagctgccaagccagtacccccgtactttcgtccaccgtccccatggccagcgggccagaagggtcgtaaccgatcacacgtccctcctgatcgtgaacagtacctagaacggtacctttttccaccgtaaaaccggcacctgccacgataagatgctgctccatcatatccagtatagaacgagcccaggggccccacaactgaataaaatccagcaacgttccatctttatctaataaaataccacggcatgggtaccgctccccctgcacgatcagctcagacatgcagcacacctcctttactgattcttagcagccacatccacactctctttcatccagtcctgtaaagccgttaccgtctgattccattgctccgcagcgctaatttttgcaggattatcccctttttggacaccataactgccgaattgggcatgatttcccccttcgactgtaaaatacagcgtgttggctggtaaataagttcttccactttggacattttccatctggatgactccatcatcacttcccagtagagaaataacgggcaaatttttatcctttaaattacccttgttatccgggtaggaggcgaggaaaaatacacctttgacctgatcaggatgtgcagctgcatatcgggccgccattacaccgcctaacgaatggcctccaataacaaacgcttctttcggatatgcctttagcacttcattcgctaaatccggggagatcaatgtaaggttcagtggcatttttgcaatgatcacatgatgacccttttccgccagacggcgtgccaacggcgcataactttcgggcttcaccaacgcccctggatacaaaatgactccggttccgcttcttttttcaggctcaaaaccaacccaatgttcttgttcatttactttcacagcatccgctacttcggctaatgcagcagcagctgtctcgtcaggctgataaggcgtaaataccttccatgccccccaccctgcgatcagtacaatgacaatcaggatgcctaagagaattttccatattttccgaggaccacgtgtcccatatgaattgtatgatcttcttgtccttcttctcattgtaaaagttcctttcgccttttgtacctcgaaattcgtaatttgaatataaaatgtgtcgctgtattcatcagcgtaactatagccttgttagggtaacatcgttgtacatacagggtcaaatcagcatacatttccaggtattagcccttctttatccggtgttcaagctttcgccacataataaggacatggtagcgcttactattgtgaaaaaaatcacattgataaagtccagagtatcgtaccttgttccttgtaaagaattattttttaaatagtttagtcggcagaagccgttcggaggggaacacatgacgacaagccatgatgtacaaggggaaagcttctttctcaatttgcgatttctgttgatcatatgtgtatttgcaggaaatgctctggagcctctagtcggttcacttcatattgcccaacaatggttcagctggatattcatgttccatatgccgttgtttgtactcgttacaggctactttgccaaatcatctttgaccggacccgcaggccaaaaagttctgcttcagatcggtatgcaatatcttatttttcaatcgctctattcgatcttggatgttgtactcttccacgttccccatatccatcattcgttctttgctccttatctgctactctggttccttgccagtcatatctgttggagactgctgatgctgacttttcagaaaataccacctgtcctccaattgggtatatccgtgctgctgggtatccttgtcgggtatctccctgtggatggtatatggctgagcgtatgcagaacctttgtttatttgccttactttgtagcaggttatcatttgaattatgcggacgttcgacggttcttcacaacaccagtccgcataatcgctggcattgtatctcttctgcttatggtactggcgggaacgtcgtatttcggcatcccggcaggctggctgtatggcaatatgacttacggtgaattgggccataccgaatggtacgcaggaatttaccgtatcggcatttatggagttcaatggatagcatcgatggcgtttctaagctttgttccgaccgtgacaggacgtataaccgagatgggaagacggacactatatgtctttttactccatggcttgatcgtccgtaccgttgttgcaaagggagtctacgaatatatagatactccagtggaagtcatgttgattgtagtgtgtgctgcaggtctgtgctgtatgttgaccatgccttgggttcgaactgcaacaagacctctgattgagccacaggtagagtggatgctaaagccagctccttatccttttagacggtccgcgtaatctttttatccctttttatttaacattgaatacgcgacaacccactcacagacgaacatgtaagcgagtctaccctccctttactccacttagagcctgtttcatacaggcgtgatgtggtaagtaaaggatgcgcgcaacaaaaaacaacttttttattaaggagtgatttgtaatggcacgtaatcaaaatcaggggaaaatgagtcgcgaagaagcaggtcgtatgggtggagaagctacttccaagaagcacaataaggaattttatcaggagattggtaaaaaaggcggggaagcaaccgcaaactctcatgataaagaattttatcaggaaatcggcaaaaagggcggcgatgctacagctgagtcgcatgacaaaaatttctacagagacatcggtcgtaaaggcggcagaaattaaggtgtagtgtcatattccgctctcctttaacataaaaaaagcctgagcccatccgctttattgcgaaatgggctctttcatattttagctgatacgcaaacctatcagtatacatatttctaatagaatcacattctaacctctcctaaatgcaatatatagacaaataaaactggtcatatctatatattgttgattacagaacacttcttgtactttttcaaaatcttcatatatgtagaaaaaagctcacatctatgatagactctttagaaaacatctgcgctattacggcgtccattgaacgccatactatttttatactttggggggaaaccagcatcatgacagctaagacgaaaatgcgttccgatatgattaaaaaaggctttgaccgcgctcctcaccgcagcttgctgcgcgcagcgggtgtcaaggaagaagattttgacaaaccgtttattgcggtatgcaactcgtatattgatatcgtaccgggccacgtccatttgcaggaatttggcaaaattgtcaagcaagccattcgtgaggcaggcggtgtacctttcgagtttaacaccatcggtgtagatgacggcattgccatggggcacatcggtatgcgttattctctgccgagccgtgaaattatagctgactctctggaaactgtcgtttccgctcactggtttgacggcatggtttgtattcctaactgtgataaaattacccctggcatgatgatgggcgcattgcgcgttaacattccaactattttcgtcagcggcggtcctatgaaagctggtaaagacaagaacggacgctctatttccctgacctccgtctttgaaggcgtaggtgcatatcaggctggtaaaatcgacgatcaaagcttgcttgaattagaacaatatggctgtccgacatgtggctcctgttcagggatgttcacagcgaattccatgaactgtctcgcagaagcgatgggtctggctatgccaggtaacggcaccattctcgcagtagcagaagaacgtaaagaattcgttaaacaatctgcacgccaattgatggaattgattaagctggatcttaaaccacgtgatatcgtgactaaagaagctattgataatgcatttgcattggatatggcaatgggcggttccacgaataccgtattgcatacattggcacttgcccatgaagcagaagttgactaccctatcgaacgtattaatgaagtcgcaaaccgcgtacctcatttgtccaaattggcacctgcttccgactatcatattgaggatgttcataatgcaggcggcgtaagcgcagtgctgaatgaattgttgaagaaaccgggtgcactgcatggtgactgtattactgtaaccggaaaaaccattcgtgaaaatgtagagggtcaggaaattctggacactaacgttatccataaactggacaacccgtattccgaacgtggcggtctggctgtattattcggtaatctggcaccgcaaggctccattatcaaagtcggtgcagttgatccttcggttggtggttatcacaaaggtcctgctatctgctttgattcacaggaagatgcactggcaggtatcgccaacggtaaaattaatgaaggacacgttgttgttatccgttatgaaggtccaaagggcggacctggtatgcctgaaatgctcgctccaacttcacaaatcgtgggcatggggcttggtgccaaggtgggtctgattacagacggacgcttctcaggtgcttcccgtggtatctccatcggtcatatttcccccgaagccgcagaagggggacctatcgcttttgttgaggacggcgatatcattgagctggacttgaacaatcgtaagattgagctccacattacggacgaagaattcgaacgtcgtcgcgccaactggaaaggctttgagccgaaggtgaaaacgggttacctggcgcgttattccaagctggtgacgaacgcaagtaacggcggaattatgaaaatctaaatgctttgccaagataggattactttatgaacggctaaaaagcctctcgatccctaacaatggatcgagaggcttttttattaggtcattaggttagctattcagtcatttcgctgttgagtatatggacatcatctctctgagttgtttgctcaagagcttcgtctgagtagtgtgagtctccctgatgaaaacggtcaaacaaggtatccattggcatcacgatcagtttcggtaccattacatcttttttttcactccattgctctgaacccgaaggatgaataacacgaaataacagctttagatatacagtggacacatgcttgaacagtcctttgggaagctcccgaacttgaaatcccaacttctctggtccccgatgaatcatacttactgcatagatcgcctttacacccttcatttcagaatcatgtacaatgcgttgggccagatcaggaagttgttttttcacaatcctaatcaattgaatagctagatgtaccatcgacttcgccgtcgaccccaattgaaataactttttattatcaaaatgaagctcaattatcgggtcccctttttctagccacctgctgttctccatatttacatttggcccatgatagatacggcgacgataataaaagatcgtatcctcctgacttacgggacgaagacgaaacaaaacatggaatagccgctcatactggagccatccacataccagcgttcttttaaaccagcccgtactggacatctcggaggcagtgggtttattgacagactgacggcaaaacaatgtatccacccgtacgctgcgcagttgtcgttcttgggcgaccctcagcagcttctccagtgcgattagcatattctggggcgcttccgcgtctgcccccaatgtcgtaccacagtcatggagcagcatcacctcgccaccccttagctttttgagcattctctccgccaattgtttcgctccaatgcttgccttccagtccccgaacatggaggaccataatacgattcgacgaccatgggtgttggaaatatcaaaaaagttcactatcccccaaggtgggcgataaaaggtcgttccctcgccagttactcgacgaatgactgactctgtctgggcaatttgtcttctgaccgtaactggccgcataagccaattcgatttgtgcacataattatgaataccgattagatgaccttcatcatgcatgcgtttcaaaagttcagggtgtttttctgcattcatcccaacaacaaaaaaagtagccttggcatcaaaacgcttcagtaaatcaagcagctgtgatgtatacactggatcaggaccatcatcaaaggtgagcgcatattcttgctcacttttaccgcgccggaacacccggaacccaaatatacgactaaccagcgccggaacaaaagcataaaaagttgaaatgtaaaacatccataacagcaaagtctgcacgttttatccccacttttctattctgaactcccaagcaggcttcctgaggaaaactcacttacttatatgttatcacaatgacgtaaacatgccgagatttcgcgactgcatatggtcagcattgaggtccaatttagtgtacaataagtaaaaatcttaaaggagtcgttgtatacatatgcttccattgtacaaaaaatattggcgtaccgtttttgatatcggactgatcgtattaaccgtgtatttaattatgttcgtatccagcaaactgtatcaacttgcggcacctgtgttcctttcgttcgtcgtgttctggtgcattgaacctgccgctcgttattttcatcgcaagggaatgaagaagcccttcgcctctgcgctctccgtattgctgtttatcatccttttacttgctatttttttcggattgggcctgattctggttacgcaatttacgaaagtcgcgcaaaacctcccacattatacgcagattatccaaacggaattcacgcggtatcttcatctttctcaagataaaattgctgctttacctccgggtgttaccgaacgtgtaaatgattattttgcgactgctaccaccattgctacgaaatgggcacagctagggttatcctttttcatacaattcctcagctctttcactgtttttatgggcaactttgcggttgcgatcattttagcgttctttttaagtatggaaattaatctttggaagggcattgctcgtagtaaaacacccaagacactaaaaacggcttacctttttctaaaaaatcacgtacttaaagctatctccgcttttctcaaggctcaagctctactggtagggattacctttgttctcgtatttataggtttactcattttgcaagtggataatgccctctcattggcgctcgtggcagctttgtttgatatcctgcccttgttgggtgtgcctgttatttttattccgtgggcagtgtatctgttcatcacaggcaataccggcctggctgtaggcctgcttattgtcatggctgtcacggtgatcgtccgccagctggcagagcctaaaattactggtaactccatcggtgtttcatctgcctatctgatgctttcctttgccattatatcgttatccatcttcggattggccggattaatcctgtcccccattctgatcattttgctcaaggaattatggcagcaaggttatctgcagcaatggattcggtttccgacagaggaatttgacgagcctccgtttatcgttaaaatccaggaggaagatcgtgaagctacccgtggaactcaggaggattgagctaacagatccattacttgaccaaacagtgctgtagcttgatttgcagaatgtgttgaagcattttgcacaaggacggcgaccgcataacgaggccgctctatcggaccataccctataaaccactggtgattgatagggtgaccgttcttcaaagcttgggcggtacccgatttgccggccagattccatgatttattacgcaaggaggcacccgtcccctgtgtcacaaccttttccattgcttcacgaagcatgcgagccgtcgatgtgtgaatcgagcgactaccctcggatgaaggtacagcatgagtaggtagttccagtaaggtgctaccgtctgcgtagctaatgcgttttacaatgcgtggtgcacgtacttgaccatcgtgcagcaaggtgacgatgagattagcagtttggagaggcgtcaccagcacatcgcgctgaccgatagctgtctgtacacgtacgcccggatcagacgcgttcgtatgggagtcgaatacggctcccttttcttcgtgatccagcggtctgaattgaggtagccctgcaagattccgctcctgccagcccacagttcggcccaatcccaatgcagaggctgtggcctgaatttgctcagcattaagccgttcaccgagatgagcgaacacactattacaggatacggcaagcccttcctccaggttcagggtaccgtgtccttcttttttccagcaagtcaaaccgtacttgccatatgttccatgacaatggaattgttcctgcggttggacagcacctgattcaagtgcagcagcagccgtaaccaacttaaaaatggaaccgggcgttaccgccttgagggcacgattagaccagtctgtttttttctgcggatcaacatgcccgggattataaaaagggcgagacaacatcgccagtacatccgcgttgcctgcatcgagcactaccacggccccttctgccaaatgactagattccgtcagcttttcaatctgttcctgtataggtagatcaattgtagtttgcacctgtaaaggatagtgaccattggatggagcactgacacgcagcggtacatgagtcaatggacgacgctgcgcatctacaaatcgggagacgaacgtttcaccgacgccgctcagcagcggctccaacgttctttcaagccccgctgcccccatcggcagttcactcgctcggtcggcacgttcatacagaaagccaagccattgcctgccattgggcaaatccctgtaacgtttcgcataaggtacaagctcaataagcgaaggggctagcttcagtagcttgcctgcttcatgcggattgatttgtacgggctctccgcccccatcacgccatatgagcggggattgcagtcctttccagcgtgtcagtagttgattcttgttcgtacgcagtagcttagccagttcttcgccatgtatagccgctttgccatctacatcgggaaaaagcaatggcgcccatacgactccgccagtcaagggttgcccatgccggtccgtaaactgtccacgtccagagtcgatagaaatgccctcctgtcgctgacgtgctgacatttccttaagcgaatgccctccataaacagacatatgaatgcccgctgtcccctgaatccaagccagtcggaataataaaatcagcagtagcgccatcacccccaaggccatatatgcaattcgacgttttcgaatgaaactgctaccacgcctcggcacacccatccttctttcatcatttttccagtagtatgtcctgtagttgaaaaagaaaacccactcaacttttaacgtgaatgggtttccgaatttatttgtatcttgtgatgtctgcttctggactccaatctaaaatctcgtctaatgaataaaaaaccgtaataaaaatagtaatggccagcacaacccaagctacctttgtgtttgtattcatcttttgctttccttcttgagggatttttaagcacatccactaataaaaagtacaaaaccacggtgatcagtgacaatcctgattcccatggttttgttatatctacaccgtaaaccgcgaaagctgttccttcaaattcaccgatactccttccagcttatccgacaaacctaccagttgattaccaatattggcctgctcagtgctgagcgaagcgacttcctgcgaagtagccgaggattgctcggccaccgcacttacattggtcattgcctcggacaaagtggtctgggattcactcagatgatgaatggaggcagtgaccgttcccaatcgtagcgcgaactctcccatttgctgctgcaccgattggaaaatgtccgttgtttcctgcacggctcccatctgttcccggaacagcgggtacacctcagataatgcctgtaccgtttcattcatttcattgacgatgttgttagtaatgcctgtagccgtacgaatagcttgacgtgattgttcagccaactgccgaacttcattagctaccaccataaaaccacgccccgccgtccccgctcgtgccgcttcaatcgtcgcattcagtgatagaatattcgtttgtttcgcaatatcctgtagtacgtccagcaccttaaatacatccgaagttgtctgcttcagttcatctactttgcccaccagagcatgtgtagtttcttccgtaacccgagtcttgcccaatagatttttcagctgaatggtccctttttcactggattgttcaacttcttgtgcgaccagactcatttcataattggaagccatcaccgtatccatttgctgagatatattcccggttagtccgctgccacgttcagcctctgttgccaaactggcggcgccgtgagcaatctcttccgttgctgctgcaatttctttggctgaaatggctgtcttcttcgaggcatcgcctagttcaatcgctgtattcagaacttcctgagctgaggcattcgtctgttgtaccagcaatgtaatttgctccatcatcatatcaaagctttctgacaactgcccaatttcatcctgagccttatagttcgttcggatttgcaagttgcctttggcgccttcgaccattaaatccttcagatgtgtcaatggacgagccacgaggcgcacgatccacaggccaatgaacaatgcaatgagtgcagccactgcagcaaatatccaggttgtggttagaatccccttagcgtctctcaccagctcagatacaggtactacacccacgagaatccacttggaagttcccagcgtattatgaaccgcaagcacactttgctttttgccgtctgcttcctgctccataatttgatttccttcgattccttcaagcttggaaacgtaatccagctttgtcttccctcctgtcaagctctcattgttagagcctacaaactcacccttgtctgtcacaaggctaatcatactgcctgagcccaaattaataccttttaactcgtcctccaccgcactggactttaaatccataaccagaacataagtccctcccaacccggacatgctgttcatggagcgtgccagacgaaaggtcttgctaccattgtcattcacctgcgtaggtagccaaaccattcccttgtttttcaaaatatccttaaaccacgcttcctgccgtacatccttttgtgttccggtgcccatagcagctaaattggtttcttccgggtacaagtacattgaatcaatcgctttattcgtaaaagcaagattcgttagcttcttattcacttcgcccatagcaacaaaagatgcaaagggatttttatcttgctttacagccttttgcaactgatcacttaattcagtatcgaaaaatacctgtgtcgatgtatcttgaaagcgctctagaataatatcaagcttttctgaagtttgctgaacggtctgctgataagccgtagctgcattttgctcaatcgtacttttagccttgtagtatgagagcatccccaagctgaccacaaataacataattgccgcaaaaaagatcagaaacaacttcattccaaccgaacgtatcggattatagtttttgaccaaatgcatgaaatctttactgtacctttccggcttaagtaaacgctttaaattgtgtgtacctttacgagtcgctttagctacccagggggcaaccttcgaagacaccgcacccgtttgttcccctttttccatggtcactttactgcctttcaaaccctgcatttgatccgttttcttgggttgcctttttactgtattcccctcttttttccgtaaacccattcctctcacctgccaccatataattagtttctaattccacgtcatccattatgtatctattatctatataacttctatcggaactattcgacaaggaatgtagctttcctttgagtatcaactaaatttagtgaaacttttttcctagaaaactattcaaaaaaaagcctctccaaccgataggagaggcttttgaatcttttcgtctgtgacttaaggcttatttacttctttttacgcatcatatcaaaatacgatacgggttgatctaccttcattctaattcgttgaagcgggtgacgagcagcatccaattcgttgccttcctcatcccagatcgttccgaccgtttgtttaaaaaatgttccgttcgggccgaaaaattcaatttcatgaccgggtttaaaatggttccgttgttgaatagttgcgatgccactctcggcatcgtagtccatgaccagtccagcaaaatcataagggactgctttttcttccggctcataaatatgatcctcatgatccggtgtatcgtagaaaaatcctgtattcagcgggcgattggctgccttgttaatttcttcaatccattctggtttgagcacataattttcaggatcagccatataggaatcaatcgcttgacgatagacattcacgaccgtagccacatagtggatagacttcatacgtccctctactttaaaactgtctacacctacatcaatcagatcagggacattttcaatcatacacagatccttggaacccatagaaaaagcattatcgctctcttcaaacagtggaagctggttaacaccgagttggaactgtttcagtgcattgctgtcctgtgcctcttcctcagatatccaaacctcacctgggcgggcatcctcaaataaatcgtatttccagcggcaagactgacaacatcccccacgattggaatcacggtctgtaaagtgattggacaacacgcagcggccggaaaatgaagagcacatcgcaccatggacaaaagcttcgatttcgatgtccacatgctttttgatttcttcgatttcctctagactggtctcacgacccagtaccacacgcggtagtccttcgtttttccaaaactttaccgcttgccagttcaacgtggactgctgcgtactcaaatgcacttccaatccaggaacagcacgcaatgccacggatacaatagccggatcagcgacaataacggcatgaattcctgcctcatacagattgcgcaagtattcctcgattccggcaatatcttcattgtgggcatagatattggtggccacaagcaccttagcaccgtacttgttggcaaattctacaccttcgcgcatttcttcaaaactgaaattatcggcgttcgaacgcagaccatatttttgtccaccaatatatacagcatccgcgccatagtgaacggcaaacttcagcttttccagatttccggcaggagccaacagctccggcttatccagacgattccgtttacctatatattttctcgttttggttatcgtccccatgacgttcccccctctgtgagttcaattcattttaaaattaataaacctgctctttatagaaaaatccgaaggaaagttcccgttctggatcttgaagacggcgaacttcatccagccagctttcatcataagcataagcatccgggtcagctgtataagtatctattgctttacgataagcacgaacaaccgcctcattgtaagccgtaggtttcaataagccctcgatcttaaagctatgcacgcccgcctccattagaatatgcaggtcctccatgatgcaaaaatcatctgaactcataatatgtgtcccattaatatcctcgtagatggggaacttttcttccttccgctctgcttcaatcagaaacaagccgcgccctctgcccaaatcgccttctacattacgtccctggtgcagcatataactttgaacaagcttacgcttggaatgataaatattggtcataccatgtacctgaacctgtgcttctatgttcaactttggtatcatttcggtaatttcatccatactgagctcacgagccaaaatgacccgggaagcccctttttcaccccaatagttggcggttgcgaagttggtggagatcatctcaccgttccagaacagcttaagatgcggagcatactccttcacggccatgagcactgcgggatcattaaactcaatggcatcaatgccgcatccagctagggtctgcacatattcgggaaggagcggcaatagctcgttcgtcatcaaattcgtcatggatacatatacctgtgccgtatgcttgcgtgcctcttccaccacttcacggatttggtcaggggtaaaatgtcccggcagccgcattccaaagcggtcatctccaataagtaatgcagtagctccagcctccagcatatggcgggcatcctccggagagctggcagttgccagtagttcgggtttgtaagccataggctcacctcctaatttgtcttacggttacttacctgaatgttatgcaaatgttctttatacgttttggcaaacaaatgtttatgtgtcccatcttttttggtcacataaaataaataatctgtagcttttggctgtaaagccgctaccactgagtttagactgggacttgcaatcggccctggcggaagccccagatgcaaatacgtattataagggctttccacagccaaatccttgtaatacagccgttctttttgcttgtccaacatatattgaaccgtagcatcaatttccagcttcttcccctgtttgagccggttataaatgacgccagctactacagaccgctcatcttcaacaaccacttcgcgctctacgagagaagcaactgtcagcagttgatgcagcgtttcaccccgctgtttcagcttggcatccaaatcggaaacagtctccagccgcttttgtgtctgttctagcatcacctgtataatatctttggccgtactaccctttttcagctcataggtttccgggaaaagatagccctccagcgcatagcgaagccccgcctgctttggaatgtcccgcactagcgcgacgtcaaaagcggacggatcgttgaccagctgcaaaaattgctgccgatctgccaatccttccttttgcagcttatcagccatctgtctaatcgtaaaaccttccgggattgtaaaacgaatcatttcctctttgacaacatctccggccgataacttagtaatcaactgatcaaaggttgcgccaggctgcgcctcatattttccggcctgaaatgcgcttccttgctgtttgaatttcacataagccttaaacacgaacgcattacgtataagtcccttttgctccagcgtatctgcaattgccgatgttcctgttccctgcaccaccgtaaaagcaacgggttgtgtttggggctgaacaggctgcatggcattccaaatatagagggttgcccctcctgctataatgataagcagtagaaacaacgtaaacatcctcgtccttcgcttcacatccacccaactccttcacagccaaaaagggcggactggtccgccctttcaggtttgatctcatcgctatccagacttacagttcttccggcaacgtacattcatcgtacagttcggaaatatcttcccactcatcatcatcttcaatggtggtgatggagatttcgccgtctgtggatgagcttacatggtatagttcatgttcgccaacagcagccccaggtctacgcaatacagcgtaccgttgttcacctaccttgaactctgcttccaattccatgcgaattgcatggccctgttcatcctgtaactctacatcaccgtcgaacgtttccttcaaatcagaggtccaactcagatcttcacgtgaatagctcgtcatttcccgtcttcctcttcctcttcttctacaaatgtattaaaggtctcttcgacgatttcccactcggcatcgtcttggatcacaaacaatttaatatcatcgccttcttcctcgtaacggaaggcgtacacatcggactcatcagcttcagggtccactggcgcaaccatcatgtacttcgcttcggaaccatctacctcaaacttcataatgacctcgaactcttcctcgttgccctcgtcatcggcaatataaataatttccggctcttcttccatacccacttgattttcagccattacgaaatccccctcaccttgtactgtgtgcgtccaaatagttttgcaagatcaggcttgcggccagtttatctaccacctgcttgcgtttttttcggctgacgtcggcctccagaagcgcacgctccgccgaacgcgtcgtcagccgttcatcccaaaggtgaacgggtaaacccagtaactccttgagtcggttcgcaaactcgatgcaaatctcaccgcgtggacccacggttccgttcatgtttttcggcaaacctacaacaacctcgcccacctcattgtcacgaaccaaatttgcaattttaccgaactcgctgtcgtcaccgcgtcgttctatgacttccaatccttgggcggtccagccgaaggcatcacttacggcgaccccaattcggcgatccccgtaatccaatcccattactttcatgcctgtctcctaacggtgcttggcgagatagaaacgaaccaactcttcaatcaactcatcgcgctcttttttacgtaccaggcttctggcattattatgccgtggcacgtaagccggatcaccggatagcaaatagccgacaatttgattgatcggattgtattctttttccaccaacgcatcatatacggtcaacaaaatctcctgagcagaagcttccttctcatctgccttgacattaaatttgaccgttttgtccatggaatccattgttgacacctcgcttccacaaaacatgtgtacatgtttatgccagcttattcttttacatcataccataagcaaagccctacaaggaaatatctaagcccgttttttcccaaaaatccgcaaaaattatcgaactttatccttgtgaggctgccgacaccagttcatgcgcacgttgaagtgcttcgtccagcttgctggcatccttaccaccggcttgcgccatgtcaggtcgtccgccaccaccgccaccgcatacggcagcaatttctttcacgagcttacctgcatgaagtccagccttggtatgctctgccggaactgctacgacaaaattaactttgtcgtccattgcagcgccgagcaccagcacagcagccggaagcttccctttcagttcatcagcaatagcacgcaacgcatccatgctagaagcctgcacgcgtgcagccagcagctgcaccccgcctgcttgcacgacctgatcggtcagctggcctgcctcaataacgctcagtttgctttgcagcgattcattttcacgactgaggtctttaatttgttgctgcaaagattcgatacgctttggtacctcagacagcttggattttacaagcccagccgacaccttcaacagctctaattgaccttccatatattcaaagccaaaacgtccggtcaccgcttcaatacgacgtacacctgatccaatgccgctctcgctgacaagcttgaacaagccaatttgcgaagtattgctgacatgacagccaccgcatagttcaatgctataatcgcctaccttaacgactcgtacgatatctccatacttttcaccgaaaagcgccattgctccgagagccttggcttcatcaatcggtttcagttcaatattaacgtccagttggctccagatggcacggtttacacgcagttcaatatccgccagctcttctggtgtaatgcttccaaaatgggagaagtcaaaacgcagacgcccaggctctaccaaagaacccgcctgattgacatggtcacccagcacttctttaagcgctttgtgaagcaaatgcgtagccgtatggtttttctcaatttctccacgtgaagcttgatctacttctgctttcaccgtatcgccaacgttcagctcaccggcttctacaacaacctgatgcacatgctgaccttgtggcgccttaaacagcccttcgaccttcgcggttaccgtacctccacgcagcaagccttgatcactgacttgtcctccgctttcggcatagaaaggggtcacatccagcaagacctgacaagactgcccttcactaacactgtccaccagtgcatcttcatatacaatcgccacaattttagactcagttatgaggtcattatatccaacaaattcacttttaaccgccagatcggacaaagctccgccctgaatcttcatgctcgcgctgtcctgatgagcatcacgtgcacgtttgcgttgctcctgcatcgcttcatcaaaaccttcacggtctactttcaagccctgctcgtccgcataatcctctgtaagatcgaacgggaacccgtacgtatcatacagtttgaaggcatctgctccgctaatgacattgcgaccttcggctttcgcctgagcactgatatcggacaaaatggccaatccatctgtcagtgtttcatggaagcgttcctcttccgttttgatcactttgatgatgaaatcacgcttgtccactacctcagggtaatacacccccatgacatccccaacggtttccaccagctcaaacataaatggacggttcatgccgagcatttttccatagcgcacagcccggcgcagcaaacggcggatcacgtaaccccgtccttcattagaaggcagcacaccgtcaccaattgcaaaagctacggtgcggacatggtcagcaataaccttaagagccacgtcactgtccacattttcgttatatttgactcctgccatcgccgctgttttttggattagtggctggaagatatccgtatcaaagttggaatccacattttgcaaaatggatgcaaaacgctctaatccagcccctgtatcaatatttttgtttggaagcggtgtatagctgtcgtctttgttatggttgaattgtgagaatacaaggttccacacttccagataacgctcattttctccccctggatacatttcagggtccgtcatgtcgctgccgtaggcttcgccacgatcataaaagatttccgtacaaggtccacaagggccttcaccgatatcccagaagttatcttccagtttgatgatacgttcggcaggaagtccaactttttcgttccacagcttgtacgcttcctcatcctcaggatatacagttacagccagacgttccggatcaaaaccaatccatttcgggtccgtcagaaactcccatgcccatgtaatgacttcttccttaaaatagtcaccaatggaaaagttgccgagcatttcgaaaaaagtatgatgacggcgcgttttaccgacattctcaatatcgttcgtccggatacatttttgcgaattagcaatacgtggattctccggcttcacacgtccgtcaaaataaggcttaagcggcgccatacccgcattaatccacagcagggaaggatctttatgtggaacaagcggtgcgcttggttcaatcacatgtcctttgctttcaaaaaactccagccatttggagcggatttcactagctttcatataagtagcctcctaattatggtgtcactggttcctggcacaggccataaaaaacagaaaaacgcccctgaacggatcagggacgattgtatcgcggtaccaccctggttaacgccgtcccctctgtacgaaatgcccatgcgcaggctgcacaccaacatttgcttaacggacgatcgatcgccttgttttcactggtaacgggagcatcccggcgggttcagcccgcacttcgaaatgagctttccctactggataaacacatttaaacatactcaattcagtatatccgtgtcatttagccgtgtcaacgcgatttcagacaagatacatacggtgtatggacaaaatcagattgttttccgcttcacataataagcaaaaaaatgctgaagtcctacctttaaaaccgccatcacgggaaccgctaaaatcaagccggtaattcccgcaatttccccacccactagcagagcgaaaataatggctatcggatgcagatgcaacgttcgtcccaccacttggggagagatgacattgctctccaacacttgaatacaggtgttaacgaccacgaccaaaagcaccatttttaaggagaccgtagaagccatgactactgccggagcggctcccaaaaaggggcccaaatacggaacgatgttaaaaaccgcaaccactcctgccaacaacagcgcataaggcatgccaatgagcatatagccgagataagccatcactccaataatgacgcataccagtaattgtcccctgacatagttgccaagcgcctgatcaatttccttaagtaccgttacaatcgccttgcgacgagaacgcgggaggtaagacacaatcgtccgctcgaacacatcaaaatccttcaaaatataaaaaatgaggaacggtacaatgaacacattgaacagcatgttgatcatcccgccgatattatccataaaggtagaaatccctgttgccatccgattctctagttggaaaaaccattgattcatacccgttcgcaccccttggggcaaaataccgctatccatagtcgtcattaatccctgtgcatgcatggtcagctcaggcagatgctcattcagctcatccagttgttcaatgaacatcggaatcaggttcatcagaatcacaacgagactggctaaaaacacagcatagatgagcagcacagctacgcttcgaggcaccttgcgaccgcccagcatactaacaacgggattaagtacataggagatgatcatcgctaccgcaaacggagcaatgattgttttcagaaattcatacaaatgcaaaaacaaaggtcgcagcagccagataaaatatagaatgacaagtcccagcagcgtccatattccgtaccggaacagtctacttttcgttaattgctccatttcgtgcccccttaccggactagcctcctttaagtatatgcctgtacctctactttaatccttcccgcaagtctggattaccctatagattactattgtaaaaaaatgatgaaaacggatgaaaacaattaacaaagtcattccatctgacgatataagtacaaagcactactttaagctttcacatttctgaaacatcggggggtcgttacatgaacttaaaaatcaagcttattctcctttttacttgtattgttatcgttgcagctgggccattgtcgatcattagcatgacaagcgttaaaaatcaggccaaccatgatatccaagagcttatgaacagcaaagcctccgaaaccgtcaatcagctcgacggatggataggtggcaacgccaaaattattgatacattggctgcaggtctggaatccagcgatatttcatcagataccaaagccgtatctctgaaagcagcttttcaaaactataaagatcaaaatatttccaatatttatgcaggctttgaagatgggtcctactgggatggatctggctggtttgaagcaggttatgatcctcgcgctcgaccgtggtacaaggatgccaaaaccaagggggaaatgtattactcgtccccatacattgatgcaggtagcaaggactttaccatttccattgctaagcctctcaaggattccaacgattctatcaccggggtagtcagcgaagatattatgctcaacgatatgacaaaaatgattcaaagcatagacctgaacggattgggctacgcatttctgattgaccaaaatggagccgtgatcgcgcacccagacaacaagctggctggcaaaaacctcaaggacacccccgagttgggctcatcaaccgcggacctgctgagcgcagcttcgggaagaacagactatagctacaatggaagtgaccgtcagctttattttaaaaagatgcctagcacaggctggattgtagggttgtctatttccaaagaaattgcttttcaggaatattactccactcgtaatacgttgattattacggttgctatcatcttggtcgtcgctatgctgctggcaatctgggcggcaaacaactttattaagccgattcgcagactccaagcgaatgtcaaacgtatagctgaaggtgatatgaccgctcgcgtagatgttaagggtaaagatgaaattgccagtctgggaacagattttaatatcatgtctgataatctctctcaccttttgcgcaaggtatcagatactgctggtgatgtcagctcagcttcccatgatatgcatcaacacgccaaagatactggaaccatcgcgtcacaaatctccagtgcagttcaggagcttgcccatggagcgagcgatcaagctgaggctgtatattccggctctgagaagctgactcacatgacaggctccatcgaccagattggcgaaagtgtcaaacggacccaaactgccgtatttgaaacagattctgccgtgcttgcagggtatgaaacagcagaacgccaagcgaaactagccgccgagtccagacaaacgacgactgcggcaggagaagctgtagattcgctcgcgctgaaaactcaggatattgagcggctggccggggccatccacgatatcgccgcacaaacaaacctgctggccctcaatgcatctatcgaagcagcacgggccggggaacacggacgaggttttgccgtcgtcgcgggagaagtgagaaagctggctgagcaagcgggcagttccagtgacagtatcatgagtaagctggaagaaattaaaattgcaggagtacaaagcgcggaggaaatgaagaaagctcttgctgtaactgtagaacaggagcacgctgccattgcaacgagacaggcgtttgaatccattcgtggcgcttctcagcatatgcttgcccaaattgaggacgttaccgccgccgcagatcatctccgtgtgaatgccgggcatatttccgacgtcatttccagcgttgtcgctgtttctgaacaaagtgcagcatctacagaggaagtggcttcttctgtacaagaacaaggtcatgccatgaacaatattgccgacctttctgccaaactcgattctcacgctgatcttctattggaagaggtcaaacgctttaaattgtaaaactaaccatcttcataaatatggtatacaaaagagggtaccccgaacggccatatgactgttcggggcaccctcttcgttgttttttatcaagcgttatccaacctactaagccgtatgtagatcacacctcttagtaagcagcctgtccactttcggtgtcaagcttaggaagaagcatgaatttgcggcaagtcctgttgtgccatctcatctccaaagaataggtcgtccagcgaactgagcgttccatcctcttccacttggtagacagacattttttcaccattcacctgaagttcgataaagcatccccagcaataaaattgatgggagccgattttgccgatatctttggaattacaattcggacatctcaataaactcaccctatccattaacagaatatatggctttttccagacgctgctcgcttaacgggggaaccataacggcattttccccgatggacatatcttcggtgcagggcagccatttccgcccttctataatatccgatacaaaaccatcgctgatttccaagcctattatgttattgcccatttcctggtcaaaataaacatccgagatgtgcccgagcataagcccttcctctgttagcacggatagatccttcagtttaccgggtccaagcaagtacgtatgttgtatatcatgggcctccgttttacggacagcctgctgattgcgaatcatgatcgcatcctcaccgtaagcaacgatatcatcccaagcaaccattttcacgtgagaagaaaaaaaaccttttccttccaactcgatccctgtgattcgccaatcagctgtcaccataaagtcatgtattttgccaatctgcttcccgtcctccacatcaaaaacggcaagtccgatcatatcttgaagcttcatatatagggtacctcctcattctgcaatccgaacgaaggtgcggtcattttcctacatgcctgtcagaccttgcttccgttcatgcaatgaaatggaaaaccgcccctcccttcttattaaaatgcggagaaatccctagtacctagtacgcagccgcttccatatggtttcaattttcttggccgtgtattccatttcttccgtagtattacccaaaccgaagctaaaccgaatcgctgaatgtaaaacatcttcaggaagatccatcgcctgcaatacatgcgatagctctagagatccggaagtgcaggctgatccgcttgctgctgcgattccttccatgtcaaggttcatcagcatggtctctgtaccaatggccggaaagctaacattgaggacattaggtaaagaatggtcagggtcaccgttaattacaaaattttggctaccgagagtgtcttccaaccctttaagcaatgtctgacgaagaaccgtatcgtgcgccccacgctcctcaatggaagcattaacaagagttgcggctttagccagacccgcaataccagcgatgttttctgttccggcacggcgtttcttctcctgaagtcccccatgcattagcggttgaatgcgtgtaccctgacggatatataatgcacccaccccttgtggtccgttaatcttatgacccgacacactcagtaagtcaatcgggagattccgacagtcgatggatatatgaccgaaagcctgaaccgcgtctacatggaatacaatgccatgttctctcgcaatctgccctacttctgagatcggctgaataacgcccacctcattgttggcatacatcatgctgatcaaaaaagtgtccggtcgaatggcagcctcgatatccgcagggttcacgcgtccaaaaccgttgaccgggacataagtcacctcataccccgctttttccagctcatcacaagcatgaagcactgcgtgatgttcaactgcggttgtaatcatatgcccggaagtacggccgtctgccgtagccgtcccaaacagggccagattatcgctttctgtccctccgcttgtaaatataatttcttcaggcttgcagcccaaagaggccgcaacggcatcccgagcagcgctgacggtgcgcttggcatcgcgaccaaaggcatgaacgctcgaagcgttgccaaattggccggtcatgatgtccatcatagtctgcgcaacctcaggatgcataggagtcgatgcggcatgatccagataaattctgttcatgttaatccacctcaaatatagaacatgtaattgtccaattcatcatgttcttggtatgtgatcaagtccttaagtgtagttgaatccaacacttcagcgatgctgtcacgaattcgcagccacagctgacgttttgcaggatcgtcttcttccgtgaaatcgaccggagaaatcggaccttccagtacacgaatgatgtctcccgctgttactcctgccggttcattcgccaaaatataaccgccgtaagcaccacggatactttttaccaaacctgcattacgcaaaggcgcgatgagctgttccagataatgctctgacagctgatttttttcggcaatacttttcaaagaagttggaccttcgccaaacctggctgcaagttccatcataatggtcaggccgtaacggcccttcgttgatattttcaattgtgccacctcacttatagtaacaattccgttaaacacgcggaataactggtgttgtaaacctctctattccgatcctaaccctcagcttatgttaacatattagggcaggtaaagggaaacattacggtaacaatcttaaaaaaagttgctttcgggcgatttggaacagctttagcccattttatatagctttcttccatcgttcgccgtgtcgttggatcgtccaaacatcgtatcttattatcgtttatgttacaataggtgggttctacaacaatattgaaagaattgggtgatgaccatggctaaagccaatcatgaaacccgtgtcgtcgtcgggatgtccggtggcgtcgactcatccgttaccgcgctgctgctgaaggagcagggctatgacgtaatcggcatcttcatgaaaaactgggatgacacggatgaatttggccgttgtacggctgaggaggatgcggaggatgtgcgccgcgtctgtgaacagatcgacattccttactataccgtcaattttgagaaagaatacttcgataaagtattctcctattttcttgatgaatataaagctggacgcacacccaacccggatgtcatgtgtaaccgtgaaattaagttcggcgagtttctaaataaagcgctggatttgggagcagattatgttgctactggacattatgcacgggttgtggaagaagacggccactttactttgttgcgaggtgtggatagcaacaaggatcagacttatttcctaaatgcattaagccaaacacagttatcccgagcgatgtttcccatcggtcatctgccgaaaccagaagtacgtaaaattgcggaagctgcgggactgtatacggccaagaagaaagacagcacaggcgtatgctttatcggcgagcgtaatttcaaggagtttctgagtggatatctgcctgcaaaaggtggagacatggtggatatcgctactggtgaagtcaaaggacgccacgatggtctgatgtactatacactgggtcaacgacaaggcttgggcattggcggctcaggttcaggtgaaccgtggtttgtagcggataaggatctggagaagaatattctatatgtggtacaaggtgatcgtcaccacagcctgtattctaccagcctgattgcaacagatgtgaactggattgaaggcgcagatactcgtccgtccggcgaattccgttgcacagccaagttccgttatcgccaacctgatcagcaagtaactttacaatggcttgccgatggaaccgtgcatgtcatatttgatgtacatcaaaaggccattacgcctggacaagctgttgtattttatgatggggaacgctgtctgggtggaggaaccattgataaggttgaaaaacttcagcctgaaacagtttaaatgaatgaccatttttcattgatatagtagggaattaaaaaagtcgtctctccagatttgggagggcgacttttttaatgaaagatgtttttagttaatggattgaaaagagttcatgatctgctctttaaatggacttctagcataaatattaacttattccctctgtaattctttcaactattcctttatcaaaatcgtcgagttcagacattaacagctcgtactgttttatagattcagaagtgttcaatactcgaagcacagcaatactatagtgtccaagcgtatcaataccaaaaagcttatttaccttagggtctctgaactggctaatatgtttcaatttttcgattattttctcattgcatagtttctttttagcgatctgactcattgcattcaactgtacctgattatgctggatatccaaacattccaccaattgatcgtcacctatttttccctctcgtatttcttttgataaagtaagtagcttcattttattatctcccatcaatctagtttaactggcccataattctctaagagatactgccgttcatccctgtaattgttccaaaggtgttctgcaagtgccttatttccaatcctctctgcttcttttatctccaccatataggctctaagttccatgataatcctatttttgaattcatatgttacatccaaactaggaaatcctttagctttatcatcaagaaaatgttggtactcatgccgcagtgcactaattgaagcatcctcatatatattcaattgcccaggctttcctgatcctttgggtgcatacgccataatgtctctatctagaatcctaacttcgactccggctccttgcgtattcttaataatagtattccactcttctggatgagaaagtcgtccgggaccatatatatccctaaatggatcagcatcattcttacctaacatcgtatcagataatcgatttgaagctccttcaacttcaatagtagccccagatctcacctcatattttattgacgagcccaatccaatcttaggtttaattactgaactgactcccccaaatattcccgctgtaccgatcatgttagcccaatgttcctttgaccatgcatttgtaggaaacattgcttctctgattgttccatgtacaccaaaagtccagaagttaaaaaaatcattccctgaatcaaactgcttggatgcacgctctgcatatccttgatacaaacctttcggaattccaaacgtccaatagtctaaaaatccacctaccgagtcatagcgtttttcgtacctgtcctccgcagcagccataaaatcctcaccaagctctaccaaactatctgccgatttttctaaagcatttctagtatctggagcagggatagcacatgaattaggtggaggtggtaagcagcttgcatcaatattacctgcttctagcaaatcagctaatctgaatttgtccgcatgatgacgcagttcttttgcaatagaatctgttagtgtaacaaagtcattcatattcttctgagatgtttggaatctataatagaactgctctttggtcaccccatcccagaatcgttccatagatgaaatttgttgcattaaattgtaattcattcgggccactttttgctgtgcaagttcaaattgcttggagatagccataagttgctcaggtgttactttaatagttgtcatattatacctctgttgagagttcgtcatgacataataacactcttcaaatttatggagaaccatcttaattcctaattgttataagaaagattaaccttattgcctatgcctaaagacttaaaacttgactttttaattattgaacctgaagaaaatttcgtgaccagaggcgtcaccagtagaaaaatcgctaataaagaccgtacataagtaacttttgataacatcctcatttgggtatatgatgtagacaagatcatacttcaattgaaaaggagcgtgcctttatgtctgattcattaggaatgttgacaccgggtaaaaaagtttctttgaaagaatgggaccccaaggatacgaagaatatcaaaaataaagaagaaatccgacaggaaacagatcaattgaaggaacgcttcatggaattacagagcaaattatttacagagaaaaaacaatccgttttgtttgtatttcagggtatggattgcagcggcaaagatggcgtcatcaaacaggtattttccaaccttaaccctgcgggggtgactgtccacagctttaaatcacctacggctgaggaattaagtcatgatttcttgtggcgtgctcatagcgttaccccaggacgtgggtatattgcagcatttaaccgttcttattatgaggatgtgctgattacacgtgttcacggacagatatccgataagcaggccaaacggaatattaagcatatcaaacattttgaacagttgttgctggataatggtgtaaaggtggttaaaatctttttacatatttcaaagcaatttcagttagaaaagctgatcgatcgaattgaaaagcctcacaaaaactggaagctcgatccaagtgatttgcaggaacgaaaattttggaagcaatatacccagtattatgaggatgtattagagctaagtgcaaccaaacaagctccttggtatgtcgttccttcagataaccgttggtatagggattatactgtgctacggattgccgtccaaacgctggaggaaatgaagttgtctgatcctgaaccaagacctgaacttgaatcccttttacctgaattgtataaagaacgagataaaaattagctgtataggtacagcactaagcttccaaaaccgtatcacggctgagaatgccttgagtcgagattggaagctttttattgcatttttacgtgttatttcgaaaatgtatagagtttaacttactctgtacccgatagccgcagctacaactcctactacgacggaggacagtacatacatagccatgcgtcggtactctttacgctccatcagttgaagagattcatagccgaatgtggaaaaggtggtgtagccgccacaaaaacctgttcctagcagcatccagagtgcaggagacaaatggttttgcgtaaactgaccatagagccagcctagcagcaatgaaccgctgacgttaatgatccacgtcccccacgggaatacggtaccgaacctctttccggcccacatgccaagcccgtatctcgccagtgtacccataatcccgcctgccgccgcccaccagatcataagcgttcctccttaggagcagcctgcgtcatttttgtccctaggcggatacctgtccatgtcaaaaacagccctccgcctacgctaagcagcaggtacaacacagccgtcagcatacgatcatgaaccgtgaggcgtacagcatctactgcaaaagtggaaaaggtggtaaagccccctgtaaagcctgttccgatggcaagtcgcaatcgcggcttgatccgccacgatcgcaaggttaccgtaaagaaccaaccaagaaacaggcagccgatccaattgattagcagcacaccaagtggaaaatccgcacccgccgcaggcagcagcgattgcagaccataacgggtagaggttccaagcgctccgcccgcggcaacgaatagcacgtctttcatcttcttatccccttcttcgctcttgcacaatcatggtgtaacgtgacgatatcgtacacactctgtatatgaagtcgcacatatattaagactgtgaatcccgccagcgctggttttgcctgattttcgactcattcccctgctcagtagcctgatagaaggtttggtctgctatcgaatcgggcaaatattgctgcttcacataatgattcggataattatgtggatattgatagccaacatgaccgagcttttccgagcctttgtagtgtgcgtcacgcaaatggagtggcacctcggccgatttgatatcgtccatagccgacatggcccgtgaaatcgccgtatatacggcattcgatttggggctttccacagcgaacaaaatggcctgtgcaatgttcagtttggcctcgggccagccgttattgcgataggcttcaagcgcactcaccgcttgcaccattgcctgcgggttcgccaggccaatgtcctcactgctcgccgcgatgaggcggcggataaaggtcatcgggtccatgccgagcttttctacggcgtacaggaaccagaacagcgcggcgtcgctggagccgcgaatgcttttgtgaaaggccgacagcacgtcatactgcgtggattcatctgctttgacaatcgggcgacggatggattcctctgcgacttccagtgtcacgtgaatcgtgccgtctgccagcggaggcgtcgtgagcgccgccagttccagcgcgttcaaagcgcggcggatatcaccattcgccatggacgcgatgtgagccagtgcagcttcatctacctgaagctgcatgtagccgagccctttgtccgcatcgctcaaggcacggcgcatagcagccagcgaatgctcctgcgttagcgcttcaagctggaacaacgtagaacggctcattaaagcgccgttaacgtagtgaaagggattttcagtcgtggcgccaataaacacgatcgtgcccttttccaccgcaggcagcagtgcatcctgacgtgaactgttaaaacgatgtacctcgtcgagaaacaaaatggtttttttgccatacatcgatttattcgtctgtgcacggtcaatgacttctcttacgtctttcacagatgcttctacagcattcagacgtacaaaatcgccttgcgtgtgttgcgagataatatgtgccaacgtcgttttgccgcaccccggcggtccgtacaacaaaatagaagaaacctgatctgcctctatagctcttcgcaacagcttacccggacccacaacatgctcctgtccaatatattcatccagcgaagtcggacgcaagcgatccgcaagcaaccgattgcttggcgttgactcttgggaatatgaaaataagtccatttcattcacttccttatggtttatgaacgaacactttctctttttctttgaaaatatactatattatgttcgctcatacggttgaaaatcatgaaaattcaagtcacctttgattctgatacggtataaaccgcctcttattctaccatatccgttaacaagttgcagatagcatggtcacggtacagctgtagatctacaagtcagtcgcctacaaaaaagaaagaacagccttagacgaaagatgaatttcgtggctgttcttcgactggcataacttcataatttccatcactaagataaacagtaacaaaaaggaatacaacaactcaggcgatgctttacaacgctttttctgcttactccgtctgtgcctgtacgtaactaggaagtgagccatcatgcaatagccacagctcatgcagcgcacgggtacatcctacatacagcagtttggcatcccatgcccgttctccataatgctcatggtcggcatccgccacaataactgcatcgaactccagacctttggataggtacacaggcagtaccgacaaaccgccttcatattgctttttaccaccgtcaatcaaattcacatccaaccccgcgcttatgaaaacctcatgtagctccacggcctcttttaaggtgcgggtcagcacagaaacagtacgatactccttagaggacagctcttttagagcggtgagcaaactctgctcacgcacggatgagtcgtaagacatcgtgcgcaccggatcgccactacgaaataccggaactgccgtaataccgccgcgaactccctgctccaaaatcgtatttgcaaattctataatttccaaggttgatctgtagctccgcgtaagtgcaaaataccctgtatgttccggcgcaaaaagagaactcatttcctcccacgcatgtacgccacggtattcatgaatgccctgcgataaatcgcccagtatcgtaaaggaatgcccttttacgaacaaatccagcaaagcgatatgaaaaggtgaaaaatcctgtgcttcatcaatgaccacatggtcaaaacgttgggatgattctacctcatgaatcagcacgtgaagatacactaacgcagtcagatcttcttcacggataatccgttttcgcagatccgactgtgtggccttaaaaatagcaggcggcagagaagccttcatctccgcagccgtatctgcgggtaaccctttagctgcctgaaaaagctgcttgtagagcgtaagtgcgtcatattgtggccattttttagcatatgccttttcacgtgcccctgcctttttcttgcgttccttgagcgctgccgccgaaggcgactttttcagctccatttcaatccagcgatgcactcttgccagcacacgctccttccgcttcgcgagcggataaggcttatattcctcattgaaccaattcaaaatctcagctcgcggtagcaccgccccatcccatggtgaaaaatcatcctctggcacggaaatgggctccagtcgttcaacaaaagcttgaagcagctccataaaatgaaccgaacccttgaatcttcccggcgcctcatccatggattcctttctcagactgccactctcaaaccaataagataatgtttcggcaggatcagccaaaggtaaatccaaatccaacaaatccagcgcccagtctgcaaatgtactttgctgaatattcccgacccccagctctggaagtacatctgaaatatagtcaaggaacatatggtttggtgcgaaaattaccattttgtccgctgatacctgatccttgtattgatacagcaaaaatgcgagccgatgcagcgctacggtcgttttgccactacccgctaccccctgaataacgagggctgtatttttagccgcgcggatgatctgatcctgctccgcctgaatagtagatacgatatcccgtaaacggttatccttgttttctcccaaacgataaacgagaaactcatcggaaacggcaggctcgtcactttcacggttgtatgtatccgctacccgttccagaattcttttacggatgaccacgttgcgcttcagatacaccaagccctcaatcgttccctcaggggcttcatacgaagcggtttcttctccgccagtaaaggagtaaaacaagctggcaatcggtgcgcgccaatcaatcaccagcggatacgctgatgtttcttcacgctccactccaattttaccgatataaagtggcttccgctgccctctgccacgttcgtcaaaatccatacgaccaaaataaggctcctgcgagcttttggccaaagcctgacgtttttcctcccgtgccgactctagcacttgctccgtaaaatcatgcccggtgtacaccggcgtattgcgaagccgttccaatctccgatcaatttcctccatagcaagcgacagcctgtgctgttcttcttgataggcactttgaaactcattctccatttcagttacctcctaagaatatcaagtctcgatttctgcatcgcattcacttgctccgacacaaaaaaaggaaagtaagcgtaacacatttaaccataaaaatccaaccttatttcctaatacgcctattcccctactctttcacaaaagtatgaagctttgcggcaccagtggagcgggtgatttgaatccgaagaagcggagcgttcgcctttgcctctgaattcccccctgtcctcattacaatgagaggaattcagaggcaacagcgatcggaggatcaaatcacacgcgcagcggcctctaatgctccatactcctctcccccatctccacaaactgcttttgagccagctcacggtacacctgatgggactctaataactcagtatgagttcctgcaccggtcaccttccccttgtccaacacgataatctgatcggagtgaaccactgtagacaaacgatgagcaatgacaattgtcgtgcgtccttccatcaagttcgctagggccttctgtacctcatgctcagatgagctgtccaaactagatgtagcctcatccagcatgagaatgtcagggctacgaagaagcgcacgcgcaatagcgatccgttgacgctgccctccggacagcttcattccccgttctcccacctcagtattgtagccttgaggtagatccataataaatgtatccgcatacgccatcgtggctgctcgtctcacttcttccaagtcaacttcgcgccccaagccatatgtaatgttatctctgaccgttccggtcatcattgagctttcctgcgatacataaccaattttggagcgccaggaagaaagtgtatatgacgatatcggttcgtctccataacgaatttcacctgtatctggcacataaaagcgttccaacaatgaaaacaaggtggacttcccacttccgctcggccccacgaatgctgtcgtccggttagccggaatgaccaagttcgcattatgaaggacctcttcaccttcggtataagaaaaggcaacatcacgaagtataatatctctgctctcttttgcagcttcctgctttaactcgagcggttcctcttcatgatctaaaatcgtctgaatccgttcagtagccccaaccaccttttgcagacgtgaatacagggtcgtgaattgtgccatcggtgtgatcacctgaaacagcagcaaaataaaagccaccaaatccccagcggtcagcacacccgatgcgacacgaacaccaccaacacccaatataatgaccagcactgcagtcagcaagaaggtagaaatgggacctacaagggccaggatacgtgactcttgcaaaccgaagcggaacatccggtaaatacgatcctcaccggcctgagcctctctgctttcggttccgtaggccttcaccagtctgatttcgccgataacctgactcaacactgaggtcagatctgccatctcatcctgctgttttttggagatgcggtacatttttctgcctaccggaaataaaatcagggctgttagcggaacaatggccataataatgagcgtcatcacccaatctagataaaataacaatgcaataccaccaataattgcgatcacattagaaatcagattgactagatactccgtaattaagttcataatcaggcttgtgtcattggtgacgcgactcatcgtatctcctgaccgattccgatcaaagtaagggataggtagagataagattttatgccataagcgtttgcgcaaattagccacaatcttatgcccggcatagttcaacatatagatagaaaccgccgaagccaccgcttgaagtacaaaagcaccaagcagaccaacaatgaccatacggtttagtgaagaaaaggtcaagccatcaatcaaccctttggtcatcatgggtacgattaaaccagcaatggtctgaatcagcgtcagaatcagggcgatgatcagaattgccttgggcggatgcgcactcgcaatcaatttgataaaccgccccatgccagccttatccggtcttttacccggtttttccttcatctggtcctcctgctcatcttggtgtgtatgatgttctttttccatatgccatcaacctcgcttcctgtctgaccattcttgttcaaacaacaacacccgcgctctgcgcgggtatgaacagtacaatctatcttcgagtttactacaccagagaatgaagcacaaagttagccacaaacagtacagaaatgatatataatgcaacaggtacttccttgccccgtcctgctgccagcttggctacggggtatgcaataaatccaaatgccatcccgtctacaatactgtaagtaaagggcatcatcaccatgatcagaaatgcaggaaacgcttcagtaaaatcactgaaatccatctctcgcacatttagcaccattagacccccaatgatgatcaacacgggcgcaatggcactgtcaggaatataagccaacagaggaataaagaaaaacgtcgctccgaataaaatagcagttaccagcggtgtcattcccgagcgtccccccgctgcaatgccagccgtcgattccgcagcggctaccgccggactgctacccaaaataccggcaaagatattggttacagccaacacacgcaagctgtttttaaataaatccggtcttccaatcatgttggtttgagcagtaatcataccaatattctcgaatagcacgatgagtaggagcaaaaagacagcgatccagaaagctaccgagacaatgcctgaaaaggaaagctctccaaacaattgcccatactgtcgcaccgtttcagaggttcgtaccgtgcttgtaggctctacagctcccagtatatacgcaaggccagttcccgccaaaatgctaattagtaaacctccctgaacattacgcacaaacaatacaatagcgagcagcaacgttacacaagccgtaattaccttgggatcattaaaatggccaatagccacaaaagtcgtctgatgagcaatcacgataccgcttttttgcaatccgataaaggttaaaaacaacccaatgcccaccgtaattccgtgctgcaaattatggggaatcgcttggctaatcagcttgtacaatgatgtaaaagccacaatggcgaataaaatccctgtgacggcaaccaccatcagcgcttcctgccagctcagcttcatagaatgtacgagcgtataggtgaaaaaagcattaattcccatcccgggtacaacgaccattggagatttcccaccaaaagccataagcaggcagccgatcatcgatgtcagcagcgtcccgagcatcgctccttggaggggaatcccggcatctgccaaaatagttgcattaaccataacaatgtatacaacggaaaaataagaaatggccccagcggctaattcctttttccaatgatgctcgggcttgaaaccgagacttctggaccatagtccacccttcataccaaaaccctccagcaagttgttcaatctgtttgcagtaagctgcgctttttcaaaacaaaaaagagctgtagcaactgtgacacaaagaatgtgatgcacagaactacaggtcttaaagtgaatacatactgctgtaaatctaccaatgcactgccatgctatttttctgcaacttacacaccagcgtgttctaacaaatccttcacggctacactaaccatgatcagtcctgctaccggaggtacaaatgcattgcttgcaggtggctgcttcgccttccggatttcaggtgcgtttgcaggtacaattttttttgtaatttcttcacgtggcttcatcggttcctcatcggagaacacaactttgacgcctttggtaatgccttccttgcgcaacttggtgcggatgacacgggcaatcgggtccattctcgtctgggaaatatccgctacttgaaaacgactcggatccattttattcgcagcgcccatactggagatcatcggaatcccccgtttcaggcattccttaatcaaatgaattttgtatataatcgtatccgaagcatccagcacataatccaagtcgtacttgaacagctcttcatatgtttcttctgtataaaacatgttcagtgcaatcgcttcacattcaggattaatcagcttcacacgctctaccatcagatcagcctttttttgacctaccgtcgttgtcaacgcatgaatctggcgattaatattggtgatatctacaacatctttatcaatcaaaatgatgcgtccaacacccgtgcgcgccagtgcttccactgcaatcgaaccgacaccgccaatacccagcacggccaccgtgctatttttcataacctctagaccttcagttccaatggccagttccgttcgtgaaaattgatgcaacaatatggtatatcctccctcactgatttaaactctatgcctgaactccagcatacaaaccacgaacccattatccatatgagggtaacgggttcatggcattctataagctatctcatgccaatggatggcacttgctaagccaaatgttcgtcttaagctttaggcgcaacaggcttcggagcaagacgaatatgaagctgatccaattgagcttgatccacttcggctggtgcatccataagcaggtctgtcgcgctggctgttttcgggaatgcaatagtttcacgcagatttgtacgacctgcaagcagcatgacaagacggtcaaaaccgaaggcaataccaccatgtggaggcgtaccatattcaaatgcatccagcaggtaaccgaatttatccttcacttcttcaggcggcagattgagcgctttgaacattttttcctgaacttcacgtttgaaaatccgcatcgagccaccacccacttcgtagccgttcagcacaatgtcataggcttgagcacgaacttgacccggatcggtgtccaagaggccaaggtcttcgtccttcggacgggtgaacggatggtgctccgccacataacgtttttgttcttcgtcatagccgagaagcgggaagtctacaacccaggcaaatttgaatttgttatcgtcgatcagtcccaaatgacggccaattttcagacgaagtgcgcccaatacatcagcaactacctttttattatccgcagagaacagcaacagatcgccttcttcggctcccgtacgctctttcaaggcttcgatttcttccggtgtgaagaatttaacgataggccccttgaattcgccttctttcacttgaatccaagccaagccctttgctccataacgcgctgcaaaaggacccaggtcatcaatgtccttacggctccacgtgccacatcctttggcattaaggactttaacttcgccacccttttcaattacggaagcaaatactttcacaccactggttgccacgatatcattaacatttattagctcaagaccaaaacgcaggtcaggcttgtcagaaccatacttgtccattgcctctgcatgtgtaatccgttggaacggtgtttccagttctaccccaacggtttctttgaacaatttcaccataagacgctccatcataggcagcaagtcatcctgttgcataaaggaggtctcaatatcgacctgcgtaaattcaggctggcggtcagcacgcaagtcttcatcacggaaacaacgtgcaatttggtagtagcgctccaggccccccaccatcagcaattgcttgtacagttgtggcgattgcggcaaggcaaaaaattcgccttcatgcactcggctaggcaccagatagtcacgtgcgccctctggggagcttttcgtcaaaattggtgtttccacctcgacgaactcttctccgtccaggaagtcacggaatatttttgctgctttggagcgcagtttcaaggtctggtacatttccggacgacgcaggtccaaataacggtattttaaacgcagagactcgtccacttctacaccattttcaatgaagaacggaggtgttttagacgcattcaatacttcgatttcagtgacgcgtacctcaatttcacctgtaggcaggttcgggttaatcgtttctgcatcacgcttaacaatagtaccggtaacctcaagcacgtattcactacggacacgatccgcaatttgcagtgcgtcaccggaatatgccggattaaacacgatttgtacaattccgctacggtcacgaaggtctataaaaagtacgccccccaaatcacgacgagtttgtacccaaccgttcaatgtaactgtttctccgatatgcgcatgagtcaatgcgccgcattgatgactccttttcataatacacactcctgtttatgtttagtagttaatgctatatgacagccagagggaaacttcccctgactgatgttacattattttgtttatcctaattcttccaccagctgatccagcttaacggtacgttgctcgccggtttccatgttttttagtgcaatttcaccctgaaccagctcatcctcacccagaatcgcagtataccttgctttaaagcgatcggctgatttcatctgcgccttcattttccgccccagataatctcgttctgcggaaaatccggcttgacgcaacttgaatagttgtttggttacttccgtttctgctgcttctcccaacgctaccatatagatatctaacggcttggcttcgttcagtttgacaccttgatgctccaagatcagctgaattcgctccagtccaatgccaaaaccaatgcccggctgatccggtccgcccagatctccaaccaatccgttgtagcggccgcctccaccgatcgtgtctatggcaccaattccttcggctttgaattcgaacgctgtcaacgtataataatccagcccccgtaccaaacgcgggttaactgtatattccacgcccatggcatccaaattttgcttcactttctcaaaatgcgtgcgggattcctcatccaaactatccaaaatcgaaggtgctccgccaaatttgtcctggtcatctttgctatccagcactcgtagcggattacgctcaatgcgtgcttggctctccttggtcaacgtatccttaattggcatcaagaagtctaccagatgctgacgataagctgcccggctggctgcattaccgacggagttaatctccacctgtactcctttcaagcccagttcacggcagaattgatacccgaaagcaataacttctgcatccaacgccgggtcgaccgcaccaaatgcttcaattccaaattggtgaaactggcgctgacgcccagcctgtggacgctcataccggaacatcgggccgatataatacagcttagttacatccggctccccgtatagtttgttctccacataggagcggacaacccctgctgttccttctggacgcaaagtcatgctgcgcttccctttatcctcaaaagtatacatttctttttccaccacatccgtcgtttcacccacacctcgaacgaacaaattcgtttgttcgaacatgggcgtacgaatctctcggtaattaaagcggcggctaatctcacgggctttttcctcgacaacttgccatttttctacactgcccggcagcaaatcctgtgttcccgtcggtttttgaaaggccattaacgtatccccccatcgttgtatttcgtattgtgcacttttttattgctccactttcaaataaaacaaaaaatccctcgtcctgttaacattaacagggacgagggattgtcgtttacaaatcacccgtggtaccacccacattccggagtttacccagacaaccagcataagaatcactcattgcccgtcagcattaaactgactccgctcatacgtataacgcccgtaacgcgcagtacggctattatgcaggaccatccactgtcggcacagttgcaatgtactttcagtagggtttcctcaattgttcgccgcctgttctcggggaggtcattcatccgctcatcaagggaatttttacagcctggaaattcctctctgcgcttgtgggttcggagtacttggtcccgtcatcaaatcatttttcattattttatgattttaatgaaccgcttcgacaaagtcaagacattctccctataatcggacaaataaggcttataaaaagaaaaaacctgcggaaacggtccgcaggttcaaaaagatatatcaaaagggggtcatgctgttattataaacaacgaatattaaggaatgatgtttcgaatattacaattgtattacagtcactcttttgtagctgaatttctcaagtatcgacaatctcttgtgttgcgctctttagctttaatccaactgcgatacatatccccgattggaacgtagcttataaatgacctcatcataatcgtcatcattcacctttgctgataatacataccgtaattcatcttgattaccgttaatatacacatctgtcgcacggagcaatcctccgtcatgattcgttgttccaccccgatcttcattcagatccctttgggctgagccagagttaatctggtcatccttcgcatctggtagaatattctcgccataagcacccgccgcagggattgccgcacctgcagagcctcctgtactcacagaacctgtattgttataggggaccagcggaattaaaactctcgtctcccgaccgagcgcatcatccaaggcacctacttccaaatgttcagttctataagcttgaagcgaggctctggcaccctcagcttcatcttctgtgcgaaaataagcctgaatctgttttgccatatcaaatcctcctcgtttgggaattgtactggcattgatctaaggaaatattcacgttcaaattacaacgcttttaataactcacgcacaaaggcaggctcatccttaggggtccgagacgtaataaagttaccgtccacaaccgcctctcgatcctcaaaatgagcacccgcattaattaagtcatctttcaacggaggataagcagtaatcgtccggccttgtaacaaattggcactcgccaaaatttgtggcccatgacagatagcgccaatcgtttttttggcctcgttaatttcagtcacaaatttcagaacatgtgcatccaatcgcagattttccggggaggatccgccaggaataacaactgcatcatagtcacttgatttcacatctgcaatggctttttcaatagtgtagcttgcttcaccttgcttgccgctcactttctcaccttgcttcagcccaacaatatctgcctcatgtccagcctttttcaattcatcataaggtaccttcatttcagaatcttcaaattggtcagctaataaaaatgcaattttactcattaatgttcagatctcctttccggttatcctcgaaacaagttaaaattaagtttgtttgtctaccacgatttgttattacccgcttgatctgtttttataacaatcgcagcagcggaaaagaaaaaggagcctttcggctcctcagattgtcgagaaaccc

SEQ ID NO: 2612 - DNA, 317649 bp, Unknown
  Kingdom: Bacteria, Phylum: Firmicutes, Class: Bacilli, Order: Bacillales, Family: Paenibacillaceae, Genus: Paenibacillus
actccatccgcggctcctgtcgtcacattgctgatcgacgtttccaccgtcgccgcatggttcacggcttccgggatcaccggcgtaaccgttacgttgaactggctgtttatggtcccgcctttgccgtcgttcgccgtaaccgtgatcgtggctgttccggcattcagcggcgtgagagtcagctgacttccattcaccgatactgtcgctacgttcgttgctgaagattttgctgtgtaggtcagtgtgtctccatcagcatcggtaaaactatttgccagattaatctttttaggctcatctgctgtacttaacgtaatatcagtaaacctggtagtaacgcctggcgcatggttagtcactgattttgttgaagttccacctccggaggaaaatgtcacgctactggacgtaattgtagtcgtttcttgaaccgttccgtcagccgactgaatttgtccaatctgcttttgtacttcgttgtaattttggataacttgtgaaacggatgcatctttaggcagctgaatcttttcaactttaaaattcgggttcaatgtcactttagcgtttgcgttggctacttgaagctccccgattgttccggttcctttaatagaaataccattgccggaattcacattaagatggtttacgtttccattcagctggatattagaaacaccgtcattaagctcgattactcctttgatatcccctttaatctgaacaccatcacctaaaattcgaagcaggctgctttccggtagaccattggtgtttaacacaacatctttttgcacgatttctaattgttgcagcccgtccacattacgattgcgcgaattaaactttaatttagctccttttagcgcatctttattggagtttccgattaactctttcaaattcccctctattaaataaggaacattatcgattgttacaatgtccccatcaatgctattgatcgcagctgtttgctcttgagatttgaaaatatccagcaggaaaggagcaatatcctccctttttacttcaccggtgggattgagcttgctgtcatgaatgtcaattaaacccaggcgaagtgctgtatcgaccgatccagccgcccattggcttaccaaggactgatctttgggtaaaatgcttgatccgccctctgcattaacccctccgactgcacgaacaaacacagctgccagctcttcacgggtaacaggatcgttcggacgaaagtttcctaatccatccccggatagaaacccggctttttgtgcggcttctatatatggggcagcaaattgtttactttgcacatctttaaaagtagaagaactcgaaatagggtccaattttaaggctctgaccaataatactgcgagttcctgacgagttaatgttgctgaagggcgaaaagttccatgaggatctcccgataaaagcccttggcgtacagcttcttggatggccaccattttatcactcgtcacataggatgtatctgaaaacaaattattggtaggcgttgcagcgtaagcagaagtaccaaacgccgcctgaagagcaacaagagcggctgcccacttaagtgaataaactttcaatggttctacctcctaatttacttttgagtcaaacgaccctattcgatcttcgaaatgtttctacataattcaaagataataaagcttattcactgtatttaccgataaaaatgtgtttatattaatcttttattcatatatttgtcgaaaataagtgatttatgtcgttttcaattaatatacatgaaaccactgaaccaattctgaacaaaagcttatctataatgatgcctagttgtatcaagtctctaactatatccttcaaataacttatttccgcaagtgatttatcggaaccctcccttaatcgcgactcttgtgctaaaaaaaataatcgcaggctagatacctgcgattatttttaaattaagacagcctatacgaagtatagaattacgttttaaaatgattagttgccaagattagcaatgccgctgctgaatatcttaaaacgttatattcgtatcttttttcatcatagccctcgtcgactattgttcagcttcatttagcattaaaaagcagcagcttcacggactgttccataagaatgttaaattcgagacttgaaaatacatttgttattcgcgttgtttcggatgtaactatccgtaaaaaataaaaaagctaggtttacgaattattggcataatccgtaaacctagctctcgacgagtcttacttaaggttatattttttgttaaagcgatccacacggccaccgatatccacgtttctttgtttaccagtgaagaacgggtgggaagcggagctagtatctacacggataactgggtatgtgttgccatcttcccattccatcgtttcttgcgaatatttagtggaagcactcaggaaagtaaatccacagctagggtccaaaaagataactttgttcaatgttggatgaatatcttttttcattagtttcacctaatctttcatgtagttttagtttcaaacttaaacgtactggcgcaatactccatcagttggcaaaaggaacggttatgtcccagaaaaaaagacgacagatcataacagttgcgctcaagctcgtaaacgacaagcaaacgatgccgcatatacgcatcgcccattgcacgaacgctccggatctttcgtcagccttcatcgttatataagcatatagtgaatggtcctccggctcgtcccaaatgctgacaccagcacaggagaactcggtagccacgtgctttcgattcaaaaggcaaagcgtaccatgtagctcggcatctatcatacagccttgaaaaaaagccgttttcttaggtgcaagctttaactttggacgctctgtccactggactaattcaagttttcgccggttccataacgcaggcttttgcaaacttaacaggcttcgctcaggaagcagaatcattcaggttgctatgcagcaaacctcaaattatctagtttcacgatggatcgtgtactttttcagacgcggagagtattttttcatttcaagacgctccggatgatttcttttgttcttggttgttgtatagttgcgatcaccggattcggtgcatgccaaggtaacaattacgcgcatttctcttcctccttaattggaatacatggtatacaattacaatagtaatttttacgattagttctattctataattcatgctccgctttgtcaaccttagagtcacggtttgtcgcttcttcgaccgtgttccagcgattacggtactgtgcaagcttaggatgaagttcctggggtgcgctcgaaagcaccaatctgacatttctaatccattctccaaacgatgcataggaagcgcacaaatttgcagtttcaggactcatgtacaaaaaaagtggggtcgtatacttttccgccaaaaaacggatggctgcttcaatcggcgtatactttttacgcttaccttcccagttctcaatcacaacagcactcaaagcttgctcccgttgccactctcccagctcgtccacccgcttgtaatacgaacgtaccggctgcttccacattcttctgacggtttcttcatgtagcggatacaacaccagctttgtaaaagataatgcagcccccgtttcggcaaaaagctccagctctctggctgtaatctgctcgaacgtatcatagtagaccatggtccctttatgcgtctcgatcggaagctcataaccatagggtacatattgaaggtttcttgtcatgccggacactccgtccttccatagatgaacttttccttctatattatacccttgttttggcatgagtttacatcaaatgtttatccttgctcaacagcaggcgtattacggcgtgaaccccttcggaattgcaacgcataaaggcccatcgtcacaagcgcaatcagtgcaagcaccgtaaaaatattgctaaaattgaatacctgcacattagatacgacaggattcaaatgaaaggacgacgcactatccagcgttttgcccaaaatacttgtcgtgatcgccccggcaatgaaattcagcagagatagcagccccattccaacaccaatctggtctttcgacaaggtacgagaaatcgtgttggacatggcaatttgcatgaaggtctgacctacgtttccgaaaataagcaaaaataaaatcagatacggagaggcacccacaaatgtagacaagctgataaaacagataaacaaaagcgatacagctgtatagacgagaaacgaatttcctttgctatccgccaaacgccctcctcttttacccaatagagccgaagcaatagcagccggaaacataaccagtccaattattgccggcgtgagctgattgagactgttcagaaactgcggtgccaagtacggcaatccaaagctaatccccgtccctaaaaaagcgataaggagcccgtatgaatattgcttgttacggaacagcttcggctggatgaatggatcatgcgcagtgttaatgcgccatataaacagtgcgaataacaccacacctaccagaaaaaacatcatattagtttgcgaaatcgaaagtaataagaaggctactgttccacccagtaataatccacccagaaaatcgaacttctgatcctctccacgctgatcgtccaaatatttgcggaagaacggcaatgcgatcagtggcagcatggaaatgacgaacaaaaaacgccagcttgcaaagcctgtgatcaaaccggaaataatcggagccagtgcagtacctaacgccaagccgattgctgtgacgcccaaagcacgtccccttttttcagccgagaaataacggactgggacgatcatagcagttgccggaataacagcagcccctgcagcctgaagcaaacgagctacaatgagcatccaaaattgattggccaacagtccaataagcgaacccagtgcaaaaaagataatcccaaacgtcagcaaatccttaagacgatatttatctgccaatttgccgtaggtcaccgaaccaactgcatacacgatcatatagccagtcagcaaccaacttacatcggaagcactaatatgaaactcctctcgaatcacaggcataacgacattaaacataaaagcgttcatcactgaaaaaacaagtgtgaaagctagcactcgcataagcttatccgcattgggataagtttgttcatttatcatttggttgtctccctctcctgtaaacctcttatctaagatcatattgcactgtttttgatacccctatccgggcaaattctctatatattcgctcaaacgcgggtgtccgcagggtggtagtcgcggagaatttttttaagcagaccgcgtagcgtctccgattctcctacagataatgtttcacctaccgagcttttaattgcctcaatagtacgttcagcttctttgtgaatctctaagccttcctcagtcaaatagatttgcttcattcgtgcatcttccgggtgacttttgcgtattgcccagtttttcttaacgatcccgttaaccaggctggtaacgcttgatttatcaataagcaatagcctttccaaatccgtattggtgactccaggcgacaccgccagtatatagagcgtctgcgattgtggggaggtgagtcccaaaggacgcagtgccgattcaatttcgcgccggacagtagtgaaaatccatttaattaaatacatcgtgctctcttcctcacaaggaagacaaacgggatacacctcacttcccatctcactacgaacctccatatccatctaaatttaatagtttgaattccaactaattttaatcagctgcctacttggtgtcaatactttcgtaaaataatgctttactagataagatgaatttcaaattacgaattcattctttatggaaacttatgtatagcaaaagacgagcccttgaaggaagcccgtcttttactttatttctgttatatagttgcttagtctgcactcttcacttgaaccagcgggtattcttctccatcaacggtaaccgtgctagcatcgttcagctccagcctttgccaaatggtcaacagcgtacgataaggatacttcttcagatcgtactcctttgtctctgtaccatcaccggacgtgctgcctatggttttatcggctgctataccactaccctcagtagaaatctccgaagtcgagcctccgtccgtgttgcctgtcactgctccatactgatcgccgcttgttccactggatgtactaccacgagctgtggaaccactgtccgtggattgtccatctgctgtcgtactttttgtagtggcgctcccagtgtttacgtcaccggatggatcattgttggcattactggctgcttccttgtcgttctgttcagcaagcgtaaaattttcgtataagtgctcctgttggttcgccccgacaatgacgagcttcttcggcttaaattctgcctgctctgtcgatgtctgaaacgcaaacaacagcttgaccattttcgttgtggacttggtattaggcacatgtgtcactatcgccgtaggctcctcttttacgggcacagtaggctctacaggctgttgtacaggcttcggagcagcaacaggcgcaggtgtgtcaccagatccgatcaccccggttgctttcaggccgccgagcgtacctacaatgacaatcagcacgatcccggaaatcaccccacctttacgaaaacgacgaagtgttttgatcaacggcgtgtccgtctcccgctttgctgccaaatagaaatttttaaaagcaggctttgcaggttcgaaatattgacgccacagcgtttttttatgcagtccctctcgtccttccttttggaagaatagaagtagcgcacgtcgatacgacggttcgaaaccgccacgtggcgtagcaaactcggggtgttcttccgaccatcggataaagcggtacatcgtatcgttatccttcgcccatttgcggatcgaactgaccagacgagcgaagtccaatattccttctcccggcccatcagaacgatagaatgcaggcaacagacgggcaaaatggccttccgcaagctgctggggcagccagccataagcccaatcctgtaccttttctacttcgccaggctccaggccgtccagcaccgacggttccggttcctccgtattaaaccaatcgtaagccgcaatcaatcgcactgcttgtcccttgaggggagcaggcagctttccaacccactgcaccaaatcgggccgtgtaaaaaatggaatctgtacgacctgatcaggtgatatttcttttagctctacttcggtaagtaaataccgatccgacgcttcctgcaggcgctctgtcaatccagattgctccagcggggacagtttgcctacagcagagctgctgtcccattgacgcaagcgttggtgaatggcagccacagcctctactggttttctttcggcacgcagtctgcccatcaatgcagattctgccaaaagctgaaaatcggcattcgccgacacttcgatataccgactgccccattcgtgcacaacggccagcagccccttggcatccggtgttcttttcatctgactgtccatgtagggaatgaacagcatttttgtaagcgccggattacccagcactttcgtaaaatatgccttgcctaatgacggattctcctcaatcgtatggtaaatatacgtgactgcttccgtatttctggcagtataagcattgtttagcgaacggattaaatattccaccaaccgattttcgctgctgcgtgcatgaactttataatagtccttgaaactatcgactagacctacatctggaatatatccatccttcacccgatcaaattcatgatcaaaaaacgatagaaacagatcattcagcctcattttacgtggcagcgaatcgggtggcgataaataatcagtcaagcttcgtaatacagcgattcgttgttcgttgtataatgcccgctctccctgctcaattctgtacaacgtaatgagctcatgatagctggatggcgtcaaatcacgccctgcctccatacctgtcagcatttgctcggcaaatttgaagaaatcatccggcgtctcaccattcagcaacgtgcggacaatccagtcaaaatacggctgtctcacctgctctgcatccacattaagtattcgactatggttagacaggtcaaatacaaagtccttttccacattccgatcaccgggacgcaaactaaaaggctcaacgaacatcaagtgaatgccttttctgctgttcggttcctgtgcatatgtaagaaatccgagtctgttccgaaatgcataaggcagtgccgcatacagcacacccagcagctgcttggctgaagatccgaccgcttctacaggaacattcagcgctacatatacctttttgcgacccgctgcggacatcatgactgcgtataaaagctgtttgaacacttcttcgctcagctgcaattgagccagcactgtagacgggtcaacagccggaaatacacttccacccggtagacgctccaattccggtaaatccgttccctgctcaatatcataggtatcaacaaatgatgtgttcagccactgcttatagtcagacggagattcaccatgtccggctggaatcacatagttgtgcgtgaaaaaggcgctccgcagcccagtaaaatccgcagccttataaatactgcggccaagcactacatccccggactccgtccgtaccagatgcatggcttctggatagacgctttcctgcttttcgccacgcgccgtcaaggcagcaggcgcatcatatacacataagggatggagcacctttttaataaaagaagcatccaatcctttggaattagccactgtatcgaagccttccgtagaacggaaaattccacgccgttcccgtgtgtacatctgctgttgtatcaaatgagaggtagaataactcactgtgtttctctcccctcaatgtacttcaacttgtaaagtagccaaatgaatggctcatccacacggatcggactaaccaatccttgcagcttttgctccactggattgctacccagcgcggaaaccgcgaaataggccgtatccgtaaaatatacatccatcgtgcccttgaacggcttatccaccttttcgatgaagcgtcgaacttcgccatcaatgttagcgaactcatccaaatccatatatttgcgatgctccatcggattaaaaatattgctattcgtcttgatgtatgtgccttcttcatctgccaatgcagtaagcatatcacttttggtcaggacgacagcagtcggaatgtccgttttccctttttcctgataagcaataaaatcaccgaacatcgtaagtacgacatcacgcggttcatcatattgtgagacccattcacccggcttatcgccaaggttaatcttaatgcgctcccgaatagagcggatttgcagtggatcgaccataaagagaatacctgctgaattcttaatatgctgtccatgcagtcccagatagtcctgatctaccattccctccccggcgacatcaaaaaataccagcgtcagtggcggcttttcctcatccttaaatacaaactggaagataaaaggctcctgcatcttttctttttgtgtcgatgtaagcagatcgcctcgttcaaataggggttcctcatacatagtgcggaactttcggctgatctctgcattgagcggcatgcaagccgcgtcaaaatgatcggctgtaacatgctgcaacgtgtgaatcagggaggtcatatagacagatttccccgcctgcgaagctccaataatcgaaatgatattgctaggcaccttacccgcggtcacgggcagctcgttatgacagtgtgggcacagtcgatgacgcgtcagctcgccataacggtctgtcagtcctgttagtacatgatcagaatacaatcgatgttcctcaggaacatcatggggatgcaaaatcgcctccatatcatgcacactgtccaagccaaaacgctcccgatatttgttcaacagctcatcttcacctaaagcgtagtcctcgtcatcttcacggtgatgagaagcacggaataccacgtcctccggggaaaatttactaaagcaataagggcacacaatatcataaaataacggccttggcgctgcctgtggctttcttctgaataaattactaagaaaactcatcggttgcggcctcctttcattcaggaactaattcatataccgtgccatatttctggccgtctgtaaaaaacagccgcacatattcatctccccccacttcaacagcgggtaaaacattccgtcccgcggcaaagggtgccgtgaatggatacaaggttccatcgtcccggtctgcgggataacccccgcgcttcttcacgtagcaaagcgcctcctgcgggactggaacttcggctgtcacctgaatctggacggttttgcggctgcgaaaccagctttttttatggtgaaccgcatatctgattttagccctccccgtgctcaactccagttggttggctccatcttgctgacggatcacgtaagtatctccatcctcccgaacagccggatacacggtataccgtacgcgtccaatgccttcaattcggtcacgatagctgccagcagccttatactcctcgcgtgtaaacagttttaggcttgaaaaaggcggtaaaacttcaccctcattttgcccattcacacctgcctcggctgattgtttcgcaatatataccacggctgcgccctcaggccactgccagcgtaacacaacccggttatcgtcaattttgtggctcagctccgaaataacaggatcaccgggctgtgcttccctatactgcataagttccagcctcccgttctaaaatccactgctgcgtcgattgcgcgtcggggcttccggtgcccctctccggcgtcctgacggcgcaccctgacttcccccaccggaagatcggcgagtattttccgcaattggcagaacaagcgaaaaaacagcaataagggccgccagtacgagcgctgccaccaaacgaatcatcaagtcgcctataggcgagctagataatcccttttccaaaataaagccagcgagcaagcctgccgggactcctccaatcgcaaaattccgcgcgagaaaacggttatcaaacatcagcccaagagctaatcctaatagaacgccgataatgaccagagccgttacgcgataaatggcaaaatacagactgtcggcatactcacctgtccgctccgttaccagtgtgcgatcaccgattttgttatatattttaccgaacgcctgagtaagtccttgggcattcgctacattagaataagttccgcctgtcaggtcagcaatattttgcaataaggctataccatccgactctgccagcttcagcccgatcgtattgatcggaatctggcgggcgatataaggagccaatgccgtctgggtatccagctcgctaaagccgtcagagagcataatgacgagagaacctttttctccattgccttgggtttcaatctccttgatcgtctcgtccaaagcaagcccgatctctgtaccgcctgacattatagtctgcatgctatcgattttggaataaaccgcttgcttctctgcatctgtgcgaatgggagtaaacggctgaaccaactgggcagtagaatcaaatgaaataatggctaccctcttgtctccatccatttggccaattagactcttggcagccgttaggcgttcattatcaggatctgtttgctgcatactcccggaattatcaatcacaagcacgaggtcctgtacgctcttgcgcccttcaggattaacctgatagcccaactccaatagcagacctgccacgaacaacatcaccagcgtagcaggcaccagtaacttccaggataacccggagtaacgctgccgccatgagtgtccatttaattgtggcgaaattagttcgccgatcagacaacctaggccaatgcacagtgccatgatgccaaaatacagcccgatcacgacgatatgcggccagtgccctatcaatttgtgaagaataagctctcccaagatgaagcctactacagcgcccagcaagccgaacagcaataggagaacgttaaatttacgctgcttcataagaatcgttgcttccttccatcattaaagtaggatgaatatgtggttaccgcaattccggcaaccggtccacgtcgattccgtgaaacacgaaaccattcgcagtatatgtctcataatacgttttgccgttgcggtaaaccatcaggtcctccagatggaagccgcccatcaaatgcagcttttccaccccgctgctgcgacgctcatgtacaaaacccagcttgtaaatacgcgaagtaatgtccacatccatcgcataagggagaaattcgccttcgtagtcaccaaagaagtacttttcttcataccgatgctcatgggtatagtcgagcaaacgtacgttaattccgccatgttcctctaacgtttgatacagttttttaaacagctcatccttcggaacgaccaaccgattttcatatgcagcagccacattggcacgccgcaataattcttcttcgaaggtctgattaaacggctgtgaactgagaatcaaggtgcgacaggtctgcgtgagtcgatccaccaatgaggacagacccccgtccagcaatccggatacaggccccatatgccgggtatcaaaaaatatagatttcccccgcttgctttctagctcacgcatgacatcctccgtcacacgctcgtaatattcgaacaggttttgacctgtgtaactgtcggcctgccgaatactatccgttgcagcttgatgcagttcacgctccaggctagaaagctgtactgtaatatgctgcgcctgcgcatgccatttttctagtgccagttcatagcggcggagcagctccaaatcggcttgaattcgcagcatgtgcagtttgtgcccgtaaaccgtctcggtcaggtaacgaatcaagcttcgaacattatgcttatccatgagtggcaatcgttgaaaaggttggtcctccactcgcccgctatacagggtgtccagttcagcggcactaatctgcaagtcattggacgtatcccgaatcagtccacgaatggctgtaagcacattccctgttttattttcatccgtccagtctgtcaactcgaataagccgatttcaggatattccttggcagctgcattcacagccgactgtagacctgattccgcctgaaaatctcctaaccgtttgtgcacaatccgttcacagttatcgcggaaaaaggcttcgcagccctgaccaaacaaggcttcctccgcctcacgtaatgtcattcgcttcaacgagccgtagctggatccgctggtcatcagtgcgctcatatccgtgatcgcttcattaccaggaacgagatcatttcgcgtgcgaccgcgctcagcagcatctaacccaaaataattcagcttatcgcgtatgtcccactcttgctctgttctcatacgttctaacagcttcacataaaagtgatacagcacagtcagtgcgattgactggttagggcggttgactcgggaaaatccagccgacacataaccctgccgcccggattccgtcatgatgttgtttttaaacgatgtattgttgtatcccccatcctgtgaccgataggaatctcctgcctgatagcgatttttaagaagctgaatatggcaaatgatgtcacagctttctcgcaggctattcggcaccgttacgccgcgttcgttcttgtcggacagcacatagacgaggtcgaacaacggtgatggagcatgggttactggaatggtcaatttgtcctcggtcatatgaagcggtgccgtaaacgtatactctggactctggatatagtccagctcccgcatgaaagcaacggacgttgcactactgtagccgaattggacagcctgatcgctttcattcactaacacatacagatccatttgtaccgatttaaaagactgtgcaaaaatatactccgccaacagcgtaatttcagggattaatacgttcatggggtcatccgctgtcgtcaaaatcgacaaatggacacgctcgaacgaagaatacaaccgaccgtaatctgccagatgtccactagcccggcgcaacgcggtgttaagctcaattagctgcgattcatgtgtataaaaagcctggtgcaagtcacggcgtatcgtttggtggccactttcctccggtaccgctatggtatgaacaatagcatccaccgaacgatctacagccgcatgatcttcctgcgagcggatctgaatatacgttactcccgtgctgttatcccacttggtccggttgatatctgcaatggtgttcatcaccgggttcatgcgatcaccgataaaaagaaacacggacgggaaatggatgctactgcgtccatctccgcttccgattaattggtcctctgcggctgcatagtcagccgcataacgtaacagctgctctctcatactttatttcaactttctgcggatgtcgtttaattttccagccatttgagcataaaatgcatatagttccgctccgttagccagctccaccttttcatattccaattgattgcgggcctctgtgtaagttgcagccagttcatccagcttcgacagcagtggtgtaatatcctccgacgaagtcaatacagcatcacggcgatccgccttgcgcattagaactgcgaatttcttttcatccaaaccacggaagtttgtaaacacttcaaactccacataattacggctcttcatgacattggcaaacggctcccaagcctcttcctcttcgtcacgatcatagacgtacaaagcgccttttttcgtaatcgtgtctgtatagagagcctgaatgaactgatccagccatttttcttcatcctgatatttgcccagcaaagcttccagttcagctgctttcgcttcaatttgtgtatatttcgctagttcttcacgaaccacctgtgttaactctggtgaacggatcaggttttccttcgccatctcttcattgatgctgccaaagatgtccttgcttccggcctgctccagcccttcagccagcagacgtttcaactcagaccatgctcttttcacctcacccaaattcggcttggattcctgcaagcgcatatcgtagcctgccagcatcgcattcagatctagcgcatgtgaacggattacagtgaagcggctgctcgtattctgatcgacatccttttcccgaatcacgccaagtgacttggcacggtcaaaatcattacgaatgcgggcattgtaagcttgcacacgcgaattaacgtaagtttcgccccatgacttttcaggaatcggcgacggaagattagtccagttgttctgacctgtttgtaccagatggcggccaataccttcgcggtcaagaatcgttttttcatagctttcttcatacactttgagcggcgtatatacaaacagaggaacaccattacgcgtattgagccagaaaatccggttacgaacttcactctctttaatagtaaagtgtgatttgccaattgcattattttgataattgcgaacgcctttcaggatattaggtgactgtacaggtactgaaacgaatccccatgacgggaagtacaagttgccagagctattactcagatgaaacacaggtacagcttcctcatccagtttgctcgcaatgtagcgctccacaaatttttcaatggcttcatcttgcccgtatttcatgacgaggaaatcttccatggaacgggtaatgagatcaccgaacttatcagtcaagaaattggagattgagctgatgatgtccatatcctgatccttcacccattgatctgaattttccagcaattcttgggcaaaatcacgaatcaaatcatcaccgttgcggttatccagcagcttggtcacaacttcagaaatatccggtacacttaccagattccaatagtacgttttgttacctttgtgatcggactgttcctcgccgttaatcagcagatcgccattcttctcgaaaattgcgctcagcgcgttcaaaatttcagtaaatacattataaatgcggctattttccttgttcaacaggtcatacaggtcttcataaaactcaatgagctgctctgtacgttccacatcagcccgcaaccaatattcattaatcttcgcttcaatgtacgcatttttctttttatccttagacacaaacgcgctcttggcatcgcccagcttttcgttcgcctgctcacgcgcccattcaatgtccgttggaatacggtgcaatgattcacgcaacgtctcaacatatgaaagcagcattttcagcaagctaaatcctttttcagtataaatcatgcgggatacataaaacggcccttgctcaggatggagaaacatccggcgaatttgatccgtaaactgtcctgtaatttccccaggaagctgcttcttcgccttgatatactcttcacgagcacgcgtcaggaacgtttgctccagctcggtgtccatattgaccacttgcattttaacgacattgctataacttaaccgttcactgttttcaaagcccggaagtggctcaggtacacgggattcaaagtttttgatcatgctatccagatccacgcccagcttgcgggcaaacttctctacatcctcttgatttggcgattgctcgaacattttggacattttgccaaacattcgataggccagatatgtcgtcatttcctccattggcagtaccgccgaggaagccccgataatattgtaatcgtagtttgccggatacgccttattcatttgtgcgatgttggtacggatattgctgatatagtcatgaatggcaaactcttcgcccgactgtttttcctcactcgccataaagttagtgatgttctcagcggtgacattcatgcagtaatcataagcattttccaacagcttgccttccgtattcgtggccgaaatgaggtggcacagattaaacggtggaagcggcgagttcacggtcaaaatgttgccgtactgctgcttaaaacgttcaccacggctatctacattcatccaatagtccagttctttcagtgcagcatagccgttctttttaatatattcacgggtatgctcgctcaggcttttgttcgccaaattaatatccggtgtaaacagataacctaatgtatttacacggtctacgcctgcagagccatagtcgcgctcaataattcctcggacgatatatgaaatatctaggaaagtaccgcttcctgtaccaccggacaaaccggacagcaggaacaccataagcttcttgttggtgccttcagacagggttttgatttttttgtcaatgctttgtacgacctgattgattttggtgaacagcagcaatcgtcctgcctgccgcacccctgccgcaccattcataccatcggtaatgcttagttcgggagacagccaatcggtaatgtacggctctagaatgctgcggttttgcagcaatccgccgatttccgcattggacagcaatacaaactcattgatggggtccaaaccaatccccttgtattttttgttgcggtcttgttcattcgtttcaaaagcgagaaattccacattgtccggtttatcgctctttttcttggaaatcggatctgctggaagcttgaatctacggttaatttgatatttcaagcggagaagggcatcaatccccgtacctccgagtccgataattaaaataggattatcaattgtatcaactctgatcttatcgcttacgatccctccgccgagtgatacgtctaattgttggatatgctctctaactactggtttcatagatatgacctcctaagggttcgtttagctgtttactgaaataaactccagtaaaatggttttgtccacactggctaacggaatcgtcagacgatcaccgtttttgagttcaagaccgttgcctgtgtcaacagcccgtccggatttttcaatcgtaatctcgggggtactgcgcacaatgatacgatcctgattggctggtgtgaacacgaccttgtcggttccagcaaattccggtgccagttgcagcaactggtgcagattaaatttgccccggaaggtgttcagcttcttgtattgcggatatgttttttcgccggtgttctcatcccggatttccagtacgatttgaccgacaaagccacggttggcctttttgacagccttccagatgaaatacgcggcaaccagcagaacgagcagtcccagccctaaaagaatgagtggcattagcttggacttttcagcaggtgttgttggctgcgtcgtgcccgtattcgtaccgctcgtcgcccctgctttagcactgatggttacaggctgtgtttcacggtaaaagctcttctcctctgctctaacggttagttcgtagtcatgctcatctggaatcgtataggaaccggtaaaagaatcccctgcattggttaacggcacctcattcgttgtaccggaatccagatccttgaccttcagaacagcattcatattcgcatacaattcctgatcctggagctgctggctattgctcgtcaggtaggaacgaatttgaactgcatcgccttttttgtatgatttggctgacggtgcgtccattttcagctccagatcatagttaaacaccagattaatatcaatctgatcctgctggactcccttgacttggagcttccagtcaccagccacaggcttaagcagtttaatcagcgagtagcttttggacttggacagcagcacatcgctcgaaggaattggcttggtgttgcccgacgggtctatcagtctcgcatccaccggttttgaggacatgatcgaaatgttagcctccagcacactatcgttcggtacggttaccgttacatcctgatagtcgccgtttgccgtaatggactgcaaaggcaccactttcaacttcaaattgctggcgaaaatttcactcaaaatgttcggtaggtcatccgctgagcttgtaataaaagatttgccgcccgtttgctgcgctatgtcggcgagcttgtttttattcagctttccatctgcattcaaaccgatggtgtagattggaacgccgttatttttagcctcggctacagcctgtgccatatcctgatcggattggctttcggttctgcctgtcgtcttattaaaatcgttgttaccgtcggcaagcatgacgatcataggcgcatgtccagctgttttaccatcttgcaaaatgcggatcgcttccttgacacccacggaggtgtcagtatacgccccccggttcagtccgtcaataaacgtcttcagttcctgcttatccgcttcggatgtaatattaagcaaggctttctcgcgctgtacgacatccgtatacgctacaatcccgactttgtcattttgcgtcgacagcatatcaatgaacattttcatggcttcattgccaattttcccaggatcactagtgttcatcgaattacttacatcgacgaccagcaccgcatccaccttagaagcagagggtgaagcggcgttcgccatctgtggctgccatgccaaaatcgaggtcatgatcattgtacatatgattccgatgaccaaaaaccattttctgtctctactaaacatcgcttgtacccctttgccggttaattctcattctaaattacagttgtactcccctactattaaattataatgagttttacatgagcgccagctgaaaatactgcccgaatggtctgaatccaaccaaaaagcctgttataccgcgtcattttaccaatatcctgcagtaatgatataattataccccaacaagggcaatcgggcaccagccttctcctttatacgacaaaaatgacagtagcgaaacccgcccatgtaaaatattgaagtaaaaatccaagtagaaagaggaagtacactatgatctcatacggatgtctggcgattatgtttctttttgtcgccatcaaatcactaatttactatatacataaaaaacgggccctgtcgattacacaaatcgacaccgagcttctagcactgctgaaccggagaagtgagcgcaatgaatagttccaaacaagctgtacaatttcgcccatttacccgcacagagcacgccttccaaaagctaagagtctgcaagcgttgtgggcaatttaccgccctttgggaagaaaagtgcacatcatgtggtcgggatacactagttcctgtagagcaatatgccagactcagagccaaacgttattttcgtaaagaccttgctgtcagtgtcatattgctggccgctactgtctttttcggccactcaccgcaacaaatgcttttgtgcggtatcgtcggtgcgcttcttctgctgcccttagtgcttctacagcagggtatttatccttatgaacagcgtaggcagcttatacgtctgttcagaggtcgtatagggcagatccaggaaggactaaacgttaatcataaaaacgcggttgccctgcggcaactcagtgagcgtgtctcctatgaaatgctgcgtgagatggctgtactcattcacaatgatcggataaggctccagcaggtcgccctgctgcaatctttcgttctccgcaaagacatggaattaacgctcgatcccctcctgatcaagagcttcgagccgcttatggtcagatatatcggagagattgccagactcaatcgtgagctgatcaaggaccggacattccgatacgtagtcttttatgagcgccgaattctggaattggcagggggcgaagatattctcgtccgcgtagccagtgcagctgtccgtaaaaagcgctacgtagtcacccatgccgctttcatttccagatatgtacgcaaactgccaaaggaacgagtccagcgtttatatcatatcattcaagagaatccgttagaaccctttggagatttggccgatgaagtaaagatcatatacctgatggagcaatataaaagctaagctgccacaatacccttctttatatgacgtcatctcgatcacaaatcactgcaatgaaccagcaaaaaaccgtcaggatcgccaacgtgcctccagacggtttttttaattatggattattataacattgttatcttctttattggccttgcagtttctgctgcgcatgtcgaatggaagtaaagttaaaagcacgcactcccttgctatcatacacaatgatctctttattcaaatacgggtgtagaccattaaagtatccaggcataatgagtctgcgcataaataggtttttacccagcatccggggtgaattggtcgctacgacaagcatttgctggtacgcagaccatgggctaggttgaatatatgacagacaatactcgcctgccgtaaaatcgtcgcccaatgtatacccttcctccgtacatgtaatttgcagatcggcttggtgcttctgaagcagctcatgtctggacaagcccgaagtgatacaaatcacgttgctatcagccagtgcttcctccgtaatatcattagaagacaccacgggataatgaacaccgatatacggattccaagttgctgttcgcgggctagccaaggcgttcgccgtccgtctcaccgcctgctcttcctccggtgtagcatagctggatggaaggacaatgtgaagacgatccatataaacgtcaagcacacccataccgtggctcaaaacgtttcttcccacgcttttcgaatccaccgttttcattttggcatccgattcttttgtaaagcatccactgctttcttcctcccgttcggcaatcaaacggtattcaggtgaggggcgtttatgtgactgtgttttaacaaagcgaaagcggctgtattcccgcaagtccaacacgaaaatacgggctccgatacgaacctgggccagctccaagggcatgacctcttgagaaagatgaatgataaattcttcggcgtgaactgcctcgatatccaactcacctgtggcactcatttcaccgtacaactcggcatattcctcattttcatccattcgcgtcagttccagccagtaagcccggttatgtctcccccgttccgtccgataggcaatacgctgaggtacgacatctcttttccattgcataagccaacccagtacgccgtcgagaagtctcagctcatgcgtatcccagtgattagactgccgctctacaacacctctaaaatgatcagatagaagctctgttacaggggctgtgtatgcttgtgcaaataagtaatcctgatctccgcatacattcaatattggcatattcaacagatttatcagatgcttaggatgtggcgctccagagataaccgcaatagccgcaaaccgagaaggataagcctgtgccatcgcccaggccgcataggctccgttcgaataacccgtcagatagatccgctcttcgtccactcggtatgcttgcagtatgacatccagcgcctccaaaaaagcagcttctccaatataactacccaacgttacaccacgacatgaaaaagtaacaaatatagcttcctcttcccagccttgcccaaaacctcgattctgaaaatccggcaaacccagctcatatcgcttgcctggcatcaggacgatcagaggatactgtcggtcagtcgagtagcttctaggaagctgaatggtatagcgttgcaaactattgtccaaacgggagacaaaaaatccttccccaattccgtcattagacaaaaaaatgtgttcttcttgaagtaaggatgggggctgtggctgttcggtatgtccatttgtgaagatctgttttaatagcttgatatattcacgcacaatccggtaatcccagatttcaaaaggatcttccggcaaatccgttaacctttttaattcctcaagcaggccctctatttgtattttctgcgcagaaggaagaatatctatagcgcgggcttgaatgtaccggtcatactcttcctgcaagccctccacgacgactgacaaaggccgcacaagtgccgaatacacaaaacgatgctccacagcctcatgatcccgatatgtaacggtaaagtgcagcattcccgtattcctggccttttcctgatcccagtcatagctttgctcctgctcccaatgtgctggaaagcgatccagctttatgccttcatcattcgttacctcgacccataacgtttgatctaagggaagatctatccgctccttacgcagtagataaaataagatcgggctgtcttcaccctccctgccagcacttttctcaacctctagccatgccatatgaaaacgtatattacgctctacaaattcacgatgcagttctgccacatctggttcgtcgcatacctgatttccactgatacgaatagagcgggcctcctcaggaataaacgcagcaatgataactaccgtgtgatcgccttcctccagatacaagcgaaaaggaccggattccgcatataccagtgtgccatctatccaaatttgtcccgttccttcaaagggtctgaaaatcacttcctgtccagccgtacaacgaagatttgaaaccagcaaaagcctttcttgttcggccaaaggcggaaaaacacctagattcagttccgcagtccgagggtctagctcggtcagtaatcggcacgctgcctttcctccggctgaaagctctattccttcttcaccacaagccttttccaaattccaatcctcatgagcaaaataattggaccattccctgcccacaccgcaattttccgggagcatgaccggaccgactgcataagcagacctcagacgtaccggatgatccgacagcacagttgttgctttttccagatgtgtgaacctcataacattccccctccaggtttttgtttcctcagagacgtagtcgcggttatatcccgtttaacattcaattgaactatataaaactattcgttattacatctacgtactcctctgttcttctcaaaaaagtagctatgataaaaaaacaaaaaaaagaggcagcctcagctacctctcttgatcattacgattattttcttacaatgctgcctgcaagtcttcgatcaaatcttccagatcttcaatcccaaccgaaatccgtaccaaaccttcggtaatgcctaactctgcacgacgttctaccggaatagaggcgtgcgtcatacgtgccggaacgctaatcagactttcaaccgctcccaagctttcagctagtgtaaaatattttacctttttcagaagtgcaaccgcgttagcgtcactacctacatcaaaggaaatgatgccgccaaagccttcagcctgggttttggacagttcatgttgtgcatggctttccaatccagggtagtacactttgctaaccttcggatgtttttccaaaaaggctgcaatttccttcgcattttgctcaatcgcttccatacgcagacccaacgttttaataccacggatcaataaccaagaatcctgcgggccgagaatagcaccaatggcgttttgcagaaaatgcagttgttctcccagctcgtcgctgttcacaacagccagaccggctacaacatcgctgtggccgcccaaatacttggtagcagagtgaatgacgatatcagccccaagtgtaattggcgtctgccaataaggggtagcaaatgtgttgtcgacgatcagtaaaagatcatgtttttttacaagctccgaaacagcacggatatcagtaaccttcaaaagcgggttcgttggcgtttcgacatacaatgccttcgtattcggacgaattgctttggagatggcttccaggtcagtcgtatccacaaatgtggattcaattccgatacggctgagcactttgcttacaatacggtaggtgcctccgtatacatcatcggtcagcaaaatatgatcccctgcgttaaacagtgaaaataccgcatgaatggctgccatacccgaaccgaaagcaaaaccacgctttccttcttccagatccttgatcagctcctccagagcaaaccgggtcggattgcctgtacgcgaatattcgtatcccttatggacgccaatttcctcttgctcataagtgcttacctgataaataggaacgttaaccgcgcctgtatggggatcggtaggaaggccaccgtgaatcagttttgttttgcgtttcattttatatcccgccttcatatatttttttgctcagataacgttcgctgctatccgggaaaatggtaacaatatgtgcgccatccggtgcattttctgcttccagtaaagcggcatgtaaagcagatcctgaagaactgccaacaagaagaccttcacgtgcagccagttccttgacacggtcaaaagcatcgacatcgctaatggtgtgaatggcattgaaatatcctttatccacaaattcagggattaattccatgccaattccttccgttttatgtgggcctgactcgccgccattcaaaatggacccttctggctccacgatgaccgttttaagggctgcattttgttccttaaggtaacgcgaggttcccataaacgttccccccgagcctgcacctgccacaaatacgtccactttgccgtccagatcgttccatatttcaggtcccattgtcgtatagtatgcctcgggattatccggattactgaattgccgtggcaagtatgcatcttttatttcagcagctaattcttttgttttttcaatagctcctttcatcccctcacttgtcggggtatgaacgatgcgtgctcccaatgccttcatcaggtcctgcttctcttggctgaacttctcaggcacagcaaaaataaccgagatattataatgaagcgctgccatcgcaagaccaatacctgcgttgcctgctgttgcttcaattaatgtcccccctggcttcagctgacctgtttttaatgctttttcaattagagccttccccacccgatccttaacgctgccgccgggattcataaactccagcttcgcaaacaggcgaattcctctcggtagagaatagctgttcagctccactaatggcgtgcgtccgatgagttcaagggtattttgatatacattcataatttcaagctccttttaatggcgaatccaaaaaaaaccaatggtcaaaaattaaccctattgtcggagaagttcgctatcatctccgagaaaacacagtaatacggtaagtattgatgcaataagattttatgtgtatttgaagcttttgtcaaatggaccagtcacaatacccacaccccctgcctacttgctcgatatgatagagaagatgtcacaaaatgtccttgtgcaacataaggaggagttcatatatgggaaagcaatttctgaagatagctgccgtatattttgctcttagtgtgctgcttagtgtaattattggcgtgtcgggtgatcacagcctatccaatgttcagtctcatacccatttgttgggttggatggcacttggaataataggtctgatctatgtgacctttcctgcactttcagttactattttggcacatatccatttttggatgcacaatatcggtctgcccgtgttgatattggcgattataggtgaaaattacaaagttccagaggctggagtttggatcgtcataggatgggtgttactcgcgggggggactatgctgtttatggtgaatgtgtgggatagactgcgctaaagcaaataagttctcttcaatggccataaaaataaggagcctgatcatgtcaggactccttgatatcttcattatatgttagctatataccagctttgctagctaagtgttctatactattacttcactgtttcatcctgtacatgttctttacagaaggtttcaacagcttgcaactcatcatcttcaagttcaagatcaatgtaacgattcgttactttttcaattaattcatactttagcagtcccgtcttttcttcgtctactaaataaagacaacggatatacagtccgttttcagtgtatagctcgtcgtcctcctctacctctacatcaatgataaattcataacgctgtccagtcaaaataccaaaagcatctttaatctgatctactgtgtacgttgtaaagttcaacatgtttttattccccccgggtttccttcaattacggtgcattctacgcccgcaggcagtagttgttcaacttgtgtacgtacttcttgacgactcaaatcctggcccatgatggatatccagccccgatcattacgcgagcgaattaaacgccctatgccttgtctgagtctaagtgccatgtgaggcatatctatctgaataaacggatctgctgcatccttgcgcagagccgtaaaaaccggatcattcggaggaaatggcagtgaccagataatgacgtgcgacagagaaggtccaggaatatccaatccttcccataatgtaacagcgcacaacacactttcctcatcattctgaaaagctgagatcagatggctgatttcagccgaaccttcgtacagaaaacgataggcagacgcctccgggtaggcaacgagacccgtctggaatgcagccagttcttcctgtgaaggaaacaggataagcgctcttccctgtgatttctccagcagtgccagtgctctcgggattggatcatcccccgcttgcaacgggtacagtgcagcttgcatctgatcgctgtagtcataaggtgaagcaacagaaaacgttagcggattttcaataccgagactctgcgccatatagtcaaatgagccctctacggaaagtgtagctgaagagaatacgatcggtatatgctgcgcaaatactcgttctttgagaatctcttttaccatcttcggcataaccacaagcgttaatccatcctgatcctccatcacccacgaaatgagaagttcaggacgcttaaacaaagccaacgcggtttgaatcatttccaaatgttcttccacaattttgacttgatactcatccaaagagaatagcccgctttcaaatacaagctcttcttcgatcgtgccgatcagttcaccaaagcggtttacctctcgaatcagtgactcattcagaatgaactccttgcgattagaaccctgtacaggctgactgttcttatcaagcgcagcgaacaaagcctcactttgggagatcgcatcttcgatcgtcattgccaaagattcccgtacttctccctccagcaatcgggtaattatagattcaaactgagcgtgcttaagcttgtaggtaagcgcattttgtgccgctgtctccagcaaatgcccttcgtcaaagacaacagagctgtgctccggcagcaacggcagctgaccctcgcgctttctcgcttcgtaggtccatacatgctccatgtaaaagtcatgagagcagatgaccagatctgccgctttacggtaatgatcacgagacaacgtctgaccgcaacgatgccgctgatggcaaacgagacagtcttgaaatacatcccatccgagtctgctccactgtccatctgttagctcgggatattcctttcggttcccgtaaggagtaaaggattgtaacgtatctggaaaatgaacaaaatccggcagttcctgataaatatcacggaaaacatctgcgtcctcatccagtccgcctcgtacctcatccagcttattcagacaaatatactgatccggcgacttccccaatctggcatcaatcgtcagattcaaatgctgtgccagcttggcaatatccccttccggctttaccaattgttcaattaacgattcgtccgcacaggcgataatcgctggttttctcatgtatcgggcatatgcaatagcgtacagcaggtatacgagcgttttaccagtgcccacacccgcttctgcaaaaatggtctttttttccttataggcacgttctagctggaatgccatataaatttgttcatcccgaacctcaaagccgacttcaggcaaaacttcataaaatacatccgcaatccagtcacttgcctgctcaataaacggcttggacggatcaaaggcaaaagggtaagtagtcaatcgggctgtgcctccaattcgttcataatgtgcatcctttcattataacgcaaaacaagctaaaaagaacatgaaaactgtaagaacagcttacattttttatttcgctataagaatccctttaaaataaagggacatacttttgtctgagtgagacgctacgtgtagcatttgatcctacgatcgctgttgccccgggattctcagattttcataaacctttaaaaggtaagaatcccatggcaaaggcgaacgctacgcttctccatattcaaatcctccactacgctgcacaccaccgtagtatcgttattttataaatgaaaaatgtcttgctttcctgacaaaaaaagtaaaacaccttaacaaaatgaaaaaacaaataaccacctaatgtattgcaagcattagctggtttcttgttaattgaaaaatatgcattaaacagaagctttggtgatctcctataatacttacagaaaagacgattgctggtcatatcgctgcaattcttttttatgtacaacaaaggtgttggtacaaagatcgtggagtccctgttttttggcagtaaaagcaaccacaatataaataatataagcaattacaaaagaaatagctttaatccaataacgccctgaggcgtgtaaaaatccaaggcgttttccttccttgtccacgacaactaaagagaacgcaagcttacccggtgtagcctgaactttcgacgactcccataaaccacaatacagccatggtagcaggagccaaagaatcagcggccacaacataagcagtacttgtatgaaacccgtctcctttatgcccagaagatctgggataatgtaaattgcgccccctattaaaaggactatggcagtaaggatgatcagatcaatcaaaaacgctgctgttcttatccaaaatcctccgtatattctttttgtactatcgcttattgctgtcatgatatgtataactccttttgcaaatgagatttaaaatccagtttattcctttacacaagatgatatcatacggttacctacctatattgtcaatttacgagcaaatgctcttaaacaagtaaaaggacctatttccatgcatcaaaatgaaaattttcataggaattaagagcttatatatattcatttttctctgattgagtacaatttaagcgcagctacaatcttttaaccccctataagtagtactttggcatcgaaataaatccagccttttcatgcataaaaaaacagcgtatatgtaataaaattacacacacgctgtctcacaattcattccgtaaatctgacaaattataggacgattaaatatgagttcgttcttgcacgcttatacactatatttttttgcattcaacactaaacaaaccttcttcaccgcgcagctttgccaatgcctcgacaaagaaataatcgccatagataatgggaacgttgatgtatttttgctcaggataatgtacggtcccgttcatcagcaatccctcatactcctcgccccatgctgtacacgtatgatgcaagccctcgaggatagattctgctgcttctgtaaaatgctccgcacgcgtcgaatattttgccagctccagcaaaccactggccgcaattgccgcagccgatgaatcccatgccccgcggtgctcttcttctgctctaaaatcccacacaggcaggcaagcatcacccaactgggataggaaaaaatcagctgtgttctcggccaccttcaagtaacgcgaatcccgcgtgtacccatacgaaagcgtaaaaccatacaaagcccaagccgtgccacgtgcccaagcagaaccgggagcaaatccctgtccgccatgctcggcgaccttttttccaatctccggatcgaattcgaccacatgtgtgatagagccgtccgaacggacaaattcacgtgctacggtatctgcatgctgcacagcgagagcggcaaaacgcggatctccgctttcctccgaagcccaataaagcaagggtagattcatcatactgtctataatcgcaacgccccgtgtatccatgtccttcgaggggaagttccacgcgcgaataaaacggccattcacgttaaaacgggcagccagcagattggcagccaacagcccacgtcttctggactctaaatctccgttcagccgataggcggccacaccgctgagcagccaaataaagccaagatcatggtctacagcttcgctattatagagtattttttccaaacgaccctcgcaccgctgtgcaaccccggcagccacactgtcaggacgcgtccgattgactagccacagcagccccggataaaaacctgctgtccaccacgcttcttcacgattatcataacgtccaccctcagcaacatgtggaaaagcgtctcccagtcttgccgccaaggcaagcgtcttatccaaagccagctcccacgattgctccagccacgcttctgctttcgtcatttctttttcctctcctttttccacatgttaaatcatatttatggctctagctctatctattcaggtaaccgaattataaaggaaatgcaattactttcacattccagacgcgctcccttaagtaacccattccgacaggccacggaagctaattcttccggccataccacgttcgttccttccgtcgtcggaatgacttcgaggcttgcacctgcgtattctactcgaatgctttccgtttcttccccggctgacatgacatgatgaataacgctgcgctcccgaccgtcatacgccattaagggaataagcgcccctacattctgaatattgccttgaagctcatacgccacttcaattttgccgggtacctgacaataatgcgttcggatttccctcactcccggaaatgggcctttccacaggagtgtaaaatccgttgctccgtcagacgctgagctttgttccatctgtacggttcctccaccatcctgcgggtcaatccctccatcccggtcgaactccagcgtaccaggaataccttccgacaagctgtgccactttccgtcctccgtttgccaggccggggtatagcttagcgggaaaatatctccctccgcgaagcctgtaaagccgcggtctgcatgacctgctgaggacggaccgatcagcgacggcagcgcagactgctgaatacgcacgatgcccggaacattgtacggatcgttgaccgatgtttgcacaagcatttgctgcccctctacggctgcaatgacagtctggaaccaaccgtccgttgccaacacccggctgccgatctccgccgggatgaaggttggggaaatgcgattcatctcctcaccatgtagaagggtgtgggccagcacagccgccgtccacagactgtagcaggtatgattcgagtacacctcaaagccatgccgtgcctcggacgaataatggttgcggacgatatgcagcttgccgtcatcggtctgccaacggctaatggcttgccagcatagatctgctgcccgtcggaacgcacctgcaagcccatgctctcctgctgtaaaagcctgctgagcatgtgttgtaaagacaaaggccgccgccgcttcgttccactgatgctgcgcgcttcttccacgcggcggaatttccccgtgcggggatagcgccagcaatgtgctgagcgctcccctgcgaaggtggtcacgcagttcgagtgcgcagctgccatcatatccgttctccagcattacgcccaaatgaaaacgtgtaacaatatcgtaggcaaatggactattgggccgatccagcggtccatcctggtacaggcccaagccggtaaaacgaggcaggtggtagctgcggatatacgtctccatccattccgaatcggctgcaattccttccgctgcacgcaaaaactcgccggaaatcataatcgcattccagttgatcatccggttcggatttttcattttgctcatcgtaaaaatgtaggtctgctccggctgaattctgctcagttgctgcttccaagccgtggcttgctctggcagcagatttttaaggagccgatacgcgcccatcatcataattggaaaaaagtctgggtggtgatctggagctttttcctccactacacaagctatgctatgcgtcaaggccgcagcagcagattccagtaaatcatgccgaccttctttgaccaacaccgccgctgccaacgcataggacggggtggagtagtaccgttcactttcagaatgggggtcaatgatagctccggtatcatcctgatgcagggcatatgcgcgaaccagcttttccagcacggccagcttacgttggtgagtccatccgtcattcattcgatttggcgcgctttccacctgttctataaatctctccagctccgtctgccaagggtacacgctgcctgtctgcagcttattcatcctgtctgcctcccattcaaaatgaaaattaatgtatggtaaaaaacagattgcaatctacgcttgcagaatcgctccagtgattggagtctagttgcagcgatgttttataaaacacaaagggagctccgtcatgatctatgtgcttcacagcctcgagccccggccgcagcacgccggcatcataatctagcctgacgactgcattcgcccccgtccattctacgaagcctgctcccagattaggctgaatacagctgatgaaaaactcctccacatcccatgacttcatgctcacgccagacgtttcaaactcaaaatgatcggtgacggtaagccttgccccctcattttcctctagcacattccatataaaggagcgggtgaagactgccaattcttctacgggataagcagatgtcaaatcaagcttaagccttgtgcccgtctgtacctcctcctgctcatccaaagcaatatccagtacaaccgcctttgcctttgcgcccgattgctgcatagtcccattgatgacaggcacggaatgaccactagaggagatattaataatcgactctcgtcccggtgaaaaataggctttcgtgtacaagcctgctcccagatcacacaatatattttcgccaccgccatgaaggatgaaatgtccaagatcgttatgattgtgcggttcattgttatgcccagccttcgctgaaaatgcaagcatgacacctggttcacccttttggcttccgggtccactatggctggaactgcggctgcggcacatcagccaaccgagttgcggcaaataattggcaacggtctcaccgctcccaaatgccaaagaattcgtccacaccaggttacgcaatacatgagcccagcggcgacaggggtcttccaacagaccaggtacgcggaaagggagtgtagatggtcgttcttgcaatgaattcaaatgagagatgagtccggaaggcaatcgttcagtttcactactgtccgaataattagcgaaaattccattcgacagatgaacccgctctccaaaggctgcaatttgcctaacctttttcgagttcagaatatccacagctccctcggtaaattcacgcagcatatcggcaaaataaatgaaataaccaaagccgtacacccagtatcctacgccttcggggcatcccccgtcctcactatagcctgccaaaaaacaatccagcacgcccagcatactctcgatggctaccgctctggaaaagtcgtcttctaccagcagcagtgctgcaattccgcaaccggaagcacatactgccgaccaattatgatctgcggtttcccatccaaaatgacgaggcttccaaaaaacgggttccagtacacgacgttcgatctcttcgtgcacctgagcgaccacatggctagccagttgttctcctagcagcaataaaatttcaaccagcgtttgtgctgtttcggacacgaataaatccacctgctgccaaggcggtgttacggtgtcctcttcattgacatgtgcaggaagcgcccatgtgtactcactgcatatgtccagcagaccgctttccacctctttcatctttcgaggctccggcttgacaacagcttccagcactatagcaaccagtcgtccacgccgttcaaagtacacatcctcatacggcttgcgctctcctgtattagcaaattgccgaaacagagacaacggcagttcaggccatgatgcttcccgattatctttacagacacgctcaatatccatccaaagctcggcgtatatcggctcagaaacagtcgtccgtagcctttttgtccaattactccttaaccgttgccttgctgaatcctgcatgccgccagccagcgccttaacgagccgcgaagcaggccaagcctccctcagaagactcatctgcatttcctcctcatgagaagcatttgtttcaccttcttttttgttaacgctttcattgtatctaacaatcattgtaaattcaaaggggtagcaaaacaattgagaaaaaataaaagaacctctatgccccgttgccgtggtcatggaagttcttgttttacactagtgccaatctccgtccagattcgctttgatcatgttttctaaactgtgggtttctcttgtttccactttctaatcccgtcatcctccagaatacccagtgctgcatctgagatattaggatcacgcagcaaagcgtcctcgactctaaatttaatatcgtcagcatctgccagcgtcatgcccggcgtaagctcaatcaacccttccacgtgataatagcgtccctcctgcaaaatacgcatttgataaatatccgtaacatgcgtatctgcgagaataatggaagccacacgttcttcgatatcaggaggagcagatacaccgatcaaacctaccatgttgtcgtaaccgacccggaaagcaacaccgaccatcagacaaccgatgagaatacttgaaatgccgtccagcagtttaaaatctgtcagcgatgtgaccaccactgctagcaaagcgagtactccacccgttgttgctaccaaatcttcataaaacaccagccgggttggcggtgcagcacgccccacatggcggaacgcagaggtgaaaatgcctaaccccttcgcttctactctggattcatgcagcacttctttcatcgctttgctccatacaaatccgtccaccactagtgacaaaatcagcactactacattaatccaaaatccatgtgtagattcagccggatgctgcagcaaatgaatgccttccaatgcggtttcataggccataatcgttacgacaataacggcaaccatacagaacaggttaatcactcgtccaaagccggtaggaaagcgttttgtcggttttttctctgccagtacactgcccgcgaatacaaacatttgattcactgcatccgcaatggaatgcatcatcgtagcaaacatagaaccgctgcctgtcaaggcaaaagcaattcccttaatcaaggcaatgccggtattccctaacgccgccgagcccgaggatttgtttccttttttgaccatactccaaaaggagtcctctttctgtttcacttccatcttgtagctcctcctgaggtatacataatctgatatatcatcgtttgttatgtattatttttaacccgtccatattctacctaaccatctgaggagaatcaatacaaacgataatattttccatggaaaaggaatgccccatgtcccctacgacatgaagcattcccgttacaaccttctatcagacatacgctcaggttaacaacacagataatctccatgcgctgacgattgacataagtgcctatttaccagcttgatttcgttattcctggaatttggcctttatgtgccaactcgcggaacgcgattcgagacagcttgaatttgcgcaagtatcctctaggtctgcctgtcagctcgcaacggcttttcaagcgggttggagatgagtcacgcggaagcttttgcaaagcttcgtagtccccttttgctttcaattcacgtctcagatccgcatatttagctacaatttcctggcgtttcttctcttttgcgacttttgacttcttggccatgtaaagctcctccttgtgatatatgccaatcatgaaggttcaccatcactaccgcgggatggatgaatacggatatggacataattttacaccttaaatagtaatcgttacgattactatttaatataacgtgctccaggtaggttgtcaaccctagcggtttgaatcacaacattaaaaagccgttgaaacagtagaaccgattcattgtggtgaacggtctgccgtttcaacggctttaaaatttgttgactagctttgttcattcagccaaatggcaagctacccagtgatctggacgagcctcacgatagagtggaatctctttggagcaacgatcgattgcaaaggggcagcgagtatggaacttgcagcccgaaggcgggttaaccggactagggatatcccccttgagcaaaatccgttctcttttcagcttcggcactggaataggtacagccgacagcaacgccttcgtatacggatgcaacggattcccaaatagctcgtcacgcgaagccgtttcgaccatggagcctaaatacatcacgccaatacgggaacacaaatgttctaccacgctcaaatcatgcgagatgaacaaatatgtcagaccccgttcggcctgcaatttggcgaataggttaataatctgcgcctgtatggacacatccagcgctgataccggctcatcagcgataattagatccggctgaagcgccagtgcccgggcaatgccgatccgttgacgttgccctcccgaaaattcatggggaaaacggtcgatatgatactctgacaatccacatagtttgagcacgtccagcacaatctgccggacctcctccttcgttgctataccatgatccagtagcgcctcaccaatggcatcaccaatccgtacacgcggattcagcgagctataggggtcttgaaagatcagctgaattttaggacgaagctcctgcatccctttggcagacaggctgtgcacatctacccctttgtattttacggtaccgtccgttttatccgtcaatctaacaatcgtccggcccaccgtgcttttaccgctccccgattcccctactaatccaaaggtttcaccctgacagatcgtaaagctaatatcgtctaccgcccgcacatgtcctgaagtacggttcataaacccggacttcaccggaaagtacgtttttaagcggtctatttccaacaacggctcagccatgaacaaccgcctcctcatataaccagcaggatgctttctgctgagctgaaacttcttttaatgtaggctcctttacacgacaaatgtccatgcaatgcccacatcgatcgtgaaaataacaggaagtcgtcagctccagcggattagggacctgcccggggatggaatacagttcctcttggcgctgattaagcaccggtttggattttagtaacccctgtgtataaggatgcttgggatgattgaacagctggaccacttcgccttcctcgacaatcttgcctgcatacatcacaatgacgtaatcagccatttcggcgacaacacccagatcatgggtgattagcatgagcgacatattggattgggctttaaattcacgcagcatatccaggatttgcgcctgaatcgttacatccagcgccgtcgttggctcatccgcgataagcagcttgggaccacaagaaacagcaatggcaatcataattcgctgcagcatccccccgctcagctcatgcggatagctttttaaaatctgctccggccgggatataccaacctgttcgatcagctccagtgctcgcttacgagcttccttacggcccattttcaaatgctcaatcagtggttcggatagctgttcaccaatggtcatgactggattcaatgaagacatcggctcctgaaagatcatggatatttcatgtccgcgaatcgtgcgcatctcatttctgctaagctctagcagatcggtttcctcaaagcggatgcttccgcctgccactttaccaccaggactctggatcagacccatgatggacatcgcggtaatacttttgccgcatcccgattcaccgacaatgcataccgtttcccccggcttcacacggaagctgatatcatccaccgctttaaccgttccttcttctgtataaaaatgagtgcttaaatgttcaatagaaagtaaattgtccatggtgtatgatcacctacctcttatgtttcgggtcaagtacatcccgcagcccgtcaccaaaaatattaatagcgatgactgtagcaaaaatagacagtcctggcggtatccacaaccacggtcgttgctgaaaatccagcacattgttagcggcatcaatcatattgccccaagtcggtgtcgtgggcagcacgccaaggccaaagaagctgagtacagattcactcaagatagctccgccaatattcaatgtagcgataacgatcaacaacggtaaaatattcggcagcagatgtttgaacagctttcgacgattcgagagtcccagtaccgtcgcggcttgcataaattcacgttcccgcaaactaagcatctggcccctcaccatccgtgcaatccccggccagttgactagactaagcatcaacatgacaatatacatccgctgatcgggtggaaccttccagtcagatagcagcgcgcccataataaatagcaggggcaaactgggaatcgtcagcagcaaatcagcaacacgcataataatctgatccgcaatcccgcgaaaatatgcggatatgacccccagcgtagcccccaaaaagactgacaataccattgaggctaaacccacggtaagagaaatttgacctgcttgcatcacgcgtgtcatcacatcccgccccagtttatctgttcctaaccagtgatggatattgggcgccttgttcatcattaatatatttgttttattatcggaataaggagaacataacggaccgataaaacagagcaaaaacataaataccacgacgagcagaccagccatagcaagcttgtttttgaacagctgccggagcgcttgctgccacattgaagatttaacagttgttcgcagtctgccgttgctcttgctcaaattactgctcacggatgacattccttagcccccttcttacactttcacacgcgggtccgcgatgcgatacaaaatatcggacaacagtgttccgataacgctcaaaatggcaattagcatcgtaaagcccataagtagcggataatcccggagcgaaaaggattgcatgtacaactgaccgattcccggccaattaaaaatcttttcaataatcagggacccgccaaacagcgcaggtaattcaaagccaacgagcgtaatggcaggcagtaatgcattcctcaatgcgtgcgtaaaaagtacctttctttcctttaagccctttgcacgggctgtgcgtatataatcctgctggatcacgtcgatcatattgctacggaagtagcgggtcaacgaccccagtcccagcagcgtcataacgatcactggcaaggtcatatgctggagaacctccttcacatactccatacctgtagcgttactgcccgtattgagcataccgccgggcggtagccacttcaaatcaaccgctgcgattttaatcagatacaacccgataaaaaaagagggcaccgacatggcagcgaaaatcaccaccatcaccaaagtatcaaaccatgaatactgcttataagcagcaatcacaccgataatgaccgcgataaaccaggtcaggaaggttgatacaacggccagcaaaaacgagttccagatgtactcattaaataaggtcagcaccggcttctgctgggcaagcgaataaccaaaattgccgtgcagcgcattgcctaaccaatttccatagcgttcaagaataggcttattcaggccgtaaatttccctcagctccgcttttctctccggcgacagcttcagattgccgctaatgaaatctcccggtgtcatggcatacaggaaaaaaatcatcatcgaagcggccaacaaaataataaccatatacgtcagtcttttcgttaaaaacgagctcatgacagactcctttcaattcaaggtcaggctactcattacgttttccccatttaggaggccccttgatccgaacctgatgttcttcacaaggggcccgcaaatgtggcttatttaagggaccattcgaacagattaccagacaagccaatgaacggactgacctttacatgttccatccgaccattgtaggcatacaccgtcttcttatagttggtaaaaataacgggcagttcatcgtttagcagcacatataattcttgatatattttcttccgttcttccatattcgtcgtagacaagcctttttcatatagctcttttacctttggattgttatatcccttgacttctccattgacgaattgctcgattccatctgatggatctgtcagcatgcctgtcgagaaggcggcaagatcataatctttaccttctactttggcgaccattgcattaaagtctgcaaagatttccggctgaaggtcaacaccaatcgctttgtaattttcagccgcaagcgcaataaaggtgtctgtttctggacgtttagaggtcagcaggtgaatggtcagcttctgtccgtttttctcacggataccgtcactaccttctacccaacccgcttcatccagcagctttttcgcttgctccgggtcgtagttgtatggattgattccatcggtcgtgtaagaccagaatattggggaagctggaatgtttgcgaccgcccctgctccctgagctgcgtcgacataaatgcttttccgatccagtccataggtcaatgcttgacgaacctttttatccttaagcttttcattttccagattgacttgcaaatatccgtaagtgctagaggtatacggcaaaatgtttaaaaagccaagcccttttagtttgtcgatattctcctgcgttgcggtgaaggatgcaaaatcggtatcgcctgtttctatgaattgccaagcgtcgccttctgctgttttgtaaatgaaatgctgtgttttcggtttgcctttgaaaaagtaatcattcgcctccagacgaacttcttgccccggaatgaatttttctaacttataagccccatttcccagagggctgctatgtaaatttttaaaataatccagctctccgaacttataatccttgccgtagtaggttttggacagtacatactcacccagaatcggcaaagcaagcgcgtttggtttttccaacgtcgcagaaatggtctgctcatcaatcaccttgattcctgcaatttgttttgccttgccttccgtatagtctttgccgcctttaatgttcagctttcggatttggctgtcaccaggataggctttgtcatagatcaacgtccaggtaaatgcaacatcttctgctgtcaaaggagagccatcactgaattttgtaccgggaaccagatgaaacgtatacgttagattatccttggaaatatcccagctcttagccagattgggcagcggaagccccttctcgtctaccgtgaccagcggagtccacaactgcgaaatcacgttgccgtcatagccgctttggttaaaatacggagtaaacaccccagttgggtcagtcagaccaacaataatcgtgtcgcttctcttttgggacacttccggcaatttggataaatcagaagcttgtaccagacttgttaatggctgcgctgtagcggctgtctgtgcggcatcactattttgcgaagtagcatcgctagcgctatctgatccaccactagagcaagctgctaataaggtagaacttgccaggagtagactgctgagtagaatgattccctttttcaaaataatccccccaagttaatttaataaattccgatcgaacaagttgtaattaataagataaatctcattataggaatctattccggttctgtaaagagagaactccatttttatgtaaaaaaatagacgtccactcatctggattccaaatggtcggcgtctatttgtttaaagtgttaaagtctaactggtgcgtgcagcctaatttcgctccatatagcccaggatgctccgatgcatttcatctactgccaaaagccgtgcgctatagccgagcaatgtttcaccatcaaaatgtgcatggatgaagccagaggcacgaagcttaaaaatatggtcgtgcgtgattcccttggacagcttgagatgacggacaatctcaataaaggtgcgtggagactggctttggtacaaatattttaaaatcttgagcctgctcttctcccccaagcttcggatcattcgatattcctgtggggataaaaaatcgtcctcctgaacataaattcctgccgagtaatggcacaacaggagcgacccaaatcgataaataatatttatcggctgaaaatgatattgcggtaccagcaacacctgcgtcagcccttcggaaggctcgaatcggaagccattagtggtacgatccacccactccatagagctatatgcgcccttctcccggtttctacgttccgcttcctgtttcaacccgcttagaatccttgtatccacatgacgaaaatactctttatcccaaccggatagcagttgcaaagcaagtttgcgaagcttctccatgtcgtcaggcagcgggattccataggctgatgcctgttcatttaattcctgtacagttcggttctccagacggtctacgacctcttcaaccttcccctgatcagaaagcatacagacgagtccataaatgatcttccaatctgcattgatttccatggactccagcaattcggacaaacctggagacagcgttccacgcacttgctccgcccacccggctgataaatcggtcttcttgtaagccttgcggcaaataaaggtgtgtaagctgctgagcaactcaaacaccggtccatatgctacatgtacatcgtaaggagcattcacgtcatgactcatcgctttgtgtcctcttttctttcatatctgatgtccattatacatactatcgtacacccgttcattcttagtgtcccttcatacgagaatttagcaaaacacagatacatatatgatggaaacaagcgtcataatcaaggcgcaaaaaaagcctgatctcatcagactttaactgttcagctataattcaaaaaggttgtctcccacaaatatcgcaggagacaaccctggggcaaatagtatgatgtttaaagtttgttagctgctactttccactctaatattcctgtggatgctgaacctttggataccatttcaattcttaatttcgttgtttttacaggcgtaaaagtagtcgtattatactggtctgccgaagtacccaatccattagcctgcttgatattagaccagctgcgaccattccaatacttaatcttgtaagacttaggaacatcaatgccagcgccatcttggaaccaatagacatccgtttgagacaccgtatactcttgatcaaaatcatattgaacccattgtgtacctgtctcaggccagttaccatacacggcatgacttctatcattggaattagcaggttcaaatccatcgtttagcgcgcttacattttcccaagatgaagtataggagctgctagccgttgccgcaggtgctatgttcacgattttatcaggatctgtttcaattgggccatcgtcgtctttagtcgtgattgggaaacgggaagtatcttttttgagctgactccaggtataacgcagcatccagatatcccagtcggtgatatgatcggaattaccggcccacataatggtgttcgttgggaatccacctagtggacgctcatgttcttcataaaaatcgtttaatccaaatccatgcccaatttcatgttcagtaatctcaatctcttccgaattcaccgtactcagaacgtattcatcattcatacgctgtccccagtcgccgccggctcccccgtcaaaattttctgtggcccagagatacatatcaaagcgtttatccaatccacccggataagaatagtttgggtccgaaaaatgctcaaatcgcgatatttcattaggcgcaacgggaagtgcagcgggaatttccggtttttcagaagctagtgtatctgtaatggtatccgtataaacgacctcatccggctgcttgtccagcagcagtgaaggatcagaaacagcccagcctaccacttttactttaatattcttatagggccagccgtcatatccttgaagatgatctgtccaatggttcatctgccgatctatcattttagcaatatcctggcgttgcttcagtgtaacgggcttagaagattgccagcgtataacataattaagagtcccttttcccgcaaaaatttgatcaaaaatcgtatttttacgagccgtcgagccttcggtcaacattctattcttccaaacccattccactgatgatttgagataagctggcatgtcagccaatgtcgaatcacccgttgccgcaaccacagaattcccgtttagatgagaatccgctgatacaaaactagcgtttcccatcagtaatgaactagcaatgactactgaaaaagaagccatcatcattccttttctgttcaacatgtatgtacctccatatccatttgtattattgcagtagttttcctgaaacgatgatctctatcagctctcttttcgtgtttgcgaactaatctaggagatcaagagtacactatcaatcttccttgtcgttttttgtaaataatcacaaatcatattatcactggattattgcatcgtcaatattttccttaatgatttaaattaggatttttaatcgtattttgggacatatacttactctttgcatgcacaaaactggtattttataaaatgaaaaaaccgtttattcacagaatcaattccatcacagaatttgattttggaataaacggctctatttataagctttttcacactactctagcattttttagcgggtaggaaaacgagtagtatccttcttgacttggctccaggtataacgcaacatccaggtatcccactctgttattttgggagaattgccggcccacataatagttggcacaggaaaaccaccgctaggctcacgctcctactctatggatatcaatgccgactcagccagtgaagccagtagcttcgctgttccgggcaacgcgcgttcgtccagatcaaaggcaggatgatgccattcctggcttcccgcagtgccgacaaagacaaatacaccggggatgttcttctgataaaacccaaaatcctcgctcgccgaggatggtatgggactaactacgtccagaccgaccaattctgccgcctcctccgcgatgacggccaacttactgtcgttcagcacaggcggcggaccctcgatccagcggatggtcgctttcgtgccgaaagcatcggcaacgccttttacgatctgctcgaagcgctcagtcacctgggcgcgaacgttctcgtcaaatgtgcgaatggttccgtccaaatgggcgcggtctggaatgatgttccaggcgttgccactgtgcagcttcgtgacgctaatgaccgcgctatccagcggattaacgctccgactcacaatggattgcagcgccgtaatgatatgtgacgataccacgatggggtcaatccctgcatgtggcactgccgcatgtgtgctcagaccctccacctcgatgtaaaaaccatctgccgctgccattagcggaccttctttgatgccgaccgtacctacgggcaggtccggcttgttatgcaggccaaatatggcctgcacccctgccaacgcaccgctgtccagcacttgggcagcgcctttggccttttcctcggctggctggaacaccagccgaaccgtgcctttcagctcctgctcccgctgcttcaggagtatggctgctcctaacagggatgcggtatgaaagtcatgcccacaggcatgcattttgccggggtgcaccgaagcataaggcaatcccgtctcctcctgaatgggcaacgcatcaatgtctgcacgaagcgcgacagttggtccttcctgctgtccgccgatttccgcaactaatccggtacgcagcggcacatccagaatggttatgttctgttcttccagtagacggcggataaaggcggtagtttcaacctcctcgttagatagctcgggatttcgatgcagatggcggcgaatgtccaccaacttctgctccaaaacctgctccttcgtcccggttgatccactcatccctattcctccttcgtgaacccaaaatagttacaattctctcagaccaacaacatctaggactgcacaggcaatccggcaaaagcttcatgcaacaactcgaacgagcgcacacgcttgtgtatatctcttattcctgtcgtaacgatcagctcatcggcctgatacttcgcttgaatttccgtcagcacagcatagatttcgtctttattccctttgttaatttgcgcttgtgtagcttcaattgtatattcttcacccgattgcttaccaaactcttctgcactttccagcgtgcccaccgtagccgtcttgccactggccagatgaattttgtacagcttgtgctcacctgctaactccgcagcttcctcggaagtgtccgctacgatgactgaaagcgcaaaaagagctttcggctcacgtccataactataatcgaaagacgcccgatacgtacggaatgattccaatgcaacctgctcattactattgataaattgcgaaaaaacgtagggcaaccccaaacgcgcagcaattccagcactgtctgtacttgtacccaaaacgtaaatatctgctggtatttctggaatcggattcgcctgtaacccggctaacggtccttcttcagacggaatattatgaatatagcgacttacttcatcaattttttcttcgagagaaggcgcatcatgaatgtttcgttgtaacgcctgtgtggatttcggcaacccgcccggtgcgcgtccgattcccaaatctacgcgacccggtgcaagagaggacagcacattaaagttttcagctactttatatgggctgtaatgctgaagcatcactccaccagaaccgactttaatacgctcagtgcgtgccagcaaatgggaaatgagtacctctggcgaagagcccgcaacctgctcggaatcgtgatgctctgatacccagaagcgcgtaaatcccaattcctctacacgctgtgctagcttaatcgtattacgaagggcctgcgctgccgtttccccctcgtgtatagggctttgatccaatactccgattttaatactcatgtctccctctcccgtctaaattgaatagttatattccggtgtaatccgtttcagaaattgtttggtacgttcctctttggggtggttaaaaatgtcgtccggtgtgccttcctcgataatatgaccgccatccataaataccacatgatttgaaacatcgcgcgcaaagcccatttcatgtgtaacgacaatcatcgtaatgccttccttcgcaatcttgcggatcaccgacagcacctcacccaccaattcagggtccagcgccgaagtcggctcatcgaacaaaatcacttccgggttcagcgccaaagcacgtgctatgccgacacgctgctgctgcccgccagacagctggcttggataatgattcagcttttcacccagaccgaccttttccagtacttcaatgctgatttttttcgcttcctcctgcttgaccttgcggacaacgacaagtccttccatgacattttccagtgctgttttatgcttgaacaaattgtattgctggaaaaccatagccgtcttttgacgtagagccaaaacatccttcttcgcaggtcgcttgcagttcactgtaaaatcgccaatgctgacttccccatcattcggcttctccagataattaatgcagcgtagcagagtcgttttacctgaaccgctcgggcctaaaataacgacgacctcgcctttgttcacggtcaaatcaatgcctttgagcacttcatgtttgccgaacgacttcgtaatattttgcagacggatcatgatgctcgacctccattaaacacattgatttttttctctaccaagccggatattcgttcaatcaataccgtcaagccccaaaatagcagtgcagctgcaatatatacctctaaatatttccagttagtagatgccagaatctcagcctgtgcctggatttctgtgaccgaaaccgtgaaggccaaggtagagccatgaagcatcccaataacggaattcgtcaggtttggcaaactcaccacgaacgcctgcggaaatacaatccgtctcagcacttgccacgtcgtcataccgacggcatatgccgcctcgatttgtcccttgttgaccgattgaattccagaacggacgacctcagacatatacgcgccactggtaatagaaaacgaaatgagtgcaaataccatataaggaacatctttggattgcagcggccagccgaaatgcttcgctcccgcatcaatcaacaaaggcaaactgaaataaataagcagcaaatgcatcagcatcggtgtgccacggataaaggtaacgtaaccgtgagaaatctgggacaacacaggaaccttatagattcgcgccagcgccgttataataccgatgaccaaccctgccagtacggaaaccaccgtaataattaaggtgttgggcaacgcggagaacaaccctaaaaaggcagtatatataaagccaaaatccagactcatatgcctttacctcctttactaagacggggacttctcaggtaacgcaccacaaagctttttcgtttttcgggttctttctgtactacatcccgatgctcatgccggagaagcgtattttccagcaccttgaacaatttttgtaaaatcagactgatcaccagatagataagggataacgcgatataggtttcaacaaaatgttgggtagccgaccctaatgtctgtgatttccctgtcatctccatcgctccgatcgtaaatgccagcgaagtatccttcagattgccaatcaccagattggaaaataccggaaccacgacagccagcgcttgcggcataatgatacgtgtaaaggtctgatagcctgacatgccgacggactgtgcagcctcgatttgtccccgatctacagcttctactcctgacctgataatttcggaaataaaggctccactattgagcgcgtaggttgctacggcaaaccacagcacatcccatctggaagaattgatatccaccagctttagtagctccggcaggccgtaatataccagaaacaattggattagaataggtgttccgcgaaaaaaggaaacatacacttgagaaacacgtttgagaaatggaatgttatacatgcgaggcagcgcaaccaacagaccaatgataagccccaatacaagcgagcttgccacaataaacaaggtgatgtgtaagtaagacagcattttcgggataaagctaaaaacatagtcaatattgaactctctgctcatatgcctgcctcctttctatacatcagcggccagaatacatagagtaccctgaccgctgaaaagtccacgtctatccttacttcttactgctgctaccttcttttttcacatcttccagtgacttagtgaaatcctctccaagccatttaatgctcagcttcgacagcgtaccgtcgtccttcacttcctgaatggctttgtcgaggtcatccgccaacccttgctcatttttgttcagtacatacagtacatccgattgagtcaaaggatcacctacggttttcagagctacttctcctttttcatcggtgttaaaacggttcgcaaagtctgtcgtaacggtagcatctatacggccgctcgtaatttgttgtaccgtatcattggctgcaccactcgtataaacgatattcagggcatctccgtgggttttgttatactctttcagcacatacgccgcattactggttggactggtgagtacctttttccctttcaaatcatcaattgaatgaatggtattgttatccttcgctacagcgactctgttcagaaaaatgctatacggatttttgttgaacagatacttggcctcgcgctccgggtttttttccatttgatgcgataccagatcaatcttgccggcatcgagacttagcagcaaatttccaaagtccatcgttttgaattcaaattcgtattgaggcaggcgcttgtccagctccttaatcagctccacatcaaaacctgttaaatttccgttttcgtcaataaagcatacatttttgaattgagtacctgtgcctacgataattttcttcacgtctccgcttgaacctgacgcgctagacgcgttatctgaggaaccgcagcctgccaacaccaggatgattgccataacagacaatattgcaaaccactttttcatatgaatccccctcatctctttgtatatcagcagtttgcgacatacatggtagctacaacatccaataattaataattcctataagtttaattggttttaggatgtgattaatttaacacctggaaacctatacgtcaatccatcaagccatagaacttttctataacaaaaaagcaccccggaaaccttctgtcagtgcatctgcaaaatccgaggtcactgcacagtcttctttggtcgctattatgctaatctgcatcgacacaccagctacctctggaacatggatacggaacagtttctgatcttttacttcacggttcacacagacatctggcaaaaaggcaatacccgcttcctccaataccagctttttggccgtgaccacattgtctacctgaaaagcaatgtccggtggttgctccagtgattcaaaagcgcgatgaattctcatccaatctagtgatccgcattcgaaaaacaccagtgtttcacgttgaatatcctgtatgctggcctttcctgtcttcataaacggatggccgtcgtatacatacagggaaatcggatcttcataaaaagcaagcgtacggatagccggatgcatcactttacggacaaaactaatatctacctcacggttcaacagtttatgtaccagttgatccgtcgtagccgtcacaattttgtagttaacctctggataacgggcacgaagctgctttaatatttcaggaatgatgtagttcgacaccgatatcgtgcaaccaattcgaatttgctgaggggctttcttacgctgttggagcttttgtttccctttttgcagcacctgaagcatctgctccgcataaggaagaaactttcgtccatcctgcgtcagaaccgtttgcttgctttggcggtcgaacaacttgcattctagctcgcgctctagcgtctgaatccgggctgtaacagagggctgggacaagaacaaggcttctgcagccttattaaagctcccataatgattcacgtatacaaaggcttccatattctcgatattcatacgcaagtcccccagtaagttttatatacatttatccaataagttaacttggttttttgtatcataaaactcactgaacgacctgtcaatggaaatattgaaaatatctataattttaatagctcatttagttctttaacagaacgttccaaccgtgcaaccaattcttccgacaacccgtatgctccatctggcagacgttcgacccactgatccactgcatacaccccgccaagaatatgtcttccgcccagtgcattaataaccggcttcaaggcatagtcaatgaccagcaggtgagccagtgtacctccgataaataaaggcaagactggtttccctcttagcccctcctgcggaaccaaatccaggaatattttcaatagccctgaataggacgccttatagactggagaagccacaataacggcatccgctgctgcaatcaatgcaagtgatgctgtgacgtcggggctgttaaagttagctgtgaccagatcctccgctggcaagtcgaccacattcagtaatgtgacctccgctccagcctgctgcaactgctccgttgtatagttaatcaagccgtataaacgggattgtgtagacggactgcctgataggatgacaaccttggacatatttttccctccttctgttatgcgtcaaccttcactttggatctggctgctgtatagcggttctcaggaataggcacgcccaggttttcacgcagtgtgctaaattcataatcctgacggtaaataccgcgttcctgcaaaataggcacaaccagattgacgaagtcatgcagacccgatggcacatcagaaccaataatgaatccgtctgccccttttctttcgaaccactcctgcacttgatccgctacttgctcagcggttccgataaaagaggttctcggtgtagctgaacgcaatgcaacctcgcgtaaggtcaaattttgttccttggctactcgtttaattttatctgtaccgctgcggaacgcattgctgccaataccatcaagctcagggaatggctcatccagcggatattgtgagaaatcatgatgatcgaagaaacgtcccaaatactttaacgcagcctcaatcgtcaccagattcgtgatctcttcatacttacgttccgcttcctccgtcgtgctgccaataatcggcgaaatgcccggcaaaatgacaatatcctcttcggatctaccataacgtaccgcacgttctttcacatcacgataaaactgctgcgcttcctctaaagtttcatgtcctgtaaatacagcatccgcttccttggcggccaggtttttgccatcctccgaggaacctgcctggaaaataaccggctgtccctgcttggatcgtccaatgttcagcggaccctgcacagagaaaaactcacctttatggttcaatgtatgcagcttttcaggatcaaagaatacgccggcttccttatcacgaacgaacgcatcctcttcccacgagtcccacagtcctttggtaacctgcaaatattcctctgcaattttatagcgctgcggatgcgacgggtgctcgcctttgctaaagttaagggcagagccttccagcggggaagtcaccacattccagcctgcacgacctccgctaatatgatcaatggaagaaaactggcgtgctaccgtgaacggttcgctataggaagtcgacagtgtgccgaccagtccgatatgcttcgtcaccccagccaaagcggacaaaatcgtaattggttcaaaacggttcagaaagtggggaatggatttttcgttaatgaacaggccatctgcgataaatacgaggtcaaacttcccttcctctgccttttgcgcctgcgttttataaaattcaaagttaacactcgcatccgcaggtacttcagggtgacgccaagtcgtcatgcttcccccaacaccgtggataatcgcaccaaatttaatttgtctattcttagccataactcttccacctctcttgaaaataatgatttcccgtcggcttataccacttgattgtaactttccagcactttacccaactcttccagatccgggttgagcagtgcttcatatttattatccccgcctacctcgacgacagggacataacgaataccatatttggtctccagcacgtcacgcagcacatcatttccgtccacttggatattttcatacggctgattttgggattccaggtacgatttgatctctccacaaaaatgacagccggttttactccacaatacaactttaggtttggacgacatatacatacctccgtgagcttaatgtttataattccgatgaattaaataagaattatatttataatgtatcctgctgccccttttccgtcaatcgcttgtgtaatagacattgctaattcaacgatagaaaattttaattttatatcgtaattaatcggttaattggtagtcaagttatctaaatttagataatttgaagtttaaatggaccctggtgcggacatccttggaataatagcgcccttgtggtgaaatgaaatgaggttgaacaaatgcaggaatggtccattgtagctttacgtacgttattagctatcgttattctttttgtgattaccaagattcttggaaaaagacaggtatcgcagctttccttgttcgaatatataactggaatcaccatcggtaacttggcggcttcaattcctttggaacgtgaatcctcctggtacttggggactgtgtcgttagccgtatgggtacttacaacacttggtattgaatttttacaaattaaaagcaagaaagtcagagatttatcagatggaaagacgacaatcctgatcaaagacggcaaaattttagaggataatatgaaaaaggaaaggctaacgctagatgagctcatggagcagctgcggagtaaaaatgtattcaaggtggcagacgtggaatttgccattatggagaccagtggtgcgatcaacgtgctgctgaccaaagacaagcaggccgtgacgcttaaggatctgaatatacagcaattaccggagaaggaacccacagccgtcattatggatgggcaacttatggagcaacaaatggcatatatggggatcactcaacaatggctggatgcaaagctaaaggaaaagagcctaacggtcaaagatgtgtttttcgcacaggtggacccgcaaggagaactatacatcgatcaatatagtgataatgtacagctaagcaaggtgcaggattcgaatcaagccgtgctgactttgctggaacaatgcacaacggagttgcaaaaactcgcatctggttccagcgagcaacaaagaaaacagctatatgagcaatgctcacaaagcttgaaagaagctatacaggagatgcagccgctaaatacatctaagtcctaagcacatacgcatatgccataagagtagaagcatgggaactaaaaaggagcgtccttcagccgtttatggctttgaagacgctcctttttaacttactgtgccggtgtacatttcacagttgctgctgccttccattactttctggcgcagcggcagcataactgtaaataccgttccttctcccaccttgctggatacagagatagagccagtatgcatctctgttattttataagcaatggacagtcccaagccgctgcctcctgcagttcgggcccgtgactggtctgctttataaaatcgttcaaaaattcgctgctgatcctggtcgttgatgccctgtcccgtatccgcaatgcagataaccgcctgatcaccgttacttgaaagagaaacagatatgcttccaccctgcggtgtaaatttaatggcattgtgaagaagattcacccaaacctggcccatcagatcctcgtctgcattgacctcaactatatctacttcaacagtcatctcgatttttttagcctcccattgcggttcgcaggcgagaataagcgaaattagctgcttgtccagccgataaagggacggacgaaacggatgccgctccgaatccagaatcgccaacttcatgagattatcgcttagcttggatagacgaatacactccgtctcgatgatcgtcaaataccgatctcgctgctcacgatttagattctcgtccttgagcgctttggcgaatccgattatcgaggtcagcggtgagccgatttcatgggatacgttcgaaataaactcctcccgtagcttttccatagtcttcagatttgcagccatatcattgatgctgtccaccaactgtacataaggatgcggcctccgatgttttccgttccgcccgccgaggtcccaatccaggttaatgtgaaagtctccttgcgaaatacgttttaaagcatcgatcatttcggtaaaagcgtgctgttctctaggctggaagaaacgccttaccgtcatactgataataccgaagaagaaaaagcctagcgtcgtattcataagaaagacgaacaaaccatggggagcccatgacatgtgcgaatagatcgcctccataataaagtacgcggcagcccagctaagatatagtaccaatactaccagcaggactctcgcaagaatatggagtaaccccggttccctcttcattgccgtacctccaaccgataacccaatccccggatcgtactgatccggaaggagtggcttgcctccggaaatcgttcccgaaggcgtttgatatggacatcaaccgttctttcgtctccctcataaccataaccccagatctgttcgatcagctggtcgcgggtaaaggttttgccaggatagcttgccagcttgaagagcagctcaaattctttgagcggcagggtaatctccttctctccagcccgacactcaaatgtatcgctgcgcaggacaagatctccgacagttactgattttgaagccatgatacgataacgttttaataaagccttcacacgtgcgacaagcaccatggggtcgaatggcttgacaagatagtcgtccgttccgagcgcgaaacctttcacgatctgtgacgtctcgcctttagctgtaagcataagcagcggcaggtcggtttgctctcgcagcttacgacacagctcccaaccatccattcccggcatcatgatatcaagaacaagcaaatcgaccttgatttgatcaaaaatgcgcatcgcgtccaaaccatccaccgcctcgactacctccagtccttccattctcaaaaagtgtccgaccagttcacgaatatgcggatcatcatcaacgaccaatacacgtgccatttcaatcccccctaactaactctgccttaaatctctcgtcctcgtcaagaagactgccatcttatgctttacgcatataagcacgcaccgtaagcggcgcgaagatcgccacaatgactgtagcgccaagtagggagatcgccagttccccgccaatcgttcccgtattcgcaagctctctgactgcgttcacaagatgtgaaatcgggttggcgttcacaaaccactgcagccaaccaggcattgtgccgacaggcacaaatgcgttggaaacaaaagtgagcggaaacagaacaatcatggagatgccctgtacactagaagcagtgcgagcaatcacgccaaagaaggcaaaaatccagctgactgcccaggaacacacaatgaccagaagcgcggcgatagctacactcagcagtcctccccctggctgataccccaaaatataccccatggcgaaggtaagtacagttgcaatagtataccggatactgtcagccagaagagctccagccaaaggcgcaatacgtgcgattgggagtgacttgaacctgtcgaacactcctttgtccatatcctcacgtagttggacgccggtaacgacggaggtcgagatcacagtctgcacgaggatgcctggaataataaccggcaaataatgctgcacgtctcctgagatggcgccgccaaagatataggtaaacataagggtaaaaatgatcggctggagcgtgacatcaaacaattgttcgggagtatgccggatctttagaatgccccggtaggccatcgtcatggaattggagaacgcctgcctgaaactcacagacttcttcaatgtgcgatcagaacctgtcatagcagtagtactcttcatgctctcgccccctccacagcatgcgctccttgggacgtctgctgcttgtttacttgtgctccatgaccagtgatggacaaaaacacctcgtcaagcgtcggcttttgcacactcatctctgctaggcgaatctctccagtacggagggcaatcagcaggtccgttacccgatctgcattggccatcggagaaataatctttccagcttccactgacacgctggacttgactgaaagcacctgttcaacgatctgaatagccctctcaatgtcctgttgattttgtactttgagttgcagcgtcgacgcccctactgccgctttcagttcatccaccgtaccctcagcgactacccgaccacgatcgatcaccgcgattcggtcagcaagttgatccgcctcatcgagatactgggttgtgagcagtacggtggaaccggtcttgaccagacgccggatcgtgtcccacatctggacacgcgtgcgcgggtctaatccggtggtcggctcatccaggaagattagcggcggcttggcaatgagacttgcagccaaatccagccgtcggcgcatacctccagagaaatgctttagcggtcgtttggccgcttcagccaagccaaattcctccagcagctccgctgccttatgacgcgcctcggcacgtcccagtccaagtagcctggagaagatgatcaggttctcggtagcgctaagcgactcatcgaccgatgcgtactggcctgtcaccccgatcaattgacgcacaacctgcggttcctttactgcatcgtgcccgaaaatacgggccgatcccctatcaggccgtaataatgttgacagcattcggatggtagtcgttttgcctgctccattaggaccgagcaccccgtagatcgtgccagcacgtacattcaaatcgacaccgtcaactgcatgcttatcaccaaaagctttaacgagtccccttgcttcaatggccaaggtctcttttctgtctgtataatccacattcatatcctccctatacggtttctatagagaggataacccacgtttatgaactgaatatgaatagaaccgtttacgttttgcaaaattgatgataatttctttctgacagagaagccaaagaagtccctatttgggacttctttggctttgtccttttaatgaataatggaaaacctatatttccagattcggcttcatgctaagcactaacttggatattgaacctatttacactgtaaaaaaataatctcgttctaccttgctcactcttaaaccaaatgttttataccactcggatttccctttttcctgcgctaccttgtgcagctcgttatgtttccaattttttatagcgtccagagactcccaatatgagactgtaatgcctactccattgtggtcacgaacactttccacacctagaaaacctggctgttgggcagccagttccaccattttgtctcccatcactccgtacccgtcatctccttccgtacgttcagaagtaaagatagccgcataatagggcggacgaggagttttagcaattgagttcatatgcccctcctaaaacaaaattaaataacctttctttaatttgattataatcataaatattaaataaaaaaatgaatatatctgatatgatacatgaatatatttcataaaaaaataggagtgaatacgaatttgtttaaatataagatttttctttgcgtagttgaaatgggaagtttcacaaaggccggggaagttttaaatcttacacaatcagcaatcagccatgcgatctctggattggaacatgaactagggctgactcttctgatccgaggtcgttcaggcatcaaattgaccaataacggggaaagattgatgaagcgatttagagagattgtacaaatggacgaaaagctctaccaagaggtagctttaattaaaggattggaaatcggaaccgtaaagatcggcacattttcaagcgtctctattcattggctgccccgtattctaaaaaaattcaatgagcagtttcctcttattgaaataaaactgctcgatgggaactaccatgaaattgagagctggatagtcagtggggaagctgatttcggctttgtgaacctacccacgttagacgcattagaggcgttgccattaaaagaagaaagcatgctttgtctacttccttccgatcatattcttggaaagcaagcctcaattcgagtagaacagctcagagatgagcctttcattatgcctgttgcaggctgtgacacggatgtaagaaatattttttcacagcataatatgtcacctaaaatcaaatatgaattagaagatgaccatgcgattatggctatggtgcagaatggcctaggcgtaagtattcttcctgaaatgatcctgtctcacattccttacgacatctctattcgacctttggacgaaaggcattcccgtactatcggtatcgctaccgcttccttaaaaaatgtttctccagccgctaaaaaatgtatggactttattactgaatggatcaactagcttcatcatgtcggccaaggaagcggattctcaaaactggaccagtccatatccatttcgttatcgttcagtaggcattcatctagctcttcttccaagtccggtcggttcattccgatacctatcatgacgatttcgttcatgcggtcgccccattgttcatcccaatggttcagagcctcaggatcggctgccacgatctcctgccgttcttcttcagataacgcagcaagccagcttcccgcagggccaaattgaatagatggtcctgcctggctaatactcgctgcccaatcctgcggggttgcaatccaagccaaacctttggcgcgaacgacctcctccggccagtagctcataaattcagccaatctcgcaggatgaaatggccttctacggcgatatacaaaggaattgatcccatattcgtctgtttccggtgtatggctttcaagctccagctcccgaatccatccagcggattgactagctttgtcaaaattgaacagccctgtattcaaaatatccgaaggagcgacctttcccttggaagttcgaatgattcgggcttcaggctgtaatctccgcagcacaccctccagcttgtctagctccacaggctgaaccagatcgcacttatttaaaatcaatacatcacaggtttcaatctggtcaatcagcaagtccgagatatcacgcgtgtcgtcttcaccagtagcctgcctacgatccagtagcgtttctcctgattcaaaatcatgccagaaacggttcgcatcaacaacggttaccatgcaatccagttttgccagcgaagccaaatcaatgccagttccttcatcggcgtacgtaaaggtttgagcgattggcacgggctcactgatacctgtagattcgattaaaatataatcaaactcgccttgttccgtcagcttcttaacctccagtaataaatcttcacgcaatgtgcagcaaatacaaccattagacaactggaccagtttttcttctgttctggacaagccgccctcttttttaaccagctcggcatctatattcacttcactcatgtcattgacgataactgccaccttcattccgtcccgattgtttaatacatgattcaaaatcgttgtttttcctgcacccaaatatccgctcaacacggttaccggtattggtttcttattcatcgctggtacgctcccttgaatattaacttttcattcttttaaatcgtaataattactattaacattaactttcagtaatatacagcatcccttttgccttgtcaactgtgaagaaactcttgaaatgaataatctatccattaggtaatcgcaaaatgatggaagtctgtgcggggcggttagaagcctatcagcgtgtgctcgggatgactttagccagtttgcccttctggttattgctttcgttatatggagttttcagcgcgggaatgccaagtaaggatcagacgattcagtctgctttggtagctgtgttttcaggggtggtcgctacggttttattttttaaagctacaaatcaggttcgtggaaatatgcaaaagctggtgacggtagaagcgacacaatctctggaagtgctttttgcattaatgggagaattaatctttctgtctattctaattccatctcctttatcatggatctgtatgttcatcgtcatcttcggcatgattctacacagttatgttacagatgctaaaagctttatgtaacttcaggcattaaaaaagaccgcaaaatagatgcggtcttttcaaatttcttgaatcgaacaatcttacttttctacattttttttgaattcgcttataaagtctttaggatctgattctacagtataaggaaatacgccttgtttcgtatgcaaataaagaacaccatgaccctgcccgatacttttaaacgatatatcatatacctcattgagagaaaactcccggtacgctgatacaattttagttgtatacaagtgtaaaactcggcgatgaatgactgtttcctgttttaacggagttacgatcctttccgctttgtaatacggctggactgaaataatattgtgcacatgatccctccacatttattatcaatccagacggatatgacgcaaatcccgcactatgggttgctttcattttggttgttttgaagatgtattttgttccaatatcggtgccagatcatcctgaacactgttcccccataaagggactcccgaacggtaggcagcccttccatttagatgtccggctacgggagaagtgataaagacaaacacaatggcaagcagtaatttgatgctgaccacgtctacataaaacaaaaaataaaggaaggctcctgttaatacgcaaagcacgccaagcgttgcacttttggttgcggcgtgagaacgtaaataaacatctggcagccgaatcaatccaaacgcgctcaatccacagaacagagcgccgaataaaacaaggatcgcaataagcaactcaccgatcaagttcatcccccccagtatctatgacggcgtctctttctatatatctcgccaacgccgttgttcctataaacgtcaggattcctataacaagaacaatctcaataaaatcctgtgtcctcagctgcatgcagatcacagcaatcatagctagcagatttatacctatcgtgtccagtgcggctaccctatctggacgggtcggtcctttaatcaaacggtacaagcaacctaatatggctaaggagagaatagccagtgatgcagccaaaagtgccgaaactatcactgtgtcacctccatgatcgctttttcaaatgtccctctaatttgctcagaaagcagtgtcgcgtcctgtatgtccatggcatgaatatacagcatttgaccttcttcggatacttccagagtgagcgttcctggtgttagacaaatgaggcacgataaaatagtgatctcccaatctgactttagggcagtctcatagacaaaaatgcctgggcggatggtcagcttcgggcggagaatatgatggataaccgcaaagctggaaacgatcagctctcgcataaacagaagtagcagcttcaggatggcccatatgcgcttcaggtagaaaggttctggacggaatttacgcaaaacaagcaatatggctatccctagcagaatgcccatggtgaaccgcgaccctgaccagtcgttgttaagtagcatccacagcaacgcaatcatcagatttaataatatttgaaagaccatcttcatctactcctttattacagcttcgatgtatagcgcgggatgagccagcacatcaccggcttgtgcaacataggaatagacccaatccgccccgatgcccatcaatataaccaggacgagcaaaccggccgccacagcattcacactttttagccttatcttcggcaggtcgccttcgggttcattcccccaaaatgcaagcttgaatactttgatcagcgaatacagcacaaggaagctcgagcctagcccaatcaaggataatgtcaacattccggcatccagtccgccccgagtgatcaacactttaccggcaaacccgctaagcggtggaatacctacaagtgcaagggccagtataaagaacatccagccgattaagggatagcgtttgatgaggccccccatatcttttaattggtccgttcccgctgcagtgataatgatgcccccaagaataaacattaatcctttcgccaacatatcgtgcagcaaatagaaaaccgccccattcaatgcatctggtgtcgctgcagccagaccgaaggccacaaaacctacactgataatgacgttgtaattaaagatacgaggaatatcgttataagctaccgctcccagtcctcccagaatcatcgtagccgccgccagccaggcgatccacgtatgcgtgagtccgggatcattcacaaaaataagagtaaaggtccgaatgattgcatacagtcccacttttgtcagtaacgcaccgaacaaggcccttatagcagacggcggcgcactgtaagaacccggcagccagaaaaagaggaataaacccgctttcaatgcgaacacaatcaggaatagaacagcgatcacattgagtacgccgccctgccccgcttcagcaacccgctgagacaaatgagccatattcagggtgcctacagccgcatatagataagcaactgccgccacaaaaagtgtggaagacacaatgttaatgagcaaatatttggacgtttcccgaagttggagcttcgttccccccagagaaatcaaggcataggaggaaatcaacataacctcaaagaaaacgaacaaattgaacatatctcctgtaagaaatgatccatagacacctacaagcaggaagtgaaaaaaggtatagtaataaaaacgttcccgttctgccccaatactgcggaaggagtagagaagaatacccaagcttaccactgaagcggtcagcacaagtagagccgcaaacatgtcccccacgaacacaatgccatacggcggcacccatcctcccatttgcaaagtttgtataccctcgctatgaacgcggtaaatcagcacaagagcaatcataatattcaaaatggcgctaactgtactaatgaaccgctgaagcagaatcttctccttcagaaaaatcaatataacggcggtacataagggaattaaaatcggtagtgccaagagattgctcattgttcttcccccttgacactgtcgatttcatcggtgcccaacgtctggtatgagcggtaagcaagcacgaagaaaaaggcagtgactccaaaactgataacgatagaggtcagaattaacgcctgcggtaaagggtccacataagtttccgctttacctcctaatactggagcagctcctgtctttagtccggccatcgtcagtagcagcagatggacgccatgtgttaacaaggaagtacctaaaacaatacgcaaaagacccttagatagaatcaggtacactccaattgtaaataaaataccgactgctacagccataatcagttccatttcactcatccccccctatggtaaaaataatactcatggtcacacctactacagccaggtatacccccagatcaaagaggactgctgtagccagctcggtatcccccataataggcagatcaaagtggccaaaggcatggctgagaaaaggggctccgaaaacaaacgagccagccgcagtcagaattgcaatgagcagccccaccgccgtgatcatgcggtaattcaccggaaggactttacgaaccgtgtccattccgaaggagatcgccatcaaaataagcgcagctgaagtcatcagcgctccgatgaagccacctcccggattattgtgtccggcaaagaacaaatacattgagaaggtgagaatcacaattatgataaccttggacagggttcgcaggatcacatcattactctgggacggaaaggcaattcttcctcccttcttatttttgttggcgggtgaaatgccgggctccattttcaagttaatcaaggcataaatgccgagggatgcaatagcgagaaccataatttcgaacaaagtatcgaatccccggaagtcaacgagaatgacattgactacgtttttccctccggccaaggaatagctttctttaaggaaaaactccgaaatgggagcgaatggactgctgcccatggctgccagcgcaatgagtgttatcgtaattcctacacccacagcgataatcaaattcggcaatctaaagctcggacgctccttctccttctttaactttggaagatacttaaagcacagaaggaacagaatgacggatactgtctccacgatcatttgtgttaacgcaagatccggtgcgcggaagataacaaacagcagggtcaccatgtacccgactgcaccggtgaacaaaatcgcgttgacccgcgacttagcaaagggtacggcaaacgctgctagaagcattacaacaacaatgacagcctcataaaaggttaacggagcatagtggatcatacccagcgatatcccttgcgtcccaagcatcacacttcccaaggcaatgacgaaaaagccaaatatataaagcaaatagtgtctgtttgatcccgtcatatagagatttgtgaagcggttcgatccacgttccagcacttgaagagatccatcatacatgagattaagaaaattgctaccgttccattcccgatccagaatccgcagtcggctgtatcttctatagagaagtgtcccggcagcgataacacccagtgtcatgaatatctcaggtgtccaaccatgccagaaatgtatggagacaccaaaggtttccactggcgacaatagctcgttatagatcgagcccatagccggctcaatcagagaataagacaagagatcaggaaataagccgaataccacagcgagtgaaaccagcaggactggggaaatcaacagacccagcggcgcttcatgcggtattttatcgagcttctccggctgaagtttaccggtaaaagtcttaaataccagaatcatactataaacaaaagtgaatacactggcaatccatgcaatcaccggaattagaatcatccacgactgtgtattcagaacatccaactcccgaatatttaacacagcggtaaagaacatttctttactcagaaaaccgctgaatggtggtaaccctgccatggagaaagcccccatcaacgccacagaaaaggtgactggcattaaggacattaaaccaccgagcttgcgcagatcccgagtgttcacctcgtggtcgacaataccaaccaccataaatagagagcctttaaagacggcatggttgatcagatgaaagatggccgccgcagtagccgtcgtatagaataacgactcctctgtaccagaaaaaaaggcagaagccgatcccagcccgagcaaacacataatcagaccgagctgactaatggtggaataggcaagcagagctttaagatctgtttgtttaatcgctttaaacgatccataaaaaagcgtgaccagaccggaaagtgagaccaaccagaaccattcggactgaccagcgaatacggggctaagacgcgccacaaggtataaccccgccttaaccattgtagctgaatgcagataagcactgacgggtgtcggtgcctccatggcatcgggcagccagatatgaaaaggaaattgtgcggacttagtaaatgcccccagtagaatcagcagcatcgccggaataaacaacggggactcggtcaataagccgacttgggctataatctcccgaatgctgtacgttccactcattacgtagagcagattgaaccccgcgaacatcgacagcccgccaaagacagtgattagcatcgacttcagcgcgccataacgggatctttcccgccggtgccaaaaggcaatcaacaggaatgacgtaatactggttaactcccagaatccatatagaaccatcaaattgtcggacaaaacgacaccaagcattgctcccataaacatgagcaaatagatgtagaaatggcgaatcgcttccgtccgcttattaagataataaatggaatacaagatcaccagcgcgcccattcccgtaatcagcagagcaaacagcaggctgagtccatccagatacaacgtaatattaatcccaagcgatggcatccaaggtatagttgacatcgtatcatttccagcctgaatgtccgatatccttgtcaggaaatacaggaaaagagctgtgggtaggggcaagactgtccaacctgtatgaaagcgcgaaatgcccttggtcaacgggattagaacagccagcagaaatggaatcaaaattgcagcatgcaacacagtcgagcactccccctatataaacttatttttttgtatatgaacttctaggaatgcggctttatccattcactttgtagaattctcaaatactgggcttcgccatttctaacgattttgaatagaccgctgttgaaatcagtatccagctcacggaaaaatatcccttttatcgtatcttctccaccaggctcttcactcagtacataacttccatcctgcttcaccaaataagcggaaaatcccttctcatgtgagtgctctaaaagctcgggataacgctgtacagccacaatatgaagatcaataggacccagttgttcaatcaaatcgttgacaaaattaccacgggtaatctcttgccatagcgtttgactggactggccgatgatgatttgagtaacctttttttcccgggctgtctccacaatcacctcagctgtctttttcccattgcatttacgaatcagaaacgctcctccagcatttttagtctgctcttcccatcccgagaggtattgttccttgttttggttgtattcatgatctgtggttgcatccactgtaagcacatataaaggagccccgagaaaccgggacaactcgctgcctctttgaattaaccgctgtccgtgcggaccataatggacacacaccataatgctctcattgttcatctccgccatcattttctctgcctcctgtttccaatttacgaaaaaaacacaaaaagagcccgctgttggcaggctcctccgggtaaaccaatatacaattagttttaattatatagtttaccggggagattgtaaaggtaaatccttttgcgtatagcacctagtataaatggagaatctttatacaaaggagtggttaacatgttgatgcgcaaagtgatgatctgcaccagtctctttatcctgttgcttgtcgtgggttggagacttgaatataatatccatgcaaaaacagtgaagagcaaccaaaagttatcagcaaatgaaagttacaaattccgatcagccaattttgctgaacctgttctaataaacattccctttctcccccgggagtatgtacggatcgtacgaaagattagcgaatagttgttagcttttccaattagctttaatatgagcccttgacatagccgttttaccaaccacgatttaggatgagagactagtacaaaaacagcagatcaaggagactattcccgatctgctgctttttgccgattatttctcacaaagaatgatgctttataacgagtacaaagtatgattaccaagcgtaggcttctggcgcaggttttcccggaccggggaaaatctcattcagcttggcaagcacatcttcgctcaatttgacctcaggtacccgtagagcatcctctaactgttctaaggtccgtggtccgataattggagccgttacggccggatgggacagtacccaagccagtgcaatcacgtcttccttttcacccagctcgcgggacaatgctgcaaattgctccagcttcgcacgattctgctccaccttttctttggcgcgtgcgctgcgagaaccagtacctgctaacgcattccgtcccagcagtccgcccgccagcgggctccatggaatcacacctagacccaactcctgagctgccggtaacacttcaagctcagcggaacgttcgttcaggttatacaaatgctgctcggatacaagccccagaaagcgtcgtgccttcgcttcggcctgcgccaccgcaatatgccagcctgcaaaattactggaaccgatataatcaacctgtccccgatccaccacggactcgaatacgccccacagttcatcccatgacacattacggtcaatgtgatgcatttgatatagctctacatggtcggtttgaagacgtttcagcgaagcgtccaaatgacggcgaattttgtaagcagacaagcctgatcctgcattgggtccgtcatgttcatttttcatatctccgtataccttcgttgccaacacgactttctcgcgtcttccgctgccctgctggaaccaacgtccgataatttcctctgtccaacctttacgatcatggccatatacattagctgtatcaaaaaagttaatgcctgcatccagtgcggcatccataattttaaacgcatccttttcttcggtttccggtccgaaattcatcgtgcccagacataaccgactaaccttcaagcctgactttcctaagtatgaatactccatactatctcccgcctttgcctaaggattttaaaattccgcaaaatgacatgccaaaaaagaccatactccgtttattcaccaaatcaaactcctttgaaacacctcaaaatcaatttaaagggatagcgcatgcaaaaaagccccacgcaccgccgaagcagcaagcgcgaggccatctccccttatactacccgccaaatattaaaagaagtgactttacggtggttaccagcggagcggagaatttgaatctggagaagcgaagcgttcgcctttgccacgggattcttaccttttcatgtctatctaatccaaagaatcccgtggcaacagcgatcgtaagatcaaatccttcgcggagcggctcacttcaaccaccgtaactcactttttttacaatcaaggaatcaatttcgtttcttttgctcgctcggccatttttttcgtatgcttgctgagcggcttcttaaacaccaatccaaacaggaagcaaacaccgataaatacaaacagcatcaccacatcccgtgtcaccgttgaaggcaacatccctcctactgtctctcgtaacagactaaccgcataggtgaatggtacaaacggattcagcgcctgaaagaacggtgtactcgtcgcaatcgggaatgtccctcctgaactggagaattgaagcaccagtaggatgactgccagtcccttgccgatattgccgaacacagaaactagtgtataggtcatcgccgtaaacaccagactgatcagcatagaggacagtacaaaagctgctttggcatccacatacgccccgagcaggaacaagtcaccgagagatacgctcagcgcctgaaaaataccaatcgtggagaatgtcataagccgtccgaaatacacttggtagcttttaaattgtccttccgggtcatccacatctaccctgaacatcgagaccagtagcatcgcacccacccaaatcgacaatgtagtgtaaaaaggtgacatcgccgaaccatagttggggattgggtatatccgttcctgcttcaacgatactggactgccgagaaaatcactttcctttttcacatctcccttgagcaatgcaatagcgcgtccgagtgcattttcgcccttaagcttgcgaattgtgtctgcagcctggcgtatggaatcctcggcagctggaagatcggtccttacaaaattggctacttggtgtaccgctttttcagcttcaggaaatttattttcaattaaatcagccattttgacaaactgttgttccactttgggcaaatcattacgcacaaaatctgctgcctgatgaattttatttttaaccgccggcaaatcgttatttacgaagtctgccgctttgttcacagcattcgtaaactcgcccatacgtccctgaatcgtcgtcgccgcttcatgcagtttttgacggtattgtggcagatcctgctggagacgtgttagctcttgctgaccgaattctgctgcagcctgtgcgtcatttaatagcttttcaatattcggtagctgctcttgagctgtagtcagcacattggcagaattgcgggcaacggatttgacctgatccagcgccttttgaatggcgggtgcatactccgtatcataattgcccaaaatgctgtcaattccgctactgatttctcctgccaggcgatcagtgtcatccagcagattttgcgcaggcttttcgccgcgctgaatggcatccccgatactagttactgtgctattcagacgacggaaacgatcctccaccccgctcacacgggaaataagtgaatccagaggttgacttggcaaatatccgttcacacggttcagcaattgagaaatatgatccagcactcccacggcagttgtcagcctaccgctgacacgtttcaccgcagcttgtgctgctttaggatcaaaatccacaccacgaatgatatctgtaatctgagaaacttcattcgcgatttgttgtaccagctgtaaatcttctttaactactgtaccaatcgaatcaagcgcgccctcgtttttgtccagaaattcaagtaaaccggttgtaaagtccttgcctgtgtccgctattttctgtacttctggcagtgctttctgagcagcattaatgaccttaagggccgtttgcgtgtcctctaaagcggtagccagtgcgctttctaccttgctgaaattttgatccagttcaacaattcgatcaccggccttttgaatatcaggtagtcttttttggatatccaaaataacagtggctaccttgtccagctcaggcatgtttttgtcaattttgagcaccaggtcaccggcacggttaatttcaggaattttctccttcaatgcaatgatcttttgtccctgtgcctttattttcggcaaattttgctccagttccaatgcctgtttgcccaacctttcgatatccggcaatcgattattcagctccaacacccggttctcaatgttacgaatcgtcgggagctcctcctccaacttgactccggcttccttcaacttcgtcaatacggcctggctggcagtttcaataaagttttggctaatctggttcgtcagagaggttgcccccgaagatgtaattttcggagctactgcattaattttttcatttacggcgtaatcaatttccggcttttgcggattttccgtcagcacacttgtaattttctctgaaaaatctttcgggatcagcaggctggcataataatcaccattcaacacaccttttcgtgcttccgcttcattgacaaaagtccaacccagcttcttgttattttgaaggttatgcaaaacctcatcgccgatattaatctttttaccattcacttctgcaccctgatcttggctggttactgcaattttaatcccagatgtattcgcatacggatcccacatcgctttcaaattcacccatgcataaacggaaggcaaaagaatgatgccaatgactaataaagtcccggtcgatactttgaatacatttctccagtctgttaagtagatttgccatatcttccgcaacttcatcactcctcgtatgtacattaacctgtcgtccattgttgtatgcacacgtattgtaaacgattcgagcgaatgaagccaatcctgttacaaaatatgtaaaaagcgtatggcacttatagagatcatacgcttttcaataaaatcaatctgcttaatttcgaactccattcgcgagcatagccatagtaccgtttaccgtccaagcgtcaaaagaggtgtctgcacttgtaaactctatcgtttgtttccccgctaattgtgttcagcacatctgttaaatgcttagtggcggttgggtccaagttaacagaagtttgtgcgttttgagctatgacagcggcgggctgctgtgcccttgcaactggaactggagccgttcccaaaagcatggatattgccacaactgttgcagtgacagagctccatttattcatgggtcgattcctcctgacatctcaattgggatttttgtcctaactcaaagaagcccctcaagccttatttttaggctcaaggagcttctcattcactacattatccattcttcagcagtctggccgccgaaaatgctgcaccatgacgcaacttccgcttttccaaccgtttgtgcagcgaacgattatacagaacctgaatgacaaaatacgagataatgcccagcaccacaccgaaaatcgacatgccgatcaggatgtgcaagcctccgtggagcaagtctctgaatacagaccagttgccgtgaaacagctccataaaagaatgctcgtggagtcgtccgcccctgacatgtaccggataatgagatggataaatccaagctcccacttgcttggcgaatggcatcagtacaattggtaaaaaggtcagcttacctacaacgttacccacaatggcagcaggcagcgagccaccagagagacgaacaatcggataaaaaacaaggtataccagagaagccgtggaaatcacgatcatctccaacgcaaagccaatggcgaagcccaaagaaatctttttaactccaccaggggcgcgtaacagcttgatgaaattcagccgaatcgcacgccatatattttgaaacatattatatttcttcttcgatttatgaggtttgagccttttcggattgagctttatcaataggaggactccttcaacagtactattcaagttcaggaatgagtcaatacagctcccatccttacttatgtctatactgtcattataaccctcagcgttcgaaaagcaatgttattccgcctgtttcgccgttttaggacagaattcacttgttgacatcgttttggagaggtacaatgtcccaaatctcagccgcgtactgctgaatcgtacaatcactagaaaatttcccggaatgggccatattcacaatagcacgccgagtccactccgagggattccgatacacttgttcaatgtgaacctgtgtatccacataggatgcgaagtccttgagcacaaagtattcatcattatgatcaatcagggattgataaatggcctcaaattcccgttcatgccgagtaaaaggagcatcgttcacgagttgatccaacacttcacgcagtctttcgtcactgttggctgttttgcgcgccgaatactggccgtctcggtaatatgcctcaatctgatccacctttaatccaaaaatgaacatgttggcatcgcctaccatttcatgcatttcaacattggctccgtccaatgtacctattgtgagcgcaccgttcatcataaatttcatgttccctgtgcctgaggcttccttgcctgccgtggaaatctgctcactgacatccgccgcaggaataatcagctccgctagcgagaccgaataattttcaaggaaaacgactttcagcttgtccttgacatctacatcccgattgatcgtgtccgccacgttgttaataagcttgatcgtctgtttggcgagaaaataaccgggggcggctttggctccaaaaataaacgtgcgtggcgtcacatccaggcccggattacttttaagctgactgtataaatgcatcacatgcaaaatgttgagcagctgtcgcttataaccatgcaaccgtttgacctgtacatcaaaaatggaggacgtatccagccgcacgccctgttttgcaaaaacatgctcagcgagcctgactttattatttcgcttaatcgtctgtatccgttctttgaacgactcgtccccactgtaacgaagcaggtcgatgagctcccttggacgggtcctccaacgtgtgccgatggtctcatcgtacaagcttgccagctccgggttggcatgtattagccagcggcgatgggcaatcccgtttgttttattattaaaacggtcagggtacagctcgtgaaacgacttcatctctcgttcctttaatatttgcgtatgcagcgcagctaccccattaacgctgtagctgccgacgattgccaagtgagccatacggatttgttcaccgtgaataatcgccatttcaccaattttgatgtcctgacccgggtaacgctccagtagcatagcgcaataacgtttgttaatttcttcaatgatcaagaaaatacgaggaagtagctcccgtaccatattgacaggccattgttccagcgcctcacttaatatcgtatgatttgtatatgaaacggttcgcgtcgtaatatcccatgcatcgtcccagcccaagcccttcacgtctatcagaatacgcatcagttccggtataaccagcgtcggatgtgtatcgttaatgtgcagtgctattttatcgggcaactggctataaggtaaacgaagcttctcgaacgtacgcaaaatactttgcaatccggccgagcacaggaaatactgctgcttcaagcgaagcagctttccctcataattggagtcatccggatatagaaatgccgagatggattccaccgatcgattgtagtcgagaaagcggtaataaccgccctcgcctcgaatcggtcctcgaacgggatcaagcgctgattccgcactccaaatccgcagcgtattcacctgcgcatgaccatagcccaccagcggaatatcgtaagggacagcccagactgtttcggcatcctgtgtctcgaatacaagacgtccctcctgttcacgggtttccactcttccccaaaaatgaacctcgacctttttgtcaggacggcgttcctcccagacattccctttctgtagccagtaatccggcagttcaacctgattaccatccacaatacgctgttcaaacagaccatatttatatcggatgccgcagccatgtcctgcatagccaagggatgccagcgagtccatgaagcaagccgccagacggccgagaccaccattgcctagccccgcgtccgcctcctgttcttcaatttcctccagatcccagcccagttcacccaatgcctgccgaaccatatccagtacgcccaaattcagcagattactgcccagtagacgacctatcaaaaattccagtgagaaataataaatctgcttctcttgtccttctttgtaggcttggttcgtttctgcccaattcttgccgacttgttcacgaatcatgccacccaaaaccttatatacgtcttccgactgagcctcctgcatcggtttgcccagccttccgaccagttgctctcgaaaagcctgcttaaaagcttctttattgctgaacaaagttgtacctcctgttatttccgttttaatggctaagtatatcctttaaattacgctattcttggcaatgacatagggaactctaatgtctccaatcagagttcgatctggtgaaagctgtacatctttatctaaaaccacattctccacaactgcccctttacggatgacacatttttgcataataatcgagttgcttacccgcgcgccctcctccacccgcactccacggaaaagaatactgttctcgaccttgcccccaatggtgcagccattagcaacaagcgaatgatccacctcggcgctgtgcgtataacgagtcggggcttcatacttgattttggtatgcaccggctgattctgaaacagtgcttgatactgctgctgatccagtagcttcatgctatttttatagtagctctcgatagaattaatgactgcatgataaccttcataacgatacgcataaatgcgcagcccacttgggtttttctggatggcatcgcgaaagaaatgattatcctgatgggctatgcaatgcttcacctgatccagatacaagcctttgtccatcacgaacatttccagataaatattatgatgatcctgctcctgatgaataccagtcacccgtccgttttcatcaatctccagtcgtgcacaaggagcatgctcagattcgagctggtctatgggtttatatacgagggtaacatctgcatttttctcccgatgataacggtatacatcctcgatatcaaccttattgacatgctgagttcctgcgtgaacaagggtttgccccgatgagcgatgaaaaaaatccagattgttgtgcacatgctgcaaatctccacgtgatgcatccgtcggatcattccagtccggtggcaaaataaacaacccgccccgtctgcggtctaaatcccaaggccgaccttcacccagatgatccagcagcgaacggtatttgcggcggataaacagtgcaatatcatgcacccctgcatgcatcatgttggataaggtaaaatcaatgagccgatatcgactggcaaagggaactgcggccccgcaccggaaataagtcaactccttcaactgatccagttcgtgatccaggttgataactccaatgagtcggctcatagcagacaccgtccttatccgggttaaattcgtgcatgaagctggctttcctgatcgaacaaaataatctcatcagaactatcttcaggtccgataaacgcgttgtcttcaataacgatgttctcattcacgatagcccggtggatacgtacattgcgcccaatttttacgttcggcatgatgacagaatcggtaataacgcttccttcacctacttcgaccccataaaatagtacagaatgccttacttctccatctaccatgcagccttcatttacaatactgtttttgagaatcgcccgttgggttatatactgggccggttgattgggactgcgggtatagatgcgccaggaaggatcgttcagatccaaaggcggatcctgaaccagaagatccatgttggactcccataagctctgaatggtacctacatccttccaatacccggcaaacggatacgcatacaacgaccgaccatgctgaagcagcaacggaatgatatccttgccaaaatcatgtgaggattcagaatcgcttgcgctttccagtaaatagcgacgcaacacctcccatttgaacaaataaatgcccatggaggccaatgtacttttcggctgttcaggcttctcctcaaagtcatatattttcagatcatcatcggcgttcagtatcccaaatcgttgggcttcctgaatcgtgacattgatgacagaaatggtgcagtctgcttccttctccttgtgatagtggagcattcgactgtagtccattttataaatgtgatcccctgacagaatgagtacatgctccgggtcatactgatccaagaaatgcaggtttcgataaattgcatccgccgtgcccctgtaccagttgtttccattttctttctcgtgcggaggtaaaacgaacactcctccatccaggcgatccaaatcccagtcgctgcctacgccgatataggaatgaagcaccaacggctcgtattgggtcaacacgcctacggtgtctataccagaatgagtgcaattactgagagggaaatcaataatgcggtaagtccctccaaaaaaaactgccggtttagctagtgtacgggtaagtcctttgagtcttttgccttgtccgccggcgagcagcatggcaaccacttccttctttctcataacaaagacctccctgtcatgtgcgtctgaagcaattgtggcgggatatttgataatatccattaaacatgaaaagacagtcgtaatcgtttcattggcgaaggaacgggtaagatgtgatggagaagggtaaaatcatagttatgcggaacgagtgcaaggaatcactaaatcgtaaaatcccgttcatcttttcacattttggatacttttaaagtattcgtgtatgacaacatgatcataaggaggcgttattcatgaagaataaaaaatgggtggtagcagcattgggaatgggtgttacgtatctgatgaaaaataaaagggcacgcgataaggtattgaataaggtacagaccattgtcaatcgtgcgaaaacatctgcaaaatcgtagaatgttaaaggtagaaaaaacgagcctctctgaaatggttcagggaggctttgctctgacttttttctgcgtctacgaacaaaatatggttcgaggttgtatccgtagacggtcaggcattctccttatgttcttctacttccatgatatgttcaacggtaaaggttcgatgcgtccattcggaagaacggtaagcctctaggagaccaaaggtatgaattttctccttgtccacctgcttaaaggtatgagtaatccctacctttcccctgaaaggaaaaaaggaaagacctacagtctgatccgatagccactcggcccaaactcgcccgctttcatgtcgaacagccgggaagcttaaaccttcagcaaaccattcataatctgctgtaggcgtacccggttctcggctgcacaaaaacagactcaattcgtcgcaaaacaacattctccgtacatccgtccgcacttgatggtcgaaggttacgccacatgccagctcctgtttgagcctctgccgacgctgttcctccgcctcctgataagcatgcgtaatctgcttgtcctgagcgttttgatgctcggtccgtccgactagctccttgtacatcaagctacacagtaacgccgcatacatacttccttgttcgacttcatcaatcccaagacgatagaaaacaaaacgtggactgagcggaaaatcaataaatgtataaggtgcagacacatgatcattccagaaaggagcagcgtctaactgtatccaaccccgatcatgctcccttgctgcatatacaaaatcctgcttatgacgtctattcttgaaggcactctcttcccattgcgaagccaactcacccgaaatatgggcatggtcatgctgcgtcgtcatgatataagcttggtccgtttcataaataaccatatgctctccccttccgttcggcgattcgtgtgattgtgtacaaactctctgatcgaaggccatggttatgcttacgtttattatatcaggataagggtaaaaaggcaggcgagttttccgcctctttatatctaattacccttttgattctgcactcgaaactgctgtggggtcatcccctccagctcacgaaacactttgttaaaatgctttgcattgtcaaaacccacgttagccgcaatttcataaatcttgcccccttgacactccagcagctttttggcttctgcaatgcgcagcctttttacatattgaacaaagctaaggcctgtataggctttgaaagcctgactaaaatacgtataattcaaggatactgaattggatactactgccatatttaaatcatcgctgtaatgagcatggatgtattggatagcacgtgtcatgctaccgtttctatcggggatgacactcgcgccaaccagtctatctttctctacgctgacagcactatcgtctatgaggtggttcctctccttcaattcctcattcaaaactgccagcgcaccaaacagctcctcccttacaatcggcttgagcaaatactcccgtgccccgcagcgaatcgcttcgcgcgcatactggaactcgtcatatccactgagaatgatcaccaaaggtctgcgttccggctccagctcgcgaatatgctgcatcagcataatgccatccataacaggcatacggatatccgttatcaccaactcgggcaaaaactgcttcacatgctgccaggcttcccttccgtccttgaccagtacacattcatagagaccggaaaattcccgttcgatcatagcttgaagtcccattcgaatatttttctcgtcatctgcaatcaacagcttggtcgtcatggtccgcccccctcatcatgtaacgtctaggcaaaatcagggtcactgtcgtcgattgtccggggatgctgtccagtcttatgccatactcttcgccatactgcatacttaaacggcggtgcacattatacaaaccgattcccccattcatcccgggctcgtgggaatccatatccgttcgcgctagaccagccatgatggcgtttcttctttcttcagatatccctactccgttatcctgtatacgcagttctatgatatcctgcttagagcaggcttcaaacgtgatgctgaatgggctttgcaatgtattccaaccgtgcttgatagcattttcgactacaggctgcaacgacattttcagcatctccagttccataaacgtcgacgatagatgaatttccaatccaatttggttatcgtggcgaatgttcatgatggccacataatgctgaatatggcggatttcatctcgcaacgcaacacatgacccggaccattggagattgtaacgcatcatcgacccaagggaggtaagggcatccgacagcggatactgccgttctatctccgccatcatttttaaattttccaatgtattatagagaaaatgggaatcaatctgatgcttgagcgctagcagttcagcctcctgagcagcggcctgcttgtgtactgcctcggcaatgagtccgttaatccgacttagcagactgcgaaaatatagagccagctcagccacttctcctcgcccatatactggaatactaagctgaaagtcaccctcctgctctacttttttcatggattcacgcagtgtatgtagctgcttgagaatgaaggcatgcagggtataagaaatgacggacataaacacaatcagcatactaataatgagcagcatggcattgcgtttctgacggagatcacccagcggatcgtccagcgctaccacatttagcaaataggcgtccaacccttctatataacgatacataccgagataaggcttattctcaaaggaaaaatcaaaagcaccacccggtccctgaacctgggactgaaacagatggtgcacatgggacagagggatggaaattgaatctgatagagaggaagctgtagctatatcgctagaagacattggtttgtcagcgttccttgcgctggaatcgccgaccagaatgaacatttgccatgcacgatcacgttgtgggattccaaatactctaggtgaaaatagctccagcctcatgtttgtttctaccaaccctgcgtgccttcctccggtagactgaatttcacgcagcagtgccatatactgcactgtctcactttcctgccgggattgccccagaagtaagcttttcggccccttgtacatttcccaccatattttcccttgtcggagttgggccgttttcagccaggaagccttaggcaatcgtgattctttgaaaatcatcggccatatttcatgcgtctgggcattattggtatacagtcgaatgttctctacattgggattactgtacagcaagtgctgtaaatttggaaacacattcaagttgaattggaccagctcatcgctagttatttcacgttcctcggtcagataacgaagtacgttgcgatctgagatcgcaagctgtgcggttcgctccataatttccatattgctgtgaatatgggccagctctgtatccaacacatactgattttgtacggtgatgtcgtgcatggtattctcgtacagttggtgaaaggtatatagcgagaataataccaccggaattaaaatgactccgatatacgcaacaatgagcttaacttgaagggagcaaccgccaagccgatcggccgtacccttcatccactgccatatagtgcggcgcagcaggctcttcatctgtgaacgtgcacggcctggcatgaaatcacatccttaggggttcaatagattaagtcattgaattaaatcatttggtgaactgttcaattttcttaaggttttcctcataggctttttgctgatagaccataactttgtcatatcctgcttttctgcggtcttccaaaaagcgagcaaacagctggtcgaattcctcatctgaggaagccagtagcagcttcggcaatgtcttgccccaaattttatctatctggcctgacgcaatgccctctgccgaagttccagtcggtttaatattgtcatattgggagaagcctttcgtctttcctttcgtccaatcctctggctgcttatacggctcgacgctgggcggcgcccactgcaaattcatattcgtatccatcagcatccagaaggtgaaggaggcgccatattttttatcaaaagcagaacgatccttgttcagcagctcctgtacctccggcttgaaggctggcttaccgttaaccatgtcccatagcttgccctgctcccccagatacaggtcacgatttccttcctcgctaatcagataagtcagaaattcaatagctcgctccttgtctttgacatccttcgaaataagcgtcaccgtccagccggaaatacccggcccggccagcgtcggcgggtccagcttactgttcgaaggtccatccaccgcgatatagacggagttcgggtccttcgcatataacagtacctgttgagtggcaaagtcagaacgctgatatagcatggcaaaatatcggccctgtgccaccttttcctccatttgcggacgtttgtcgataaatacgtccttggcgatcaggccctgctcatttgcttgacggaatgttttgagccagcgaatatactcttcgtccgaacgacgatcgtatagcttgccgtccttttcatgaggaatggctaggaaattgagtaaatagtcttcaaaagaataatttccgttatctgtaaattcgtgaaatcctatcgggataagaggctgaccgttcacctccggaaatttctctttcactttttgaagcgctttcaaaaatccttctggtgtcctcatatctggtttgccgatcgcctcgtacatatccttccgaaccataaacgtctggttggacacaaaattttggccgtatttttgataatcctgtggcgaagaagaagcgttaggatacccgtatacattcccgtccgtttggcgataccaggacattttcgccggatcagctattttaatcagatacggatcgtatttctcggccagcttgttgagcggaagcaccatcttaccctcgatcatttttttgaccgcgtcctctccccaacccagcgtgacaaaatcaggtagcttgccggaggccagcatggtattgagcttttcattttcattccctgcgggtacgataaaattgacgctgaccccagtcttttgcgtaacatactttgaggtcatatccgtcccccacttgttcgggaaccaggaaaagttcaaataccagtcaaacgttatcggctccttatccgccttccatcctggtacatctgccgtagccttggtcttctcgtccttcaattccgtgacagtaccgcctccaccggacgtacatgccgcgagcaaacccaccagcagaacagaagccaacagccccttctgccatttgcgaatgttcatcataaatctcccccttggatgatgtgctatcccttaatcgagccgatcatcagacccttgacgaaatatttttgcagaaaaggatataccagtacaatgggcagtgtcgtcacaaccatcgtcgccagcttgatcgattgcgaagtgacggactgggcaacgacccccggtgcagcagccatcatctgattagagctggattgggcaacaacccggtacaaatacgtttgaatcggctgaagatccgtattattaatatagatcattccagtaaaataatcgttccactggtataccccatgaaacaacgcaatcgtcgctactaccggcatagatacaggaagcacgatccggcaaaagataccgaaatcgttcgcaccgtctattttcgccgcctcttccaatgcatccggcagttctcggaaaaaagccataaaaataataaggtcaaaaaagctgaacatcgcaggaatgatgtacacccaaaagttgtccagcagtccgagatcacgagtcagcaaatacgttggaatcaatcctccaccaaaaaacagggtaatggtgccaatcagcatatacagcttgcgaccgatcagctccttacgggaatatgcatatgcaatcatagcggtaaaaaacacatgaacaatcgtgccgattaatgtcttggcaatagtcactcccatcgcagtcataataccgttgttggcaaacacagcctgatagctgcccagactgaagaccctcggccaccagtaaatgccgcccctcatcgcgtctgctccttcgttaaaggagttcgccagcacataccacacgggatacaacgtcacaaaacaaatgatcagcatgaagacgttgttcacgaaatcgaatatcgcttcgcctgctgttctgcgttgcaatagctgcatgcagccgtcctccttcaaaatagggatgttttattcacccgcttggtcaccgaattggcaattagcagtaaaatgagagcaagaaccgattttagcaaacccactgcggtagaatacgagaaacggccctgctgaatgcccacctgatatacataaatatcaactacattacttgcactttcattcagcgagttacgcaggacgagaatttgatcgaagttggagttcaatatgccgctgaccgccaaaataaacaaaatggatattgtccccttgatagcgggaagtgtgacgtaccacattttctgaaagcgtccggccccgtcaatggtggccgcttcgtacatgtccgtagatacccccgccattgctgccaaatagataatagctgaccatccaagctccttccagatatccgagctaacgacgatagcccaaaaatagctcggctctgccaaataactgatcggctggtcaatccacccccaggatagcaacagttgattaatcatcccggtatctgccagccacgtcgttaagatcccaccaagaatgacccaagataaaaagtgaggaaggtacgaaatggtctgaatagattttttgaaccgagtagatcgtatttcattcaggaagagagcaaatacaatgggcaacgggaatccgatcgccagcttgagcaggctaatgcccagtgtgtttttgacaatgtaccaaaagttatcatcctccaaaaaggcccgaaaatgctctaaccccgcccatggtgcgcttgatatggttccaatgatgtcaaaatgtttgaacgcaattaaaataccgtacatcggaatgtaatgaaaaataatcatccaaaccaccccaagcagcgccatggtctgcaaatgtctttgttgaacccatttgcgcgctagtgatgatgcccctctacccgatcgaaccggcggctgtggctgtggctgcggatttttccatcctgtactcatacagaagacctcccttctctttaatgtaagcacttacatttattattttagaggcttctgcttcgaatgagtagtactggattttttgattttggtatctaaatttcaggtggggatctaactatacgcacaagttttcttccatcctttggatttttacatctattaatttacgaagaagactatcagatggtacgataagactatatgtaattccaatcattacctatatacctagatcaggaggattaagaatggaagaattggttcgttcgattcagaaacaggttcgaattaaaaaggttgcctgctgggcggggctcatcatgtttggcctgtgtactttagttggcattgcagctcaggaatggcttatgacgctcttggcgctcgcgatgacaattttatccgtctatggattaaccatgatgcgtggtatgacaaagtttactaaggagtatcaaccgggaaagggctacggttattatcgtcgtacggtacaacaaaagctgcgctatctaacttggggacagtggttagtaggcggccttattgtcctgatgttctttgtatttaacgtccgacttagcgcttttctcatagctattctgggtatcctaaccattcagttcagtatcaaaaaacgaattaaaaatcaccaggagcccgatatcactgagcaggatgagtttgtacgaatggggattgtttctccgcatgagcagactattggggtatataaagattttctacacctgagccatacgtttcggggtaaccaaattgttatcgttacagacaaacgtctgatttctgtatttgtggaggaacaggggcgtgcggtgaaaacggaaatgctgctctcgggtataaacaaaatacgcgcaatcggtacgggttttcagggtcaaggtatattgctgtctgtaagtaaccgtgaccataacgagcttcacattcatatggtcgggaaaagcattttcttttctccagagcaattcataggctccttgctacggacactggatgcagtgttaaaaagcagatcatacagcacggaagaaccattcccgtgctaccaacagacaagaatttcattgcacccctcagaacaaggtttgctgcataaacctacgacagcttaaataattttgggacatgtaccacgttatatatatgcgttatgatcgatcttcataatacgccaaatagcaagtaagccctgatcttaatgagcttacttgctattgggtgtacttccacatcatattttcaaatgaactgcctacctgctaaaacaactaattctctactttacttctgtcttcttaatgattagctccatgatagaataccgtgatgaggtcatgacttgtaacaaacactagcaagctaaacagactgagcgacagagggcgtgaaatcaattttttcatcctttaacactccttttaaaatagttatatattggtcttgctgtgttgctgtagcttgcgatctgaaaatttcaaatatagcggtacatttcctaaactcatgctcatgttccatacccagggtatcggacagcatgagagattgcaggatatagcccagcgcaaccgtaaactgttgttgcttgatataataaagagccagttgatagcagaagcgaaaataataagatacattcacgggctcttcaaaatatttaaaaccttcaatttgttcggcaaatgattcaagcacagcctctaaaggatagtcatatctcgacgctccctcaacgatagaaagaagccccggcaacagctcttccggattattacgaagaaattgcatgtattcctgcaacacttcggcatggcctgacaaaatatcaagggcatacaaattagctctggcagcatagcggtaatattcaacctctgcttccccatattgatcgagatcattaaaccagcccaattctgcatatttttcgatgcaatcgcgagcggcctcatacttgccctgtttttggaaggccatgcctttcataagatgactgtagccgtagtagtagactagcggccgtttggtatgtatgggttgtataggtttcttgcgcgctttgtagagctgtaattcctgatacttttggttgacatggctatacaaccggtcgcataaagcaatcatattggcaccatccgcaaatgaaaaagacagcttaatcatgttaacaagtgtgtctagatctgtgatgtcggagtgaacaagatcatccaccgttcccgcctccttatccgacttttatattcaccaaacaaaagtaagatctaaatcccaactaaatataacttaattacgtagttattacgtagttattacgtaattaagttatatcataaattcaaacatatgacaagtgcattatgataatatattccagtttttaaaataccgatgtaagtggatcgttcacttgttcatttccatgtgaagcaaaggaaatgccctacctgatccatccagtgcagatcgccccgtgtgtacaaagccgtaatgtctgtagaaagcatacgctttctcgttctgctcattcacgtccactttgagatgcttcccttttattttttcagcatactggatgagtcggctacctatgccctgcccatgccgttcagggtccacaaacagcatctctattttcaatccgtccagcccgataaaacctgttggttcttgacttgtattccattccatccaaacttcaagttctcttaaaacaccattgcgtacgatatgatgataaaattgaatgtcctcttccgacaaaaatgtgtgtgtccggcgtacagcccgctgccaaatatcaacgagttgatcatgattttcttcacgataagcaacaatttcattttgcacttgtacttcccccttcatttaaaaatcgatattgcatgttttgcagtaagtctaacatgcctattttgaagcatacaaacacaaaaaaggaagcggaataattccgcctcccttacattacggccttttacaacgtaacaccgtttttaaaaatagcgagctccctgaaattgtttttctcattgttcacccaggttccgctggctacatcgacaatgtaatcgacaaagttgcggagcgcttcttccatactgacatcctccaccagtgaaccagcgttatagtcgatccaatgaggtttagctttatacaacggcgagttggttgagaccttcatcgtcggaacaaaggagccaaacggcgtaccgcgtccggttgtgaaaataacgagctggcagcccgccgcggcgagagctgaagatgccactagatcgttgcccggtgcgctgagtaggttgagtcccttggtcttaagacgttccccgtactgaatgacatcagtgaccgtggaagacccggatttttgcgtacagcccagtgatttatcctctagtgtcgtgatgccccctgctttattgcccggcgacggattttcgtatactggctgcttgtaatccagaaaatattgtttgaaatcgttaatcagatgtacgatcttattaaatacttgctcatcggcagcgcgctccattaaaatcgtctccgccccgaacatttcaggtacttctgtcaataccgttgttccaccttgcgcggccatataatccgacaatcgtccgagtaatgggttggcagtaatacccgataagccatcagatccaccgcatttcaagccgatgttcagctcagacaaaggtacaggttcccgtcgatcttcttgcacggccgcaaaaatttcatgaagcaaccttaccccttcctctacttcatccgacacatcctgggaaagcaaaaactttacccgctccgaatcatattccccgatggcttccttaaattctttcatctcattgttctcacagcccaaacccagtacaagtacgccacctgcgttcgcatgtttcacagcatcgatcaaaatcgtgcgcgtatgtgcgtgatcgtcacccaactgagaacaaccatagttatgcttaagcacaagtgcattttcaaaaggtgaaatatctcccgcttcctgcttgaaacggtttaaaataagttcagcaatcccgttcacacagccgaccgtcggcacaatccacaactcattgcgaatccccacacgaccgtcctttcgccgaaaaccttgaaacgtacgactctcctgttcatataaatgaggagctggcttaggcttataagtgtactcctccacgcctgtcaggttcgtcttcgtattatgcgtatgcacatgctgtcctgcctgaatgggctgaatggcatgaccgatgggatatccgtatttcagaacatgcccaccttcagctatatcctgcaaggcgattttatgcccgcgtgctacatcctcggctagctccactcgttgttctttttgtgctccccacgccagtgtttctccctgcttgtaatcacgcaaggcgacagccacgttatcttgatcatgaatttgaatgaattccagcattccggtctcctccttgcttatgctctgggcacgctgttcccggttagagaatcgagcgtctccttcattcctctgcttgtaatttcatacacatgctgtgccgtttgtgcagccagcccttcgatctggttcaggtcttgaccccaccatgtctgctggccaagtaccagcgcagtcaattgcttcgccccggcgagagtaccgtcatatcgactccacagttcaccaaacgtacccaacacttcagcttcgtctgccaacgcaatcgactcaccatttctgtctccccgataaaatacgatcagggacgccagtgaaaatacgattctgacaggcagagccttacgttgtgccacatactggagcaaggatggcaagttccgtgtcttgaacttggacaccgaatttagtgcgatactcataacataatgacttacatatggattacggaatcgttcaataacatcgtcggcatatacattcaattccgcttctgacgagtccagcgtcggaataatttcttctcggatcagtgactggataaagttgcccataatatcatgctcgaccgcctgccccaccgtgtccaggccatataaataagctacaggtgtaagagccgtatgtgctccattcaaaatgcgtactttccgtgtacggtagggtgccatatcgtcgacaatcagtacattcaatccggccaaatgagcaggtaattcttctttaagccattgtggcccttcaatgacccataaatgatactgttcgcccacaacaaccaaatcgtccttgtaacccaattctgcttgaatttcatggattcggtctttgggatagccaggtacaatccgatcgaccaaactgttgcagaacgtattcgattcctccaaccatgcaataaactcggccccaagcttccattggtccgcatatttcagtacgatttccttgagagcgtctccattacggtcgatgagctcgcacggaatgatcaccagtcccttgctctgatcgccccaaaaaaattgaaagcgcttgtacagaaaggcggccaatttacctggaaagctcttttgcggacgatcttccaattgatcctctggggcataagcgatccccgcttccgtcgtgttcgacacgacaaaacgcagctccggcttttgggataatgcttcatactccacaaagtccgaaccgtacggattaatcccacgagtgacacactccacaacggtatgctccttcatggccttcccatccttaatcccttcaagaataaccgtatacaggccatcctgctcgttaagcttctccacgaggcctcctggctgcggttgtacaatcacaactcccgtattccattctgctagcttattcattttgtcaaattgccagtctacaaaagcacgcaggaagttcccttccccgaattgcagcaccctctcgggatgtggttcattaacgataaagctttttctgtttaattggtctaattcatctacttgtttcatccggagtaacctcccacaattaccataatgatttcatcgttattttatcacaatgcacacgttaacaaaatagttttatcaacatttttagtttaaaaaattaataatgacaataatatgaacacgttaacatatacgtttatataaaaatctgcaagtatatcgtcctttttctttgtttcgcacctgatctaagacggttaaggctaacttatcaccctatcctgagaccttgttcttatatacatttcaggagaatagacgcaaaaaagcacgggcaggataatactacttactaggcaggaggaacactatgaagacaatcgcagatactattgtacaagttttggtcaatgcaggggtcaaacgaatttatggcattgttggagattctctaaataatatggttgattccattcgcagcaacggtcaaattgaatggattcatgtaaggcacgaagaagtggctgcctttgcagccggagcggatgctgaccttagtggcagcattgctgtatgtgctggaagcagtggtcccggaaatttgcatctgattaatggtttatatgattgccaccgcaatcgggtgcctgtactggctattgccgctcatattccaaccgacgaaatcggaagtgaatattttcaagctacacatcctgagcatcttttcggagaatgcagtcacttttgtgaggtgattacgacaccgcgtcaaattcccagaacggtgacgatggccattcaacaggcaatttcacgttcaggtgtctccgtcattgttcttcccggtgatgtagcagctttggaggcggaaaaggtacccgtccctgaacatgtctaccatcccactgcacctgtagtacacccgtcagcttccgaaatttcccgactggccgaatatttgaataaaggcaaacgaattacgttactatgcggcgccggctgtgcacaatctcacgacttgctcatgcagttatgtgacaagctaaagtcccccatggtatccgctctgcgaggcaaggaatatctggagtatgacaacccttattatgctggattgacgggactgatcgggtattcttccgggtaccatgcgatgatggattgtgacgtcctgcttatgctcggaacagacttcccttacagacagttttaccctgaagatgcgattgtcctacaggtagatatagagccagcccatctcggcagacgtactccgttgacgtatggtttatgcggggatgtaaaagccacattggaaatgctgctaccgcatttaacgtcagagcatgattccaagcatctagagaaaaccgtctcccactataccaaggtacgccaggagttggatgaccttgccgtcggtaaaccaggtcatacgccgatccatccgcaatatctcgccaaggtcatcagtgacgccgcgcaggaaaatgctattttcacctgtgatgtcggtactcccactgtatgggcggcgcgttatttgcagatgaacggtcagcgtcggcttctcggctcgttcaaccatggcacgatggcaaatgccctgccgcaggcgatcggagcgcaggccactgagcctgaccgacaagtgattgccctctctggcgatggcggactcacgatgctgatgggcgacctgctcaccctgaagcagcatcagctgcctattaaagtcattgttttcaataatggcgctctcggttttgtcgagctggaaatgaaagcggccggattcctggaaaacggcactgaactggtgaatcctgattttggtgctgtagcgcaagccatgggactcaagggcatccgggttgaagatccgaccatgctggaggatgccattcagcaagcattggctcatgatggccctgttgtggtagacgtggtggtgaaccgtcaagagctatccatgccacccaaaattaatcttaaacaagcagaaggatttacactgtggatgatgaaagcgatgctgaacggacgcggtgacgagattgtagaactagctaaaaccaatctctttcgttaaatacagacgaagcggagtacattttaacctaaaagaggcagaaaccatacatctagcatggtttctgcccctttggcctgcctgttaatcaaacgagactcagcgtggtctgcctgccgttgatttccgcttcatgagcgcggtctccataaatataagctcaccctcattggacggtgactgaattcgttccaaaatgcaggcggctccgcgctcgctaatctgctcaatcggtcttttgaccgttgttaacggtggagtcgtatacattgagaacccgatatcgtcaaaaccaatgacagagatatcctctggtaccttcaagccgttttcgaatactgcattcattgccccaatagccatatcatcgttagagcaaaataccgctgtcggcggctcctgcaaggaaagcagttgcttcattgcctggcttccgctttcagtatcataatggccttgcacgatatattcatgtcgaatcggtttaccactatcaatcaacgcattcataaaaccctcgcggcgttgctgggtagacttgaagccttctaccccttcaatgatcgcaatgcgttcatgcccactctcaacgagaaaggaaaccgcttcataggacccttccttatcatttgaaatcacatttacaatccccgccccggatacctgccgattcagtacaacaagcggaatgccttgaccgagcacatgataaataaaagggttgtccgcctcgctctggctcatcagaatgataccatcaaaacgcttgcggtgaatggccgaaaaatcggcgtaatcgtcaatccctcgcacaaacagattgtaatccaccccgatgacatgattaactccacggatggtatccgcaaaaaaactggagctggtgccttctgaaatactggtgaaaaacaggccaatcgtatgcgagcgctggagaaccaggcttttggcattaaaatttggaatgtaattgagttgctctgccaactccataattttgcgtttcgtatcttctttaatcagcgggctgttattgagcgcccgggagacggttgtatgggaaacattagccaatttggcaatgtctttaatggtagctgccatatacgtatcctttccttagtgaggctctaaaaaaattatatacccaccataccacaggagccgcccggaaaagaagactttcacaaattatacgcggttatccgcatgtcgacgttgtaactcttgaaccatttctgcatgtctgctgtcagtcagcttgtacattttaccgatgaccagcatggccaaagccagggcaacagccggatagagacaaagcaatgccttgatcccaagcagcgttccagaggactgaaccacattcggaacatacccgatgagcgctagtccaatacccgatagaaaaccagacaaggattgagccaacttacgtgaaaagttaaataacgagtaagtaatcccttccttacgctccccggatgaccattcgccataatcaatgatatcggacacgaatgcccaggtcaccccgttaggaatactaataccaatgaacgaaatactggcgaggattgtaaaaatatatacattggaaggcataaaaaagttaatggagtcggcaatgacactaaccagcatccccagtatggctgtttttcgtttaccgaagcgccgtaccagcttgggcaggaataacacacccagtagcgacgaaccgataataataaaattcatataagccattaattctacatgccccaagttatattcggcaaaatagatcagtagtgcggacttaatattgtacgcggatatggtgaaaatcgtcatcaaaacgagtaccagcaaaggcttgttattcgtaaaggtatgcacgataacgcctatagatagcttctcttttggcccggactggctaataatacgttctttcgttcctcggtaacatatgatgaaagcgatcacaccaatgagtgacataattcccatcacaaccggatagccaacatggtggttaggaaacagtaaaattagcggcatgacaacgacactggtgacgaataatgcgcccagagatcccgcctgacggaaagatgacaatgaggcacgctgatgagtatcctgcgtaatagcggcacccagcgagccgtatggaatgtttacaatagagtagccaattccccagatcatataggacgcgtaagcgtaaatgagttttccagtgggcgaaatattcggcgaaataaaggtaagaatcgtaagaattgcaaggataacgcttccaacgataagaaaaggtctaaattttccacgtgtaccgatatgtttgcgataatcaacaaaggacccgacaatgggatcacagacggcggcaaatagcttgctgaccaggaaaatgcctgcggcggctcctgcagaaacccctgctacatcggtaaaaaatttcagcaaatacaactgccccaaatcaaacatgaatccgtttccaaagtcacccataccatacgaaatcttttctttcaggctaatatgctcacctgtcttgttgtcagtttggacgctctcctgcacgataggcactcccatacctacacactcctctatgtttgtaattattttcacataattagttcaggattttgcaaaattcgattccagtcgctccgaagtgcaagatacagacgaactaaaccatttcgatctatatcttgttcattggaagtcgcttatgggatttttgcaaaatcctcagttgataactattttgttttcaattgctcttaccgggagttttgaaacaagctcctggcaagagctctttttatgaagttagtgagttctcacctaggcaataacttcacttactatgaacaaccgttgggaaattaaaatattgctcggcgttattgtagcaaatattttgtaccattgctccgagcagttccagatcctcaggcgccttaccctcctgaacccacgttccgattaagtcacaaagtatacggcggaaatattcatggcgtgtgtaggataggaagctacgggaatccgtcagcataccaataaagcgggacagcaccccgtagttagccagcaacttcatctgctcctgcataccttcgatgtggtcgttataccaccatgccgtgccaaactggattttccctacagttccaccggattggaagcagcccgcgagacttgccagtactggataatcaaccgaattaagcgaatacaaaatcgttctcggtaatcctcctgccagctcctgtgcgtccagcaatgccgccaatggacgggcgatcgagccatcatttacggcatcgtagcctgtatccggtcccaaatggctgaacatagacgtgttattgttacgcagcgcgtgaatgtggtattgcatagcccagccatgttctgcatactgtttgccaagaaaaaccaaaacgtacgatttatatttcgcctcctctaaaggagtcacatggccttcccccagccccttgctgaatatggctgctgcttcctccagtgtcgtttcttcatagacaacagtatcgagtgcatgatcagatacccgacctccggcagcatggaaatgacgcacccggcttgccagcgcattcaaaaacccttccagtccagaaacatccagtccactgacttcacccaaccgagccacccaaggctggaaagtttcgcgattaatttccaaagctttgtcggggcggaagcttggcagcactgccactgggaaatcggtcagcttgctgatttgtttgtggtattcgagatggtccgtcggatcatccgtggtgcacaccacagttaccttcgagttcacaatcagatctcgtgcgccaaagccctttccctgcagcttttggtttaccttttcccagattacaggtgcgttctgttcattcagcagctcatagacaccaaaaaagcgttgaagctccaaatgcgtccaatggtacagcggattgccgattagtgtaggtacggttttggcccaagccaaaaacttgtcataatcctcaccatcacccgtaatcaaacgctcctcaaccccattggcccgcataagtctccacttgtaatgatctccgtacaaccaggcttccgtaatattcttgaactttttattttcataaatttcttgtggacttaaatggcaatgatagtcaataatcggcatatccttggcatactgatgatataaggtttcagccgttggattgctcaacaaaaagttttcgtctaaaaacgttttggtcattactttctcatcccttctataatcgtgtttcctagcaatttgttaacgttaacaaaaacgttcgagatactacttgccttttaacaattacattccccatagcagtaggaaatccatatgatttgtacaggacaatacaattataatatgatacctgtacatcatgtcatactggtttgcttcaccttaaatttaatgtttacgttaacaacaattacattgtaaccgctatcctttgtagaggaaagtgatttttatcatgtgagcggataaaaatgatctgcctccatttgggacagatctgttctatatcttctcggtgaccgacaccacaagaaaattccacaattttaattttccgtgatagatcaaactttgaaaacgttttatatagttttctctttttttctgaaaatttctttcttgaaaataccagttattgtattataattgcaatatacatccattgatttacattaaaagtatttcattagttatttcacagagaagaagaagaggtggtagcattgagtacaaaagtgcaagctgttcaaactaaaactatatccgatacaaaaggagccgaccttgttgtcgattgcttgatcaagcaaggggttacccatatttttggcattccaggtgccaagatcgattctgtttttgatgttcttcaagatcgggggcccgaattgatcgtatgtcgtcatgaacaaaatgccgcctttatggcagcggcagtcggtcgattaaccggtaaaccgggcgtatgtattgttacctcaggtccaggcgcatctaacttggcgacaggacttgtcaccgctaatgcggaaagtgatcctgtcgtcgccattgcgggtgcagtcccaagatccgaacgcttgaaacgcacgcaccaatctatggataacgccggactattcgaaccgatcaccaaatacagtgtagaagtagaacatcctgataatgtaccggaagccattgctaatgcatttcgaattgcgacctcagcccagcctggagccacattcgtcagcctgccgcaggacgtgttgacttcgtcatctgaagtaaccgtcattgagaaggtctctcttccccaactcggaaccgcacccgccggactcatcaaacaagtcgcagagcaaatcaaaaaagccaagctgcccgtacttcttctcggcatgaaagccagcacgcctgaagccaccgcagctatccgtgctctcatccgagatacagatctgcctgttgtggaaaccttccaggccgctggagccatctcccgtgaactagaagaccactattttggaagagtgggtctgttccacaatcaaccgggtgatatgcttcttggagccgcagatttggtactgacgattggctatgatcctatcgaatacgatccaaaaaactggaacattccggcaaaccgaacactcattcatctggatgaccatcaagccgatattgatcatgattatcaaccggactacgagctaatcggaaatatagccctgattgtgggtagccttgcagaagaattacctaccttaaagctacctaaatcctcctgcgaccaattgaatcgtctgcgccatgatctaaacgagcaagcggctgttcccgcacacaagcatgattttctgattcatccattgcaatttattcgtacactgcgcagcctgattgatgataacgtcacagtcacctgtgatgtcggttcacactatatttggatggcacgatatttccgttcgtatgaaccgcggcgccttctattcagcaacggaatgcagacgctaggcgtagcgctgccttgggggattgctgccacactcgtcaatcccggtcacaaagtcgtttctatttctggagacggaggatttcttttttcatccatggagctcgaaaccgccgtacgtcttaactcaccgttggtgcatatcgtatggagagatggttcctatgacatggtcgcttttcaacaacagattaaatacggaagaacgtctggtgtaaaatttggagatgttgatgtagtaaaatatgctgaaagcttcggcgccactggattacgcgtgcactctcctgaagaactagaaagtgtattacagcaggcacttcataccgacggtcctgtggtcgttgatattccgattgattatcaagataacatccagttgggacgtaaactgctgcctaaccaattaaactaaccttaaccatgcctcactcgtgacggctttatgacaattatggagtataacgttttttttatgatttttttgagttattcatgttatttactgaaattttacgtttattattgaaaaagaaagaaaataaatgcatacaattataaaaggaagtgtattgccatgaccgttgcgcaattggaaaccaagcaagaagctgatcatgatatttaccaaacatccactatgcttgctctattagatggtctttatgacggagttgttgcctttgaggagttgcaaaagcacggggatttcggaattggtacctttgatcaactgaatggcgagatgatcgcgttcgatggtgaattttatcacttgcttccagacggtacggcccatcgcgtaaaaccggaagaaaccacacctttttccaccgtcacctttttccaggaagatttcacatatactattgaccgccctatgcatcgtgaagaattggaagctttgctgttaacgttatttccaagccgtaatctgttctatgccttccgtatggatggcacttttcatgaagtaaagacacggaccgtgcctcaccaagttaaaccatacaaaccttttatcgaagcgaccaagtcacagcctaccttcacttttaatgaggcttccggcgtgattacaggtttttggacacctgcctatgctcaaggtattggggtagccggatttcatctgcattttattaacgatgaacgcactggtggcgggcatgtctttgattttattgtcgaaaagtgtaccatccgcatttgtcaaaaatccaatctgcatctggtcctgcccgataccccggattacttgaaggccaacctgtccagagaaaacctggagaaagaaattgccgttactgaaggtgcgcagtaatcacagttatataactcatcaagttacggactctatagctaaacaataaacagtaaaagatcacagtcagggaagagaattactgctctctgactgtgatcttttttatgtacgagcatatatatacgttactgcttatgctctcactccggttcacctatgcctcgatctgatccagtttatctgcataatattgaatagcacgtgagtactcctgtgtagataaatccgaggtcgtctcagccacctccattagcagctcctgcatggctttcccgtattcccccagattgtataacaccatcgcgtaaaatacccgaaacggtctgtaatccggaaattcgttcattcctgtgtccaaccacgctttcgccttggcgtaatctcccaatacccgatatgtactgcttaatcccaggatggctcctttccttgattctgcggataacgccatacctaggcttttttcataataggcaaccgcttccctctctaagcccaatgaatcatgtgtccaagctgtctgataccacaattctgcatcattttgctgctgttctaatgcctttaaaagaagcttacgtcctttctctgcttgccctgttcgtctaagctcgtcagcttgcgccatgatatcgttcatattcatcctccacttctgactcatgcctatctttgaggtatatgttacccgacatttgaatgcaatgtaaatggagtttttcctaagatttgaaatccaaaaaaacgaccctccctttaggagagccgctatatatccgaagctgaagttacggtttatttaaccttcaatgatcctacagttagtattcccgctacacgttgtgcgtcgaaaatacgggagagctcctccactgccgtcaagtacagtagaccgttgccctccagcttaggagaattaccgagtggaatcgtgcgtttgatgagttgtgcgtataattccggttcggtaagatcacgctcaaagctcgcattcgccagctgcttaatcaacgccaatgcacctgctacgtgcggagtagccatcgaagttccgctaaaggtcgcatatttgccgcccggaacggtggacaaaatatcttctcccggtgcaaccaaatccacctcattatttgaattactgaattctgaggcgtgcctatcaaagttgatagcacctacgctaatcacttcattatagcaaccggggtagccgagctcgtccgttctgtcgtcaccgtctccctcatttcctgctgcacagatgactaagatttggctagctacagccttttttactgcttcatgaagctctggcacatcctcaggaccgccaagtgacatcgatatgatatctgccttttgctcaatcgcataatagatgccttgaataatccagtcatattgaccggagccctgcttgtttagaactttgatgatgagcaggtctgcctctggagcaacacccacgacaccatccgcattttctgctgccgcaatagttcccgccacatgcgtaccatgaccgttgtaatccttgaaaatttccggattaccttgatcatcatccgtgaaattccggccgccaataatgcgcgccttcaaatcaggatggtccgaatcacagcccgtgtccagcaccgccaccttcacgcctcggcctcgagtctggttccataccgcaggagcctgaatcagctctacccctcgcggtatttcattcacttgttgctcctgcttgatcacttggtaaggaatgatatgcactttacgttccatcctattccctccttcatggattcaatcggaaaccatccgtctttgaaactttgaaaaatttgaaaacctctactacgttcgaggttactatattctagcaatttttgaaaagtttgaacatccccattttgcttatttttgtaaaaaaaagacatcccccaatttgcttggagaatgtctgttgtagaatctctttcagccttaaactgattccgcctgaagttcagccttagataacagcgatttgtgctgccatttccgacccttccagcgtaaatagtggaaaatgcctcgtacccactcatcgcaggcatgtgcaatccacacacccagcacaccatatcccatatgaatgcccagtacatatgctagcgggattttaatcccccacattgaaataatggccatcattagcgggaactgaacatctcccgctgctcgcaaggagttaatgacaacatgattaaacacacggcccggctccagcagtatacagaacagcaaaatcgctgcccctaattgaatgatcgccggctcatctgtaaagatcgtcatcacttcatatcggaaaaaggatactaccacgatcacagcaatcgtaatgaccaaagaccattttaggctccgtaaaagttgatgataggctttttccttgtctcctgctccaatcaggcgggcaacaataatttccgtcccctcacctacagccattccaaataccataaaaaagtatacaattgtattcgtataaaaatgggttgcgatcgctgttgtacccataaagctgacaaaccgggtcaccatcatttgactaagttgataagacaaccattccagcccggcaggaataccaatcttcaggatggctaccagcttactccattgaagctgtacataataccggatgcgaatcggcgcactcacacgcttgtacaacagtagaaaaatccagacacatgctacagcacggctaataaccgttgaaatcgctgcacccgccactcccatctgcggcagaccaaaccagccataaatgagcagcgcattccccacaatatgcaatatattcataccaatgcccacgatcatcgtatctttagtaaaaccatgcgatcgaataaccggacctgcggttagcataagcgcttccagaaacagcgaaccccctgccagcatcatataaatctctgcattttccttgatcgtcggggtaatatggtaaaaggatagtaaaaaatcccggctcacaataaacatcaagctcagcgccagaccaaacaccagattaaaggttagtgccgaagctgtaacacggcttgcatccacatgcttttgcgcccccaatagctgagcaatgatcacacctacaccaagaccaagcagattgaaaagtataatcgtaaattcaatcaactgtcttgacacccccacagccgatacaacctcatcagaaacatggcttagcatgaacgtatccacgctacccatcaaaatgtgaaacaacatctctataaagatcggccaagtgattgcaaaaaccgtcatcgttttaacgacttgcgcttgcttggaaccgttttcctgagaaagtgacatcctttcgtattcctcctaaatgcgacccaattattacttaatagctacacgtcaattaatcaatcataaaaagtcatatgctttttatcttttttataatattccaagcggtcctgcaattgtcctgtgtggaattcaaacttatgtccgtctggatctgtaaaatagaccgatcttttatcctgttcattccgctctcgtccaggcaaaatggtaacattaaaagttctcagcttgttgagcatcctctcaaaatcagcttccgctatcgaaaatgcaatatgcgtataagaatgatgaatttcatttctcgggatatcctcttccacattgagagccaaccacattcccagacagtccagataagccagcttacgtcctttaacgagcagttttccatctagtacattctgatagaaatgtatagacttctccaaatcagacacggaaaagcaaatatgattccacccttgtatgctcatgttccctattcctttcagcgtaccctgtctagccagtaggtccacgcttctgtatatttatcgaggtctttaggatgatggcgaatgcaggtagctatacgaaagtataaccccagtaacacttccctgttcagctcgtattcccctgtcatctccggctcaagcttctctaaggcaggcaaaatagtatcgacggtcagcctatccggtgaagaacaaaaggcgtatatcagatcatacagaggttctcctaccactggatcagggtcaataatacccgtcaatgtgccgttttcggtaaacacaaaattatgtaccccacagtcaccatgaagcaaatatttaatattacgttgcggcaatccagccacaagggtatgaacgaaccaatgattctctcggggtaaaacgccttgtatgatctttccagattccttcgttctgtgcagcagaaaatctctccattccacaaacgggtgatccggataaccataatgacgttcctcaccacaaggcttgtagtgcgagatcacctccgttgccagacgaagcaacaaatcgcttttgtttcttccatgatactgtgtgaaccctgacctgaacgtgtataccaaataacggtgcaacggatctacataaaccaaacgcgatagtttctcaatctgtacataggtatgtaagaattctgcctcggcttctacgacagcgggatcattttgcttaatcacgtatcgtggcttagttccgtccatgacaactaccactttgctcgaagttccgccagtcagcggtttgagatttcgcatatggctttcaagcacgcccgtttcgtgaagctcattcaggatcagttgaacatccatctcacgcctccctccatgcgtctgatccacaatgcggctggcgatttggatatttcatttagctcccatacgttcgccagccactcttcttttaaaaataaatcttttcatgctccgcatagatttcaagcgcccgctccatcttatgcacataggcctcatcctgactagaacatagaaatgtaatgtgtccctcctgcgatggaccggattttggcgaaggttccagcaaattacgctcagacaacacctgtttcaaccgcctaactgttccctggctcccgtcaattaactgaatatgagaaggtagtagttcccttagaatttccttataaaaaggataatgagtacatcccaataccaccgtaccatatatgtcgagattgaacgaagacagctcacggttaaaatattcgaacatttctgcccggtcaaaattcaactgttcgcaataatgtactagctccggcagaggtagtgagtccacgctcccatgatcgtcaactctggataccagcgctgcataacaggattgtttcaacgtcaatggtgtggctaacaccagaactcttttaccattggctcggttcatctcgaccgctggcttcacagctggctccataccaataatcggaataggatattcctttcttagctccgcaactgcgatacttgtagccgtattgcaggcaatgaccaatgccttaacatcttctttaaggatcgtttctactgaagccttgacataaccaagcacctcttgaggagttttcgtcccgtaaggcacatgaagcgtatccgccatgtatacaaaattttcgtttggcaaacgtcttagtgcctcggacaatactgtaattccacccaatcctgaatcaaaaaaacctatcttcaagctactcaccttttttcgttcaactattgtgccatatcttacaggcaccatgttcattttcttcttcgcctactcaaaccattctcttcattagactttacatttaaattttaccgcaaaactgatattttgcaaaagaaacacgtaaaatttacagtgtaaaaaataaagtaacttttcaaagtaaatttaatataaaagtgttgacagatattatctttatattgtaatattacgtggtaacttactaacttaacttacttattcaacttacttagggggaaataaatcatgtctaaagtattatttgtcaaagctaatgatcgtacagctgaagaatctgcaacagttaaattgtataacgccttcgtagaaagctacaagtcttcccacccaactgatgaaatcactgagctggacctgttctccgtcgagcttccttatttgaacgctaacatgatcaacggcacgttcaaatccgctagaggcatggagctgaacgcagaagaagctcgcctggcaaacatcgctaatggctacctggatcaatttctggcagcagacaaagtcgtatttgctttcccgctctggaacatgacgattccagctgtactgcatacgtacattgactacctgaaccaagctggtaaaacattcaaatacactgctgaaggtccagttggtctcgtaactgaaactaaagtagccctgttgaatgcaagaggcggcgtttattccgaaggaccagctgctgcagctgaaatgtctttgaactacatgaacaacatcttatccttcttcggagtgaaagacatcgtgaaagttgttctggaaggacataaccaagctccagatcaagcacaagaaatcgttgcttctgccgtacaacgtgcagtggacacagcaaaatcgttctaatcatatattatgaagagaagaggatatccgcgccctacatgggctggatatcctcttttttgttataaagtataaaaaacacgtgctcccctgatctataatcaagtgaaagcacgtgtttgtgaaatgagattacttctattttaaggaatgaattgctgcacgatttttacaactttaccctcacgaagcgtaacatggtatggaaattgactgaggtccagaacgtcctttttagcaaaatctttctcaaactgtgccagaggaatcgattcattccattgcacgtctgtatcttctatgttacccgtgtgatcataaatctgcacctctaccgaagcatctggtgcaacctgatacacgtcattttgcacggaattatttacgatgtagtagccatctggagctccatccaatcctgtatttccttcatgctccaataatgctttgtcagctgccgcgccttcataccattcaatcgggtctgccgacaaataaatctgtccgtcacgaatctccatttggtttatatatacggtctcctgattttcagcagctgctacaggcgtgtagccttgcgctgttgcccctgccgtcgtaatcagcatcatcattaaagccaatacggtccatttcgaagctagtttcatcatgtctgatctctccttgccgtttgggtatgtacacggtgtctgtaagcttcattacccttgtgtacttatcataaacgttgcacggttaaaaagtgtatcagatacataaaaaagaagttacgattttttaagacttggtcttaaaacttgataacatgtcttatttatctttgctatcttaataacccgacctgacgtgcctgttcttcggtgagaataaactcttcattttgccatacttcgtcctctttggttacagcaaacatccccatgatctctgtccatattcctttgtcgacggcttcctgttgtgtaatgataattttcatttcgtttcctcctcctgtaaaatatgcgcaatccaaggctgtcgatttgtgtatcccacttcgcgttcagatggtttctccgatcgctgttggaacctgattttttgaattatattttaaatggttaaaatcaggttccaaaggcgaacgctatcgcttctccgaaatccatctgcccgcttcgttactcagcttatctctaccattctcattttgggcctctaacacttatattgaatttgcattacgtattggagatgctcagggggctcttgtcccgtcccgcttataacatatgtacccttttcttgccaagattattcgtatcttatttcataatttaaagcttattatatctgcattgtcatgtcatgtttttcaattcaaagtgattttattctaacctttttttcatctgtcttgttctagttaaagcccggctaaaatgaaaagagacccacatgaagtgagtcccaactttcaagcttctattcataccgtaccttttgtgtagagtatcatcttgcatatgcaataaagatattcagaggcgcaatctgatcataaataataaatataataaaaaaggtaatcctattgctgaaagtattgtgattacagtacgtacttttttctcagctcgtaatataaacaataaaaacttataccctaaaataccaactaatccacccacacaatttaaaattatatcatcaatgtctgatgctccaatgccaaaaagcccctgaatgatttcaataaataaactcactatgaatataaatagcagattggttattgctcttttatcgtttttgaataatgacaaatatgtgccaagaggaataaagataactatattgccaaccacattagcaaaagcgaaattttttatagtgccagagttgctaaatatatattcctttatactataaaaaggaatgagattgattgacctatctaaagtcctttgactatttaacaaatccaaaagtgaaactcttgataagaaaaataatttaaataaaaaaaggatgtaacaaatgaaaactccatataaaaagactgttacaattctctcttgtttattcataattcttccatttttcatttttcccgcctattctctgatgttcagtttataaattcgtaacggctttgactatagccaacctaatgtgtaaaaccattctaacagccctgtagattaaccactaaatggtagaacatgagtcgtcaactcggtaaaatcgtttgtacccctacaaaccaatcgaaaggtgacgacactccataaaaaagtctatcacgattctatctctccttcaatccgtattaacgtctgaagaagtcgcgctcgttgtccaaacgattggttatgagaatatatataaaatattatcgtatattcatatataataagacttttcttagaaacgactgggtaaaaaataaaaacggtccgcagattaatctacgaaccgttttctaaaaatcctctatacttagtgaatcacttgataccatcacacatatacatagtccttcatttctttagtctgtataaataaaagtgaagagtcgccaaaagcactaaagcagcggagaggacggaatcgttctgaagaagcggagcgttcgcctttgcccccggatttctacccttgaacatacaaacaagaaatctgggggcaacagcgatcggaagaatgatccgtcctcgtagcggtcacaagccgcataccgttactttgtcactctgcatgatattaatgtagaacgatttttacacggaaaagtaaaaaggctgtacgcatactggcttggatacggttacttgttgcccggtgtaggtcaagcgtccacttgccttgtccactttgaacgtaacgatgttgttggtgtcgcggttggccacaagcatatggtcaccatttggagtcaaagcaaaatggcgtggatgctctccttcagcagatacatgctcgactaggctcagcttgccagttgctccgtctacagcgtatacgacaatgctgtcatgcccacggttggaaccgtacagataagctccatcccccgaaatcgcaatttcagcagttgtgttttcacctgtaaagtcagacggtaatgtcggtacgctctcaagctcagtgagcttgccagcctctgcatcatatgcaaaagaagtaatggaagaatccacttcgttaatgacaaaagcaaatttaccattcgggtggaacgtcaaatgacgtggacctgcacctgcatgggttttcgtttcaccatgaaacaccagttgtcctttgctgtcatcaatagtgtaaacgcggatcagatccagaccgagatcttgtacgaacaggaagcggccgtccggactaaagaaactggaatgaggatgtggacgatcctgacgctcaggatgcgctcctttgccctcatgctgtttaacatccagcaactcaccgatacgtccgtcctcagtcagggacaccagtcccaccataccaccgtggtagctgactacaataaggtaacggtcagatggatcacgctgaatgtggcaagttgttgcacccacgttttccgcacgattcagcaatgtaaatgttcctttaactgggtcaatttcgaaagcagaggcttcgcctactttcgctcctgcagcagaagtcgtctctccaatggaatacagcttccgatttttgacgtccacattcaggaatgtaggatttttcaagccggagaactcatcctgtagtgtaagtgctcctgtctgttcattaaaagtgtacgaataaactccgttaccttccaattcggcgtaagagcctgcaaatacgagcaatttttgttgtgctgtcatggttgtgtcctccttggattaaaaaaatgatgggcaattggaatgattgctcctgttacaaatatcgctttaagaggcgcgctccaccacgggctctgtggacaacgccacatttcccgctacggcacgcgagatcatacatgaggtttctgcctgctctgccagtcgcaatgcttgttcgatctgcgattctgtcgcatcggcggccaattgaacctgcggacgatgcacaattcggcgatatgtaaaaatattgttcgttacatcgacaatcccttcggattccagcgccagtgatgccaccgggagactcgcgcgctccatcatcgccgccaacgtaatcaaatagcaggtagcggcggcaccgagcagcatttcatctggattggtgcccacaccagggcctcccatctcagccgggatcgaaattgcagtccgcaactgtccagcctcaatatggccgtcgctgttgcgccccccgttccagtctgccttgagcagaaaggtatgctccatttcaggtcactcctctctcttatattatgaatctttacacaggtgaatgtaaaggttagtcaatctcctgatttttggtttccgtacccagcaaccatacagccgcagctccgatcaagatagctacgaagaaaatcacaaagatagatggtagcgctacgccctgtcctacgagtataccgaccgcaaaaggcccgataacgcctccaatacggccaaacgcagccgccatacccacaccagttgaacgtacagctgtcgggtacaattctggagtataggcgtacatggctccccatgcaccaagattaaaaaaggacaagcagataccagcagccaacagcattcccgccgtttccgaggtgccaaaccaaatggcggacactgctgtgagcagcaagtagatgatcagtacgaatttacggcccagcttttcaattagataggcggcggtaaagtaacctggtagttgcgcaagcgtcatgatcagcacatactcaaagcttttaaccagttcgaaacctttcataaacatcatgctcggtagccacaagaacatgccgtagtatgaaaatacaactgtgaaccataaaatccacagcatcagcgtagacttgcgatggggtcccgaccaaatcgaagccaatcgtgcacgcagcggaagtttgacgctttgctgcttataacgcggtgaatcatcaatagctctgcgcagataaagagcgtacagcgcaggtactgcgccgagaataaacgccatttgccaaccatactttggaataacaaaataagcaataagagccgaaaggatccagcctgccgcccagaagctttccagcaggacaaccgctcttcctcgttctttcacaggcactgattctgacaccagcgtcgaagcaacaggcaattccccacccaagcctgcaccagcaataaaacgcagtaccagcagcattccgagacctgtcgccaaagcggataatccactggcaatagaaaagatcaacaatgtccacactaatatggcacgtctgccgtaacgatcagccaaaatccccgccaaagcggccccgaacaccattcctatcgaattcattgcagtcagcagtccaatttgctcagatcccagatgccactcctttgccaacgctgcgactataaatgaaagcagccccacatccatagcatcaaacaaccagctgagccctgcgctaaacagcaattttctttttttggctggtggtaatgaagttaattcactcatgatttgctctcccttaaaaatatatcgtatgtagacgtatattcaggtgtcttgtcacctgtagcctagcatctattgtaccgtaagcttccttaatctgcgagctttttaacacaaaaaaaacggaagattgcctacggcaattctcccgccttctggaacctgccacttaccggttttggaccagaccgatgatcgtcaccatgagcaccagcagctggatgagtgtatcgttactcattccaatcgcctccatcccatatgagatactccttcggccgtttcccctctccccggatcatgacgcttgttccccaagacatacctatgcaggcggcgggaagcttatgatcaatcatggatgaaaatctccatacgtttaaggtttaatccaggaccactgcaaatccatttcctgaatgcattcacggttatcatgttcatcattggccaccagtggggtcaccggatagatgctcatgtctccttgctcatacgtgcgtagtagaagtagcagctcatctatgttctgtacggacggattcagccatgaatctatatggtcagcttccaaaatagccggcatacgggtatcgaattcacgtatatccgtattggcctgaactgtcatcatcgtacaggtgcgtaaaggctccttacgactatcctgccatacttcatatagccccgcgaccgcaaacatcttctgttccggcaataccactcgtacagcacacatgcgtttacccaattttcgccaataataaaatccattgcatggaatgatacagcgccgggtttccgccatcttgcgataacttggatttacccgaaccgtattcaagtctgcattgacacaatccttgccccagtagggaataaatccccagcggaattcatcaagtactcgttctccatcctgatgcagcacaattggaacatgctgggtgggactcatgttatagcgtgttttgtaataatacatcacccgttgtataccaaaatgatccctaacctcatccaaatcagccgataacgaaaacctcttgcacatttgctattcatccttccgcctttttcacctattgtgcggatatacaaggaaaaatatgcatatgcaggttttgcaaaaatccaataaacgacaaaacatatagcaatatccccgcagttgtgaagctacggggatagatactaacttatattgttattacttcttttctaccgcgtgaccgccaaattcattgcgcaacgcagcaaccactttcccgttgaacgtgtccgcatcaagagaacgatagcgcatcagcagggacaaggcaatgaccggagttgcagcctgaatgtccagtgcttcctcaaccgtccattttccttcgccagaagagtgcataaccccacggatttcgtccaggtttgcatctttggaaaatgcacgttcagtcaagcccatcagccaagagcgaataacagaaccgttgttccacacgcgcgctacttgttcataatcaaagtcaaagctgcttttttctagcacttcaaatccttcaccgatggaagccatcatgccgtattccacaccgttatgaaccattttcagaaaatgtccgcttccagatttacctgcatacagatatccattttccactgctgtgtcgcggaaaataggctcaacaaccgcccaagcttccggatcgccaccgatcatgtaacaagcgccattacgtgcgccttccatcccgcctgaagttccagcatccatgaagctgataccatattcttgaagacgagcatgacgagcaatagactctttgtaatgagaattaccaccttcaataatgatgtcccctttggacaacatcggttgaagctgatccagcacagaatcaacaatttggtgaggaaccataatccacaatactctaggggattgagttgcttgtacaagctcttccaatgtagaagcacctgtagctccataatccttcatttcttggattgcggctgcattgacgtcgtaagcgacaagttcatgcttatgatcgatcaaattttttccgagattcaagcccatttttcccaaaccaattaatcctacttgcatagtaaaggcctcctgccgtagcaaacatattttgtatatactttcttattggtgttaagaacgaacgactgctttttcagtgctttcggacttttcgtccagccaccatgtaaaaccttgttcttccaacaattgatctgaagcttctggaccgtaagagcctgctgcatacgtatgaagtggaacatcaccacgagcaaaagcttccagtacaggttgaacccacacccatgaaagctcaacttcgttccaatgagcaaaaaaggtggaatcgccgcgcagcgcatcaaagatgagacgctcataggcttctggtacatccttggcctcggaatgataattcatcagaaccgtttccagttgaccagcgtttagcgggtctctactattcagacgcagcgttaccttttcatccgggttaacatggatgatcagcaagttcgggtcagtcggttgcccttgagcggcataaggatctgtgctgtcctttttgaattccacgacgatacgagtagatttttctttcatacgtttgccggtacgaatatagaacggcacaccagaccattgttcgttgtcaatccaaaggcgagctgaaatgaaagtatcattttgtgaatctggaccgatatccggctcttctttataggaaggaactgcttttccgttgatctcaccgttggtatattggcctctaactacgttggaagcaatatcggaaggatcaagcgcacgaagcgcgtccatcaccttgcttttttcgtcacgtacctggtcagccgtgacatgtcccggcttgttcatcgccgtcatcatcaacacctgcagcatgtgattttgtaccatatcacgaatagcgccggaatgatcgtagtatcccgctcgctcctccacccctacagtctcggaagcggtaatttgcacattggcgatgtattgattgttccatatcccttgaagcaatggattagcaaattttaaggcttccaagttttgtaccatgggtttacctaagtaatggtcaatacgataaatctcatcctcagcaaaggttctgctcaggcgatcattcagctcacgtgcggattccagatcgtgcccgaatggcttttcgataatgagccgtttccaaccctttgtttcagctaaaccactttcccgaatattgtgggcaatcacatcaaaaaattccggtgccaccgataagtaaaacatgcggttccccggaattcccaagtcattttcacgttgctcagcaagctgtagcagctttttataatcttccgggtggttgacattcaatgcgctgtaacggaaagcacttaagaactgatccatctgtgcacggtcttcattcacgtgtctggaaaaatccttaatggattgctctacattactttgaaattgctcgtccgccacttcacgacgccccatcccaattacagaaaaggaagccggaattttaccttctacaaacaaattatacaaggcagggtaaattttgcgtttcgccaaatcccctgtcgctccaaataagacaaatgtcattgaatccatgaattattccttcttcccattataaagatgaggttattaaaagttacctgaggaattaacgtaacccataatacacccaaaataaggggcaagtcaatcaaattttagcgaaatcgtgaacattcgatatatcctgtaatgataacgttttctgtgatatgattgacgaaaggaaagagaaaaaactgttaaatatgtcacagttgatacaaagcgttatagttactattggtatacagagttacttttagtatactgtttaaaacaacaatgaaattgaggggattcagatgagcgacgacaggcagcctaagcttttgtgcggtaaggtggaacagtcctttcagatcatcagcaaaaaatggaccgctctcatcattcatactttgatggaacatcccaaacgatttagtgaaattcacgtctccatacctgatcttagcaaacgcatgctgaacgaacgcatcaaggaactagagctttccggcctgatccttcgcaatgtcatcacagagcggcctgtgcgtactgagtattcgctgacacgcaagggtaaagagctaggtgatgcattgaatggtgtggagagctgggccgagagatggctttaactgctaacaggaggtcgccacacatggtctcctgttattgtgttaccccacgtggatcataatacaaactatagtacgaaaataatgggacaaccgtcagcagctcataatttcagaatgggccaaggaaggatgagaacgatggcatttggcattacccggcaggagcttatggcctggaaaagaaaggtcagtggtggtgaaattgcttttctgacacattactggctggatgatcgctttccaggcattacaaccgttaccaaggtaggatgttctgatttggacaagctgcgcttatggtgcaaccaaaacggattagacccccaatatattcatcagcgtcagccctatccgcattttgatctcatcggtaacaaacaagtggaaattttacgtaagtatggcattagcgatcaatttaaacgctttgaacttcaactcccaacgagtacacgtccatcgttctaaaccgcagctctcagtgctgcggtgcttttgttttcataccagttaataccttgtttatccaaatcgctgacatagccccttctcccatcgccacagttgcttgctcggcatgagctcctaagtccccggctacccatacattttccacatttgtcattttgctgcgcggatgagtttcaatatgcttattgtgcagcagatgtacacccagttgctctgccagctctgaatgaacatgattgctgccaaaagctaaaaagcctcgctctgctcgaaccacttgtccatcagccagccgcactccttcaaaacagcctggttctccggttataatctcagaaatggctgcttccttatagccaatccctttttcccgcagcttcacaatcagctcgtccggcacctctgaacgctcatgattgacataaacaagttgatcggtgcgcgctgataaaatcagtgccatggaagctcctgctttgcctgctcccatgacgaccgtgctgcgatcctgaacctcataaccgtcacaatccgggcacacatatacactgttgcccaagcaggcttgtaatccatccagctttggaaaacggtccgttagccctgtagctaacaacagcgtcttagacgaatacacggagccttcctccacttgaatgtcaaaaagctcatcccttttggcggcttttaccaccttcccttcaataaactcagtacctagttttgtggcttcactacgtccaagccgtcgcagctcttcaccagaaattccgtcaggaaagcccaaaatattatgatactgatggcacagcgtagatcggccatagcccgaatctatgaccagcacccgatgactgctgtatctccccaattgaatcgctgcttgcaatccggcaattcccccaccaacaataatgcaatcatagttcatcacttttcctcctttgaatcgcgttatcctagacatctgcataaaaccgcaataacaccaatgtaaacttctcatccaattttaaacataatatcacccactaacggatgaattaacccctgtgtccgtacatatcaatagcttacattccttaaaaatggaatgacaaaaagcactgtggatacccacagtgctttaccaggccgaatctgaaacgtcaatctatcgtgaaaattatttaaatgtttttacgcgttcttcaacaggctggaattctttttcacctggttggaatgccggtttaccaaatggcatttcagcaatcagtttccaatgctcaggaatgttccattcgtttttcactttttcatcaatcaatgggttgtaatgctgaagggatgcccccagtccttcttgctccagagccgtccatactaccaattgcagcataccattagattggttggaccagattgggaaattgtccgcataggcttcaaattgttgttgcagaccagccaccacgttattgtcttcaaagaacaagactgttccgtatccgctgcggaaaccgttcattttctcggcagtagacttgaattgctcctcattgcctacaacctcacgcaaaatatcttctgtaatattccacagtttatcatgatgctctccgagcaacactacagcacgtgaagtttgggagttgaaagaggtaggtgtgtacttaacagcttcctctacaatctcttgaatccgttggtcagaaataacctgttctttgctaataccataataggagcgtctgtctttcagagctgtgaagaagtctttagccatttttttgttacctcctgagaaaaattaattacttttcgtaacttaatttacattgcatatatcttaaagtcaagagatttctttttaaatattaccagttagttgatgattatacgccaccattgtattttttctcactggaagaggtgtgcttggttgcatccttgtctctctcctcctgtctttccatcttcaaatcctctacaggaatggcgtctaccgtctgctcgatctcaaaacggtcgaacaagctttcctgctctgtcggatactgctctgcatgatctcgattgatcgactgtttctgatgtttagactccgttgttcctttccccgtctgtcctttctgctgattctgatcgtgcaggttatcttcaaatggggccattttacttccctccctatcggattggtgtccacagtatacttttacctttcacatcggggattaaacgcaaaaaagagaaaatctctgcaaagattttctctactcatgtacttatagatggttgattggattattccgagctggattgacctgtacactcatgaaaaagatgaggttccagcttctctcccgttacgagcttctgcaccagttgagtccccgagtcgggggtcatttgaccataccagtccccttgaggatatacgatcacaaccgcagcatcatgacaacgcccattacagcgagttctggtcgtgtgaatatatgcttctgcattttgtttacgaatttcatcccgaattgcctgtgtaacttcttcaccctcatgtcgcatacatgtgcctccattgcagatcaacacatgatgcttcattggttctaactcaaaaatagccatagcttcccctttaatcaacagttgttggttttaaatcaatgtttatctggataaagaacaagctgtgcttccatctgatcagcttcaatcgtcagcacgatgaatgaatattcgtcttcgccgcgtttgtccgtcggagaccccggattaaggacaagctgaccgtcaatcgttttgaccaccggaatatgcgaatgtccataaatcaggcaatccagcgtttctcccttaaacgtattcaatgcgatattttctgtcgttcctcgccagccgtgaccgtgaaccataccgatccgcttgccttcaacttcaacgattcgttgatagcctaaacgctccacgatgtccattccatcattgtttccggcaatgccttgcacaggcgcaaattcagctagacgttcatatacgaaccaatccgtccagtctccggcatggagaatgaggtcactgccttttaactcctgtacaagtcgactaggcagtgttttgcttctatgcggcatatgagtgtctgaaagtacgatgattttcatatcaatttctccttaccagcgtctttacacagatgaactttgttgccctacgcgctgctgaagtgcctgctccagatctcgcagcgtaacggtctcgaaaaatgcctgtattttctgctctgccacggtatataaaccatccaacaatgcgtctatgttcctgcctacctcacaattatgattgctatcggtatggatggcgaacaacggaccttcatccttggtcgcctcatagatcattttcagattgatgtttgaactggacatgcatagacgaaagccgcgtgctccaggcgacgaatccaccaaacccgcttgcttgagtcggctcataatccttctcacaactaccgggtttgtattgatgctggaagcaataagtgacgatgtcattcgctccggtgccccttcagccagaagaagcagacaatggatactaacggaaaaatgggtactcatgttaaccacctttatgtgtgtgcctcattaaatgtttggtaaaatgcatgtttccatcataccacaatagaggcagcaacacagtgcttactgcaccttactccggaaaatagtcattttcaggacgtactcgcacttttaattggcgtacactatattccaactgcttaacgatatcctccagttgacgacggtcaagtccattaaggtcggcggcaggcttaggtgcatttttcaaatcacgtatggttgcctgctgctcctgccacttgtccatcaggtcggctatattcgcataaaagcgttcgtaatccttgatcacttcatccagaaaggcatccacctcgtccggatcatagccgcgcattttattcttaaactgtttctcatgaatggagagcgcgtccagctgaatgcccagttgcttaaacaactgcttttgcttatccagacgacgcttcatatgttcatccatcggttattccctccttaacacactattctttttatatcacattctaggctgggaataaaagtctctgctgattgcccagccctatgaacgggtataaaagagcatacgtgtcacttatccagaccacgaaggggagagatgatcatgaaccacttgaacgattcgcagcttgcagagctgaaacatatgttgttggagcagaaaaaggatttagaaaagcattttgaacaaaacggtcaggaaaacgctccattgggagaaacactgacagattctacaggtgagctctcgtcctatgacaaccatcccgctgatatagggacagaaacctttgaacggtcccgtgatctggcgattaatgattcgctgcaagacgaactggagcaggtcaatgcagcccttcaacggatgaaggatggaacgtacgggatatgtgtggagagcggtgaagaaattccttttgaacggttgcaagccattccatatacagcctataccgtcgagcacacgccaactcgagaattatcgaatgaccgcccggtagaggaacaggtcatgactccgccacccaagggtgcaggtgagattcgccaacgaaatgcaggacgatttgacgatgcgggcgcatgggatgccgtagaaaaatacggtacatcgaactcgcctgcaactgccgccaagcgtgatgtcaccgattatgatgaaaatatgtaatgctatacgcttatgtattcgttcatctaaaaaagcagcttgtcctttggacaagctgcttttttatgccttacgggaatacggtgatcccgtttatccaatttctatccgttttcgactgcgagctgactcaatacaagcgtcgatcaccttcatattgctcaccgcatcttctggctcatacggcaacgggacaccgtcaagcaccgctttagcaaaagcatccgcttgcagttcaaaggaattaaaacctttcagacgttcctcacgcgtaaccgaaccgacgtggacgaaaatttgcggtaccacagacgttctttcccaaccgaacattttgggcatcgcaatcgtacccttgctaccgagaatttccatgttggaacggttggctgcccacatgccacaatcgaaagtaaggttgactccacccggaaattccagcaagccggaagccatcatatcgacgttgtcatgctccggggaaaataaggcatgtaccgtcactgcctccggctcccggtccaaatacatacgagcggctgatatcggatagacgcccacatcatatagcgagccgccgcccatgtttttattaaagcgcacattatctgcctgatcggtattgttaaacgtaaacgtgcaatggatgccgcgaatgtcaccaatttccccactattgataatttccttaattcttcgatgtttgggatgatagcgatacataaaagcctctgcaaagatcactcctgcacgttgacatgcttcaatcatgcggcttgtcccagccgagctaagagaagatggtttttcacacaaaacgtgcttcccagcctccgctgcccgaatggtccactcttcatgcagatggtttggcaacggaatgtacaccgctccgatttcgggatcagccaacagttcatcatagcttccataactttttggaatatcgaactcccgggcggcctcagcggctttatccgcattacgactagcaatcccaagcacttctccgcgttcagattgctgaatcgcaggaattacagcgatttgggcgatctccgcagtgcctaaaattccccatttcagctttctacccatcattctcatcctttcgtggttaggaatagttgtcttgttccgctttatgcagcatacctaagcaacggtccaaatcagctttgacctgcttcttgtacaatcgtgctttctcctccccatcatctgtaaagtgatagagtacaatctcctgaaaatccacgcgcgggtctgttcctttcaatcgcttggtacggtaaaaaacgccttcctgtaccagctcatgcaacgcccggtaaacctcgctctgaggcggaacatatccaaagccactaaactcatccttcatcgattcgagcatctgatatccataaccgcgatgcctctccaccattgtgatcagataaattttgataaaagcccgctgggatatcataaacgccatttcacagcctcctccacaccttattcgtgcaccttatcttccattataaaccactctgcgtccatacactatttcctctgatgagataagagtttatgagaactctccatcccttgtgacctgttttaagatggtgagagatatagaatgaggcgatatagagtagtgtgcgaagcgctgagaaatgattttattgttctttctattatgaatttttcatatgttgaaataatgtaactaaagctaaaaaaatagagttacgattgcgaagactggattaattgttttaaggcctccgtatcgttacttgtcaaaacaggaatatattctgttattttttggatgtcccagtcccaccatttcagtgtttggagcatagctatagtttcctcatcaaaccgataacgaattaacttcgcgggatttcctcctacaatggaatatggcagaacatctttagtcaccacggcatttgacgcaatgatcgcgccatcaccaatttgaactccgggcataatgctagcattgtagccaatccaaacatcatttccaaccacagtgtcccctttgtagcccccacttaaattgggtacaccaacttcccaatctccaccaaacgctccaaaaggaaaagtggtaaacgcatttgtattatgattagcgccattcataataaatttggctttggctgcaatcgcgcaaaacttaccaatctttaatttgtcccctataaaatcaaaatggtaaaggacatttttctcaaaatccaaagggttatcatcatcgtcataataggtataatccccgatttcgatatatggattaaccactacattgttcaaaaaacacagacttctaatatttttcatcggaaaaacgcttcttatatctggaccactcatttagcgaccctccccatatggatgtgaacatccagtctatcagtatgtatactattaaacaaatgtagatagaaaagtatcccttggccctatttcttggctttgggatactcttgtgaacatatgtgattgggttatcaaatcaggcttgcttttgtaaggctggcggacctccagtcgggcgaggacgaacccgaagccccacgatccatttacccagaggcaaacgtgccagcagccatgttccagcaacggaaaagatcatacatagaacgaatgaagccagcgtacgaagaacgtgactccagtctgcaaacaacctctcgtcaaaataataggtcacacgtagcataaaggcatgcatgagatacgctccataggacaacgttccgatggccgtcagcatactcgccacacgtccccccttatgagcaatccacgtggctacccgataagctacaaaaatagacgcaacgcaatatacagccatgactggacgcagcagagacaaatagttaaaggaaagaactgtacctcgcggcgtctggaactgaccgatcatctcatacagtaagtagcctgtaatcacgataaacaacggccagtatatcatctgtgctttggttacccaagcattccaacgcttgacgttcatcccggctgccgctcctagcacaaaataaaagaaaaagtagatcacattccggtcagcgtactgggtaaaccaagaggtaatgaccggaagctggagcttatccatcacttggtatacgggtccaacggcgaacatgagcaaaatatatagcacgccgaatccagccaatgcagcgggtcgccattttgacggcagtagcgcagacaaacggcgaacggcataacgaaacaccggaaataacacataacattgaataatcataacgatgtaccataaatgatagctgcttttcccgttcaacaacttctggaaaaaatccagcgggtgaatatatccaccactttgggcaagctgatttcccaattcgtataaaagagaccatatgatataaggaacgatgatgtccatgaatcttttacgtaaaaacgttccgtactttaaggctccatcataattgtaaaatagcaccattccagtgataaatacaaacacaggaactgcaaatttggaacacagcagtaaaagtgtcatcaataccccgtcctggatgcgcgccccctgcgcaaccgcatagtgtgcgacggaatgctgaagaacaacggccgcaaaagccagccctctcagcaaagcgacttcggaaattctctctttttgactcatgtcactctcctgttacatctagcaatttataaatccaggatttttgcaaaatcctcaatctattataacgacaattctgtaaaaatatatagaaggttaaacgtgccaacggcatgcaaagcatcatttatctcaggtttatcaatgagtaaaaatatgtaaaagcagcagtcctccctctcagggagactgctgctgtaaaaacaacctatatgcaaaggaaataggaaagcctactgtacatcactttcttgactagccgtaaagtgtttacaggttccttctagtatctgtgtacacatctgtacgcggcgtgtccgccaccgtatcatcatacgttctgtaacgatccgcattcagcgaacggttggtgcggaaaatatcataaacatccctgtgatggtccgcggaatccaccagcactaaaatcttgccctgatcgacgtatgtctcgtattgacgtgcatcatcctctggaatgcccagtccgaccagtccaccgaccaagccacctgctcccgctccgacagctgctccggtaagagtagccgcgataggtccagcggcaaggataggtccgatacccggaatagccaaggccccgatgcctgccagcaagccagcgacaccgcctacaactccacctgtagccgcacctgtcgctacaccctccggtgccttggtgcctgtctcttcactaatcgcccttagatcgtcacggtcacgtgtgatcacagaaatctcactgcttggaattcctttgctctgcaattgtccaatcgcacgagatgcttcctgttctgtatcaaaaacaccgacaattttcttttcgttataatcgtttaagttattagccatgatagttacctcccaaatattttagtgttgagtggttcgttttttcattaccccactataatgacgtttaaacgattttacaaaaattcaaaaagtcgattagcataaaccagcttctatttaacgctttggctttgctctgttggtcgccacagcttccagtggatcatccggccaataatgcttgggatatctgcctttcagatcctttttgacttcaaaataagcctcgctccagaagctggacaagtcggaagtcacttggacaggtcgctgggcaggtgacagtaaatgcaatacaattggcacacgtccgcgtccaatacgaggcgtatccctcataccgaacaactcttgtagtcgtacggccagcgctggtgcctcaggattcgaataatcgacgggaatacgagaaccgctgggtacacggatatgcgtcggcgcttcctgatcaagctgctgccgctgttcccaatccagcctgccaagcagcaatgcagcactgtccagccgttgcagatcggatacatttttggctcctatagcaaaaggtagcagccacgcttccagtgaatccagcaatgccgattccgtgcaatccggccagtcttcaggcgccgagaagtgcataaaaatcaaacgcgcctgcaactggagggtttgccgattccatgacagcagcttcagacctcgttcacggacaccctgcatcaaggcggcagcaaactcctctgccggaggtcgctcataggacgtttcctttaagacgagtgagcccagccgcagtatcttgcgggctctcactgctgaggcggagctatcccagtatacgttagcttgttccaacagcatttcactgcaatgctcgaccagctcttgcagttcaattggtgccgccaactgaatagcaccgtctgctccctcgtcgtctacttcagcggcgacgagataggacgaacgcgacatccactccacttgtcggagtcgcgccccccgaccgccgctaagcaaaaagcggccatccccccggccctgcgcgatccgatccggatacgcaaagaccaacagcagcccgcaagccgcggagccgtcaggctcgtcctgcgctgcggttgctgttggcagcgtggctagcagctgccggctctcctgcacgatacggcgaatcaccgtatcgtctgctgcccgcagcaggctgtgcgtactgcgggcatgggccgcctcgcgcagggcatccagtcgcgggcgcaaatccgtcccgccatgagcgcggaacgggtcacgctcttgcagcagcgcagccagacggctggcagttggtgccaggccgagggccgcagcacgcaacagcatgtgcccaaggcgcgggtgcgtgcccagggcggacacctcgcgcccatgcgcggtaatgccgcctgtagtgccatcggctgctgcatccagacagccgagctggtgcagcagacctattgcctggcggtacgcggcctcaggcggggcatccagccaggccagctcggcgggctcgcgcacgccccaggccgctagctccagcgcgagcgaggccagatccgccgcggcgatttccgggtggctggcatcggggagcgcggcttgctcctgcgcgctccacagccggtagcatgcccccggctggaggcggcccgcccgtccgcgccgctgatcggcggaggccttggacaccttgaccgtggtcaaacggctcatgccggttcgcgcggaaaatacagactcccgcgattgtccgctgtcgatcaccaccgtgattccggcgatggtcaagctagactcggcaattgaagtggccaataccacttttcgactgcccgaagccgacgggcgtattgcttcatcctgctgctccagcttcatgctcccatacagcggaatgaccttgacatgtgctggtaaatgctttgaagccaattctcgttccgttctgtgaatttctctagcccctggtaaaaacaccagcagatcaccttcatgagcatagagtaccttttctaccgtctcagccgtaaaggactctaatgaagttgacgaaggtttggacatatgaaaggtttctaccggaaatacagtgcctggacattccagcaatggcgcatcccctaataatctacatacaggctctgcctccagggtggcagacatgatcaatatcttcaaatccggtcgcaacagtgcctggctttgcagggcaagtgccaatcccaaatctgcatgcaggctgcgttcatgaaactcatcaaaaataatcaggccgactccctccaacgcctgatcatgttgtagcatccgggtcagtacgccctccgtaaccacttcaatccgtgtgtttggccctacctttgtatccatacgaacccggtaacccacggtcttcccagtgggctctccgagcgcttttgccatttgcaccgctgctgcacgcgctgccaaacgcctcggctccagcataatcatcttttgccctgccagccacggctcatgcagtagctccagaggtgttaccgtcgttttccccgctcccggctgtgcaatcagtaccgccgctgaatgggattgcagtgtatgcttaagctcggggatcacttgcataataggcagttgtttatctgtcaatgaaatctctccaatgatacgcttgatgcgtagaatctaagttttaattcctttattattgtgaatttttcattacctgtaattatcgagcactgaatagaaaaggttaagctgcccctctggaacttctcttcggtctgtcgtgcataattcttctaaatctattatacagatatttaaatttcccgtctggccatcgcagctatgtaagttttctgtgttagctcctatacctgtcgggatgcactcgcgacaagatcgttttataatatagttgatatggattgctgaaggacggaacacagaatcgaggtcactttcgtatggaattacaggcccaacccatcagagggcgatttgccccaacaccatcgggatggatacacttaggaaacgctcgtactgccttattatcctggctgcacgttcgctccctgggtggaacctatattttgcgcatggaagatattgatatgacgcgagctcgcagccagttggcgcaagggattatggaagacttgcgctggatcgggctgaattgggacgaaggacccgacgtaggcggtccctacggcccctacactcaaagccaacggctggaacgctaccagtctgcattggagaaactacagagacaagatttactgtatccttgtttttgcagtcggaccgacattctggccgccgcccatgctccacatggactgtctggtgaaggacccgcatattcaggggcatgtcgtaaccttagctctcaagatgtcgtagccaaagcccagcataaactcccttcacttcgctttaaagtaccgcaacatccagatgccgttatttcgtttcatgatcaggtagcaggtcatgtggcctttggtgcggctgaggggggcgattttatcgtcaaacgagctgacggcatgttttcctatcagctggctgtcgttgtcgatgatgcggatatgtatatgaccgacgtactacgcgggtatgatcttctcgattcgactccccgtcagctattgctgtaccaagctttggggttgcagccgccacgttttgcacacgttccccttgtcctaggccctgatggacgaaggctggccaaacgacatggtggcgtagcactccgagctatgcgccgacaaggggtcacaccggaagcagtcattggctggctcgcctatttttccgggctgctggattcaccggtgcctgtgaaggctgtggatttaatcgatgactttcatttggacaaactgcccaaagaacctgtcatcctgacgaaacaatgcctcacgagattatctgcactgcaacggtaatgaggtaaagcacggagattaaagtgtacgagcaggggcatccgccctttgctcctctcgcttctattcctccagtcgcttacgcatagcggactcatattcaaaaaatacagacgacgtattcagccctctttcctccagcagcatacggagacgtagtgatttttcagtcagcctgcgactgatccgttgttgctctcctgcctcatgacaagcgtgaagcaaatcacgtagctggacacattccttttgtaattgaagctcttccggtaaaatgcctgcattcttcaacagcttgtacgacatccgcagctcctctggaacatgtgacaaatcctcgatcaccagtggcttgccctctcccggtaaatgatcaaactcacctttggccatcgcctcggcaatcttttgctctgccattctggagaacatttccatcactccttgtattaagcttcctatgtacaatctatattaaagaaacctggagtcctttgccactgtagcttatatatcattaggatgccctgtttccataaaggagaaagagggttattcttcgatcccaagcaattgacatacttgtactctatattttttggccttacgtgttccatgaatgagattggacaagcggctagcaggaatatggtaggtatcacaaaatgttctctgatccatttgcctctcaactagcttttctttgattttccagccaaaaggagttacaggatttcgtttgttcaacaacgttatcacctcttcataagtataggatttagaattttgattggggtttggggattggagttcgtcttcttcctttaaaagcgcgtcatgcacacacattagctaagatttcattttgcaggtttggtattgattcaatagttcatccagtttcatggattgttcaatcactttgggatgcgttaaaaatccgtatttcttctggatttggtacagtctttttctggcccgttcgacacgaagtaaagtcacacctggattcatcagcatgattcccccttctgtgtcatatcctaatacaaaacgtaaacttttggattttttgataatttactcgacaaaaaaatgcttctggagcattccagaggcacttttttggcgttttatgtttatttaaaatgcaacagactcctacaaaatgaacttaaaattcaactattgattcactacgcagcccgatgttgcttcccatcgtcaccgcccctgtatttcctgaataaattcagattaaggttaaaatccgtggtaagggcgaacgctttacttgcacagcaacattctaccttcttcgttttccatatatattttattttattcaacttggaatcaacactgagaaatgattaataactattaataataaaataatctttcttttcgcccttctctaactaaactttcatacttcgtacacatcctaaagtctgcaaattgtttgaactgctcaaataatcttatacagctaatgaaaaaggcttctttgttaatgactaatgatttagataaaacgtctagtaagtatttaaatccatatgagtaattacctttatttaagtagtatttagccagttcatatttaaaacgcgttgattgttctggaaccacttgatgagtgtacatatcagcagatggttgctgttgggtgatcgaatctatctccgcttcgaactgcttaagtacttcatccacatcaacttgaaatcggttagccgccatcataatattcaataattgagtaaccatttctttagtggtaattgatgatacactaatatactcaacataatcaggaagcacacttatatctccggacaatagtttatttacatacgtattaccttctgaccaatgtttgtacaagttgacccagtgttgagtgttctcatccgtctctatgacccaatccaagtttgcgtaggcgtatgtatattgtagggcttgttgataatcaccttgagcttcacagacactagcgcacagtaaatcagcataagtaatgtatgcgaataacggacactttgttttcttgccagaaccctctcgcttcttctgctgatgcttcaacgaatattggacttccgctttatctctcatttttcgagctgtcgcatcaagccgatcccataagcgtaaagaacgatacacattcgctaaatcttttagggcatcaagttgatctatttcatccagtcgttccatgaagggttcaaatagcgttgctgccttgagatttcggctttgatcatctccaacttgaatcgtgaatatacgatattggcaggtggccaaacgttcagaatgctgatatttctccacttctgcgacattctcatagagaggcagcgcagcagcatgtcgtccctgttcaaataatgcttctgcaacatcaaatagcctagtcgcatacagcggattatccatgatatgtccaaccattcgacggattgcatccagcttgtccagctccgcacaacgatacaataatggctcgattcgcctaaaattcggggaaaggtcaatgatgtaattttctatgtatagatcgtaaaaatagccttctggcaaatccatagccacagtgattcggtctagctgctgtacggaaacaggacgatgctgagtaatccaattactaagcgttctttgatgaacccctgaatattcggcaaattgactcaatgtcatatcattttgttttagataatcctcaaactccgctgaaatcgtaggtgtatgcttcaagtcataaccacccttcacataaaaattccattattttaaaaatcaccctctattcttctccataattaaccatctgtcaatatattatgcaactaatgtttataacgaaaattcagcataacttacacatattgagacatattggacaagcgacatcctgaaatcattggatggttccaaataaaaggtttcacaatgttgacatgacggattcatttccctaatgtgcattctcaccagtaaatgatatagaggtcccatgcaaaaactctgttggaccttttaattacatgaaaaatcccctgatgttgatgcaatcaagggatacataggtcatttctctcgctttgataatgcgaagttgattatttctccaatcacaattcctgtcaaaattgcatagattcccatagcgctcatctgatatcccaaagcgtaaaataaccctatacctattgcgtagcccaacaaaatcactgcatagcgttttagaaacttactcatggaaattctcattagcaactcccaccttaatttatacttcaaccattgtaaatgttaagtaattgttgcataaaagtaaggggaaatttgtcgaatgagaaatccgttaagaagaaatttgcacctattcactgctgggcaggccacgaaacaagccttctttttcataccatccacgcactcacatggagtgcgaccaattttgaggtgtacccctcagtcatttggcgcaaatttcaatccacgcactcacatggagtgcgactttttataattcgtttcatcatcgagggaaaaagatttcaatccacgcactcacatggagtgcgacctcagacgagttttcaattccttgacccatactgtatttcaatccacgcactcacatggagtgcgactctatgcttttctatagcgtctttgctcattaccaaatttcaatccacgcactcacatggagtgcgacgactgcttggagacgcgaacgaagaataccgtaagatttcaatccacgcactcacatggagtgcgactttggtaaatccaacgtacttatctaagatcaaatttcaatccacgcactcacatggagtgcgactttgatattggaaatatcggcacggctgttattatttcaatccacgcactcacatggagtgcgacgtatcccctttacgtacttcgtaaatcgtcattggtcatttcaatccacgcactcacatggagtgcgacgtgattgttacagccgatggaacactattcgagatttcaatccacgcactcacatggagtgcgactaaaaaccatgctttcagacatcgttacggagtatttcaatccacgcactcacatggagtgcgacttaaccgaatctgctgataatgcttttggtggatctgaatttcaatccacgcactcacatggagtgcgacaatggtgcgattctacaagatagtgctggaagtgatttcaatccacgcactcacatggagtgcgacagcgaaaatgcagtaattgataccctaatgatatcaattctacacattgtcgcaaaaactgatgtcaaataagcttggatcaactattgacttttacggttaaatagcaattttaatacttttcgacaaatttcgaggtgcgaaggacccggggtttttatgtgagcttcacattcgcaccttataaaatcagtgggctttccatatcgtaagcttccttagcccctattgctctactttctttttatagctatctccaaagttgtagaaacgcaggctgtcttcttttttgtctatcaattcttctaattcatattttaaacggcggaactgggtcgaatccaaaatgcactcaaacacggaattttacaccctttgtccgtggtctacgcaccttttcacaaccttttccagtctttttctgccttctctatctaatgtacttacatcatacgtaattagtattaacaagatcaacctacttccacaaaaatggagggtactcgtccagatctccacgaatatatctagctaagagcaaagcctgtcaataggacacaagcccccaagacattttctcattcaaataaggatgaatcattttttcctgtttccgttcttgccatgccttcaatacgattttcctcgtatcatcgtccatcatagcagcctcgttttcttttttgtaaaatcctttgccatgaatcattttttgttaataatgtaagaacaaaacggtcgggatatactcctctaagctcttccatcacatccagtgccaaggaggctcgccctggacgatcttctatgcagaaaacctacataagcatagaccgacagcttctagtgcggatttcatatcgttggacaacagtgtataggcaaaagataataggtcattcacgttatctaacggcgggcgcttatggcgtccatggaaataaaaatcatctttttgctgcaagatcagatcatcccacacggaattgtactgaactgccgccgtcccctccaaaccgcgtaaaatctccagctcctcacttcacggacctcttcatgatttcggataaagaggcgctctccactcgtacgaccaagtggcggctgctccgtcatgatccacgcactcatatagagtgcgactctctcttatttcttttcacgcaaggaggacaggatttcaatccacgcactcatatagagtgcgactcggaggcaaattggcaccactgcttcgccataatcatttcaatccacgcactcatatagagtgcgacttaatttcatcatgatgtcaccccttgatgttggatatttcaatccacgcactcatatagagtgcgacttggcgttagacacgtatttaatcgtatgtactttgatttcaatccacgcactcatatagagtgcgacctaatggaagcagcagaacaagagttgcgccagaaggatttcaatccacgcactcatatagagtgcgaccacccatcttcataatttggccgtccgttgtaccatttcaatccacgcactcatatagagtgcgaccatataccctgtcattgtgtccctaaagctatataatttcaatccacgcactcatatagagtgcgacctaaacaggtggtgcacaacatggaatctatattatttcaatccacgcactcatatagagtgcgacagcgaaaatgggtcaaatgccccctatttaagtaacattctagcgttattttggcaaaaacgcatctaatattacctcatcctcttgcgatcgtttaaaatttgttcacattcgatataattcgacaaaatctgaggtgcgaaactctcggagaattcatgtgagcttcacattcgcacctggacagactcgctttttggcttagcaacaaattcctgcctggacttatttcacctctgccagttctgccacctgtgaaggaggaagcgcacattcgaatatatttaattcatcgatagcgcatttaaaagcaaggttccaccagttaactccaaagctaaacgttctggctttgggtaaatgcatccagaaatatccactacattgatcagaaaaatacctttatgttttcaaaaaacataaaggtattgtaaaatatttcataaagacgttctgcaaaagttgagttattaaccctgttcatcataccggctgcattacctgcataaaccttcccatccgttccagcgccttctccaaatcgacgagcgaggctgcatatgagcagcgaataaagccctctccgcctgatccgaatacatgtcccggtacgaccgccaccttcgcttccttcagcatacgaagtgcaaactgctcagatgacatgccagtagaagtaattgaagggaaggcatagaaagccccctcaggctcatgacaagcaagcccgattgcattcaagccagccacaaacagcttgcgacgttcattgtagctcgccatcatctcatccttggcagccaagccatggcgcaatgattccagcgcggcaatctgtgcaatggtgggcgcacacatggctgtgtactggtggattttcagcatgccggcaatcagctcatgcggaccgcacgcatagcctacccgccagcctgtcatcgcaaatgctttggaaaaaccgctgatgacaatcgtacgctccttcatgcccggcaaggaggcgatactgacatgctttctcccgtaagtcagttcggcatacacttcatccgaaatgacgaccagattatgtttgataatgagctctgtaatcggtagccaatcctgcttcgtcataactgttccagtcggattacagggataattgatcattaaaacctttgaatgaggtgtaattgccgcttgcagcgcttgcagggtcagcttgaattgctcctctgccgtagctgccacctctacaattttaccgccatgcagatgggtaatgggttcataggcaatatagcttggtgctggaatcagcacctcgtcacccggatcgatcactgctcgcagcgccaagtcgacggcttcactgctccccaccgtcacaatcatttcctgctcagggtcataggaaagcgcgaagctgccggaaaaataagcagagatctcctcccgcagctccatcaagccggcattcgaagtatatttcgtctgtccttcacgcagtgcctgaatgcaagcttcacgtaccttgtccggtgtaacgaaatcaggctctccgaccccaagggcgattgtacctccgcctgctgcattcagatcaaaaaaagcgcgaattcccgatgggcgaatatcccgtacgcgcgaggatacaaaccgccctgtccccatttcactaaacatattacgccatcctccattcctgtttccgctcatggagcgagctggcaataatttggtcgagtagctgtgtaaaggttatacccgcagctgccgcactcttcggaagcaggctgttggcggtcattcccggtaatgtgttcacttccagcacgtaaggtctatcctgacacaaaatcatatcgatccttgcatagaccttgcattgcagcagccggtagctggacagtgccgcctcgcgcacacgctgctcaataacggggggaagctcgatcaccttctcctcagcgccgccgacctcatattttgctttgtagtcgaaccacttcgaacgagcggagctaatgctaataatcggtaatacctcgccatctacgatggagcaggtaatctccgtcccttcataatagggctcaatcaagatcgcttgatccaagctgcaagcctcctgaacagccggcagcagttccttctcattttgtacaagctggatgccgatgctggatccccccatattcggcttcacaataaccgggtagcccaaatgctccaccacctgcggatcataatcgtccatcccctgccagtaaaggcctgaaggcgtatgcacacccgctgccttcaacagcatcttggacaactgcttattcatgcataagctgcttgccaggacaccgctgcctgtgtagggaatgcccagtgtctccagcgctccctgcaccgtgccgtcctcgccatactgaccatgcagtgccaacagcgcgatatcaatgcctgcctgctggacctgcgcgattaaatccgctcgctgctcgatcaccattggaaccacttcataacggctgcgatccaaatgattgatcatctcttgacctgtctgcagagaaatctcacgctcagaggaaataccgcccataataacgccaattttcatcatgacacctcatttttcttcaaaatctttatgtggctacggatgttcatccgatcgctattgcttcttcgaaacaatattccttctctatagctcttttcttaatccttatgccttaagaaatttacgcgtctgtttaccgattatttgaataccccgttcgatattttcatctgttactcgtgaaaacccaagccgcaatgtattcgtcccttcgccttcttgaataaaaaacttgtctcccggtgtaaaaatgacaccctgttctgtgcaagcttctagcagctggcgtgtatttacgcctgtcgggaaggtaaggaacaaatgcaagcccccgtcaccagacacctgcgcctcaggaagatgtgcttcacagcatgtctttgtcagctcatatttgcgcttatactctgtacgtgctttttttacatgtttatcgaaatttccgttaagcatatattggtataaaatcgattgatcgattgttgaggtatgaatggtgcgcgcacgcttaatgctttccagagtgtcaatcagtgctcggtctccaagcacccagcctacacgcaagccagggaacagcaccttggagaagctgccaatatagattactccgttcccttggcctgctgtcgctattaagggcgcaatatgcgctcccgagtaacgcagctcctcattgaatccatcctcgatcaccggaatctgatagctcatcattaatttcataacagcgctgcgctttgctggcgacatgacgatgcctgtcggattgtgataggaaggagtcaaataagccaaatcgaagctattggtctgcaatacctcctctagccgctctacatcaataccgtcacactccatcggaatgccggtaatctcaaatccttgcaacttcaaatttttgatcgctgtgtgatgggtcggattttcacaaattgccgctccgcggcgtgcagaagggcgtaaagccgacagcacaatgtcaaagccttctgtaaacccgcctgtaatcagcatatccttgccaattatatcgacgcctttgttctccatataatgcatcaggtaatcaatcagcggcttgtagcccttggcatagccgtagttgagcagcacctgcccttcgattgccatccgatccataaaagctcgccttacatcccctagatcaaacagttgctcatccggggcgatgctggtgaacgagatagttcccttttgggcacgaatgccctgcttcatcatatccaggtcaacagctgatatagcatactcgttcattcttgccttccagtcgatctcccaagtggcagagccgtcagatcctccgttatctacggccgactggcccaccatggtggccacataactaccctttccgggaatcgcatacgtaaatccatcatcctccaagccttcataggctgcaatgactgtattgcggctcaccttaagcagaacgctcatttctcgtgtggaaggcagcttctgatccgcctgaagcgccccttttataattaaacgattgacgtattcttttacttgtatcgagaccgggcggtcactgacgagcttgaaatcctggaacatccttcatcgcctccccctataatgatggcatacaagacgtgtgaaaaaaaagaaccaccgcactggatttttcatccttcggtggttcttccgtattttatctcctgtactccctcgtattcttgcctcattcccctgcatcattgcctctcatcgcgcccattgcgagcattgtatatatcacaaagatcgtttcacttcgattttattttcttccttctgcggctgaagccctgagaactatgcaaagcataccagtcaaacaaaaccatatgccgtaaggactgaccgtgaatcctgccgcatcgtcaattgtcacatggagtgcgcctatttctttcttgaggacgtcctccattcatcatatttcaatccacgcactcgtatagagtgcgacacggcaagcttaagatgtaccgtttgtccaaaagaatttcaatccacgcactcgtatagagtgcgaccacccggatcaaaacccccgtgtcccggatcaattaatttcaatccacgcactcgtatagagtgcgacgggattttgatttctatgtattcaaaatggaaattatttcaatccacgcactcgtatagagtgcgacgtgtcccatccgaccaactcctttgtgtctgatatatttcaatccacgcactcgtatagagtgcgactatagtaggaataaaggatgaaggtatatcagacaatttcaatccacgcactcgtatagagtgcgactctgcttttgcgtaacccacaaggcgtaacatctgatttcaatccacgcactcgtatagagtgcgaccaggaatatcagcgcgtgttgatggagccgttaaatttcaatccacgcactcgtatagagtgcgactcgtcagggaggcgtagggtgcagggatataggaatttcaatccacgcactcgtatagagtgcgacgcagctattgccggaaccatcttcaccatatgggatttcaatccacgcactcgtatagagtgcgacttaggattgaaagtgtctgaaccagtcattaagtcatttcaatccacgcactcgtatagaggcgaccgcaaattctggcgctacgtcatagaccaagagatttcaatccacgcactcgtatagagtgcgacgctagggttctgaaaaaccgatccgctccgccactatttcaatccacgcactcgtatagagtgcgaccgattccgagaatgtacgaccacgctgctcatctatttcaatccacgcactcgtatagagtgcgacgtggcggcggtgggggaatggttccataaggagtgatttcaatccacgcactcgtatagagtgcgacaagggcaatgctaagttgggtaatcttctcaaggcatttcaatccacgcactcgtatagagtgcgacatgaagatggtaacaaagttaaattccttgaattatttcaatccacgcactcgtatagagtgcgacagcgaaaagaacgcaaataagtaactttatcactttattttaacgtgtatccgcaccaataaaatcattatagcctaaatccctaaagttacgttcacatttcattcacattcgacatgttttcgacaaatttcgaggtgcgaatccccccggaaaatcatgtgagcttggcattcgcacctctgatttagactcatcatcataccctataggatcagcggcccttccatatcataagccgttttggctccggtatgctctactttatttttgtaattgtttccgagattgtagaaacgaagactatccgtctgtttatcaatcaggccctccaactccagcttcaaacgacgatactgagctgcatccaatacacattcaaatacggaattctgtactctttgtccgtaatctacacatttcttggctactctggacagccttcttctaccttcactatcagtggtactcacgtcatacgtaatcagaaccagcatcgttcacacctacttccacagaaatggaggatattcatccagatcaccacgaatatatctggcaaggagaagcgattgtgcatatggaacgagtccccacggaatttgctcattcagataagggtgaatgatccgctcctgcttgcgttcttgccatgccttgattacttttttacgtgtatcatcatccataatgaccgcaccattttccttgatgtagaagcccttgtcgttgaccatttttttgttaatgagattcaaaacaaaacgatctgcatatacccctcgcagctcctccatcacgtccagcgccaatgatgcccgaccaggccgatctctatgcaggaagcctacgtaggggtccagtccaacggattccagtgcagacttcatatcattggacagaagcgtgtaggcaaaggacagcaaggcattcaccttgtccagcggtggccgcttgctgcgtccatagaagtaaaatgattccttttgctgtaaaatcagatcatcgaacaccgaattatactgcaccgccgcactgccctccagcccccgcagcacttccatgtcctctgtctggcgcacttgcagcatggtctccgagagtgaggctgttacttttttcatctgctcggtacggatacgcagtgcataatcccggatagcccgttcgagaatccacttgctattgtacagcttgcctacaatcatgttccttgccagcttcgcactccgaatctcgctatctgaaatacgatactgttccttgcgcagcacgacattgccacgatcttccccaatcactcgggccaaaaatctccctgagcgcgtcatgaatgtcagattcatcccgcgcgaagcacaagcgcccatcagggcaggactaacgcctgcgtacccaaaggtacagactccttccagattatggagcggataacggcccaacgtgttctcttcctgtttgatgacaatattggctccgtccagagacagataagtatctggtgatgtgacaaacaatgtattgagcaactttttcattcatccaacctgctttcaatataactggccacagatcttttatgcagtatttcaggcacgcagaggttcatcagggagcagttgcggcagtgtgggcctgctttggctttaggggtatgacttcgttcataataatgccgcatctcttgcacacttgaacgaacacgttcccggtcatccctcgtaattctgacctccacccgatgctttatttcatcatagtagaaaaaggcagtatttatatcacagccaagcatctcctcaaggcaaataacctgagcgacaagctgtgagtgatccgaatcattccgcttgggcttaccccgcttgtattcgaccggataaggaaggaacagtccttcctcgcctgccaacggaatacctgacgtatcccgaacaaactcaacgacatcgcaaatcccggtaatccccagctctctggaatgcacgggcagcgcgcggacgacgagtttatttcctcttttctcacgaattgtcggctgatctgcattacggtggaggtagtcgccctcaatggtacgaacattgtcctcccattgctgttcgatatgaatgagcgcccactgtcgacggcaaaaattaaaatgctgaagtcccgacaacaaaaggtaatcttcctcgttatattccggcataacgctgtgcttcgagcccctccagcggtactgcatgaatttcgtaagcgtcatacaattggggtacaacgccagcttccttgagatctatgtgcagtgaacggtgcacctttgctgaagagtgctgccccagcttagaattgtgctcccaccaaaatacgtcatgcacctccatactgccgtccggacgagcagatgaggcatcattttcaaacaaagtacgcagggcttcacgaattttaagggcatcctcataggtaaaacctgtcttctccgccagttgagtattaatactgccatagaacacatacacgccaaaatcgacgcgatgcttcattcccatcgtatcagggccttttttgtccgggtccttggaagtgacggagttgacactcttcgtaatttgcatgctggagatgtcaatgggcgccagactgactgcactatgtatggagacagggccccgaatacctaccgacacatcggttccgctaaaggcaaacacttgtccgaagcttctcacatccacccatgactggcaggcaacttcggcaaagcgttccttgtcggccttcttgcccttggcatgctcctgcaatgcagcgttggcatcgacacgatccttgatcgaacggaattcgtcatccctccgatcatcggattgtaccaaaatggcctctcccatatcctggagtcgattacgcagcttgcgcttgagacatacgtctgaaatctcaccatgaccgtcataattctgacgcggacgattcccgttaagcggatcaccattgggattagcattgcggactgacaaaactacagcaaaatctattttatgattcagtgtactcatattgttgacctccttagtcttctcgttgctttcaaccgcgagattatgcgctctgttctactccgaatggtcatcagttaccttatccggagggtcttgcaaggcttcctgacttgaatttgcttgtccagcttctttggcttgcttgctggtgtacatctcgtctcgctggttgtaataccccatcaggaaaagacccgtcagaggctcatcattaaattgttgaagctcaaacttgcccattatttcctgacacagcttgttataaaaaaaggacttatctcccattcgcaccaggtaaggctgaatctgggcgtaaatgattttccacgtgcgtaatggccgatgtgagaacacattcatgtaacgcacggcgtttgttgcccggtgactgctgctgcctgagcgttttttttcccggttcagctcccgttcctccagcacgtctgccacagccagaagtcggccaaacagatagctgcggtctgtagattcggcttttaaatacaatccgtacccctccttcgcatagtgcttgtttacaagcgcacaagcaatgctcaatgtcttttgccattcccactcctccatccccacagggttagaggcacgctgcactgcgcttcgtacaatatccagcggtatttgtcgctggtccacaatgcatggcaagatccgttccattaatcctttgacgactttatcactggcacgcggtccgtaagcggcaaaggcaatatcctttggcgtcggagttttgacaaacgtggcagagccagtgcttgcagtctgatttttacgataacgatatctccagtagcaggtgatataccagtgctccaattggtctatatatacattctgatctaagttgcggtagtacacgattgacattctacccggtgtcgctgcatccagaatcatgatagtcacatctgcaatggaagcatactgcggatcatatcggaagccgacgagtgcatcgcgaacttgcagagcatattgcttgtgtgtactgtcccccatcacttccggctccatttcatgcgctgcgaacagatcatatatatcttcctgcggctcgggctgtttcaactgttcactgccccatacgagaaacactttgccgtcctttggcgtaccctggcgctcaatgagccacttgagggcgttatgtgccttctgcgagacttcatagctaactaccgctgcctccctgctagtacgaaatcgcccacgatacgtgaaaccaccggaatcattggccgagattagtttggatttgtcgccggagtgacggatgcgagacgcatgtttttcggctatcggtagccactctccacttacatagcagaggtctgtatcttccatacgtgacgcataatattgagtgaacgattcctgaacttgcgtatcacgccatagacggtgctctatctgccccggctcatgaacagcgaacctgacgaatgccccactctgatctccgacaataacattgaaaatttctggtttctttccaaatctcttttccagctctggtgtacatttgcccagcagctttccgtcagcacccggatggagcacctcatgccgcaccaagtcttcaatcagcgtaccttggcgtacatattcgtagacactgcgtactttgcggtcaccataaggagagctgcaccagtcctgcaactggctaagatagtcctgatggggcgtccccttaggggcttcacaataccgtgcgtaatcccctgctacatacatcagcttgtcgaacaaaggataaggcacaggtgcactagttcggctggctgctgcctccgtacaaggaatgatggtgctgccttcctccttacctactactctggctttcaaaaaatgcccgtccatatccagatgtacttcaatgtgtgccgtctgtgtcgtatgggaaagagggatgagagcgtattcacgaccatccttttttagctcaaattgtcctgcaacatgagcatggtcgtcataggtttggctcagattttccagccagttcatccttccacctcgttcccgaaccattcctcgtacaggtcgtcaaccgactgcacattgtgtggactaaaagtcttcggcatgaattcgcctacttttcgtacccattcgcattcctccggaggtttgaagcggatgacacccttcttcatttccgcttgccacagcctgatttcccgttcctttcgtcccgtctcgtcaggatagttaataccgtgtaccatcgtgccaaagttcagctcttttacgttatcataagcacccgcatcttcgtcgaacacgcaaagctccacatacccctgacactctcttgtgcccagaaaaatatctcttcgcccccccatccgcacagcacgcttcgcaatattatgatgcttgtgctcattgcgatcatgaatcaaatcctcacggtgaggattaaattcaaaatgggcgcgtacgcgataccgcacgtctttaagataggtataataggccaacgtgttcccaccgttgtattcaatcgggcgcatccccctggattcagtctgaatcgcattcataatccgcacctcatccacaatccagatcagcgtaggtttccagtagattgactccacgatacccttgagcgcctgataggtcggcacttgatagctaaatttctcgccgcccagcttggtgagcggatcggtaaacaacgcatatcttcctgatacctcgaattcaatctgatttctcatctgtgtgcctcctttcttattctgtttgtcaaacaagcagcgccacccaagcagttgctcaagttatgagcgctccccattccccttcattctccatcgtcaagccatactccagcgagtaggcgctatcacgcagtccccaagcttgaccatgcagaagcggataaacgtctccattcttgtgcaactcatccagctcatgcttatagatattgactgtatatagctgcgcctcacgcagcaggtctcccaacttgtcggaaccaggcgcccattcaccattgagttcgagaatcaactcagctcccctgccgtaaggaaccagcacgggtgtagcatggctctggatcgcttcaaaataacgctctgcggtagcaatagcagtcgtattcttcaaatcggtctgtattttgttgcgcttgcaatagctatccttgtaataagtattggcattgatgagatcgaacaaattttgctccagctcagggatcggatgctgaattttttgctttaccatagcaaaatatttttcaaaatacagccgcatagccttggccgacagcaactgttcaggctgctcgcggaattcacgcaacacatccacggtcatctcgccgccgatacgaatttccggcagacgtgtcaaaacctcatctgcacagcgtataacatacaccttgcgtaaaaagtcgcgaccatgccgattgcatcgtcccgccgcctgggcaattgaatcaagtccggcgagtgaacggatcacacactcgaagctaatattcacccctgcctcaataagctgtgtactgatgcagatcacacgcttccgtcccaaagtgcgaatgaccccgtgctcaccagacagcacatccttacggtgcgttccgcacatgttcgtgctcaaatgcacgatttgaattccttgcacacgtacccagtccgcagccttcaattgctgatacagcttacggacagccgtcttcgtgttgagaatgaccaaagcattattcacctcgtccatttgctcctggaggaagtcgcctattttctccgctccccagccggatggtgagtctaagaccaggtctaccattttaacccttctaaaactttgttcgacatcgtctaatttctcaatcaattccgggttcggtgacaagcgcagctcattcttcacataatcaagcgcaggctgcgttgctgtgcagagcacaagactggagccgcctatcgcctgcaaaaaattcagtgccgagttaaataaggagatacagtggacaggcacggactgtacttcgtcaaagatcagaaccgaattaacgagtcggtgcagccgtcgtacattccgtgttcctgaaccaaaaaacgtattgagaaactgtaccattgtagtaaaaatgatcggactgtcccaatgatcccgagccagcttgagccgcttgcgccgcgtctcgtatacttctccgtcatcctccgccgtgcgttcgtcatcctgatcatctaccacgttggaatgatgctccagaatcagatcgccacagcccagaatccggcgaatctcctccgcattttgttcgataatggtcgtataagggactatgtaaatgatacgatctttaccagtctctagcgcgtgcctgagagcataacgcatgctggcaagtgtcttgccgccgcctgtcggaatggacaaggtatacgttccggaagggcgatacgccgctctctcgcactgctctgacatggcctgtcgtagccgttgtatatccttgttggcctccgggcttttatttaagtggtgtatatgtgaaataagcgtatcatagctggattgaaaaaattcgtggtgtttgtgtgcaaagtctgctatttgagataaggcgtcaggaacttcagacttgccttcctcaaacaggcgggtgttggtacggtcagcgtcaatcagacaactgaatagatactttaagagcaaggtagatacaatgggtggaagcctgtgctgcctgatatggagtacatattgcttgaattcctcgatggtacaggcgaacagctcatctagcttctcaggaggaacgtggcgaaaaaattcttccaccgcatcctcatactgttttagttctcggtgttccacccgctccagataaggtgaagtgcgatcgggagatatataatcccgcagcccttgatgatgcgaaataatacaattggctaaccattcggcggtataccgatactccgtccccttgtggtggtaacgggcatggatcagccgcccccctgctgtcgaatgatcaaccgagcctctacggggcgcattcgcagcgttcgtgctgaatacagcttgctgaatatacgtactgaacgcctcagtatttttaccaaggtcgtgtaacagccctgccagtccagcaaaataacggaagccaattttggcccccgcctgctccgcatattcctgcacggccagcaaatgctcataaacggtctgaattttcccatctgcttcgcggatgtgtgcgatatagtccgtatgaatcatctccaaaatccttttttagcacagagtaaaagagaaatatcataaaacagtccttgagacgtagttctactttctcattattcgactttttatgcccaaatcctcttggattcatattttcttgtagaaatttgtgtgaagcgtccatcagatattcaatgctaatctcgcacctgtccaaaaacagcttttctatatgccacattcgttattttatgaagtctcttaatctgagcattttgcataaatcccaagggcgctttcaaatcaacaatctaggatcgaaatgatttagttcgcctataattactagttttcttatggagtgcgactagcttgaagactttcttggcagcgggaaacaatttcaatccacacactcatatagagtgcgacgtgggttcataatttgtgacttgttattttggaggatttcaatccacgcactcatatagagtgcgacaaaatgtgcgagttacgcaacaaaaattaatcatcgtttcaatccacgcactcatatagagtgcgacgcatcgtgagttgtgacaggctcacctatgttaagtttcaatccacgcactcatatagagtgcgacgaaaaaggtggtacattgcgtcaaataactggtattgtttcaatccacgcactcatatagagtgcgacccccgccgagtagagcgaacaccttataaacaaagtttcaatccacgcactcatatagagtgcgacagcgaaaagtggggaaattcaatcttatgcagccctattttagcttaaattttaacaattgatatcgaaaaatgaatttgcacactacacaagttcatattttgttcacattcgaatgcttttcgacaaatttcgaggtgcgaaagatccaggttttttatgtgagcttcacattcgcaccgtaaccaagacaatacactcaggataccacaaaacatttctctgtcccagagaatgctctattttctaaaataataacgactctgccccatcaataacaatttgtgcgccagtaatgtgtcgcgaatgatcagaggccaaaaatgtcaccaaatcagctacctgctcgggttgacccggtccatcagccaacggttgtcctccttcgggaaacttgacggggatggtaatttgctttaacccttccgatttctccgtggtttcatcaatattcgtcgagatggcacccggatagatgacattcacacgaatacggaacttagccagctccagcgcagccattttagcaaaaccggtttgacccgccttcgatgtgctataggctgacatcccaaagctggtaaagcgctgatttccattaatggagctggtaataataatgctgccgccaccgttctttttcaaatgtggtattgtatacttcaccgtcaggaaggtaccatccagattcgtggacaatgtttgccgccaatcctcaatgctcagatcctcaatcggtccgacgaccccgttaatccccgcattggcaaaaatgatatgcagcccgccaaataattcaaccgcttccagaactgctttttccacacgcaccggatcggcaatgtccacgtcaaaagcccgcgctgatccttcacgtatagcattaatttctctttctgtctccgaaatgcgctcattacttacgtcaaaaagagcgacattcgctccttctctagccatctgaatggccgttgccttgccaatcccagaaccagctcccgtgattagagcagttttgccttcaaagcgcgcgcctcctgcatatgtgtagctcatatgtatcgctccctttctgtaatctgtataatcacaagattacccaaaaggatatactttataatcactatttttgcgcattttttgctattcctttgcgatatttaagaaaagagcgaatattacgcgtattagcgcctctttccttatcttcatcgttacattctacaaatatcttaaagaatcgttatgttctaagtattcatcaaaaaaggacgtatacatccatatccatggttgtataacgtccttttcttatttatttaccactgcaactcaataaatgcagcatcatcatcaagtcccccggtatgggatgcatccagcaatacctgtatctgctcatcagggataggctcgcgaatggggtctaaatcggataaaccgtccgtatatacctgtaatctcatcggcatatccgtgggtatgcttctttcataccaatgaggcttccctccaatcggcccacgacttgtagaccagcgctccgctgtagagaaagtatgatcgaacagctcgctaatttcttcggcaccgttccatagtcgcaaccgtgagtctccttgccaggcaagtcggagacggccacgactaccacgcttcggcagttcgattttaccgcaaatatacatggactggcttccctgacgacgtttatcttccaataccgaacgcattaagcctgattcgtgatccaaaggctgccgacccagttcctctgccgctgtacctgccaaacgttcaaggtacactctcaattgatcagcagacagatcttgtccccgttccatccaatccagtaaagaagaacccagatagcgggctgcaaaatctcctcggtaactgagcccgacaccatcacacaagacaaaacaacagacggatttatgaatacgtactgcggcgaaatcctgtccgctttcccccatactggcagattcggcagaccttccatagccataacgacacataaaacgactgtgatgagatgataaaggctgatcgcctgtctgagagcttatgtaagcaaattgctgagtcagccttgcattcattcccttttttttgctcgccgggagcagggacagcagtggattcatgcttttacctccttaccgtacaggcgttgcggccgacatttggaatccaatggacaccagttccgcacaggttcccggcagcatcataatggctccttcacctaactgataatctgcctcaaacagcatttctcgatagctttcaggcagtacagaagacatatcacgcaatttcacagcatgttcatcctgcaacggcgtattatgcgtcagacctttccagcgacgggggtcctgaataggcgtttccagcaacctgtcggataaaaatatattttccaccagtacattaccgtccggtacactcatgctcataatacgcttcgcaatcggttctggatcatcgcctgtagaaaccccatctgtcatatgacagaccaaaggtgcaggacagtcctgcatccctggtagttctgcctgcaaaatacgttcagcttgcaagaaggcttttgctgaatccgagaatcgtttgggtgtcaaatcgggcaacgaaccaatagctgcgatttcatcaattcccttgacaccattcagcaggtcatacacgtcgtcactataagccaaaatcgcaatccgataacgcgctgtcagccgatttcctttggttgaccgaaaaaccatctgccggatcgccaacgatatagcttcatatacaacgtcaatacgccgccgcccctccatcagcatgttcatcgacgcgctgatgtcaatcaggtaaatgatcagggcgggagtgcgttgtgaagcctgtattgtataattcatagtttgtacatgctcccctcagttaccttctatctccatctattttgtatctatcattccgcccatatataaacatatgaaatattaaattttaggcagtctaaaattcgtatctcctaaaaagttataaatcgaggaagctcgatatcccacttcacctaccgaacgataataagaaggattactatcatatagtgttctaaaacgcttggcaaagctcttagccttcgcagcgcttccaccttcctgagaggcatacgccttgttgtacagggaaataagctgaagaacgttctccttgtttcgtgcatgcaaggactctttttgcttttgttccgcctcggctgctgccttacgagctgcctcttcctgggcggcacgagcttcctgctcttttttcaaagccaagtatttttcatactttgcctgttgatcatacgctttttgcttcgccaacttggcagccgcctgcttgttttgttccttttgggcgagataagcttcatatttaacctgttgagcgataagggcttgctgtttcttctgctcctcctgttgcttttgagcagcaagtgcctgttgtttggtctgctgttccgcttcctgtcgttgtttctccgtcagcaatttttgagccgcttcctgctcggctgccagcttttcctcggccgcctttgcagccttcgctgcctcttcctgcttggctgcctcgatttgccgctgattggactgatctgcaagaatattcacggctgggattccagctgccaatagaacgactgcggccgcagttgtcacgataaatgctttggatcgataccaggcttttgatttttcaggttgctctggcgtcttgggattcaactgctcctctagccctgtgatcgcagccgacacctccacatgcagaggactaccgtcttctacaaaatgatacaacgaccggtatacttctagcgctgcagcaggtttgttttgctgctccaaatcacgtgcctgtcggaacagcttgtccgttaccccacgctctccctgctccagggcagcctgatttagcaatgcagcctgttcagctttgagcggtgcaggggctgacaaagagggtgcaacttcactggcaaggccgcccaccgctgccgattctattgtttctgtcgcagcaggctccggttctatagcctcaactggaatttcctgctcagtaaccgcattaagtacaaccagccattcgccaaaagtagggcaactgcttaaatcctgactatcccaggcacggctgaacaattctaccactttgctgccccaccgggattcaagtgattttcgtaaaataaaataacgttcacaaggcgtctgcatttcatgctgatcaaaataactttcgccccacgctttgtccactactacacggtcagaccagcctagcatttctcctataataattgcccctgcaaaacggtctgcatacgcactccataacccgctgtggacggtacgatgggcggcataccctggcgaacctgccaatagagcatctggacgatccattttagtactatacatttgttccacgtccaccaattccacagctgacgtgccttgaggcagttccacttcagaaaaaaacggaagcattacattcggcgccgataaatcacaatgcgccaatcctttttgctccatagctgaaccgatccctgccaatgctctggctaaagccagactatcggaagcctcaagctgacgctgatctgtgagacaatcgaaccatgtcataccgtgaacccatggcatcagcaccgcatacagcaaatcaggctgctcggcgatcagacttccgtttctttctggagtgagcacatcacgcttgcatacctgcaaaccgggaatatccccgtatgcttccatatgctccgattgataaaccatagccgggatgcggaacttcggaaaaaacaccttaagggctttggcctcatgcggcgctccgtttttggcatttagctggtatacaattccctgtcgccctgcttgagcataggctaaaccgggtgcagcgggatgtcgcccaaccacataagctgtgccgtttatgatcaattcgtctcccggattcggttgaaaagacatgaaacatccctctccttacatcattcagtatgctagtattcctcaccttattatatacatctatggatggcaagaaaaccgggtatccgaagatcgcccggtttttcctgaacatcctgtgccaaaccatgaggaatggctcacatattgcttctttatagagtggtgtatgataagttgatccctatcaggcaaggcaacttatttcgtttggtcaaccgtacggaatttgttagcgatagctgtcaattcttggctgatgctattcaaagtcgttacgaaagcttgcatttgtttgctagcttcctgaaactcttggaagaagcgttgcttagtcataccttcccattgaccttccatacctgagatggactgtgtcaaactggaaacgatctgctggctttgctcaccactttgtttaaattggttagccacctgatcaacctgttctggggtaattaaaatgcgtcctgccattttttgcgtcctccttgatgataaataatgtttttgtttatctggttcaaattgtactatggctatttaattccctacaaaaggcaaaggacctaattgttataatcccactttttaactagaaaacagcacctaacagtataatattaacaaaacaaccacctaataagtcccataaagccgggaattgcgaaacgaattcaagtaaattttgcaatcgatccagattgtcccggaacgcgttcccaactaagcgacaggctggtctcttgctgtagacggatcagtaaaataccaatcctgcggactgctagaagacgcctgcatcagaatatcctggtgcaacgtttctatatccgaagactgtacaccagcaatggcatgtacgacagactgcgggttcgaaatcagactgcctccttccgaagcttgcccaggcagaatagacggtgattgctgattcgaccaatcgagcatcgtgacgggtcgtcccaatggttggctggcaaatgacagaatcgtttgatagttgtggtcaacagactgaaactgctctgcctttcggttcagttgtgtacctgatgtatggaggtaagcatggatctgttctgacatccgcttggcctgcatccaatgattcaagatcgcctcgcgtgcagatacatcccaatccagcgattgtaacgcctgctccaaacctgctgttaactgttgaatttgctccgccgcatgctgtagctgcccgctaagcccccgaagcacatccggttcaactcgaatgcgcatatccatcacccttcttctgtcacttcttcattcactgccgactgtttcaaccaatttaataataaatccacaaactgatctcttgaagccatagctgcaatcagccagtctccgttaccactagagctcatccgaaatatccagttcattgcgggacacaggacaaaggctgcccgttgtgattcccactccctaccgttccagaccagcaattgcaattctccctcggctacacgggaactcaaagactgagccaggcttacagacccctctgcatctccgctagcctcggtcagtttactgctgatcagagatacactttctcctgccgactgctcgtaaattttattaaatgcctgcttggagaacataagtgcgggggattcaggcacaagtcgatctacccaacccattttatcaatcaatgtttcgcaagccttttccacattacccagatcgtacagtcgatactcatcgggttcatcagcggatttcgcgagttccactacacgttcgttcgtgcaatggagatagccttcaaactgcttgcctccccgcacatagcgtatacggcaagccctgttggataatcccgcaatagcgactcttgaaaaaacggtaggaggcattgctagctctttgcccttatctgcccgctttagataacccttttccaaaagagtagcttttacctgctcccactcttccgccaactcctctgctagatagcccttaaacggatcttccaccccaagcagtctgtcagaacccaatacgcctgctagaaaaaacagttccttcgccttgagggttattaacttctgcttggaagcttgaaacgttaacattatgagccacctcccttcaaactacaacatgccatcggtcacgaattttcgttatccaatcctcacagctcacttgctctgagaagggaattgccgcttttatcctggtaaatttgcgccgtacgtagtatccctgcccaggtggcaggacttttaggccaccagcagcggcgttcgcctccgaataagggatacgaaagaacgatagatcattcgaatctagtgttccaaatagcataccactttggcttgccttgacatcattaaaccagtccacaccaaaggtaggaaaatcagatggcacacccgatagcacgacatgcacattgcgatcacgtcccaaccgtacaatggcggagagctgatcctttatcataaaatcgttcagttgcttacttaacatatccgcatcatcaatgaccaggagcaattcgggatcattcccttccttgttccgctgttgaacgatatcatacactttctgtaccagaggccccatttcttcttcgctttcggcagcagccttaacatgaggaagatgccgtaatctagatagtcctccgcctccatagcgtgtatcaatcgtatagacttccaattgattaggtgatgtgtaataagcgagcgatataatccaactcattagaaaagaggtttttccaccctccattggactacccacgataaaattgggcccttcttttagattcaggagaaaaggctcaagatcgtcactctgtagacctacaggtacctcataaggaagtgcgcccgagggtccaattgtccgatcccactgctgaagcagttccgacagtggaatccgctcaggtaatggaagaatggctggtgcgtgcttgcctttccattcctgcgcaatgccagcgatattgcgacgtaaccgtgctgatcgttccgcctcatcttcacctggtgaaggcaaagccgtttggaactccagcggaggaacatgtcctttaaccagggcgcggcctggaattaacggtcctggcgttttggctggtcgtcctaccgcataataatagtcactcgggtcggacatttcaaaagaaacagcattcggtatgttactgcggaatttctcaaacacatcggtaatccggttcgccgtaatgataaacgtgatacctagactacctccttctcgcaaaagagattccagcagttcattttcatctggataagcattacggaaattaagatatccatcaatgactatgacaatttgcggaatgtcctcgacagcagaacgtcgataagagcttattgttttgacaccagcctcggaaagcatttccttgcgtacggccaccatcttgaacagataacggaacaatcgcttgatccggtcatcttcctcagccatcataacagctccgatttggggaagttccccaaagtcgcgcatcgttcgacccatgtcaatgatataaccattccaatgattcgcagtaaaacgctgagccgtggacatcagcaacgtatgcaaaaaggtcgttttacccatgccaggcataccgtacacagcccaatgaccatgatccagcgatgcataaatcggctcctgccgctgattgggcaaatcatccaccagacccataagagccttcagctccaaagatgatgatgtactatctatttcggtgcatgcaggcagatttgttaaatccagcaattcaggcagcggtggaagccacggtccctgaagtcgttcgatccctgctttagcagcctcattcgcaatataatcaataaatacttgaagttgtttaggagcttcttcaccttttaagcctgagcttgcccgttctccgcccgtcagtagcgcttcacgtttcccgttcagtctcacttcatggacaggtagtgcagaagaaatatcgctgttgcctatatacggcgcaccgctccaagcaaactgcatctcttcaaacacctcgtcgctacccacttgaaaatatcctcgtcccggcttcgtaatccacgcagcattcggtattttcaacatgtcacggctatcaccttcgctttgcacccgtaagcagatgcggaacctggagttactccagatcttatcatccacgacacctgcgggcttttgcgtcgccaaaatcagatggacacctaatgtccgcccaatcgcggcaatactgattagctcgtccatgaactctggctgatcccgctttaattgtgcaaattcatcaataataataaccagatgaggcagcggttgttcctgccgctgccggagtagtctgtaatattcatcaatatgctgtaaattgcctgcatcgttcaatatcttctgtcgacgaaccagttctgctttaagagatattttggcacgttcaatcaaattattgtccaagttcgtaattgtacccaccacatgcggcaagtttacgaacgtgttggacatgcctccacccttgtaatcgatcagcataaaagccagatcatgcggatgaaactcggcagcaagcgaggctacgatggattggataacctcactcttccctgaacccgttgtaccggcgatcaagccatggggaccatgtccttgacgctctatcttatcatgcaggtttatcataatcttcttgccgcctgctcgcacgcccatcggtacgggtaaggtatcaggatggcggttacgtcgccaccgatctgccacgtccagttcttctacactcgctacgctcatcatatcaaacagaggcagcacagcgggaatatcagaagcagaggaacgcttcaagcgaataggagccatgtatcgcgccaatgcatcggcttcctcttttgataaacgatccggtttaaaactttgctgttcaacctccgccgattctgatttgcgggcatatacgccctgctctttggaagcctccacaatcagctgacactgcatcggcaaagcttctttacgagaagccagcacaatcgtgcacgcatcaatggctcggccgtcctccagtaacaacggcagcagtggttcttcctcaatcagctgggtgtcagataaaacaacgacataacacgggacttccatccctctgccctgacgatcattgcgattatttttacggcggttcagtctggcaaacagaaaatcagctagttgatgtgcactgctactgcggtctgacatcattctctggattcggtcatcatcccacacatgtgggagccagcgcatccaagtccattcactttcctctcgctcgtcatagaaggaagcaattttcacttcatctggcgagtgacgaaccgtcacttgtgccaagatgactcttaacgcagcaagggtatgttcccgttcgccgaccaatccaaccactttagattgaaatagcggtaatgcaatggaagcggcgtctaccagacgaaattcttcttccagttcatccgcagctcccaacaaaggatctcgatcataaccgtctgggcgtggaatttgtaatttaatatggaagggaacttgtccagtcccaatacgcacctgcaaaaagtcctcatcctcaggtgatcgttcccagagtgaactgttgcggtttttgacaatttgagtacatatttgcgggtcaccgtgaatttcatatagtgtgcgaatttgctcctcgcgtttcatttcaagttcttcacgatgcttttggagctgttcccggtacatgcggtcccgttcctcaagcttacgcttgtattccttcttattatttagatagacgaaaaaaggaatcgtataagatgtaagcatcatgaccacagtaaccatctggaacatcaaatagttactgttgcccatcttacctgttttgctcatatatacgtaaaagcctatagtcaccaacgtcatcattaacggaataagtatagatataatagaaaaagacggcttgctcggctcagccggaggccgtaaaatctccagcttctcctctcggagcgccggccttaatctcggggatcgctggtataatgcattcaagacaaaagtcccccttttcgctttctatttcattttaccaaggtttcatataatttcatgtgtgtatttacccatttttttcactttgaaacagagaacgccttccatacacaggcgcttcgtcctgagttgtcgaaaaagcgcgctgaatacgcacagtacagccttcccgcaagcctgatcctgtgagtagctggttatcccccaccctgaaccaaagcccttccgggaactttgcttccataatatattgcatgccttccgctggaggctcgccgaaaatgcgcacacccagcatcaactttaaatgttccaccgagtattcatcagctacctcgatgtcaaaccactctgtttcctgtcgtcctgaaagcacggtcaggatcatctgtcatccctcccgatccttaatatatagcaaagttcacgcaaaaagcctatttctacggaaatatggctatcgtaactgtagcatccgactattagactgtcaatttgttacaaaatacccactccaaaaataaaacagcgactttagtcatattttctcaagttagtagagccattagcatcaataatatgtatttaatcgtttttaatatggggatatacgtcattttgtcgattagttagaactaaattcgattgttacctagattgttgtgaacactttgtaaatttttcagacctttatgtttttataaggtgtttttaaggtaattttaagaaacgggcactacaatgaagccatgaaataactcaggcgaggtgatttttgtgagaacattaattacatttcaaaacaaacgtattcccgtatacttcaatcaagaaaataagcaaccggtacaaaaaacattaaaacttctaagtaacactttggagaataaaatctccagcggcaagcgtgcccttcaaaaatgtcttaactctttgatcagtatagagattgtcggttgtgaagccatcttgcatagcgtaagtgaaaatgattcattggcattgtccctctattaagagggacttttttttgtccacattagacacaaaaaagagaggggcatttcagcaccctctccatatcagcagctttgaaacatgatacatgtgacttaccgcagcctatgcatttgattagactctatttaaagtattctgcgataaccttttttaccgcctcgttccttattctgcgccttctcaatccgtattctaaacagttctagtaaattagcgcgtgtatgctcttcccggcagttgtccagcttttttaagataaaacggtcaatggacatatgactcaggctcctttacagcaagctgcccctgcttttcaaggggatgatcaggctatccatttttaaccattctgtctgttgtttaaacaggtacgttacttataggataaagcagacgggattacataccctttaattagggtaaatacataaagtttcgaaaattttatcacgttaagcctggaagctatggacaaggagcgagcaaaaaccatgagtaaacatatgattaccaaaataggctggaaccttttatgtgcattcttaatcctaacgatgctggctgcatgcagcagggaaaaagcatcaacccggagtatggcccaacatgaagctgaagcacgtgcctacaccgtaacgggtaatcccaaccaaggcgcatcatcccttgatgaacgagctgccaatcatacacctgtccataagcaaggcagcagctatgtcgaaatatcaggtggcgttagcattgataaaaataccgtgaaggttacaggacattccaacctcccggccggagcacggatcaaagggaatcttgcggtcaaaaactccctgttaactgggtacacggatgagacaaccgttcaaaaggatggaagttttgtactccaggtacaacgccccggaatacagggcagtatagatctgactgttctgttccgtccagatgaccaagacaatgaaatacgaaatctgtatggcagcggtggcaacaaattagaaggtccttatgtatatcaatacgaagaaaacaaacagcttctgcatgaagttcggattggggctgaatttgatcctgaacaagaacgcaatacccctttagttaagcccgtctggaacaaacctaaggactacggtagccctcaagtgtggattaagcctgatgtgaagcaagaaggtaactattatcatgtatatgcgcgcagcaatttgctggaagggtcggacgtcaaactcacgattgattttccgggacgatggcagtttggctacgatgatcaaaccaaagttatgcctgacggctccttcagcatgagggtcaaaaagccgagccttgccaaccactacaccatagtcataagtttcgaaccgaacgaagatatgtggaccaacgccaaacaggcgtacggtccacaaggggaacgcctttcgggacccttagtcaagtccgcagacgacaaagagggctccaaacagattgaagcccgtatccctatccaacccaaatcgtaactaaacgcagcatctaacttaacgttacggccgttcaccatgaaatacgcttcacagatacagcctatgcgcggtttcctcgtctgagtagatacagaatctagtgtcgtctagccgctacggctgtatcgtgactggcgtgcctatacttaccttctcctgaagctcaagcacatccttattctgcattcgaatgcagccatgtgacaccatcttgccaatggaccatggctcattggtaccatgaatgccgtaatgcggcttggacagccccatccagaacactccgaaagggccgccaggattgggctgtttgttaataatcgtaaattgcccatgcggtgtctgtgtagccagcttgccaataccgactggataactaagaacaatctgatctccatctttcaaatataaacgacgatccgataaatccaccacaatgctgtagttcggcatatattcacccctttataccatatgccgactacaacttagattttcttatatttttacatttgatgcttcactgcagttcggcttaccactccacatcacgtcgccagccgcttcgctgatccctacgacccggggctgtgcttgaacggctatctttcctgcgtcggtctgcttccttacgcgcctgatattccagttcccgctgcatttttcgataattgttcactctggattccgacaattcccctctctctatagcttcctccactgcacatccagcttcgcccttatgcttgcaatctgcaaaacggcactgctgcgccgtttccataatatccgtgaaggtatgaacgacacccatggaatcatcccacagattaagctcgcgcataccaggtgtatccagcagaacggcttgctttgcgatgggaaaaagctgacggtgagtggttgtgtgcctgccccgactgtcttcctccctcacatcctgtgtcagttgaactacagacccggagagccagtttactatcgtagattttccactaccggaagagcctgtcaaagcaactgtacagccaggttgaagaaacgcctccagttgctctctgccttcgttctgcaaagcagaaataacgataacaggtacaccaggggcaactccctccgcttcagcaacccgttgttcgacatcttcacaaagatcacttttactcaaaacgacaaccgggtttaccccgctgttccaagccataattaaataccgttccagtctgcgcatattaaaatcatgattcagcgcattaacaaggaacaacgtatccacattggtagcgatcagctgttcctttgtctcaaagcccgcagcctgtctagatattcgacttttccgcggcaagacggcatggatgactgcatctgacacttcatctggcgtagtgattgctagccagtcccctacggcaggcatttccgccggatcgaccatagcatgtcgtagcttacctgaagccgctccccagcgttctccatccattgtgataagcttcaccttttgtccataatcggcaatcaagcgggcaggacgtacctgtgtatttcctgctctttcctcatagttttgcttccattggtcccaaaaaccgttccagtaatcagaccaaccgtattcatgtatactcattgttttcctcctgaaatcatcgtttatttttgatcgtagtgttattcgataggtgtacattttttctccccgcatgcaaacaacgcaaaaaatccgcaggggtttccctgcggagggtatacgattcaggccgatgtgatccgttcgttcacttaagcaagcggtctctcacggaccactccccagaatcaacaactggataacaagacgcctaaccataaaaaatccgcagggaatcactccctgcggatttcgttggttctactgtccaaccaactgctaagccaagactatagatctatacagtctttaaccgtgcatcgtccgtgcgggagacaagtcattctgctgctgaacccatccattcatgttcgtacgcatataacatcgcctcctcctaaaatttcctttatcatacaagtccatcaattgtctgtcaaggctgctacggaacttttttgaaatctttgtcaagtttcgtttagcgtacctgatcccagcgtgtccacatctcacgcgggttcaattcgtacatttcccgttccctatacataaactgatgcataatcagctcacgccgaatcgttgcaaaatcctcatggtattgcttgatccactcgtttaattcacgttcaggatacttacggcctggctccagcttttctgccagcatctgaagtacaatcaattttttcttatactgtgcagggatttggcgcaacttgccgtccttggaaaaaaaattgcgtaagaccgacgcctccagcgtttcattcaactctgacatctcttcctccccctctcctttttcgaaaataaattgcaccgtcgcctcggcatgctgccggatcagctctggatttagtgtaaaatacaccgtgtttttatcacgtcgttccttaatcaacccagcctcacggagtttggaagcatgatgtgtaacagtcggctgtgataaattcagctttttcgccaaagcttgcccatgcatctccccacgggacaaaagaagtaatatccgcattcgcgttggatcagcaagtgctttatgataattgaccattttatccagttgcatcgttattccacctcttttcactagtacatacttgctatgcaagcgaattcaatcatacaaaatagatatatatctaattatatgtttgctaaaagtggctgtcaatcttcactgtccgttatctctttctgaaaacggctggatattgtgttcgcattgcggtaggattattatttgaaaacttctcacatactgagctatttgcttcaattctgagatccgtttttaatcgtcaaaataatgttaaccctacaaaattggcggaataaaccaatacaactggaggttcatccaaatgcacgacgtaatcattatcggtggcggaccctgcggactatccgctgcaatcgaatgcagccgcagaggtttgcaaactgtcattattgaaaaaagcaacatcgttcactccatttttctgtatccgacgaacatgcagttttttagcaccgccgaactactggaaatcggtgatgttccattcagcacccctaatgacaaaccttttcgtcatgaagcactggcgtactatcgtaaggtagccactcattataacttgaacattcagcattatgaggaggcccagtccattcatcgccaggatgacggtacatttaccgtacataccctgagcaaaggagaaataaccaaaacgtattcgtcacgttatgtcgtagtggctacaggatattttgatcatccgaactatttgggcattcccggggaacaattggataaagtcactcactatttcagcgaagcccatccctatacaggaacccgggtcgcagttatcggtggcagtaactctgcggtagatgctgcgatggaattggtgcgggtcggagctacgattgatatggtatatcgtcgaagtgagttgtctcaatacatcaagccgtgggttcgtccactgtttgacagtatggtacaaaaagggaagatcacgctgcacttaggcgcacgcattaccgaaatccatccagaccatgtcgtagtcactccgctggacactgaagcattccgactcgaaaatgattttgtactggcactgaccggatttcacccggagcgaaaactgctggagtctgtcggcgttcacatggctgaggatctggacaaaccagaatttaatcctgccacgatggaaacgaacatcccaggtgtatatgtcgccggggtcatcgcttcaggcagcaatgccaatgaagtgtttattgaaacaggccgctggcacgggcgacaaatcgccgaacatatccaaagctaaataaacgaaggagaacatctgtatggattacagctcacttatcttactggtattggctggtctagggattgttagtggcaactctaccgtgactattgccatggttgtattactgctactgcgggtaaccagctttcacactgctttcccctggcttgaaaagtatggcctgacgatcggaattattattttgacgatcggggtcatgaccccgctagccagcggtaaaatcagtatcaatcaggtgatggagtctttcctgcactggaaatcactgctcgcgattggtatcggaattctggtagcctatcttggcggccgcggagtaactttaatgtctggacagcccattattgtgacaggtctactgatcgggaccgtcattggcgttgccttctttaaaggagttcctgttggacctctaattgctgccggattgctttccttgttaattggccgcagctaaattcgtacaacaaatataggaatacatgatagcaatctgcatgtcgggctgaattcagtcccgctttgtggtatactcatatcgcataatttggtaaatgcaggaggcttgaccgatgtctcgacaatttgtaacggaagctgtaatggtggctatatacggccaactacttacatctcccgcccctgtggaatatatagtgccttacacatcactgctagaactatacgaattccaggacagcacagagccgctcatggataatcctatggacgatcaacatgtgaagcggaaggtaagcgagttgatcagttattttgaggaaccgttgaatcagaaaaaaattcggcgtgcccttcagatgccttgggccaagagcttgcctattctattcgatgccaatacatcactcatcatcattaatgctgttgatacagcgcattacggagaatattttgatccaattgagactgaactggtgttgacagctcagcgtgaatcattacccattctgacggatcaattggactggatccaccgcattatcgaagcttccgtacctgtacatgtgtacgacattgatgattttgattttgcactcgatggcccgatacttaacaacccttgacatacgacatacccgccttgaccacaaaaaagcggcggagcatcatgtacaggcttatctcctgtaacacgatactccgccgcttttcatgtccaaactatttgcacgctatgattgacagtggaacactaagcttgttcatcctcaacataggtgtaaataatgtcatcatgttcctccaaatacttaacttccagatgatggcccttcagataccagtaatcctggtcctccatataaaacgtaatgccagccgcttcatgctgtaatacggggtgctgcggcggctctacggcaattcccagagaaaagcctggatgcaacccaccgccagagctatagcgaacaaaaaaacggatcgaatctccacgattcaaactaagctccttaatgtaccactgtgccgcaggttcagttacctgtatgctcatacgttatgctcatctccttgtacaatgacgtctgccaactatatcatagcatcttttagaatgaccaccaaccggtctcaacccagcgagcttcttggacaagtcatatacatttttttgaaaaaggtttgacaattcgcaaaaaagggtgttaagattcaaccatacgagatccattttgaaatttattaccaatttgaacgattactcatgttagaatgaacccattttgaggaagaaaggagtgttaccggtgctaaaatttcctattgcattttacccacatctacaaacacaacaacttcataccggagcatctcccctgtcgcatccttcaaaattgggccattcgcgttgtatggtttaatacgagtggctgcctgcgtttgagcagtttttcagtggtgagtgtgctgaaaatacctgcgcgccatatgatattgagatttaaggcatatcgtctgcggacggtatgccttttttgcgcctgttgccggatcatatttgtggtagcaagccgctgttgtttcttcaaaatggtacacaactctcgaatgaacttatcatgaaaggatgggattcctcttgttttcggtacttaaaaatttgagctggttttttaaaagagaacgaagccgatactccattggattgtttttgctgatagccgttggtgtgctggagcttgctccacctcggctgcttggtagtgccattgatgaaattgtgcgtggttcaatttcctggtcctcactttggcgttatattttgtacatcataggcattctagccgtcatctactacattacgtacatatggatgcacaagctgtttggtggtgccaatctggtggaacgcttactgcgcacacgttttatgaatcatctgctgcgaatgacccctccattttttgaacgcaatcgcactggggatctgatggctcgtgccacgaacgaccttcgctccgtagcaagtacagcgggcttcggtatgctgacactgacagactctacggtctatctgagcgtggtattagttgccatgggcactctaatcagttggaagttgacactggcagctatcctgcccctaccttttatcgcactggctatgagcatttacggtaaagccgttcacgagcgttacacactggcacaagatgcatttggtgatatgaacgatcaggtgttggaatccgtggcaggtatccgagtcattcgcgcctatgtgcaagaacgaatggacgaaaagcgtttcgctgatattaccgacgatgtatttcgtaaaaatctggctgtcgctcggatggatgctctctttgaaccaacaattcgtttatgtgtaggacttagctacgtcattggactcgggtatggtatttatctggtatttcataacgatatcacgctaggcgaactggtctcctttaatatgtatctaggaatgatgatttggccgatgtttgccattggagagctgattaacattatgcagcgcggtagcgcttccttggaccgggttaatgaaactctcgatgtccagccagatgttcaagatgcagctcaacctgttccagtggatcgcctcgaatccatcaggatgaaagacgttaccttccgttaccctatctctactattgacaatctgtcacatgtgagtctggagctcaaacgcggagaaacgctaggtgtcgtcggtagaacaggcagtgggaaatccacgctgctcaaacagctactacatgaatatccgacgggtagtggtgatattttaatctccggcatacgtctagaggacattgcagtagaacaactacacagctggatcggctacgtgccgcaagagcaaattttgttttccaaatcggtgcgcgagaacattcaattcggaaaacctcatgcagatgacgacgacattatggaagctatccgtactgctgccttcgaccaggatttaggtaccctgtctgatgggctggatacactggtcggagaaaaaggtatcgccctgtccggcggccagaagcagcgtgtttcgctggcgcgcgcctttatcggtgatccggatattctattgctcgacgatgcactatctgcagtagatgcccggacggaagcaaggattattgacaatatccgacgtaagcgctcgggtaaaacaaccttgatctccacccaccgcctttccgctgtagaacatgcagaccggatcgtcgtgctggagcaaggacgcattattgaggaagggacccacagcgagctacttcaggctgacggatggtaccgacaacagtatgaacggcaacaagtggaatctgatctgacctcaggggaggtatcctaatgaaacccaatatcggcaaaaggctatttcagtacgcgctgacgagcaaagcaggctttatcgccgctctcatcgctttggctatcggagtagccgccgagctggctggtcccttcatcgctaaaacgatgatcgacgaccatatgctcgctattgaaaaaccattttatgaaacgactcgtgtggacggaactgtaagctatgctggaacccactttaagcgtgaagatcgctttgagtccggggagactaaaggtcgcgaagcgaggattttacaagttgggaaatctttcgtatttgtcgatggctcggttcaagtggcggacggtaaccgctcctttacgaacggaacgctgactgtgatacgcggctccgacacctttcgctatgaagctaaggctctgacagctgatgaactgtatagcttttacaaaccggaaatgcccggtatctttcagctgattggctggtattgcttcttcctggttatttccatttttgctgaattcggcaaaacatactggctgcaatcctcggcgaacaaggtcatacaaaagcttcggcttgatctctacgctcacatccagcggctgccagtttacttttttgataacttgcctgcaggcaaagtcgtatcccgtgttacgaatgacactgaggcagtcaaagatttgtttgtggctgtgctctccaatttcacttcagggattgtaacgatggcaggagtatatgttgcactctttttgctggacttcagactgggtcttatctctctgtttattgtaccgttactgatcttgtggattgtattgtatcgcaaggtcgccacccgctataatacgatcattcggtccagactcagtgaaattaatgcgattatcaatgaatcgattcaagggatgtccattattcgcgtgttccgccaccagaaacaaacgcagcaagagtttgaagaactgaatgatgactatatgaagcatcagaataaaatgctgaatttgaacgctttcacttcgcacaatttagtcaacgtgttgagaaatctcgcctttgccgtcgtgttgtggtatttcggatctgaggcgctcggaactacaggtagtgctgtttcactaggcgtattgtatgccttcgtcgatgtgctgggtcgactgttccaacctatgacgggtatggtcaaccaactcgccgtactggatacttccatcgtatcctcaggacgcgtatttgagttgatggacgaaactggagagccggtgacggacggcacgatgccgcgctacaaaggccaggtagagtttaacgacgtttcctttgcctacaaaaaggatgatgtacttaaacatatttcctttacagcacagcccgggcaaacagttgcccttgtcggacataccggatcaggcaaaagttcgattatcaacctgctattccggttctatgatccgcaaaaaggaacgatcaccattgacggaacgtctgtcaaagacatccctaagcaatggcttcgccatcatatgggtattgttcttcaagatccatatttgtttacaggtacggtagcctctaatgtcagtctcgaagacagccgaatcacgagagaacaggtgaataaagcgctgcatgacgttggagccgacaaattgctggcccatttgccgcaaggattcgatgagcctgttattgaaaaaggcagcaccttatcagccgggcaacgccagcttatttccttcgctcgtgcactagcctttgatcccgcaattttaattctggatgaagctactgccaatattgacaccgaaacggaagcgctcatccaatccgctcttgaggtgctcaagaagggacgtacgacctttatcattgctcaccgtttgtccaccattcgcagtgcggaccaaattttggtgctgcatcggggtgaaattgttgaacggggtagccatgatgaacttatggcccaaggcgggcgttacttccaaatgtatcagctccagtcgggaacagttgcaacagaatcagatccaatctctgctacgcctcctgcgcaagatgacttgcttactggcaaagtcagcatttaaagcttgaatagcccaattgcttagggctaacgatgaacatttggcatgaaaaaaccagcgagcctctcctacacattggaggctcgctggtttatttttatataggacatatggtttgtaattttatttagctacagacgtgcctgtttcggtgggcggaagcactgttccatctactgctttgagcgtaaccttatacttgctgtctaccaacgtacttgtgtgggtatccgtaatgacctgaatattcatttcccctggctttggactagtcagcttgtagtaaattactgcattcgtatcatctacgtagtcgatgtgatccacttcaatgccgtaacctggattaggtgcctgcagacgggtgattgtcactttgttctgctggtcatttgctttctctatactcatactaatattgttttgttgaaccggatctacaggctcagccggattttcaggagtagcttcaaccggtttatgactttgtacaaattcggatgcgttatagaccatttctgctgcctccatccgcgttactttacgatctgggttaaagttgctctgttcgtccaattttgcaattttggtcaatagcaggaattgaactgctgcgtttgattcctgatctaattttttgccatccgctacattaattaacatacggacagttggatattcacccgttgcactcactgctttatacagaatattcgcaaattgttctcttgtcatacgggtgcttggatcaatatctggtgacaaagggatttggtgttgggccgcaatccgataggactgggtataccatgcggaagccggaatgtttgcaaaggaacccgttgtgaaatcaggcattacctgaagatccatcgcacgaacaaccaaatgtactccttgtgcataggtgagcgtttgatccggtgcaaatttatccttggttattccttggataattcctttatcctgaagtgagtttacgatcttctcctgttcagctccctttatatcacgaaaagcagaagccgacgtagccacagccaatgagcagacgacaagcagggcaactgccacgcttttattttttttcatgagatacacctccatgtttactttgcttctatacttaccgacgcaataaaagcatcaaatgtttcaaatatgcacaaattggttgcaaaacagtgcaatagctgcgattagtgtaacccatctaactcttttctgctcactatctttatacatcctcaaaagtgcctgtgacagattaccttttacagtgtccccttggaagaaccggatctgggtagcggtatcccgccgggaaacctcgctcccctttgttctctttgcttacatccgattcggtgctttcagaccaagaagttgcagcgcgcatgccagaatatccgcagtttgttccgccaattgaatacgccagcgtccaccattgacaatcctttccttggcgtaaaaacgattgaacgcctgggccgtatccagtgcaaatctcgcaataaccgaaggctccagttggcgagccgcacgtatcagttgtccgtgataacgatccaactgcttaagcagcgcccaacctgcgtcaccaaacatttcatccgatatgtcattcaaatcacgagaatggctatcttggacaagggcgttgtcgctagaattagtagtaacatcaacatcggcgcgagcatgagctttctccagaaggctgcgtatgcgcgcatgagtatactgcacataaggcccggtctcaccttcaaaggtcagcgcttcctccaacgaaaaatccacttcattcagccggttgttttttaagtcaccaaaaataatcgccccaataccaacgtcctctgctactgcctgtcgttcctgcaaatcgggattcttctgagtaatgatggcttgagcacgcgctatagcttcatccagcacctcctccagtttgacaacttttccacgtcttgtagacattttcttacccgcaaaccgcattaatccaaacggcacatgctcacactgctccgcccatgcctctcctgcatgtttcagcaccgcaaacacctgctggaaatgcagcttctgttccccaccaacgacgtatagaagccgatcagccttcatcacttcatgacgataaatcgctgttgccagatcacgtgtcggataaatggtagtcccatccttttttagaataagacatggcggcagttcctcgtcttccagacgaactacaagcgcgccatcactttcctccagcaatccctttgctcttaattgagcaacaactgcctgcatcttatcattgtaaaaactttctcccagcacatggtcaaatgtaatgttcaggcgctggtacatacgatcaaattcacccagactgacttcaacaaaaaatttccatagttgttgagcctcagcatccccatgctccaaacgtcggaaccactcgcggccttcatcttccaaagccggatcatgctcggcctcctgatgaaaacgcacatacagtttcagcgattcaccaatcggatcatgttgtagctgttcctcatttccccatcttttataggccgcaatttgcttgccaaactgtgttccccaatccccaagatgattcacactaattgggacatatccggtttcaccaagtatgcgatacaaggcagcaccaataacagtagagcgaagatgaccaataccaaacggtttggcaatattgggcgaggacatatcaatgaccacccgctgtccgtgtccaatattgggcctgaggaaatcagccttgctcaattcagcaagcataagcggaatatgaaccgatcgatccaatgttatatttacgtaggcacccgatgctgaagcagtgaaaccttcttcatggctcactagctccgctaattccattgcaatgtgctgcggagactttcgaaacttcttagccagcacaaaacagggaaacgctacatctccccattcaggctgcggaggcacctcgaataaagataaaacttccttctcctccatgcccgtatggcccaatatcgcttgagcagcaatcctcaacaacatattcctctctccttcttctataggtctaacaaaaaaagcccccgcctcttgaaataattcaagagacgagaacttcaatatccccgcggtaccactcttcgtaaatcggttgtgcagctaaagctaacttacacaattcgcgatttcactccaatgactaataacggtgtctgccgggctgatctactagaaattctgctcgttggatcaaccgtctcccgggtgcgcttcacatcggacctcataccggctttcacctcttccggctcgctgtaatgatacggctccgctgctactctcccgttccatgacgttaattccaatcattatacaaacctattcagtagaaagcaaccttttatttcctcttcaggcactagttccatatatgtaattacactgccaccaattggcggcaggcctgaacgcaacgacggcaggcttctgcacaatgtttgcaatgatcatgggaatgcttgctgctttcagcagcacatacctcacaggccttggcgcacagctcacagatttgctcggcaaaatccgttccgcgctgcagcatttgagcagcaaatccgcatatttctgcacattccctactcactcgaatacattcacgcagcatagctaaatcatattccttcaaactcgctacgtaacatacattgcaagcgttcatacattccaggcaagcatccacgcattgttggtatgaatgattcatattacattacctcccagttgttgaccctgctgtactattacccgctgatccttgagtttaatcatttgatgtgcgcgcttacaataaaataaaaacaaaacaatcccgacttatgtaaggaagtgtactatattccagtatgtaagtgcaaggatattaatcacatggatttttagcccttgtttctgacttgcatacactcagtcattgctctattgtaaaaagtgtatgtctaaccatcgatcaaggagtgaacattttaatgaatatgtcttccgtagaggagcatcgacaggaatccccgcaacaggttaattgcatggtcgtgactgtctcggacacacgtaccgtggaaacagataccgggggacaattgctcatggatctactagaaaccaatggctataaggttgttcgatatgtcatcgtcaaggatgactacgaaggtattcagcagttagtatccgaagcagcggcacagaatgacatcgaggctgtacttttgacaggcggtaccggtatttctccacgtgatactacatatgaagccgtctcctctctactggataaggaactacctggctttggggaaatcttccgttatttaagctttgctgaggacattggttcagcagctatattaagccgggctgtagctggtactgtgggtcggacagctgtattttctatgcctggctcacggggagccgttcgtttggcaatggaacgcattattgtccctgagctacgacatgtgatgagagaaatttataaataagctcctatttcctacatgccgcgacacaaaaaggcaccccatacattcatgaggtgcctcttccaactattctttttcttcaacttcgggctgcatatagctgtcgatcagcttttgcttcagctcccataccttctcgctcagatttacacgataaatttcagggttcagcttccgcaaatattctggccaaaacagtttcaactgtgaagtatggtaagcacgaatttcatccagctcaggaagctcatataccttctgtccatttataaaaataggctcaagcattggcacggcttcataattttctacatacttcttcatatacggatgtaaagggttaaacagcttcaggcgcttaccattacgcggacgctcttcatccgggaaagaaatataatcggctacagctctccctttcttcttatccacaatgcgatatacatccttcttgcctggtgtggatactttttctgggttacctgagatcttaatcgtcggcaacatttcgccatccacttctcgttcaaccagcttgtacaccccaccgagcgatggttgatctgaagccgtaataagctgtgttcctacaccccatacatcaatacgtgccccttgggctttcaggttaaaaatcgtattttcgtccaaatcattggaagctacaatttgtacgtaatccaaaccttcagcatcgagcatttcccgcgcctgaatggatagataagccaagtcaccgctatccagacggattgcattcatacgcttgccctgactctccagcatttttgctgtccgaatcgcatgaggaacaccgctttccagcgtgtcaaaggtgtctaccagcagtgtaacctggtctggcaaaaccttcgcatatacgtcaaacgcctcctgctctgtcataaaggtctgtacccatgaatgggcatgtgtccccttcgtcgggattccaaagtgctcgcctgccagcatattagaagtcgcgtcaaaacctgccacataagctgctcgtgctccccaaatcgccgcatcagcttcctgcgcacgccgtgtcccaaattcgagcagtgtatcgtcacttgccacctgcttgatgcgtgatgcctttgtcgcaatgagcgtctgatagttcataaaattcagcaatgccgtctcgacaagctgcgtttccataatcgttccttcaacacgtaccaaaggctcgtttggaaaaacaagtgctccttctttcatcgaatggaccgttccaccaaacttaaactggcgaagcgcctccatgaacatgggatcgtatttctcctcctgttcagacaggtagcgaatgtcctcttctgtaaaccgcaaatttgcaatataattcacaatgcgttccagaccagcgaacacggcgtatccattaccaaaagggagtttacggaaatacgcctcgaacacagctttacgctgatgacttccgttcacccaatgggcgtacatcatattaatctgatatttatctgtatgtaatgcgaggctcgttgactgcatcgtaatcatcctctctgactgtccccaggtttgtggcagcgtaccgcctcatctacccagattcagcaatatccggctccattttgttatcggacattggtgcacaatcgttaagttattttacttcttctgacgtaaaaccgtgtcctcagccgaccttaccgcggctccaagacttccttcaaaatgacccaaagcccaatcatgtccagcttgattaaagctcgccacagcgtccttgtatacggtaatagcaaaacctttgttataagcatctacagccgtatgcagcacacatatatctgtacacacaccaatcaggtgaacttccagaataccacgttcacgtagcctgagctccagatctgtgcccgcaaaagcactgtaccgtgttttattcaaccagtagataagatcactttgttgctcatagaggctacgaagcttgccatacaaatgtcgtccgttggttccacgtatattatgtggaggaaacagcttgctctccgggtgataaaggtcgttctcctcatgcaaatccacagccatgacaacaaagtccccttgatccacgtatgcctgcgtaattgctgcgatccgttcatccaactcaatcgcaggttgtcctacaggcaaactaccgtccacaaaatctttcgtgtaatcaataacaattagtgcctgcatcgtacggtcagctccttatcctcaaagtgaaattgtacattctatgcgtaacctattacattagacgttacgtgtagatagataaacgcggtactctgtcactaaaacggtacaactgtgccggtctttgtgaatactggttggaactgagcggtttgccgttctcatcacgcacttcttccagtatcccctgcctgctacgagtcgatgttattttgcgaataaagtttggctcttcgaaatccggtacgacactctgaatcacctgatataattcacccagtgtaaaatgtagcggtaaaaactgcttggcgatcgtcgtctgaagcatctgcaactgaattttgcgataagcgtctactatgatatcccggtgatcgaatgccagctccaattcctccaacgcttcgcggatcgtgaatagcccgacctcggaagcatcatcggccgcttgacgctgttccaacatccattcttctaccagcgcaaaaaacgcatgtgatatgatccacccgcgcggatcacgtcccggtccactatatacacccaaatactccagatgcccgccgtccacacctgtttcctctaacagctcccgcttggcagctccatacatagattcatcttcctgacaaaaccctccaggcaacgcccagcgtcccgcaaacggccaactgcggcgcttgatgagcatcactttcaactcccgaatcggcaatgtctttgttaccgtcttacgctcccgcttcgttaaggtaaacataacgatatccgctggagctccatccggggtacggtatttcttaatgttgtacgacgccttctgcgcctcttcgtttatacgattgctatccattggcatcaccatattatatcgttttgataaattcattatgacataataaaaatttttgtcaagtgtcaggccttgcctgaatcacttgcttgtgtacgtaatactcggaaggttgctgtagatgtagaaccgagtgtaccttcactatctcttacttccgcctcagtggttatagtgcgacctccttgatgaagaattcgcgccctaacctccagtcgtccttgcctcatggctgacaagaaatgaacattcaggttcgttgttacacatggatccatatttcgtgaagccatactgaccatccccatcgcctgatccatcaatgaagtaagtacacccccatggacaatacccatcacattggtatgctcttgtttggcctccaaagcgatctgtacctcgtttgcatcagctgcaataagctcacaccctaaataatcccaaaaagtattattttctccctctagcatcttacccaacttatccattcccttgcttccatcccttcgatgttgtcccatttctcttgatgtcttatagacacatacgatagtaaattgctttcgaaaaaaaggcgtggaagctacgcctccacaccatagatttcattctaatcactgcaattcgacgaggaagtgcttttcccctcttctacgttcaccttctcagaaacggtatcacggatcgccatgattaccatttgcagtagctcattaatttccacctgactctgctgaaactccgtgacaattggaataccgtcaagctcttcctgtagctcctgtagctcggcctctattttggcaatcattttttgattcttcaaggattcaaatgctacaatttccttttgcttctttttcatcgttgcaatcagttgctggatgcgcccatgatcctgaatcttttcttctgctttccggaatacctgcacttcctcactgctacccaaaatacctgccaattctttggcttttgccaatatcatttcgcgattgaccatatgatcatgctggcgcgccgccgattgaagttctgtttgttgcaaccgctcctctgtcattgcccatcgctccttttctcacttagacggccttgcacacggccctttactcagaccgcatgcaacccgatagaatattcttttatccgttaactgctacagccgtttcaaccagatcacctttgatgtaaaaggtcataggttccgtaattttcacttgaacaaaggaaccaatcaggtccttagaaccctcaaaatgtacaagcttattggaacgggtccgaccggcaagcactttgctgtcatttttgctctcgccttccaccagcacttcaaccacttcgccacgcaatcgactattaaagcgaaggctgttttggttcacagcaatgttcagacgccggagacgctcttttttgaccgacataggcacattatcttccatcgaagcagctggcgtaccttcacgtggtgaataaataaatgtgtaggcaaagtcatagcctacctcgcgcaccagagatagagtatcttcaaactgctcgtctgtttcgccagggaaacctacgatgatatctgttgtcagagaaacatgcggaacagctgctttaatcttcgcggccagttccagaacacgctcacgggtatattttcggttcattttcttcaatatatccgtattaccggattgaacaggcagatggatatgctccaccaaattgccacccttaccaagcacttcaaccaaatggtcatcaaaatcacgtggatgtgatgtcgtaaaacgtacacgcgggatattgattttgcgcatatcatccatcagatccccgaatctgtaattcaaatctttcaaatccttgccataagcgttaacattctgccccagtaaggtaatttctttaaagccttgacgtgccaaatcccgtacctcagcgattacatcctctggacgacggcttctttccttaccacgtgtaaagggaacaatgcaataggtgcaaaatttatcacaaccgtacataatgttcacccaagcccgcataccctcacgcttcttcggcaagttttcgataatgtcgccttccttagaccacacttcgaccaccatttctttgctaaagagtgcttccttgacgagctgaggcagacgatgaatattatgggtaccaaaaatcatatcgacaaaaccgtgtttttgcataatccggttaacgacattctcttcttgtgacatgcagccacacacgccaagcagcagtcctggcttttctgttttgagatgcttgaggtgacccagttcgccaaacactttatcctccgcattttcacggatagcacaagtgttcagtaaaatgatgtctgcttccttccgatcctcggttgcctgatagcccatttgctccagcaagccctttatggtttcggaatcatgctcgttcatttggcaaccaaatgtgtatacgatataatgctttccctcaccgatatgcttgagctcatccgggactgcgttatcatacaatacttgtacgtcctctttaccgcgttgcttttcttttctatggttcggctccgccataatgttgatttcacgtccgcgaatacggatctttttgctatgctcatcctcagaaataatcttcgcatccgagaaatcaaaatatttggagtaatcttttgttttcttttccattccttagtcactccttacaccatctatttcacgagctaatttgtgatttactgtatctttaggcatgggtaaatttattttaagttctaaaaaacctttaaaaaaggcattacactaaattatagcatgatttataggtcatcgccatagatcagccgcagataccatgaagtcaatgtgaactcatgttctttttgtacataagtgaagtatttatgaattatatagtatgtaaaaagcccgattcttttgcaagaatcggactctttaagccttccggcatttaaatacgtgtatattagtctacgatttcagcgttgtcaccgtttttcacaccggctccgttcgcttcatctgtatcaatgtgcatatccaaagcaaaagaatcggacacacgtgcaagaacattttcaaatacaaggccacgttcgccgccgacacgtactttcagcaactgcttgtccttaatgtcccatttagctgcatcagatgtatggaaatgaatatggcgggctgctacaatcacgccttcctgcagttccacttcaccagctggtccttttaccgtgattcctggtgtaccatcaatgctaccagattcgcgtacaggtgcttttacaccaatagcaaaggaatcagtgcgagagatttccaactgggaagcaggacgagcaggtcccaaaatgcgaaccttatcaaattggcccttagaaccaattacagctaccgtttcatttgcggcaaattgtcctggttgggacaaaggtttaaattcagttaattgatagcctgctccgaacaaaatttcaatatgctcttgagtcaggtgaatatgacgggcggaaacgccgacaggtacgattttactcatcgtgtggtcactcctttttctctatacaatactttacacatccatgctattatactcctattttgccaagaaagaaaaggagagcgtataaagttccctttttcaccccaatcagcgttaaatatcctccctataaagtcggatcaaaccgtcgttttagcgaataggagaaaaaaaagcatgatttcagctacgatgagatgagggggaacgacaataaatatattaaggataaacaggacacagagtattccagttaagaaaagaatgactctgaggcttggtttaagatgacttagtctgtaccgatgaaataccagcaaaaccgataaaaagtaaataagaacagaagcaaaggtaaagcaaagcacaaagatatagtctacttgtcccaaaaacaagagctgaatcgaagcagctagcatgctaagggaaagataaataaacaaatgaccataaataatagtctggcctgctgattgtattgatttatctacgcgcttctccatattctcaaaatattgccaccagattgcgatgactaatacaaaagccaaagcagcaaatacaacagaagaaaccgtaaaatgatcggattgtaaaacagaaagcatacttatcacagattcgccaagcagaattaacgtgaactgtgcaaagcgttctaaaagatgctccgtatggattggtgtgatcaccaactttttacggccaatcaaaggaacgagaatatcaatagctataccggtatataaaatcaaatatcgaacccaagaatcaaagaagagggagaaactagagatgactattccaatccaaaaataggtaccaaaaaaacgagctgtttcctgtttatgagccgtttctttggatgccgaaagtaaatattgaacgacagttaaacctcttaacccaatatagccaacaaaaaaagatacataatacgcatcaaaatctatattaaggctggcggtcatgatcaacacgaaaaacaattgcaggatcataaaaattcgatgcgttatactgtcttgcccaaaacgattgttgtagaccgtttgccccacccaagcccaccatattgggataaaaatcataataaacttttccatatgttcccacgaaatactaccatgctcaacatgtagtaaaacatgagtggccttagagacagcagctacgaacaataagtcataaaagagctcaagccaagtaaccttctttattaacattgtgtaatggagccccctctgatatggcggtgcaacatggtgtcccgtcagtcttgctccaacgtctgccgtatttatgcttattttagcaccatgaaattctaagatgctccaattatttcgtaatcgttctcactttgtcaaggtattcgcagccaataataactcctagtaaatagctatttaagaagacattttggaaggcaaattcgtttgcaggtattccaacgcatgtcctcccagccatcccttgactagctcctcagggtaatgcttcagcagcagttctgcaaaaaccggatatttacccgagtgttccagcccttgcacatggtgctcgataccgtcaaaatcagagccaaacatcaaatgcctttccccgcctaatgaacaaatatgctcaatgtgcggtagcagatcctcagcggttaccgtaccctgctctttgagaaacatcgtgacgaaggtcaaaccaatccgtccgttacgagcgatcagtgcacgaatctgttcatcccgtagattacgaggatgagcacatctcgcaaaggcattcgaatgcgaggcgatgggtggtagagcagcctcctccaacacctcccagaagccctgtacggacaaatgcgacacatctagcagcaatcccaggtcattacagcgattgaccaaatcacgccccttgctagtcagcccgcctcctctatgttccataatgccgtcagccgcccagttcgcataattccatgtcagcccaatcaatcgtattcccatggcatagcacaattctgcataaaacgggctcccttccagcgcgtctaccccctccagtgagagcaaagcccaaggtgcccatgtatgatccgccccattaccatccacatacgttaacttttccgtgcgcttctcttctcctacctgttttacttgctccatctgatgcactgcggacgtatttttacactttgccaagtcttccttccacagcaatggtctcaacccacctgagatagaggtaacatgctgcctgaacagctcaatttgacgaaccacatgctcaaatcttggcgtgcccaatacctgtgaaatatatatagcgaaagtttgcaaccgcacgttaccttctagcaaacgttcttttgtgacatcaagcgatggatgactgaaatcgatctccgcatcgagctgcattttacataacacatcacaatgaaagtcaacaacaggccaattcacttttagcttatcattcatgcatcttacctccatttatagattgaagcactacaaatttattttaaaaaatcatagtaacagactcacaatgcaaaaaagcccgtttacaaatcgtaaacaggctcaggcaacttacatttattatcttggttctacaatcaatttgatcgcagtccgatcttctccatcaataacaatgtctgtaaaagcaggaatacaaatcaaatccactccgcttggtgcgacaaatccccgggcaatggctaccgctttaatggcttggtttagtgcacccgctccaatcgcctgtaattctgcatttccgcgttcacgcagtactccagcgagtgcgcctgcaactgaattgggattggattttgctgatacttttaatacatccatagtaagtacctcccctgggaatgatgatggtttgattccactattagatgttattcgagggtcagcaaataattcctgctttttggtgacagttttccttattctttccttaagtagctcacaaaaaagttaatccatccgccattcatcttctttaagtctaattttctgaattttgcgggcttttccatcattatcattcagttctacgctgatggcatgaaagtgccatttgcccatgtccacttgaaaacgtaccggaagctgggtctggaatttctgtaacacagcctctttctgcatcccaagcactccctcataaggacctaccattcccgcatctgtctgatacgcagttccttgtggcaaaatcgtatcgtcattactctgtacatgtgtgtgcgtacctaccacgattgaagcacgtccatccaaatgccaacccatagcaattttttccgaggttgcttcggcgtgaaaatcaactaggatatgcttatgttttttccgtagttcatcgacaatttcatctgctgcacggaatggacagtcaatagctggcaaaaaggttctaccttgcagattaacaatagccagctctttacctccaccttttacaacggtatacccccggcctggtgttcctggtggaaagttagccgggcggatgatccgtggctcatcatctataaaatcaaatatttccttattgtcccaagtatgatttcccatcgtaatcccatgaacgccccaatcaaaaaattctctggcgatggctggggtaattcctcttcccgaagccgcattttctccgttcacgataataacatgcgggttgtattttgattttagcgaagggagattctccctcaatgcctttctgcctacactgccgacgatgtctccaataaataatacgttgatagaaagccctccctagtctgccttacataatgaaaagtggccctacaagcagcggccacttttcattgaaatgcttttattttgcgtattctaccgcacgggtctcgcgtatgacggtaaccttgatatgtcccggatagtccagttcattctcaatcgttttcgtaatatcacgggccagtcggaatgcttccgcatcatcaattttctctggctgtaccatgacacgaacttcgcgtccggcttgaatcgcgtatgatttttcaacgccttcaaaagattcggagatgcgttccagcttctcaagacgacggatgtacgtctctagcgtttcacgccgcgctcccggtcttgctgctgacagggcatctgccgccccaaccagcatggcgatcactgaagtcgcttcgcagtcgccgtgatgtgaagcaatgctgttgatgacgaccgggtgttccttgtacttcttcgccagttccacgccaatttcaacgtgcgatccttccacttcgtgatccagcgccttcccgatgtcatgcaacaatcctgcccgtcttgccagtacaacgtcttcgcccagttccccggccatcagacctgtcaagtatgcaacttccatcgagtgcttcaatacgttctgtccgtaactcgtacggaacttgagacgtcccaagattttgatcaaatccggatgcaagctatgcacgcccacctcaaaggtggcctgctcaccatactcacggattcgttcgtccacctctttacgggatttttccaccatctcttcaatacgagccggatgtatccgcccgtccgctacgagcttttcaagcgcagtacgcgcaatctctctacgaatcggatcaaatccggacaaaataacagcttccggcgtatcatcaataatgaggtcgattcctgtaagggtttcaagtgcacggatattacggccttcgcgcccgataatccggcctttcatttcttcgttcggcaatgtgactacagaaaccgtcgtttctgctacatgatctgccgcacagcgttggatggccagtgtgatgatttcacgagactttttgtccgcttcttctttggcctgctgttcaatttctttaatcatctgagctgtttcatgacgaacttcctgctctacgttggtcagaataatacttcttgcatcctccatcgtcagattggaaatacgttccaactcagttacctgactcttgtaaatcaaatcaatttgctgctgggtttcatcgattcgtttctctttgttggccacttgttcttctttgcgttccagcgattccaattttttatccagcgattcttctttttgcagcaatcttcgttcctgtcgttgaatttcattgcgacgttcacgagtttctttttcagcttcggcacgaatgcggtggatttcatctttcgcttccaataccgtttccttcttcagcgcttctgcctcttttttcgcgttctccacgatttgcgcggcagcttcttccgcactggagatcttagcttctgcaatagatttgcgaataaaataaccaatcccgaacccaaagaataacgcggctacagcaacgagaacgaaccagatcgcagtcatcatactgttcacctccccgttggttcctccaaggcattccttgggactttttgcaattgtcacatttactttgatcgtcaaactaagacaacgacacaaggtcgtttcatttcatatgcacatgctttcacatgtacaattccgcctggcatagcggcatcacttgttatttggcgatgagaactcacccgtggattccgcttttttggaaggaaaaagggcgttccacaagtatcgtttcatatatattttattatttgacaaatggcattgtcaagggaatgcaaacattagtagactaccatgcagctttccctgtaataactagctcatcctatccgttcatactagccaaaggttcagcagccgtttagcaactattcctcccactgcaacaattcctcgtcatctgaagcaacgccatgctcggccgcagtgagatgattgacgactcggcgtgtcatatcccccgaatatccgcgtctcatgagaaaagggtaggttttcctttttttctccattatatcaccacgtgtctgattccatttcttacgtccgaccgtcagagcgctctcccactcctcatgatcggtgatctcacctaacgcttcgccaatagaggctttagagatgcccttctgacgaagttcttgcctaacccacatcttccccttacgttggctagttatgcgctgccttgcccattggcgggcgtataaatcatcatctacgagttgttctctttgcagtcgatccattacttcgtcaattacagactgatccagttctttttgtaacaaacgttgggcaatttcctgacgtgtgcgaggctttcgccccaaatagcgaagcgcaagtacataagcctgttgtttttcatctgccagaacgatatcttccagttcttttttatcaaatgacgttcctttgaacatattatacttgatcattacatcttctaatacagacagcgaatacggaccaaaatgaatgatataccttccacgtttgcgtccctgtccctgctctaccctagtaatcatcaattcctcatgatccggaaaaagagaaatcccttgttgcttatttgcttccgaagtgtattcatcttcatcgtccaactgcaatatatttccctcactttgaaattcacgaaagcagccttggaacacctgctacgcaaagttagattccgctgacaaagcagactttagttgatgcaaaaatgccctgcacaactgtgcagggcatcagaatcatgctattcaaacggacggtgccataaccctggccccagttcacaaaccaggattcaccaagctttattcaagctccaacaattcctgttcttccttcgcttgctgtgccaactcttcttctgtaggcggagcaactgtcgtaatcaaattgctggccacccgaattttttgttcgatcgtactagcaatattcggattttccttcaaaaattgtttagcattctcacgtccctgaccaaggcgctcaccttcgtaggaataccaggctccgctcttgtcgacaatgtcatgctccgtaccgatatcgatcaagctaccttctttggaaataccctcaccgtacataatatccacctcagcctgacggaaaggaggggcaactttgttcttcacgactttaatacgtgtgcggttacccacaatgtcgttacccattttcaaactttcaatacgacgaacatccaaacgtaccgtagagtaaaacttcaaggcacgtccacctggtgttgtttcagggttaccgaacataacacctactttttcacgtagctggttaataaaaatagcaatggttttcgacttgttaatggctccagaaagcttacgcaatgcctgggacatcaaacgtgcttgaagaccaacgtgggaatctcccatttcgccttcaatctctgccttgggcacaagtgccgctacggagtcaacaactacaatgtctactgctccactacgtacaagggcttcggcaatctcaagcgcctgctctcctgtatctggttgcgatagtaacaactcatcaatattgacacccagcttgcttgcatacgacggatcaagcgcatgctcggcgtcgataaaggcggcttgtccgcctgttttttgcacctctgcgatagcgtgaagagctactgtcgttttaccggatgattccggtccgtatatttcaataacccggcctcttggaaagccgcccgttcctaacgcaatatccaaagcaatcgaaccactggggatcgtttccacttgcatgtgggtagactcacccaacttcataatggaacctttaccaaattgcttttctatttgacggagcgccatatccagcgcagcacgacgatctgacaataaactcacatccttcattgtttgtactttaataataccttgttttgacacgcttgccaagcattttttcgaacatacattcgttttttttattcgcaaaactctcttctataattacatctgtctcttaaaacaaaaaaagaaccgctggcaaaaggctttgcaacggttcttccgataagatgattataccatgaatatctatctaaaacaactctacgagtcacactgtacatagatgtttaagagagtttctcgttctctaccagcctgcgccacaatctgtacaggattgctttaactgatcgcagtcggattgtttcacggttgccactcagtctcagttcatgtacttccgtttccttgtcgcgttcagcaatgccaatatacactagaccgactggcttccgttcggaatacccaggcccagctacaccagtaactgaaagtccaaaatcgctatccatgatcattctcgcctgctctgcaagcacaagggctacttccttactcactgcgcctggcgcatggtccccttccaaataatcataaggcacgttgagtaacttcatcttcatttcattggaatagcacacgatgccaccttgaaacatagcagcactgccaggtatagaagtaatctgttccatcagcattccacctgtacagctttctgccgcactcacagtgagttcgcgtttggccattagatctacaataaccttctccagcgcaacatcctcgcttgcatacatatactccgaaagacgctgctgaatttctacttccgtagctgtcaacttaattaatgcttcactttcgctggccgccttggtggatatacggatcgtgacttccccttccttggcataaggagcaatcgtaggatctgtctgggattggatcagatctaacaaatgggtttcaagagctgactcaccgatccctgcaaattttagcattttcgaataaattggcatttcctcaccgctcaatgcctgctgaagcaaccaaggtttcgcatggtttgcaaacatgggtttgagttccttaggcggtccaggcaaaactacataaaatttaccttcctgtgcaatcgcgtcgcccacagctagccctgtctcattttcaagcggagtagcaccttcaatagaaagcgcctgccggcggttattctcggtcatttctaccccacggttacggaaaaattgatctagcttgtccattgcaagacgatctatgtgcaatttccgccccaatacagccgctatcgcctctttcgtcaaatcatcctgagtcggccccagaccgccggaaaacaaaataatatccgcacgcttctgagcaatccttatcgcttcctgaagccgatttatgttatcgccaaccacagtctgaaaatacacatcgattccaattgtagccagctcttgtgacaaatattgagcatttgtattcactatttgtccgagtaataactctgttcctactgcaattatttcagctttcatcaattcttcctcctgtactgcgaatattatgggaattatataaagaaacagcaataagtttagtccctattgctgtttccataaaatttatcctgttaaactttggaggagctcagcaaatggatatttttcacgaaataatcaatacccgaataaatggtgatcaacactgctgcccatatcgctattaaatcaaacggtataccaagaaaaacaaacgggaaattattaatgagcagcgctacaatagcaacgatctggataatcgtctttaatttgccccaattgcttgcagcaaccacagacccatccagtaaggcaatctgacgcagccccgtaaccgcaaactcacggctaacaatcacaacgacaatccatgaatcaattttccccatttctaccaaggaaaccaaaatagcggttaccaaaagcttatcagcaaggggatccaacagcttgcccaaattggtgaccatattatttttacgtgccaaatatccgtcaagaccatccgtgctggctgctacaaggaaaatgatagccgcaatcagctgattatacggcagcttgaaagctccgatctcaatcggcggcggataaaaatcaaagttcaccagcaaagccagcatcatcaccgggataaggcaaatccgcgttattgtaattctgttgggtaaattcacaacacactctcccctgattatcgtacttgattacaaatggcagttttcggattaaattcaatcctatgtaaatcgctttcgacgagcgctatacacctgaattgtctgcattttcgttacaagtataatatggcgcaaaacgcatgtcaaaataacctgccgcacatcaagcaacgttttttcctacaaaatatatgagggaaaacggctttatttcatgtttgtaaattgaagctccaatggcaaatcagctttacgtagcaattgaataatcgcctgtaaatcatccctgttttttccggtcactcggatttgatcaccttgaatctgacttttgacttttagcttggagtcccgaataagaatattaattttcttggcattatcctgatcgattccctgcttaagcgaaagacgctgacgcactgaacctagagaagcgggttccaatttgccatactccacatttttaagggacagacctcgtttggccattttagattgcaaaatatcaatcaccgcattcagcttgtactcgtcttccgatgcaatcgtaagagcttctttctcaagcttgaggctacttttgctatccttgaaatcaaatcgtgtttcaatttcacgctccgtctgatgaaccgcatttgttaactcctgcatatccattttggagacgatatcaaatgaattttctgaagccatcgtttcactttcctttccacaacaaagttcaatatctaattataggctagtcatttacaaaaatccaataatccgttgactaaaaaggcgtttttgccagttttcctgacaaaaacgcctttatttcaattacggtcaaaatatctaattatggcttcgtgttggagttcggaacatatccaaaagtccaagcacaatgtgagcaagaccaaagcccagtatgccatagccccatgcattcggtgtcagataatagcccagtaaactgacaatgataccgagcccagtcacaatccagctgacggtcataacgtatacacctcactttgcggaaaatgaaatgactacctttccaagaattacagtcattattatttcctcgcaccaaggcgtttattcaccatcagtagttgtagaatctgtaccactttgtgttgaatccgtacttctacctgtcgaagaatctgcaggtgagcccgttacccctgcactcgttccggtcgtggaagcttctccttgctggatcagtacacgagtagtcgatttattatctgttatcggttgacctgctacggaaatatctgtggcagaagaccgccctgatttgatatataaaccttccggaccaatatcgaaagacatggcatctccacttttagtcataccgtagctcagcttttctccacgggaattttgtcccttgtacacttcaagccagctttcacccgtcgctttaatatcaaccttggctgtggctcccgttgcactggaaactttgaaaatcgtcgtcttgccttgcttgccgtcctgtgccacagttacaccttgttgtggtgtagtcgtatccggctgctgtccagtatctggagtagtagcacccgtactccccgtaccatttggctgagtttggccggtttgccccgcatcaggagtctgcccaccagcaccatttggagccgtcgtttgaccattgttcggctgtgtcgtagtggtatcaggagtagacgtgcttggcgttgtacttggtgttgtaatcggcgttgtgttttctgctgtttttggagttgaatggttgttgctcacccaataagcataaataaccccaacaatgagaactagaaaaagccacattaacgctgtaggcaaccatttaagattaccaattgtggcgggacggctggagcgtttctgtgtaacaggctccatgactgcttccggctcaggttcaggcacattactttgatgcccttccagaatctcatcggggttcaacccgaccgtttcagcgtatgttttaataaaagctctgacataaaagcttcccggcagcactttgtaatcgcccgtctcaatggcttccagataacgtttgcgtatcttcgtcatttcctgaacatcgtcaaggctcaatcctttttgcagccgggcctcctttaattgctgacccagttctgacatgtcatcatctccttgtgtaattacgcttatttaaagatcttctgtataactggctgtaaaggtatcataaataatttcctcagccggattattgcgaagttcaataatgatattgaaatcgtcaaagctgtatcctgattcacgtacaaatacatcaggatgctcaatcactttagtacttggcatgctcatgatttcctgaagaaggtgataatgtctttcatttgaccgaattgtactcacaataccatcaataataaacacattgtttgggttcatttcttcttcagaaagctgactgcgcaccgtctgtcgtagtaacgttgaagatacaaaagtccaacgcttcattgcgcatacactactggcaataatggattccgttttgcccacacgcggcatcccgcgaagaccgatcacctgattgccgtccctctttaatacttcacccaaaaaatcgaccagcaacccaagctcatcgcgtgtaaagcgaaatgttttacgatcatctgaatcccgatcgatgtaacgaccgtgtcttactgccaatatatcaaccagtctcggagcacgtaaggccgtgactgtaatgttgctcgctttttttaacgtgtctccgagaatgcgtattttctcgtcatcgtccgtttcaagcaacatcccccgtctttcgccttcaacaccgttgattgtcagtatattaacccccagaataccaagcatggaagcaatgtctcccagcagtccgggtcgatttttatgtatcttgtactccatgtaccactgtttcgtttcttccgtcacgttagcacctcattcacattcaaaccgtcaacaactccaaatcaaagcattattgtatcataaaataacatctttcgacaaaaccaattattgaaattcgataggttacattgtgttgtaagcctcaatcacgtttatgatatataaattacaatggaattacaagaacagctctgtaaccattacagaaaagcccccaaaagggagcttttcatgttggttcctacttatgcgttgctcttagccaatttaaccattagccgggcgatggtgtgacgctcgtcctcatcggcaactccccacagttctttcagtgcgcggttggagtggttcgctgggtcgaccttctcatccagaaaatcaccgatttcataagcaagctctgaaatggtatcttggctgattcccagcttctccgcttgctctacacgctgaccaaggaactttttccaaacatcaaaattctgaacaactgttgacatacttaaatcctccttagatgattcagatttaaaatcaacagttataatatgctcttctcagacgcttactatactggtggattcctccaagcgctatcccttaagtcacccatcctccattaggacttatgacctggccattaatataacctgactcaggaagcgcaagaaaataaaccagggacgatatttcatcaggtcgagccaaccgtccggcaggaatttcttcttccaaactggtaatttcgtttttatccaaatgatccagcatcgacgtatccactgcacctggagctacagcattcactgttaccccggaaggtgctacctcttgagccagcgctttagtgaaagcgttaatgcctcccttggtggtggaatacaacacctcgcacgatgcgccacatatcccccacacggaggaaacattcacaatgcggccatagcgttgggaaatcatatgtggcataaaaacctgcgtgcacagaaaggttcccttaacattgacggccatcacttcgtcccattcctcttccgaaacatctgtcaacagcccataatgagataatccggcgttgttcacaagaatatccggcttcatcccgtgattatccagcttttcccgcatgcgttcgatctgctccttgctccgcagatccgctgacacggtcattaccttgcctgaataagccatgcaacgacgggcaacttcatttgctttttcatgggacttcatgtagtgaatgacaacattcatccctacagctgcaaaacgctcagcaatagccgcaccaattccgccactggctcctgtaatcagcaccgttgtatcgccaattgcttttaattctccgccctcggtggtcatcgtttccctctccctggacattacggactcaccactagtgatattgcgagttgatcccactggatatggtcttttagacggcgatttacatcctcgagcgtgatactttcataaatagggagcagttggaaaaaatcgctgccccggaagcgatgtcttgtaaattcatgtgcaatattttctggtgaattgagtgtacgcagataaccaccgattttctttttgcgtgcccgttcaaaatgttctgctgcaaagccctgcttctgaatggactccacctcttcacgtattctcgccaacagccgatccgggtctttggtatccccgccgattgcagagaatgcatattgctgcgtactattgtactcatgaccaaaactgtccgaaatcagatcctcatcgtagagcttttgatatagttgtgtactggaaccaaacaggagatcaagcatcagcttggtttccagatcatgacgaagtaattcttcacccgttaggcctacttcagcctccttgaatccaaacagtagctttggcagagaaacggccagcttcacctcacgacgtggttctgcaactgtagtgggttcatcgtcgaaaatccgctcaatctctccctgcgacttatagtcctttttgacctgattgttacgtaccagctctattacttcagctggatccactccgcccactacaaaaagaatcatattgcttgggtggtagaaagcttcatagcaactgtacagcgtttcttttgtaatcgtactgatggattgaacagtacctgcgatatcaatatgcaccggatgaaccttgtacaacgcctcgatcagaccaaagtaactccgccaatcagggttatcttcatacatattaatttcctggccaataatgcctttttccttttctacattttcatctgtaaagtaaggatgctgcacaaaattgaccagcgtggtcaaattttcttgaatacgctcggttgccgaaaacagatatactgtttgatcaaagctggtaaatgcgttcgccgatgccccattagaggagaaggtagcaaaaatatcgccttcaggctcttcaaacattttatgctccaaaaaatgggctatgccatccggcacctttacgggctgttgaccttctacgcggaaatgattatcaactgagccgtatttagttgcaaatgtggcgtatgtcttctgaaaacccggtttgggcaacacataaacgtgtaaaccgttatccattacttcatagtacagcgtttcctgcaaatgctcataaggtatatgctccaccgctattcccccttctggtctctcaagaaataaatagtgtccagtcggaacgtccgggcggcatcctgaacatcctgcaccttgactgcctccacctgactcagcagctcatctactgtccgttctttaccggaaagctgtctgttaaaatcataggcgatcatttcaaaagcggaatcctgcatctcctttagcaagttgcgaatcatcgcctgcgtttgggtcatttccagctcagtaatcgctccgttttgcgtatcttccagttgcttgcggataatagtaaccgctttttcataattaggaatttcaataccagattgaatcgtaccaatacctttatgcccgtcataccgtgatgaagcgtaatacgccaaactttccttctccctcacattaacgaacagctttgaatgcggatacccgcccagaatgccattgtacatcagagcggaagcatagcgatcgtctccatacgtaataggggtgcgcaaccccatgttgagcttgccctggttcacatcaagacgctctacaacggtttgaacatcacgctctaccgacttgggctgttcaggaacataccctgtttccgctgaacggttcaattgaaaatagcgatcaacaaacttctcaacttcttctagcgtcgtatctcccacaacgtataaatccatgctggcatgattcagccattctccataagccttatacaagctctgtgcatctatactgtccagatcagatcgttgaccaagagggtgcaaacgataaggctcatccttgcacatttcctccatacagcgctcaccagcataacgtattttatcgttaactatagattccagcttcttacgcacattttctcgttcctgctggacgtatcccgtttgaaatgcaccattttccaatgcaggcttcgttagtacttctccgagaaaagaaaacgaacgatccagtaaactatctggactatttacaaagttgtcattaatcgtatccatgcgaaattgcacgatctgataatctccacgtttatacacatcgaaaccgaaacccgcgccatacaattgctctaactgttctctgaattgtgtagtctgcggatacgattctgtaccccgtcgcagaacgaaaggtgccagccccactcgagttacggtgtcctcccgtagcggagtgcctacatacaatgatatagcaaacgtcttaaagcgcttggtcggcagtacatgaatcctcagttgtctgcgtgtgccacgctcgaaacctgttttgttcaagtccaaaactcctttgtgacgtcaatttgcgtctagcctttgattagcaaagcattagctgctgtgaatcttcctcctgtaaagaggtaaagtgtaccaatctttattctaaccatgcaaaagccaagaagcaaccggagacaagctcccggctgcttcggcgttttacatgcaaaaaatatgttccccgatggttttcacctgcggacgggaccaaatccatttagaggtggctgtttttgggttaaaataatagagacatcctccgcttggatcccagccgttcagggcttggcgtaccgccttttgtgcattctcattcggtgtgagccagatttgaccgtctgctactgctgtgaaagctcctggttgaaaaatcactccagatggtgagttgggaaagctaggtgacttgaccctgttcaaaataacagccgcgacggcaacttgtccttcaaacggctcgccgcgggattcaccgtagaccgcgttggccataattttaagatcgttttcagatagtcccatggtgttggccgatcccatcgtttcatcattttgatccgctttatcgttattgtctgctgtctgtccctgagcggaaccttgattgttacgatgcataggagtttccgttggcttccagttgggagtagcattcaccagctttaatttcgtctttgctccgaccactccatcaggacggatgccaaattccttttgaaaacccttaacagcttttagtgtactgctgccaaaatggctgtccactttcccgccaaaaaagcccagcaacttcaaacgtgattgcaactcatatacatcctgaccgtaagatccaaaatcaaccgctcccgagctgaatgtcggctgagaaggttgcgccgcttgtactttctgctgtgtgctcagcggctctgcttgctgctgtgcagagtcacttttaaaaagtcctgtgtacgtaatagccgaggctgcgaggatacccgtgcaaatccagaccattgtctttttcatatgctgcgctctacctttcttttgtgggattaacaggatggctacgtttattatgacaaggtccgcttaaagctattcacccttttaatcttctttcagcaggtagtcgccacacctcaaaaaacatcacaaaaaaacgctgtttgtgcactcggagttgtcatattagaacaaccaccatgcgaacaaacagcgttttaatgtagtgctggatagagatcatgcttaggaacttactttattttgctgatattgctccattgagataaggacctcacggggcttgctgccctcataagggccgatgactccgcgagcttccatggagtcaatcagtcgagcagcacgtgtataaccgatccgcatacggcgctgaaggagcgaaacggaagcttgtttagcctctaaaatgatgttgaccgcctgatcgtacagctcatccagcatttcatctgcatcagccgatacctcttccacctccggcactagcgtttcatcatactgcgcttcaccctgttcacgtacgtagctaacaatattttcgacttcttgatcgctcatgaatgctccctgaacgcggactggtttggaagcacccattggcatgaacagcatatcaccacgtccgagtagcttctcggctccacccatgtccaatatggtacgggagtctacctgcgaggaaacgccgaaggcaatacgtgaaggaatattggctttaatcaccccggtaattacatcaaccgaaggtctttgcgttgcaatgataaggtggatgcctgctgcacgcgccatttgggcaagtcgtgcaatcgcatcctccacatctcccgcagctaccatcattaaatctgccaactcgtccacaataacgacgatgtaaggcagaaatgcatccgggttatctttcatcagattattatagccctcaatattacgggttcctgatttggaaaataactcatatcttttttccatttcaactacaattttcttcaatgcaagtgaggctcgctttggatcagtcacgaccggagccaacaaatgcgggattccgttgtacacgttcaactccaccattttaggatcgaccatcaaaaatttgacctcatccggctttgctttgtacaaaatactcgtaatgatcccattgatacacactgatttacccgaaccagttgccccagctacaagcagatggggcatcttggccaaattaccgacaatcgtctgtcctgcgatatcacgtccgaatgcaatagataaattggaagctgactcctggaaaacggttgtctccataacctcacgcatcgttacaatggaaacttcattattcggaacctcaattccgatagctgatttgccaggaatcggagcctccatacggatatctttggcagcaagcgcaagcgcaatgtcatccgtcagactcacaatgcggctgacctttactccaatgtccggctgaatttcataacgcgttacggcagggccacggacaacctccagcaccttggcccgcacaccgaagctttccagcgttgcctccagcttgcgtgccgtttgcatgtaatccttttgtcccatacctttgcctgcgttttgtggtttagcaagtaaacgaaatgatgggagcttgtacggtttaggcggcggcggagccggaatagctgtatggttaccttcagcctcttcgcctgccaccccagttgcaatcgtctgagcttgtccctgagccccttctaatgtcccctggatcgctgtcgaatcatccatatccgtatttgcattggcatccacaaagtcatcatccagggattcatcaataatggaagttgtctgctctgctcctgtcagggactctccaaattcagcttccggtcttctttcctcatgctttacttgttcgaagaaatccctaataatcggcgacctttttaacagagttgcagcttcctgctcaacgtgttcgactacgtcagacatctcttcactctggttgccgtttctccactgggcctgcgcgtcctcagcttcatatggaagatcatgatcatcctcatccgtatcgacagaatgctcatccttgtccgctttatctgaatttttgagaccaaacaactgaaagaaaatcggctgtttgcgtgcaggaggctgcatttcgtcaaagtcatcatccatgtcttcctcataggcaggaatgggctcagacttgatttttctatttccactacttttgctagatgctgaaagcggagtagctttaccagtccattttttgcgcacgcttcccccggcagtcagcagcttggtctttacaatccgtaccaaatccacataggacagttgggtcatcagcatgaaacaaatgacgaacataacaatcatgatcagtttagctcctgtgagaccaaacagccataacagaacagtaagctgcaatgcgcctacgtaacccccgctgatatccttgttcagcattgaggtatggccctgctggtcaggcgacagcaactgctcacgcatatctatatgtatctgggtcatcactccgcccggctgaagcgcgttgatcggtcccaaacgctgctccatagatgaaatagaactcataagtgtaaaggcaaatactaacaggagcaaacccgttttacgcgagttccactggttcggccacttgcggtgaatcatcaccatcagaccataataaatgccaatgagagggataacaaaatagaatttccccagtacgagcccaaacatcttggatagcgaccgaccaaccgccgcttcacccgacaacgcaatgaccgctaatgtaatcagcacaatgccgtaaatttcaaattttagaactccgccaaatgcggctttcttttttctttttcttcttctggacatacaaggtcaccccccagaagaatattataccacgtcaccctgtatccgcacatatgttctttttcaacagtaaacgacctatttctatactattcgacaccttctacgaccactcgatgacttgacctggtccataacgcggattcaggtaggcttccagcggacagtccaacagccgtacaatgatcccccgacgactttcaagcggctgtacttgcataagtagaccgtctacccgaacctctgcaaactcctcagcctctttccacatcccttgccataccatttccattggcattacagtatatagtgtcattgtggtagctccccgctatgctcccctgacagtgtctctgtaggagttcctgtggcactaggagaaaaaggagcatacggagcctgctgttgaatcccagcgatcccgttttgctgacgccgcgtttcaataatggtgttcagctgttttaaagcctctccgatgcctccaaccgcgtccatcaatccatacttcactgcatcagctcctccaaccgctgtaccaatatcgcggtttaactcaccggttttaaacattaattccttaaactgctcttctgtaatacgagaatgagaaacgacgaagcgtacaacacgttcctgcattttttccatgtattcaaaagtttgtggtactccaatgaccagaccgctcatacgaatgggatgaatggtcatcgtcgcactctccgcaatgtaggaataagtggaagacacagcaataggcacaccgatgctatgccccccacctatgacaatggtcaccgttggtttactcatcgatgcgatcatttcagcaatagctagtcctgcctctacatcaccaccaactgtattcagcaaaatcattaatccttcgatacgaggattttgttctgccgctaccaactggggaataatgtgctcatattttgtcgttttgttttgaggcggcaaaatgagatgcccttcaatttgaccgataatcgtcatgcaaaaaatattggactcgcctccaggcatggaggtttgacccagttgctgcaaaacctccatagcaggtaaagcgggtctttgcccaatttctggttgatctggcgcttcactttcctcattgccagatgttagattgctgtattgttccatatgggtgatcttcctttcgctttacgcatctatatatgacccgtattcaccctatagtatgggatagaaatggaatattttatacccatccccatgcctttccttgtcccaggaaatcaaaaaagcctctcctcccgcggaaaccgtccaatatttcctgcgggaagagaggcgactgtgtgcctgtgacttaagtttttaattcaggtttttgaacaaatttcaattgaatcacacttccattataattggcaggatcatcggtctccgacgagtttgctcatacaagaagcgacctagtgcatccttgacatttgtcttgagggaagcccattcatttacattttcactcatgagcttatgcagtgtacttgagacaatacgattcgcttcatccagcaaaccttccgattcacggacatatacgaaacctcgggaaatgatatctggtcccgatttaatcgttccgtcttgcttgctcagcgtaacaacaactaccaaaataccgtcctgtgacagcaatttgcggtcgcgcaatacgatatttcctacatcccctacgcctagtccatcgatcagtacgttacctgctgtaactttaccagctctgcgtgctccaccattctgaatttcaatgacttcaccgatatccgtgataaagatattctcaggctcaatacctacaccttcagcaagaagagcgtgacgacgttgcattctaaactcaccatgaattggcaagaagaactttggtttcatcagattcagcatcagcttgagttcttcctggcttccgtgtccagaaacgtggatacctggattagctgcgctgtaatatacattggcacccagacggaacagctcatcaattgtgcgtccaacgtatttttcattacctggtactggagtagctgcgatgatgactgaatcccctggaagaatgtcaacctttcgatgtgtggaacgagccattcttgtcaaagctgacatcggttcaccctgactgcctgtgcagagaataactacacgatccgctgacattttgccaacttcttcaggctcaatcagcattccatctggaatttccaaatagcccaagtctgaagcaatacctacgacattaaccatgcttcgaccaataactgttactttacgtcccgttgcttcagcagcattaattacctgttgaatacgatgtacgttagaagcaaaagtggctacgaccacacgctgtctcgacttgcggaaaatgtcttccaggacaataccaacgctcttttccgaaggtgtaaagcctggtttttcggcattcgtactgtctgacaaaagagccagtacgccacgtgtgccaatttcagccatacgctgcaaatctgcatattgtccgttcaccggagtatggtcaaatttgaagtcacctgtatgaacaacagcgccttcaggagtatcaatacatacacctacagaatctggaatactatggttggttctgaagaatgttgctttcagtgtggaacccagcttgatttcagaatcagcattgatcaaaatacgtttggtttcaccaagcagattcgcttccttcagcttgttttccaccaatcccagcgtcaatttggtaccatatactggtacattcaaatgtttcaacacgtaaggcaaaccgccgatatggtcctcatgaccatgagtcagcacaatgcctcttactttgtcgcggttctctgtaaggtaggaaatatcaggaataacgatatcaatgcccagcatgtcctcttccgggaatttcaaaccggaatccaccacgacaatgtcattgccgtattgaacgacatacatatttttcccgatttcaccgacgccgcccaaagcgaaaatcatcaatttatcgttgtttgtttttttagacaaatgaatctaaacctcctatggtagttggacgtcgtaccttgatttgtttatttaattttcaaaaaaataccgcacccagtcacttgaccccattatacatgattaaaatacgaaaaaacaagtcatcctgttcgttacgctaggtttcccattgccgtctgaaaccattagtatccgtcattttgtctacatacatggttaaaagcacagcaaaaagggcgtcctataagaacgcccttcacgctgggaaccttgtcagacaataaaccctataggttttgtacctaccgactgcccttaacaaggatactccttagtattaattaacatcttacattcctatttccctttaccgggtaaataattttttaataaattccgcttcatcctcagttggaggaatgagcggcaaccgaaccgaccctaccttaaccccccgtaattccaatgcatattttactgccaccggattaggcagaggatgaggacagccaaacaagcccttgaaaatagggaacaactgctgatgcaactttgctgcctcctgcgagtgtcctcctacaagtgaatcgatcatccgcttcatttcagcacctaccacatgactcgctacgctgataataccataagcacctacagccatagcaggcaacccggaagcatcatccccggaataaaccagaaaaccttctggcgctgccgctgcaatctgtgtgacctgcgcaagtgatgcacattctttagttcccacaatattcggaatttgtgcaaggcgcagtgttgtttcagctgttagactcgctccagtacgacttggaacattatacagtatagctgggagtgatgtggagttcgcaatactttcgaaatgctgatacatcccttcctgattcggtttattataatatggcactaccagtagaacaccatctgctcctgcctgctccgcggcacgggttagatgaatggagtgacgcgtattgttgcttccagtcccggcaataattttacatcgtccagctgctttttctacaacaaatgcaaacaacttgattttttcatcatcgctcagggtaggagactcccctgttgttccagatacaacaagtgactctgagtgctgttcttctattaagtaatcaatcaacgaggacaatgcagtccagtcaatctctccttgcttatcaaaaggtgtcaccattgcggtaatcaatctgccgaagttcaccatgctgcctcctttttgcaagtccgagcacggacaatgcgcctattgatggagttcaaatttattatgcaatgcgcgtacagcctgcaccatatcttcttttttaacaagtacccagatcgtcgtgttggaatctgcggattgaaggatctgtacgtctgattctgccaatgcctccacaatcgtcgccataatgcctggtaccccgttgataccaccgccaatgacagaaactttagcacacccggccagtatcttaggttctagacccaaaccgttcaatacttcaaccgctttgcttccatcatgatcgaacacagtataaactgcccccgatggcgttacgttaataaagtcaacgctaattccatgttcagccatagatttgaatacttgtaattgcaagtgctccaaacccggctttaactcaacattaatctgagtgacattgccgacatacgcaatacccgtcacgaaacggtctacgatgtctgcctgcacgtctttgaagccttccgggtgggtaactaacgtaccttctccttcggagaaggtagagcgaacacggaccgggatattagcctgcatggcgatttcaacagcacgaggatggataacctttgctccctgatgagccatattacaaatctccgtatagctaacatgtgtgagtggctttgcgttttccacaatgcgcggatcggcagtcaatataccattcacatccgtataaatatcaaccatatccgcatgtagagcagcacccagagcagtagctgacgtatcgctgcctccccgacccaaggtagtcatatcaccgtctgctgtttgtccctgaaaacctgtcacaatgacaactctaccttggttcaactcttcaacaacacggtctggctttatatccaaaatacgagcattgccgtattgatcatccgtaataaagcccgcctgtgccccagttagcaccgtagcaggaataccttccttctccatcaggctgcataatgtagcagcagaaatgatttcaccacagcacagcagtaaatcccgttcgcgcttcggaagactgtcgccgttagacgccgcccaatccagcagcgtgtcggtggcataaggctctccttttctccccatggccgacacaacaacaaccaattgaagattttgttccagctcccgcttcacatgtgccagcacaagttgacgtgcttcaggtgtggacagcgaggttcccccaaatttttgcaccaaaatacccattattcttcccccatatcggaacgttactccgcgtttgcagcaataatttccgcgatttgcaccgcgttccatgctgctcctttgagcaggttgtcggatacgacccacaaattcaatccacggctattgcccaaatcacggcgtacacgccccacaaatacgtcaggttttcctgcagcatcagatgccagtggataaagctgagcagcaggatcgtccaccagcgttactcccggtgccgaagccagcagattgcgaatttcttctaaatcataatcttttttaagttctacatatacagattccgagtgaccatatacaacaggaatacgcacacacgttgctgttacgtccacagattcgtcacccagtatttttttcgtttcacgtaccattttcatttcttccagtgtataaccattgtcctggaatttatcgatttgcgggatagcattgaaagcaatctgatgctttactggcaacgagcctactggcaacagatcaggctgaacttcatctccgttcagaatcgctgcgctttgacgattcaattcatcaatagctcggcttccagcgccggaaacggcctggtatgtggatacaatgatacgagaaatgccatactgatcatataatggtttcaaagcagctaccatctgaatggtggagcagttcgggttcgcaataattccttgatgctcggcaattttgtcgctgttcacctcaggcactacaagaggagctgtcggatccattcggaatgcgttggtgttgtcaatgcaaactgccccatgacgaacagcatgcggcgccaattccttacttacgtctccacctgcactaaacaaagcaatgtcgattccttcaaagctgtcgggggtagcaatctctactggaatttgctgacctttaaagctaattaacgtgccggcagaacgaggcgaagaaagaaatttgattttgtccacaggaaaatcccgtttttccagcagatttacgatctgttctcctacagcgcctgtcgctccaacgacagctacattaaactttctattgctcatctggtgtatctccccttctcgactaaaaaccattttttattctgaaagcatccaccgccaacaagaaattagacccgatacaatatcgaatcatcttctaggcgagggatgctcagcagttaactataatacttcatggggtcttgcgttccacaatcatcggctgaagctgtttgccctgcaatgcttcataagcagcctccggaatcaactccatgttagctacaagcgagttcggctttttaactggattgtcctgtccgaacggcacaaaaaagatatttttggctacgagtaatttggcgatattggcagcatttagacccagtccatcattagtagatatagctaaaagaagtggacgaccgttgcgcaattgcgccttggcagccatcaaaactggactgtctgtcattgcattcgctaacttactcatcgaattccccgtcaaaggtgcaatcaccagcacatcgagtatttgggagggacccagtggctcagcctccacaattgtagaaatgatatcattccctgttatatctttcaactgtttttgccaactttgcgaagtaccaaagcgcgtatccgttgttagtactgtattggatataataggaacgaccttcgcaccctcatcaacaaagcgctgtataacaggcattacctcttcaaatgtgcaatgtgagcctgtaattgcataacctactgttttcccttgccaactcattgtgcatccccccgatcaggattatcttccattaacaactgcaccagcgtattcgctataatagcgccagcagttttgggagcaacaataccgggaagaccaggggcaagcatagccttgattccacgcttttccgcataacggaaatcacatccgcctggtgcggaagcaagatctataatcacggtgctcaatggcaatttagacaggatttgcgctgtgataatcatagagggtatcgtattaaaaatcaagtcaactccctttgtctcatgcgccaaatcccttgtcataaaaggcctccaacccatttccacggctcttgctgcatcctctgcccgccgtactccaaccttcactctggctcccaacccctgtagtgcccttgccatggtaaatccagtccgtcccatgcctagaaccatacaatctgcaccgtgaatcgtaaaatcagtatgctgaatggccatcatcagtgcgccttcggccgtaggtatagagttgtatatggccacatcatctctctctagcagctctaccagctttaactcatgtctggtacaaatctcttttaagtacgtccgcgccatccctgtatatacaacgcaatgcggtggaagagcagcagcatgttcattcagaaactggagcttctgtgctccgaaaagtgcatttacgttgccttcctcatcgcatcccaccaccggcaaaatcagtgcgtctgacgattccagcagcttgacagacattggttctagtgtcactcctttgagtggtacttcaagcttgtcaaaaccgaccacactgacggtagcatccatgtccacacatttgcggattacctcaagctgcctcgcatcgccacccaaaacaacgacgcgtattcctgttagcatccggatcactcctttccgagacacgatatgcttttagtctatgcgagtgcccggagaggggtgaaaaaacacaaaaaaaaaccgccccttgatgaggcgacctttatttgcatgcttactcttaagcaagtaaatttgaagcttttacaaaatagacattcttacattgcaaaccaaccatagctcagcgtcctgtatggccaaagcctccagcaccacgcactgtttcagataattggtctacttgtttcagctctacctcaggtacaacctgaaataccatttgtgcaattcgctcattgcgcgtaatcgtgaacgattcttcgcccaaattaataagaagtaccttgatctccccacgataatccgcatcaatcgttcccggtgtattgagacaggtaataccatgcttaagagccagtccacttcgcggacggatttgtgcctccaatcccgctggcatagctattgcaaatccagttggaacgaggcaacgtttgccgggttccagtaccagattttcctgtactgctgcatacaagtcaaaccctgatgcaagctctgacattttgcggggcagctcaatatcttcattgcccgcaagtctgttaatttccacgtaagttaacaaaatagtccctcctcatatcctttaccgctgaatcactcgctcccaccatcgacagggcaaacggctccgagaacatccgatccagcactttgttcacatcatttgccgtcacttgctcgatatgttcgatcatttgatccagcgtataatgctgaccgagcattaattcattttttccaagccgattcatccggctacctgtactttcaaggcttaaaatcaaacttccttttaattgctccttacctttacgaagctcattagcgtccaaaccgttgacagccacatctcgtaaaagctccagcgtcaaatccagcacgtcctttgtttgcttaggagccgtacctgcatagatcgtgaacaacccactgtccgcatgggagctatgataggaataaaccgaataagccagtccacgcttttcccgaatttcttgaaacaaacgtgaactcatgccgccgccgatcgcgttattcagcaaaaccatagcatactggagctcgtcacccgctgcaaatccaggcagggataaacaaatatgattttgctccgttgctttctcatgatacaacagctcaccgttaaacacaggtactgtcagcggcgaaacggttccatgattatcaaaatgtccaaaatgtcgctccaacaattctaccaagcgatcgtcaacattaccagccacactgataactgtattttcgattgtataatgctccttcatataatgactgaggtgtgagctatccatagcaagcaggtgatcttcggttccgagaatcggataagccagtggatgttcaccataggccgcgcgagatacaagatcgtgcaccatatcatccggtgtatcctcgtacatggagatttcctccaaaatcacattcttctcttttgccaattcttcctgatctagtttggaattaaagaacatatcagacagcacatcaactgcgatcggtagatgctcatccaatactttggcataatagcatgtatattccttcgaagtgaaagcattaacatttcctccgatggcatcgaattgctcagcgatttccttagcgttaaaacgctctgttcctttgaaaagcatgtgttcgataaaatgagaaataccgctattgtccggcgtttcattccgggagccagttttaacccagataccgaaagaaactgaacgtacggttggaattttttcaatgaccactcttaggccgtttttaagttgaattctttccacgattggccctcctaaactgaattgcatacttagccataatgttcaatcctaacagaaaaaagacgttcactcaaccggagcaggtagttgccgatcaggggaaagtgtctgactgacagttccgagcacaagtcccttactacgaatagcatgaatcatgcctttgagagcagccgatgaggaatctgttgggtgcatcaatatcagggagcctgattcaaccttactactgattttgttaatcaccgattccggtgacggatgtctccaatctacagtgtccaatgtccacaacactgttttgagcccaagttctgctgctataaccaccgtttgctgattaaaatcacccgatggaggggcaaaccagttatttttgatactcaaagtttctcgaagaagcacttgagtcttttcaatttcttgtgtggctctggcccgactcagacggctcatattcggatgagagtatgcatggttcgaaagctcatgccctcttttttgaatctccttggcgagatcaggattttttttcaaccaacttccatcaagaaaaaatgtagccttgaccttttcctgatccagcgtgttcagtattggcaggataaattcattcccccatgctacattgatcatgaaagataccatcggcttttcgggattccccctgtaaattggaacattaccaagctgatttaaatgtattttaggtgccaattgtcgatatacatattgaatgggtcgatccggagatgcaatcgctttgcgataggtagcatccaaatccacctccagtccgttatagcctggaatagccttccataccctgtcgatcttggcatcaactggttcccgccgctgacgtgctgcttctgttcttagtcgctgcataagcgtattgtcgggcaaaactgctatcgccatcgtggttacagcttctggctctttaacccctgtaacgtctccattgcgtaattgactagcgtagtcacgaaccccactaaactgcccgattacaagtgtgatggctaaactggctaccacccacactgctcgttttgccctactcataattccttcatccccccgcccgtttgtccacattgtatgcggcgaggacaagaactatgacgtagcaagctctagaagctcacttgggtgcagcttgtgcatatgtatgaaaaaagagccagaaacgtagctctgcctctttccaaaagcttaaacaatgctattcaaatcccttgtactgttaatacgaaaagctactcctgcctttctagtctgcaacatgcagatacctaggattttgcaggtgcttctgcagtcagaacagccttacgggacagattgacacgaccttgttgatcaatttcggttactttcaccgtaattgtatccccaatagcaattacatcttcaactttggctacacgctcagtagacagttgagaaatatgaaccagaccatctttgcccggtaaaatttcaacaaatgcaccgaatttctcaatccgttttactgtaccgatgtaaatctcaccgaccacgacttcctttacgataccctcaataatcgaacgtgctttttcattcatctcttgatttgtggaagcgatgaacacacgaccatcttgttcaatatcgattttcacgccggtttcttcgatgattttgttgatgattttaccaccagccccaataacatcacggattttgtccgggttaatgtgcatcgtcataatttttggagcatacggagacaactgctcacgcggcttctggatcgcttccatcattttgctaagaatgaacaaacgtccttctttagcttgcttgagcgcatcctgtaaaatctggcggtcaataccgttaattttaatatccatttgaatggcagttacgccttccgcggtaccagcaactttaaagtccatatcgcccaggtggtcttccataccttggatatcagtcaatacggaaacatggtctccatccttgatcaatcccatggctacacctgcaaccggagctttaatcggtacacctgcatccatcatagccagtgtacttgcacatatactagcttgtgaagtcgaaccattcgattccagtacctcggaaaccagacggatggtgtatggaaattcagtttcggaaggaattactttggaaagcgcacgctcaccaagagcaccatgtccgatttcacgacgacctggcgcacgcaaaggacgagcctcacctacgctgaatggcgggaaattgtaatgatgcatgaagcgttttgtttcttccagatcaataccgtccaaaatttgcacatcacccaatgcaccaagtgtacaaatgctaagtgcttgcgtttgaccgcgtgtaaataagcccgaaccatgagtacgcggcaaaatgctagtgtcgctttcaatcggacgaatttcgtcaagcttacgaccatcaggacgcactttatcatgcgtgatcagacgacgtacttcttccttaacgatatcatagagaacttcgctcacgtcactcaaaagctcaggtgtctctatgtattgtgcttcaaaatgagcaactgtctcttcgttgactgcatcaattgcctcttgacgggcatgtttttctgcaattttaacagcttgcattaaacgttcagctgcataagcacgtacttcactgttcactttttcatcaacagcatgcagtttaacctgcattttctctttacctgctacttgcaccaattgttcaataactgccacaatgttcttaatctcatcatgaccgaacataatagcttccagcataacttcctctggaatctcattgccttcggcttctaccatcatgatggcatctttcgttccggctacaaccaggtacagatcgcttgcattctgctgtgcaatatccgggttaatcacaaattgcccgtctacacgtcctacagcgactcccccgattggcccattaaaaggcacatccgaaatgctaagtgctgccgaggttccgatcattgctgcaatttcaggttcgcaatcctgatcgacactcataaccagattcaacacctgtacatcattccggaaaccttccgggaacaatgggcgaattggacggtctgtcaaacggctggacaaaatcgctttttgactcggacgtccttcacgtttaataaatccgccaggaattttccccacagcatacaatctttcctcatagtttacggtcagtggaaaaaagtccaaatctttcggttcacgggaagcggtcacggtacaaagcacaactgtttctccgtagctcactttaactgccgcattggcttgtttcgcaagacgtcctgtttccaacaccagctttcttccgccgagctgcatttctacgcgttgctccatggtatccctccatttcatttcattgtaaaagttctatacatatccagtatttcctgcgcaggtcttattcataagaagctagcagacaaatcaggatatgtaattcaaaaaaagattcctcatttcaaaaaagaacccggctgctgtccgccgtcgccttagcagggacaagcggtgaacaaccaggcttcttttctcattacatgtctgaaaattaacgacgcagtccgagacgctcgatcaacgcactgtaacgtttaacatcagtcttcttcaggtaagccaaaagtttacgacgctgaccgaccattttcaacaacccgcggcgggagtgatggtctttcttgtgcgaacgaaagtgactttgcaagttgacgatgttttcagtaaggatagcgatttgtacctctggtgatcctgtatcggattcatgagttttgtactcctcgatcaattgctgtttacgctcttgagtcaatgccatcctgttcacctccttcattataatcgccattagcctcgtagccgccggtgaaagcggacaaccaagctaaggttcatcgttgtttacacaacataagtcagtataacacagcgcctgtcttatgtaaataaattagcctaacagctttttagccgtttgtgcgtcattgccaatttggttgatcagctcatccaccgaagagaatttgcgttcagggcggatgtagtggtgaagctccacaagcacagactctccataaatttgctgattaaaatcaaataaatgtacctcaaacgacggattcagcacaccttcatgaaaagtaggcttaacccctacattcattacaccgtttatccaacgatcgcctacaagcgcccgtacagcgtacacacccttaatcggaatcacgtaagtgtcatccagtctgagattagcggtcggaaaaccgatcgtacgtccgcgcttctctccatccattacagtaccctggatgcgatacggacgtcccaaccagcgagaggcatgtgctagatccccggtctgtaaagcacggcgaatgccagagctgctcaccttgtccccatccagttcgaacggtggtacggtgtgcaccgacataagctctcctcccagcttccgaagtgtatcctcatgcccggctccccggtggccaaaccgaaaatcaaagcctactaccgctgttcgaatgtgcaatggaagcagcacgtcgctcataaacgcctcagggctgaccttggaaaattcttcgttaaaactcaaaatataaagtacgtccacacccatatcagccagaatagcctgcttgtccggaagcggtgttaaataaccttcataatcgccttttttcatgacttccttcgggtgaggatgaaatgtcatgacagataccggcacctgctgttcacgagccagcgtaacagccttacgtatcacgcttgcgtgtcccagatgaagaccatcaaactgaccgatcgccgtgacctgtggacgtccccattgctgcaaaagctcatcactcaatggataagataacgatacggtaatcattattaattcacctgcatttcacatcatttgactaacttcgtcaaaattatagcacaattcaaggtaaaaaaactttaatgggagcgatcgcgtctgattcatcccgaccatatatgcctaaaaacgttttatcctctttatacaaacggaagggctgattgtccgtcacagatggtgaaatcatattcagcgacaggcgttggccttgcagagccgcagttaccttggcttcagccactatatgctcaggcatatagtcaatcgcctgatctgttgtaataagccgctccccaagactaccatccgcaacgaaacgctctatttcttcgaaagtcagacaacgttccgcaggaattcccgcagacatggttcgctccagcttgaccatcgtggaaggatatcctaattcacgaccgatatcaacacatagtgtacggatataagtacctttggagcataaggcacgaaaagaaatatccacatacacccccgtctccgcgaatcccgtcatttccaactcgtaaatgctcacttcacgacttttgcgctccacggttttgccttctcgagccagttcatatagacgtttgccgtccacttttagcgcggagtacattggaggtacttgggaaattgtaccaacaaaacgcttcaggaccgctttgacttccacttccgtcacctctactggacgttcactctcttccgtgattttcccagtcaggtcttcggtatccgtggcaattcctaatcgcagtgtagcccgatattccttgggccgctcctgcatgtattccaccacacgggtagcacgtcccagacacaagggcaaaacaccggttacctgcggatcaagtgttccagtgtgtccgattcgcttcatacctaataaacggcgagccttggccaccacatcatgagaggtaaatccagcaggtttatagacaggtagaatgccttcccaagttgcctgttccttctttatcgggttcatagctcagatttcacccgccctacaactgtctcaatgatatctcccagcttaccctctagccgacagccagctgcacgtacatgtccaccgccaccaaatgattgagccagcgcagctacatcaacattccctgccgatctcaagctggccttgaccgcttgatcattaataaccttaaagaaaatgcctacttcaactccacgaatatttcttggataattcacgatgccttccaagtcctcatttacagcaccacaatccgtcatatcgtcaggggttacaacaacccaagcgactttcccatcctccgacatcgtgagcgtttgcaatgcttttgttagcaccttcatttgtggaaaggtcatttcctcgagcaatttctcggataaagatggaccatctacaccgtaagcaagtagctgtgacacagtagacatcactttcggtgaagtgttggagtaacggaaaccacctgtatccgttagcaaccctgtatataaagccgttgctatttcgacatcccatgttactgaaaactctttcagtagatcaaaaagaatttctgctgttgccgcagcatccggcttaatcacattaactgtaccgtaagcatcattcgttggatgatgatcaatattcaggataatggcatcttccgaaaaaaattgctccgtcaaaccaacacgacggtaatccgcacaatctacacaaatgatccggttgtatttccgttctggcggttgctggctcatatccataatctcatcggcatgccataaaaaatccatacgtttgggaataggcccctcattcagcatggtaaatttcttccccagacatgagagaagccagcccaccgttacggtggagctgactgcgtctccgtccggctgtacatgcgatacgatcaggtaatcatcatgctccagaataaattccttcgcttgttgaagcgcctgttcataggtatgcattgccttctcctttacattcagttcatggttccttcagacaaactaaaagttttatttttcatccttgtcgatatcactcagcagtttttcaattcgactgccgtaagcaatagattcgtcaattttgaaaatcaactcaggaatatggcgcagccgtatccgtttgccgagttcagaacgaagataaccgttcgctttgtccaatgccttcagggaagaatttttctgttcttcatccccgagcacgctcaagtatattttcgcttgggacaaatcatttgtaagatcgacacccgttacggtgataaaaccgatgcgggggtcttttaattcagtttgtatgagttggcttagctccttcttgatctgttcgccaacccgacctgtacgtattttagccatggatgctcacctctctgccgttagcgctccactgtttccatgacgaacgcttcaataatgtcgagttccttaacatcattatagccatcaagggtaataccgcattcgtaaccttgggcaacttcttttgcgtcgtccttaaagcgtttcagtgagtcgattttaccttcaaaaatgacgatgccatcacgaatcaggcgtgcttctgctgaacgggtaattttaccggatgtcaccatacaaccagcgatcgtaccgactttagtaactttgaatacgttacgtacttcagcatgcccaatcacattttctttatattcaggatccagcatgcccttcatggcttgctctatttcttcaatgacattgtaaatgacacggtgtagacgaatgtccactttttcagcttccgctgtagatttcgcctggttatccggacgaacattaaaaccaatgacaatagcattggaagctgcggccaaaataatatcggattcggtgattgctcctgcaccactgtgaagaattttaacgcgcacaccttcgacttcaatcttgttcaaggaacctttcaacgcttcgacggaaccttgtacatcacctttaataatgacgttcagatccttcatttcgccatccttgatgtgttggaacaggtcatccagtgttacccgtgtattactgcccagatcagattggcgttgtgtgatcgcacgtctatcagcaatagcacgagctttgcgttcatcctcaaacaccatgaatggatcgccagcaagtggaacttctgtcaaaccagtaatttcaactggagtggaaggacccgcttccttaagacgacgacctttatcgttgaccatagcacgcacacgtccgaagcagttacccgctacgaaagcatcgccgactttcagtgtaccgttctgaacgaggatacgggctacagaaccgcggcctttatccagttctgcctcgatgatggtaccacgtgcccgtttgttcgggttcgctttgtactcattcacttcagctacgagcagaatcatttcaagcaggtcttccagacccattctttgtttcgcggaaacgttgacgaaaatcgtatcgccgccccactcttcaggtaccaattcatattcagtgagttcttgcttcactttatccgggttggcatccggtttgtcgatcttgttgacagctacgataattggcagacctgctgccttcgcatggttaatagcttcgaccgtctgtggcataacaccgtcgtcagctgcaaccacgataatcgtcatatctgtcacttgagcaccacgtgcacgcatagcggtaaaggcttcgtgacccggtgtatccaggaaagtgatttttttactattaatttcaacttggtatgcaccaatatgctgtgtaataccgccagcttcgccaccggttacattagtcgagcgaatggcatccagcaaagttgttttaccatgatcgacgtgacccataatcgttacaactggtgggcgtgttctcagatccgcaggatcatcattttcttccacggtttcaaaacgatcttcttcgaccggaattttcacttctacctcgacgccaaagtctccggcaagcaagaggatggtatccatatccagttcctggttaatggtcgccatcgttccgagcataatcagctttttgatgacttctgacgcatccttatgaagaagcttggctgtttcgcctacagtcatctcaccacgcacaataattttcttaggcgtgttgtcgattttctcgcgacgttcctgttgttgacctttaccacgattgttaaatttcccgccacgattactgccaccgcgattattgcctccacgaccaccgttaccaccgcgtccgccgccttgacggttatcgtcaaaacgtccttgaccggaacggttaccaccgttgttggagttactgcctgtacggttgccaccactacggttcgcattgttgctacctgtggaggatgatgttcttacagccgtaccaccctgactacttccctgagggcgtgagttagtgctttggttaccttgaggacgtgagcctgtgttgccactaggacgctgttgtcctccctgtttttgaccattactgcggttttgtgtactttgctgaccagtgggtctgctagtactttgttgactgcggttttgaccgccctgctgactgctttgcgctttaggagcgctgcttcggttactgttttggttgttgtttgtcctattcatacttacctgcttttcctgttgatttttggtttgctcagttgaatgattactattctggcttgaaccggcctgattcgagcttacttgcgccgtacctgctccgccttgcttggccgcagcattggatttaatattcttaaaaaaactttccactttacctacggcatcatgttccatgacgctcatatggttgttcacgggaatatccagccgtttaagaatggtgataatttctttgctgctcatgttcaacgatttggcgtattcgtatacccgcactttgtctttgctttcttgtttactcaatatactccacctccgacattatccccgcatgtttcttgatcaatttcgcgaatccttgatccgtcacagccagcacaacccgttcaggtttgccgatactgcttcccaagctttcccggtcaaatcctatcaataaggggattttgtacgtcccgcatttgtcgcggaatttcttttgagtattcattgaagcatctttcgcaagaatgaccagcttggcttctgaagacctgatcgctttaaaaacgatctcatcacctgttagcagcttgccagctctcatggcaagacccaatccagacagcgccttattcatcctgcacgctgccttgtgccgccaggaattcttcctcgacggcagcaaaatcacgacttagctgctcataaatatcaggatgaaccgagtgcttcaatgctcgatccagtgccttgctcttttgagccagcttgaagcaggcggctttgccgcacaagtaagcgccgcgtcccgactttttgccagtcaagtcaatcaacacttcgtcttcaggggttttgacgacacggatcaactgcttctttggcatcatttcatgacaggccacacatttgcgcaaaggtatctttctctgtttcatgcattaacccccctacactccgcttaatctacagaaacggaatcctgatgcatttcatcggtggatgttctcggtctgccgagttcttcctccgcctgtgtttcactcttaatatcaattttccagcccgtaagcttagcagcaaggcgagcattttgccctttgataccaatagcaagagaaagctgataatcaggcacaataacacgcgccattttctcttcttcaaatacttgcacttcgagcaccttggatggactcagcgcattagccacgtattcatcaacattatcggaataacgtacaatgtcgattttttcgccacgcagctcatttacaatagtctgtacacgtgttcctctaggacccacacaagagccaaccgggtcaacctcggcgttacgggaatgaaccgcgattttagaacggaagcctgcttcacgcgctacggaacgaatctctacaacaccatcaaaaatttcaggcacttcgagttcgaacaaacgcttaagcagacccggatgtgatcgggacagcataatttgcggtcctttggttgtgttttctactttggtaatataagccttgattcgatccagatggctaaatttctcattaggcatcaattcacctaacgggagaaccgcttccaccttaccaagatcaatataaatgttacgcgggtcttggcgctgtacagttcctgttacaatatcttcttccttgtccacaaacttgttgtagatcagtccccgttccgcttcgcggatacgctgggtcacgacttgcttcgcagtttgtgcagcaatccgtccaaaatcacgtggtgtgacttcgatttcagcgatatcttccaactgaaaatgcgggttaatctcacgggccgcaggcaacgaaatctcggtgcgaggatccaatacctcctcaacgatcaacttgcgggcatataccttaatgactcccgagttgcggttcatatcaacacgcacgttttgtgcggtgttgaaattccgtttgtaactggaaatcaaggctgcttcaatggcctcaaacagcacatccttgctgatccccttttctctttccaactcgttcattgcttcaataaaatccatactcatggattactgctccccctttcaaatgatgcacctgcgtactggtcggcacacgaggcaaaaaaacatgtagtacatgtcaaacagcaacagtcaaatctgaattaaaatatgatcgcgagccttgcaccagctaccttgtcataaggtatggcatgcttcttttgtccgctttgaacggtgagttccccgtcttcaaaagaaagcaaacgaccttcgaattccttcaggccattgatcggctcgtatgtagtaacgaatacgtttttgcctaccgctttagtaacgtcctccgcttttttcagcggtctttcggcgcctggtgaagacacttccagaaaatatgctgtagaaacagggtcattttcatccaacttttgacccagatattcactgatcatactgcagtcgtccagatcaattcctccgtctttgtccacaaaaacgcgaagaaaccaattgctgccctctttgacatactcgacatcgaccagttcaaaaccatgctcatcgaggaaaggttgggccatttcttctactactgatttgatctttggtgtgctcaaagattataacctccaaaagtgaactttcctgtggtgaaaaaaagacgccctattaccatggacaatgcttctccatcaccggctttttcattttcatttgatgtaatgttcatttcgggctcactgcaaataaaccggcgtaccggtttcgtgcccaaaaataaccttttcacgttgtaactgtatatcaaacagtaaagagtgggtttccccactcttttagcaacggttttatctccatgattaccaaaaaaattataacataaccatagttatgtgacaagtgccagagcttgactactgtggttcggattaaaacagagacagctgattactctctggcagacctcgaaagcaacccatctgggacagcatttcgacaatggttttactagctttcgatttttgttgaaaatcctcgacagacaaaaattcaccatgttcacgggaggctgcgatgttacgtgctgcattgtccccaattccctgaagagctccgaatggcggaatgagtgaatctccatccaccttgaagcgtgtagcttcagaacggtacaaatcaatggatttaaaactaaacccgcgagctgtcatttccagagccatttccaggatcggaagcatccctttttctttgggcggtgcctgaaagccgagttgctcgatttcgacaatcttccgtgcgattgcatcatatccctgacagcacagctcaatatcaaaatcggctgcacgtactgaaaagtaagtcgcataatattcaatcggatgatacagcttaaagtacgctgtgcgcactgctgaaataacgtaggctgcagcatgcgccttcggaaacatgtactggattttcagacaggaatcaatgtaccactgtggcaccttgcattttttcatttcctcaatccattcagcactaagccccttacctttacgtacgctctccgtaattttaaaggccagacctgcgtccatccctgccttgtaaatcaaaaatagcatgatgtcatcacggcaaccaattacagtcttgatgttacaggtattattcttaatcagttcctgtgcgttccccaaccatacgcccgtgccgtgagacagtccggatatttgcagtaagtcagcaaaagaacttggctgcgactctactagcatttggcgtacaaacttcgtccccatttctggtacaccataggtagctacaggtgtgcggatttgctggggtgttacaccgagcgcctccgtggagttgaacatgctcatcacctttggatcattcattggaatggtcgtaggatcgacaccagtcaaatcctgaagcatcctcatcatggtcggatcatcatgacccagaatatcgagtttgagtagattcgcatcaaaagcgtgataatcaaaatgcgttgttttccattccgagcttgtatcatcggcggggtactgtaccggcgtaatatcctcgacctcaatataatcgggaacaacgacaattccgcctggatgttgcccggtactgcgtttgacccctgtgcagcccgaagctagcctgttcagctcagccccacgccattttttatgatgcgcctcttcatatttctttgcaaagccaaaggctgttttctcggcaactgtaccgatggttccagcacggaatacacttttctcaccaaataatactttcgtatagttatgtgcgacaggctgatattcgccagagaagttcaagtcaatatcgggaactttatctcccttaaacccaagaaacgtttcaaacggaatatcctgtccctcacccttcagtttgccaccgcatttgggacagtttttgtccggcaagtcaaatccactcggcacactaccgtccaaaatccactcgctatgtctgcattcaggattaccgcaaatataatgtgcaggcagtggattaacctcggaaataccgagaaaggtagcgactacagaagatccaacagaaccccgtgaacctaccagatatccatccttattagactttttaaccaaacgctcggaaatgagatagttggcagagaaaccgtatttaataatcggctctagttctttttcaagacgggctacaaccacttcgggcaattcctcaccatagatggatttagctgtctcgtagcaagtgttgcggatttcctcgtccgccccatccagcaaaggtgtgaacagcttgtcagggaacagctccagctcctcaaatcgatccgccaactcactggtattcttcacaacgacttcataggctttctcctcgcccaaaaactcgaattctgccagcatttcatctgtggtgcgtaaatgcgcatctggcttacgaatatcttttagcgggctaaatcccgtaatgccgtgtatcgtaatatcacggtacaacttatcacgagtttccaaatagtgaacattgcctgtggcaattacgggcttatcaagtcgccgtccaatttcgcatactttgcgtattgccgttttcagagcatcgggcccgcttaccagttgtttttctactaaatgcatatacatcgtcaaaggttgaatctccagcacatcataaaactgtgcaatttcctcggcctcttcctcggacttgtttaacacagcctcaaagaactctcccttttcgcaaccagaaataataagcaatccgtctctcatttctgacaatttggatttaggaatacaaggcacacgcttgaaatattcggtatgagacatcgaaaccagcttgtacagattttttttaccaatcggattgagggcataaatacagcagtgaaaaggacgaacggtcgataaatccttacccacataatcattcagacgatcgagcatttttaaacccttaatttgttccgcatcattcagcaagccattcagcacttccgtcagtgcgactgtatcgtcaatggctcggtgatgactttctagcgccactttatatttggtcgtcagcgtattcagacggtggtttttcattgttggaaacagtaaacgagccagttctagcgtatccagtaccggattggtcatttcaggcaaacccatatttcgaagggtcgcctggataaagccgacatcaaatcgcgcattatgggcaaccaatacagcatcgccagcaaaagctacaaactccttcataacaggttctacatccggcgcgtccttgaccatttcatcgttaatgttggtcagttgctggatattgtatggtatgcgctcatgcggattaacaaaggtagcataacgatcaacttctttgccatcatgcatttttacagccgcaatctcaatgattttattctgtgtaaccgataaaccggtggtttcaatatcaaaaacgacataagtcgctgttttcaaatttaatggttgtgcctgcattacaacctcaacggcatcattaaccacgttggcctcaataccatagatcattttaattccgtttttctttgctgcttttgctgcatcgggatagcattgcacaccaccgtgatcggtgaccgcaatcgccttgtgcccccatttggcggctgttttgacgtattggtcaatagaggcgacagcatccattgcgctcatctttgtgtggagatggaactcaacccgtttttcctctgcattatccttacgtgtgggtggagcctgtacttcaactagatcagaaggaatcataaccagctcgggaatttgcataaaacgatcatattcaactcgcccccgcactttgacccatttcccgttagccaacaaactgaggatctttagatcttctttagttttagcaaacattttcatttgcagggaatcactaaagtcggtcaaataatacgtaaacaacgtactgccattgcgcaattctttactatccaaaccgaagattgttccttgtaaggtgacttttttctcttcgtcctgaatatcttgcatcggaacagccggttctttgatgtcataaccaaattgaagccgtacgtctccttcttcttcatccaaaggcggcatttcggattccatactttccatcatctgctgaataacttcgcgttcttcctgcatcttcttttcttggaattgctgtaatgcctcctggttactttcacccacttggactttaatgcgcatagagagtccaaaatatttatcgtaaaatttgatgatagcttgatctatctgttttttacgcgccagttccaatgacatactgtcgctcatcgtcagcaataatagaccgtcttcccactcatgcacagcccgattcatccaaccgttaacagatgggatctcacgatgcacccactctagaaaaagtttccagtattcactgatgatatcaccaggctgaatctgctcactatactgaaaacggaacgtaatttttgcgatgtgactcattttttcctgtacttgaatacagaacgtacgatacacctgagcggggaccagtgtctccttggcaatggtgatattccaatccttattggtacggctaatctccacttgatcaatccaaccgtccaaaaaataaggttcaaccactccagccggcatcccaacttgcttcatcagcagttccagccgctttcttttttcttcagctccgcccatggctctccccccaattttaaatctaccattctgaaaacatgaaaagcttctgcgtcaaaaacatctccgaccgcaaaagcttttcgtagccctcttcaatccttctcacaacgacatagatccttcggaacattgtcccgtaacagctaccatgtcagcaaaaagaatgaagtgagtatagtgatattgccctacatctatattagtacgcccgtgcaaacactactgtatgcttggcaggtttgccacaacacaaacatgtggacttttgctcggttgttttaaacggtatgttacggcttgtagcacctgttacttctttaactttgtcttcacattcttcagctccgcaccagcctgccaaagtaaagccgcgtttttcttccatgagagtcttcatttcatccagcgtatcgacggaatagaagttttcttccatgaaatttttcgcacgatcaaacatctcctgctgtacctgtgcgagcatcgcgtgtacttcctcaaccaggttatcctgctgcacgatttttttctcaccgctgatgcgggacacgagcacacagacaccgttttccatatcacgaggtccgatttccagacgaaccggcacaccgcgcatttcatattcattaaatttccaacctggacttacatcgctgcggtcgtccattttaacacgcactcccgcttgtttcaactcagcaaatagttcatctgcacgagcgataacggcatcacgcttcttaggtggtccaattggaaccataataacctgcgtaggcgcaactttaggaggcaatgccagaccacggtcatctccatgtaccataatcagtgcaccgatcaaacgtgtacttgttccccatgaagtcgtatgcgcgaattccaagttgttttcacgactcaaatatttaatgtcaaatgcaacggcaaaattagttcccatatagtgggaggtcccagcttgtaccgcccgtccatccttcatcatcgcttccagtgaaaatgtatccttcgcacctgcaaacttttcagaaggtgttttctgtccagtaataaccggaatagccagaacttcctcaataacctcacggtatacttccagcattttcatcgtttcttcgcgtgcttcttcttctgtttcatgggcggtgtgaccttcttgccacaaaaattcacttgtgcgcaagaaaggcagcgtgcgtttttcccaacgcactacgttagcccattggttaataagcacaggcagatcacgataggattgaatccatttggagtacatatgaccaatcatggtttccgaagtcggacgaattgcaagacgctcttccagcttttccccaccagcctcggttacccaaggcagttcaggattaaacccttcgacatgctctttttccttttgaaaaaagctttctggaatgaacattggaaaataggcattacggtggcctgtttctctgaagcgcacgtccatggcttccttgatatgctcccagatttcaaaaccatcggggcggaatacaatacatccgcgaacaggggaataatccatcagttctgcttttttaataacatcaatataccatcgggaaaaatcttcgctttgtggcgtaatttcctcgacaaattgtttatcgttcgacatagaaatgcatgtcctcccatacagaccgtttttgtataagcccgtctctaattaaccattaattaagcgcaaaatatcgttatacgtgaccgcaatcataagcaggaatagcatagcaaaaccaacgaaatggaccattccttccctgctcggatcaacaggacgtcctcttaccgcctctacaccgaggaaaacaagtctgcttccatccagcgccggaataggcaataaattaaatatccccagataaagactcattatagcagtccaatacgtcaactgctcaatcccctgcttggcaatttgccccgtcacttcaaaagtacgtaccggtcctcccaggtcattgatagaaaaacgttgaataagctggctaaatccttggaaaataatatcggtcgttctgaccatggattgcccggcaaatttgaacgtttcacccacacctgcttggcgttttggaagttcaggcacaatgcccaccttgccacccttttgtccttccattgcacgaggtgtaatagtaagatcaaaggtcttattatcacgacgaaccgtccacttcattggcttgtcttgagaatccgcaatcagtttgatcatgttttcaacattcgcaccaatggctattccattcaccgattcgatgatatctcccttatgcaaatcagcttcagcagcaggcatacctgctgtaatttcactaatttggacataagtcgggttgtccacttgtatgccgaccatctgaatatgcagaccaaacaaaataaaggcaagaataaaattcatcagtggtccagcaaaaatagccatcgcacgctgtcctactgttttactcccatactgccgatccttgggtgcaatctgaatggattgacctttggttaccatcatcgcttgcgggtgtacagtgtattgctgatcttcgccatctacatccaattttaaagttaacgactgttccagatcaatatccaacacttcgccacgcaccacattcttgcgattatccagttgatccagatagatggttttaacgacgtcatccgttacgcgtacagcaatcgtttgtccggtctcaatttcattgacctccggatcctctcccgccatgcgggcaaagccaccgaacggcaacaaacgcaacgtaaatcgcgtctcgtttcttttataagaaaacagtttcggaccgaaaccgatcgcaaactcccgtaccagaatcccggcgcgcttggcaaaataataatgcccccattcatgcactgtcactatgacgaaaaacatgagcaccgtcatcaacactatttgaatcgtttccaatcgtttccgttcccctttcaatgagatcgagtttgtcttcctagattatcattattctccgatcccgcacaagagaatcacatttcgtttctaacccaacattagcctacaattctgcagctatgctacgagtctctccgtcacatgcttcaatcgcagacagatcaggattagccacattgacatgccgctccagcacacgttcaataatagcttcaatatgcagaaaagaaatttcttcacgcaggaaacgggcaacagcaatctcattagctgcattaaatgcggtcggtgctgtaccacccattttaccacattcgaaggcaagccttaaacaaggaaaacgattataatccatttccttaaaatggagtctgcccactttagccagtgacaacggcttcgccggggacttcatacgctcaggataagtcaatgcatattgaatgggtactctcatgtccggattcccaagttgagcaacaatgcttgtatcctgaaactcaacataggaatgaataatgctttccggatgaagcaacacatgaatctgctcataatcaagtccgaatagccaatgcgcctcaatgacttccagccccttgtttaccatcgttgctgaatcaattgtaattttagcccccattgaccaattgggatgcttgagtgcatcttccactgtaacttcacgcaactgttctcttgtcaaatctcgaaaagaaccccctgatgctgtgagagtaatatgtgccacatctttcatacgctcaccattcaagcattggaaaatagctgaatgctcactgtcaatcggcagcaacggcactcctttcgcccgagcccgcgctgtgaccagatgaccagcagtaaccagtgtttccttattggccaaaccgatctgttttccagcctcaattgcggccagcgtggagtgcaatccgacactgcccattacagccgtcacaaccatatccgcctctgtgttcgcagcaagctcaacgagtccttcatttccccaatgcagttccattccagaaggcagtaaaggacgaatttcatccgccaactgccgagtacccacagacacttttttgggtttataaagatgcgcctgctcagcaagtaactttatattagaaccacctgctaaagcctcaacagtaaactgatccgggtgcatggacactacatccagcgtttgagttccaatagatccagttgaaccaagtaccgtaattcttttcatgatgcaccttcctatcctgaaaatcacttttatccaggagctcattgattattattcaggcagcaatgctactggatccaaccttctagtagcgcagagtgagcagcatagagattagcctgagcataaactgtaatcaatagactcatggaagcagcatcagcatatgtacaaatggaaaaacgacaatccagctgtcgcagcggtctagtataccaccgtgccctggcagcagattaccggaatctttaatgccgtacactcgtttgtatgcagattgtaccaaatcgcccagttgtcccacaactgcacatgacaaaccgatgccgatggctttgccccatggcagcagtccacccgataatccagcgaatataagagctataaccaacgctaaaacaatgccgccaatggatccttcgaccgttttgttcggactgatcgcaggccataatttcgtctttcctgccattttgcctacaaaatatgcccctgcatcacttccccaaatacaagccaataataaaaatgtccataacagtccatgttccatatgacgtgattccgcaatatacgaaaatccaaaccctatataaacggtaccaagaaataatatagctaccgtttgaatcgggattttattttttgttcctaccgtgatgatcataaaagctatcattaccagccaaagcatactggcaaagggtaagggtgagtgcaaagcaaaaggttcatacgggaatacaaaagctaatatgcttacgtatccaagtattgctgtacctccaaaaggagacacctgcgtcattcgtgcgaactcataaaatccgattagggccatcgccaatataagcaaatggtaggccaagccgccccacaggaccatcgccaaaaagaatatgcctgccagaataccggtaattaatctctgtctcaacggctttcatcctccatttacttcagtccgccataccgccgtgttctttgctgatattcgatcactgcttcgtataagtgttctttcttaaactcaggccaataaatatcagtaaaccacaactcactgtaggcaagctgccagagcataaaattactaagtctaagctcaccgcttgttcgaatcagtaaatcagggtctggcataccactagaaagcaacgtattaccgatcagctcagatgttatatcttctgttttaagcttcccatccgcaatttgacggcccaatgtttgcatgcattctgtgatttccaaccgacttccataatttaatgcaaaattaagaacaagtccggtattattttcagttcgtcgagtcgcttcagtcagcgcctcaacggtatgggaaggtaaatgttccttattgcccatcatacgcacttgcacatttttttcaatcagctcatctagctcaatagccagaaattcctgcggtaagcgcattagaaaatcaacttcgtcctttggacgcgtccaattttcagttgaaaatgcaaacaaagtcaaatacttaatacccagttcatccgctgcaattgctgtgcgtttcactgccttcattccattttggtgccctacaatccgcggcattccaatccgtttggcccatctgccgttcccatccatgatgacagcaacatgctgcggaatattgtcttttgaaatggccggtgtttgctgtttttgttccccgttccaccaagaccgaacccgtttgatcattccagttcctccagcattctctgaaaatgtgcctcaggcttgaaaagagacaaaccccaccgtaagggaggggctgccaatcttttaaacttccataatttctttttcttttgcagctaaaactttatccacttcagcgataaacttatcagttgttttctggatatcttcttgatgtttacgagattcgtcctcggaaatatcacttttctccatttttttgatgtcatcattggcatcacgacgaatgttacgaatagcgatcttagcttcttcaccgttcttcttcgtcaacttcaccaagtcagttctgcgttcctccgtcaaagcaggaatgctcagacgaatggtgttaccatcattcgaaggtgtcaaacctaaatcggatttttgtatagcgcgctcgatatcggccaaggaagatttgtcccaaggctgaatcatcaaggtccggctgtcaggtgtattgatattcgcgagctggttgactggagtcattgcaccatagtactctacctgtacacggtccagtaaagctggtgtcgcccgtcctgcacgcaaagatgcaagatcacgttgcaatgcttggattgctttttgcatgcgttcctcagcactctttttcacagattgtggcattaatttacactccctttgacgatcgtaccaattttctcacccagcacgacacgtttaatgttaccttgctctgtaatagcaaagacaatcaacggaatattgttatccatgcacaacgaggaagcggtagaatccatgacaccgagatttttgttgagcacatccaaatacgtaagctgctcatatttctcggctgtgctatctttaaacggatcagcagaatatacgccatccactttatttttagccatcagaattacttccgcttcaatttcagcagcacgtagtgcagcagtagtatcagtcgagaagaacggattacctgtacctgctgcaaaaataacaacccgacctttttccaaatgacggatagctctacggcggatataaggttcagcaatctgttgcatcgcaatcgaagtttgtacacgagtaggtacttcaatctgttccaaagcatcctgtaaggccagtgagttcatcactgttgccagcatacccatgtaatctgccgtggcccggtcaattccgttggcacttccagcaataccacgccagatattaccgccaccacacacgatagcaacttctactcccagttccaccacgtctttgacttgttcggcaatggacgcaatcgtatccgcatcaataccgtaaccgttaggacctgacagcgattcaccactaactttcaggacaacacgcttaaacacaggtttttccaaatgatcaccctccaatatcatttatactttatgtaacaggataggtgtcctgttgcaagaaaaggaacactgatgtgttccatttccgttttttccatatgcaattaccgttcgttggtaattattgtttcacttgagacataacttcttcgtagaagttgtcttcttttttctccagaccttcacccagttcaaaacgaacaaagcgacgcagggagatgttttcgccaattgtactgattttttcgttgataagcgtggagattgttttgtctggatccttgatgaaagattgctccaacaagcagaactcctcatagaacttaccaatgcggccttcgaccattttttcaacgattttctctggtttaccttcgttcagagcttgtgctttcaggatttctttttctttttcgatctcttcctgtggcacttcttcacggcgaacataacgagggttcgatgcagcgatatgcattgcaatgtcgcgtacaaaatctctgaactggtctgttttagctacgaagtctgtttcgcagtttacttctaccagtacgccgatacggccgccagcatggatgtaggattcaacaacaccttcagtagcaatacgacctgctttgttggctgcagctgcaagtcctttttcgcgcagaacttcaaccgcttttgtcaaatcaccgtttgcttcttcaagcgcttttttacaatccagcattcctgcgcctgttttttcacgaagctcttttactgcgctagcattaactgccatattatttccctccaaatttgattttcagtggtataccgtgctttattccttaaaaaaagggtagtgagaggttatacacctgccaaccacccttttcatttaattcatataggtatttcctaatggaaatattatgctgtagtttcttcgccttggtttgcttccataactgcatcagccattttacctgtcagcaatttaacagcgcggattgcgtcgtcattacctgggataacatagtcgatttcgtctggatcgcagtttgtatcaacgatacctacgattgggatacccaatttgcgagcttcagcaaccgcgatacgttctttgcgtggatcaatgatgaacagagcactcggaaggcccttcatgtttttgataccgcccaagaatttttcaagacgatctttttctttgcgaagaatgataacttcttttttaggaagaactgcgaatgtaccgtcttcttcccaagcttccagttgtttcaaacggtcaatacgtttttgaatcgtttggaagttagtcagcgtaccacccaaccaacgttggttaatgtagaattgaccagcgcgtgctgcttcttctttaacggaatcttgtgcttgtttcttcgtgcctacgaacagaattgtaccattctcagctgcaatgctttttacgaagttgtaagcttcctcaacctttttcactgtcttttgcaagtcaatgatgtaaataccgtttctttcagtgaagatataacgatccattttcgggttccagcgacgtgtttggtgaccaaagtgaaccccagcttccaaaagctgtttcatggagattactgccatcttcacgcacctcctaagtttggttttttgtgtgtcctccgccgacatcatttttcataaagactttccattggaaagcaccctctataaaattaaccgacgtgcgtttttaacaccgtcaattaatataccataacacttgcatcgttgcaaccaacttttcgacaatagttggaacaacgcaaaatgtgacgttttacgcctcttatcgaacttgtcagcatgaataaaagccgtccacttcccggtctggtcagttggacggctttttcgtaattttagtaataatagaactgaaatcctcacctttagcaaactgataggtacccgtacgaattttggtattgattttttgggccttagctgctgcctcaaatgcactagcatccgacacaacccctgcccgttgcaatcctgatgccacacttctcaaattgcttcccgatgcaacgctatactgcacttgtggggtggcaggctgcttggggatgttgggagtcgttgtagtgccagacctttgagtttgcggcttattcggactttgtggaaccgatgcgctggtcgaaggtttagaagccgccgaggatgtgctatttgcaggtacctttggtgttgacggcgtttgagctggtttagccttttcgggtgcagccggagttttgttgccttccttgatcaccttattacgccattcctcttctgtcattttcggatcagaactgtcactgatctgaagatttaattcggctgctgccttttctagttgctctcgcgtcatgtttttcgggtctgtggaagattgctgtgattgtccctgaccgatcattgccagttgcaacagcaatgcccccgttataaggcccgtacccatgcctagcataaatgaacggtttttgatcacgttacatcctcccgcttcgcgagttgcaatatgagctgtacttccccccgctggatgcctgattgcttggctatataatccaacgacttgccttgctcatgcagcgcaaacaactctttataacgatcacggatggactctacttcctgctcagtttcagcgtcttgcaatactgtctgctcctccatagttacgagaggagcttctgaatcaggatagccttcctgtacagacactccgggttgcggactttgaaattgaccgtaagcaaccgctgcctgatgagaagttactgtatgttgtatttccttagatacaggctcggtttgcatagaaacagtagcaaacatagcctggcgctcaagctccacgatacggttccgaagctcagctacttgttcctgtaatgccgcctgtttaactgtatgctcctgcttcataccagatacgagctcaatcagctcgtcattgtcgttttcaatatcggccatatactgctccaatgtggcctcgaccttttgaacgacggcctcttctgttccccggcctggctgacgcttaggcagaagccaggcgtagacaacagctgcagcgcccagcagaacaatataaatccatggttgatccactgcccatcgtctcctttaataacgcttctccacctgtcggatcagagcgaaaaatcaatatggtgtcccttgtacggatgctctgccggatgctccttaggcacctcagtctcatctgattgggaacagctctgctgggaagaatctctgctctgtcctcccgtttgccgctcaccgacgaatgtttctgcagactgatctatggcactgcttcgctgacgcatgttctctgtctccagcgcggccttttgtccaagcaatgcttgatcattcatcggccgctgctgggactcactttggtattttcctgcttcactggtgcgaggtacggcaatttgcaattcaacagccttcaagctcattggaccacaccctttccgattgggcatccgtatctgtctttcaaggaatacaaatgttgaatgattaacagtgtgctgaattacacgtaggaggacatgctgatgtctccctcatgataataaaacgctattctttccactgaatctttaataaattttgtatatctgccgataactattttagagccaccgtaaatcacatttttcacttctacccgtgcccggctcgtatcctctaatgttcgttcaatttcaagcattctggacttggtttccaaaagctcctgttcattagattttttagtagatgtcagcttgattcgcatagccattctttcaggtgcaagctgtccggcggcggcaagttgatccaatatggtaagggccttattcgttttatcctggctgtctgtctgctgcttcaaacgtgcgcggagttctgttagttcatcgcgcagttcaggaagcacacccacttcgataacagtagctgtggacattgtattaccgatggtacgagctactacctttttaccagcttgtacactgccacctacgataagccctttggtcccctggcagagtacatttacactcgctttaatctgggaatgcatgatgctctgggatacaagtatatcgcctcccgcaatcacgttaccatcttgtatgaatgagcatttgacattttgtgcagccttcacgaaccccttatggtatccgataatgccgccactgatttccactgaaccttccgcctcaatttcagcgccttccacaccaccgatgacacgaatgtcgccagccgcccgaacgcgaaaccctgtcaagacattcccacgaatgacgacggttccaacaaaatcaatattaccgacactataatcgacgtccccgttcacttcatatacggggaacacattaagtttgcccttttcagtcgtagtcaccagtccgtcaatagccgcatacatggcaacaccttccggatggatcactacattttttccaactttaaaacgcgcctctctacctggaagaaaaggaatttcctctccggttacagcaatccccggtacacccggcagaggatcaactcgttcggcaatcaattgtccacgttttacatttcttaaacgagttagttctttataatccacccgtccatctacggtttcaagtggcttatgtgcatcttcgccagtcacaatatcagccagattaatttttccgtctttgccatggaccggctgctttccctgagcaatcagtaattttccgaagaaatgatcttccggatttgccgcaaatacacgaatcgcatcggtcattaaaccgtaggatattttttggttgcttagaaaacgctctaattcttccacagaacaggcaaaaccttcttcacgtttggcaaactccaagtaggctgtttgtttgtcaggtgagacaaccacttttaaatactggtccaaagcatattgcttctccacaagggtgctccttccgtctaactgttactgtaacctcccgtacgttaatctttacgcattagcaaatcccgttgtttgtccaatgtcgctcttagacgtaatattgctttggaatgcaactgtgaaattcgcgatggagatagcgacatgacctcagcgatttcgctgagtgacaaatcctcgtaatacaataaagaaacaacgatacgttctttttcagtcaatttatcaatgccttgtgcaagggcatcacgaagtgtaaattcattgaccttatgatccggatttttcgccttctcgtccaccaaaagggaaagccgtgtttccgattcctcttcacggatggggtcctccagtgagacaatcgacataacagcgacttcctggatcatactttgaaactctttttcagaaacgtccaaataatggctcatctcttcgtcgcttaccgtgcgtaaatatctttgttccaaatgctggtaggcatcctcgattttttttgctttttccctaactgaacgaggaacccaatccccttgacgaagaccatccaaaatcgctccgcgaacacgccaagaagcataagtctcaaactgcaaaccacgctcatagtcaaatttctctaaagcgtcaatcaaacccataacgccgttactcgccagatcatccttggatacatttttgggcaagcctactgcaaggcggcccgacacatattccacaatatggagatacttttcaattaactgtttctttgcttccttgtcaccgtgttctttccattgctcccatagttcggaatggtttaaatgagcggctttacgctcgttcatcggcttcaccctccttatttgtctgtcaggtgacgaacggccttggccaattcttcagggtccttgttggaaaccagcttaggtgggtttaaaggcgcgaaacccttgttcccttcgtccgtctgctctggtttcggtttcagcaattcattcaggttttcattctcgtctggtgtcgtcaggtccagattcccccctacgccatctacctgagagcttgcccggctttgggcattccccagatctggccgcgctacaacacctagtgtccagcgcagcacaaatgcaagtaggaaccaaaaaacgaaggcgatcaagccacgaattaagctcgtggtcagcagattgctgccaacggacaacacaaaagtcagaataaatccgactactccagaccaaagattaatgcgtaagctgccaaataacatgtttataattcctttacacctttttgtacgcttcgaatattcaaaacgccagtttcagagtccaactcaatcgttcgtccataattgccgcctgtgtcctccgcaatcaagggaataccgagatctacgagcatttctttgcatgattctacattgcgtggaccaatgcgcatggtatctccactaccggcaaaggcgaacatctgcgctccccctgccattttggcaatcagtctgcgtcgttcagcacccaatttcagcatccgctcaaataactcgggcagcgccgtatcggcgtatttagcaatattcagttgcccttcacgtgcaatatccgaggatggtagcatcacatgtgccatacctgccagtttcaagtgaggatcgtagagagtcaatccgacgcaagaaccaagtcctgtcgtgcgaatcgagttcgggttactggtaacatttaagtcagccataccgactttaatgatgcttttatcctcaatcatcgttcatcgggactcctaacgacctaaagattttcccgaacgattctggatcaggaatcaggaaaaattgaccctctatctgattctgcccttcgagaaacgatgtgtcaatcaataatgcagcatctcccatctgcccaaactgcaacagtccatagctgagaattgctcctgccatgtccaacgccagcgcagggactgttggatacatagataaacgcgtaaagtctgccagcgaagacaagtatgagcctgctaaaatgtttccgatctccgacagggctgagtgctccatttcgttaaaactgtcctcgtcatctgaaggaatattcgccaaacgggaaagtaagccttttgccgcctgaggctgcaatatgaagaatagattcccgggggcttccccttctaccctaaaaaatatggcgacaacaagttgctcatagccgccgactttctcggcaatttcctcaaagggcagcatttgtactttgggcacacccatatcgaccggtttattgagaagccgggagagcgctgtagcagcgttccccgagccaatgttgccgacttctttcaacacatccaacttgaagtcttcaagatttccaagattttccatatgttaatcctctaagccttccagttggttcatctcgctacgattcaggacttcggacaagttcagcataatcaacaagcgctcttcaccaatcttagcaactccgcgaaggtatttagccttaactccaccaatcacttccggtggtgtctcgatattgtcagaattcaggtcaataacatcattcgctgagtcaacaataaagccgacttgcatttcacccactgcaacgataatgatgcgagtttgatcggtatattcagcttcaggtaatccaaaccggccacgaagatcaataaccggaatgactacgcctctcatgttgaatacgcctttaacaaaatcgtaggttcttggaacccgtgtaatcggcaccatgcgttcaatagattggactttttctacttcaacaccgtattcctcttcaccaagcttaaatacgataactttaatttcttctcccatgtctaaaaaccctccttattgatgtcagcaacttcacatttctttcatttttgatgaagacattatttaatgaaaacattcgggtcgatgatcaaagcaacctgaccgtcacccagaatcgtggcgcctgaaattccttggatgtttggaaggtatttgcccagatttttaaggacaatttcactttgtcccaaaaagtcctgtacggaaagagctgccagacggtctcccttgcggatgaccacgacctctgtctcttcttcttcatcttcattgaagtccggtacctcgaacagctgactcaaggagatgagcgggatatgagaatcgcggaaagcaatcattttattgccatgtactgaacgaatttgtgttcgcttgacgatcgcagtctccacaatggaggacaatggaatcgcatatttttcagaaccgatctgtatcatcatggctgcaataatggatagggtcagcggcaattgcacagagaaattagtgccttggcccagtgtagagtgaaccgtaacattaccacccaaagcggtgattttggatttaacaacgtccaaaccgacaccacgtcctgatacgtctgaaatgactgcagctgtactgaagcccggagcaaacaatacctgataggcttcctcgtcggtcatgaccgctgcttgctctgccgtcaaaatccctttagaaatagcactgtttagtaccttatcgcgattaataccatttccgtcatcttcaatctcgatgaatacgttatttccgctatggaaagcacgcaagtgaaccgttcctgtctcaggtttaccagctgcaatccggtcggctaccgactcaatgccatgatccacggagttccgaagcaaatgcaccagaggatcgccaatttcgtcgataacagtgcggtccatttcagtctctgctccagtaataaccaaatcaagttttttatccagcgatttggccagatcgcgcaccatacgcgggaaacgattgaaaacagtatctactggtaccatccgcaatttaagaacgacgttttgcaaatcgctgctcacacgactcatgtgctctaccgtttctgtcagtgctggattggaagcttcacttgccaactgctctaaccgcacacggtcaatgagcaactcgctaaataagttcataagtacatccaggcgttcaatatctacgcgaatcgtacggttatgcgtaggcgcagctgccttagctgctggtgctttacctgctgctggcttagccacagaggccgcagctggagactgcggctgggatggagcaggtggttgcacggcaacaggtgcttcctgcaccgcagcagcctcagccagtccagcagtaacttcgctcatttgtttaagcgattcctgatctagttgtaccactgagacagtgtcaatttcagagatacccgcgatttccctttccagctccccaacttctttctgcgttatgtaatataacgagaagctttgctcgaatttctcctgctcaatatcctgtaccgacggataggccttgacgatttcacctgagttttccagcgtgttgaacaccataaaggcacgtgccgctttcaactggctctctgagctgattgttacctgtatatagtgaacacgatgtccttcagaaatagattgctccagtacagaatactggaactgatccaagacaagcccagcactatcgtttttgtccacttttttagatggagactcctcagtggcagcatttgtgccggacttttggaaatccccactcacgatggattgtagtgaagatacaatagaggagacatccgcttttccgtcgcctccctctgtaatgtgctgcaccatggactccaaagcatccaatcctttaaataaggtatcgaatataaattcatgcatcgccagcttgttgttacgtaccagatcaagaacgttttccatttggtgagttagcgatgctaggtcttcaaatcccatcgtagcagccattcctttgagggtatgggcagaacggaaaatcacctgaacgatgcctagatcggttggattgctttccagttgaagcattttttcgttaagagattgcagatgatcattcgactcatcaataaacatgtttaaatattggttcatgtccattgtgagacacctcctccatgagttacactccgattatttcacaacttgtacaagcttgggggcgatctcctgcattggcagaaggtgacgcacacattttaactctactgctgagcggggcattccgtacactacacaagtttcctcattttcagcaaatgtggattgtaccccagtatcataaagctttttcatcattttggccccatcgctccccattccagtgagcaatactagatgccgctccaacgaggttaacgagagcaacgattcaaacatcgtatctacggaaggacggtgaccattgcgagcttcctccatcttcagtgacacagtgtatttaccaccggctcctggcacaattcttagttgatatccccctggggcaatgtaggccgttccagtctccagcgtcattccctgctcagcctccacaactcggagtggacttaacgtgttcaagcgttgtgccagcgaacgagtgaagtttggcggcatatgctgaacgataacgattggagcaggaaaatcaccaggaatgcgttccaacagcgtcttaagcgcccgcggaccgcccgtagaacatcccaccgccaccagtttgcgaaagctggacgtatgcacaccttttttaagagaaaatcctttaggtgcggcaggaactgtaggtgccgttactggaggcgtagcagccgctggaataggagtagctgatgaactcaccgtcttacggggctccggcttaaccagccctgctttatccttaccatacagcgatttgtcagcggccgtattagaactgtttagtttccctggtgttcgtcccatccccttggacaggtcttccttcttctgaacagtaggtgcttggactgacttgcttggctgagcagctggctgttctatgcgccccgccgtaacagatgttccagactgttgtcgtttcgtttcctgcttggctgctgccgggacggacttgccagcatcacgcttcggctgagttgatacagcaggtgaaggagcaagcggaacaaccggaggcttgtctgtcgaagcttgactgcctgctcctcgtttctcagtcaccgcctgtctagtcttttcctgtggcgtttttttcgcttgttccaatgcagctttgcgctcattagcttccttgcgctccaggcggctccgcactgcttgcatagcagtgtgcatctgttccagcaacgccttgctcacttgctcgatatcttgcgcatgagcaatggaaggctttcttataaaatcgaaagctcctgcctccagagccatgatggtctccttcatgccttgttcattaatgcctgacagcataataacaggtagcggatgggctgccataatcaatggcaatgcttcaagaccattcatttcaggcatctcgacatccatggtgaccaaatcgggctgcaattccttcactttctctacagcctctttgccattggcggctgtacctacgatgttgaacgactcatcccttacaattaaatctgtaataattttgcgcataaaggccgaatcatctacaaccagcacccggtaagcacacatgttaaacacctctgtttcctctcatcaaaatcaatgtacagaacgtcgcaaccatttttgcataaaccctttaattccattcaatgcacctgattgcggaatctgtggcattgctgcaaaacggtgtgccagattcaatatatctcttgaagccgcacatcccggaaaagcaaccataaaaggtatttgccttttgactgcttgcatgacatgagtatcatcactgatatgcccaagcaacgggatttcgatctccaaaaaacgtctcgcaaccagtgcgatcttatcggcaacttgacgggcctcattatcgttatcggcacgattgactataattttgaataccgtattcttttgcaacccgctgacgactttaattagcgcatacgcatctgttaaggacgtcggttccggcgtggttacgaccaggcattcgtcagctgaagtgatgaatttaaggttttctttagataaacctgcacctgtatcaaatagaatgtaatccatatctgccgccattttttctacttcttcggcaaaataattcagatcgtcatccgataacgcaaacaattcgctcaagcccgatcctccagcaatataaggcaaaccacctatacccgtttgaataatttcatcaattgatttctctcgttttaacaggtgaagaagattgtattgtgaattggcccccattaatacatcaatattggccataccgatatcagcatcaaacacaagtacctttcgaccaagggattgcagagccagagcaaaattcagcgtaaaattggatttgcccaccccgcctttaccgctggtgatcgttataattttggcttgacgattacgtgggggcaatcgatatttatccaaggaagaagccatttgtctaagtgattgggcttggtcactcatatggaatctccgttagctcctgatgatgctttgggtccaagcagcatgcttgtcaccatttctgtatcgggatgaagcaggtcgtcaggaacattttgtccattggtaatataggccagttgcatcggaaattgatgcaaaagattaaacattccaccgcagctacctgtctcgtccatcttagtaaatacaaccttaccaagaccaaacttactgaaatgtccagttatattgagcatatctttgcttttggatgtcaggctgagtaccagatacgtctcactttcattaataggcgaaagcagactttgcagttccgaaacaagtaattcattacgataatttcgtcctgcggtatccatgaggatcaggtcacaatgttccagacgttgaatggctctgtggacgtcaccgggagactgcacaacttcaagcggtacattcaaaatcgtagcatatgtacgcagttgctcgacggctgaaatccggtacgtgtcagaagtaataaatccaactttgcgatgatgcttaaacaactgctctgctgctaacttggcaatggttgtcgttttccctactccggtaggacctgccacatacacaattttggtatctttggagatccctttgtccagtcttgtctgaataaaactggccacttcctcacgaaaggcttgttcccaatcaaaagtttcaggcgcaaaaggatgctcactccggcgcacatatacctgttcgagccaatattccagtaaatcgcgttctacttcctgctccagcacatgctcacaaatctcttgcagcggctccggccaagtactttccaatgaagaatttcgggaaaaccgagtcatcatagccttcatttcccgcaattcattaagcagagcctgatttccctctgctccgctcttctctggaacacttacttcaatgggctgtttaaacagttcactggatgatttcatgttcgaaagcaatgcttcatgatcaagtacttgagacatagtctccagattattagcaggcctagataacaaatgctcagttcctgaagctgcctgttctgcatcactcgttaattcagcttgttcttctttggaaccacccgtcatctgcgttacccgccgataagcttctggagcagcttgtctgggaaccacaggcataaatgacttttctggctgttcaggagcattcattgaagatgaagccgcctgggtaggctcttgtgaagatggtccaaaccgtcgtggcttttgaggttgcttctcctctaccgcagctaccacttcgattttctttttactgaacattcccatgaaaccgccgaccttcatttcctttgtacttaaaatgacggcgtctgttcctaagtcacccctgatttgcagcatagcttctggcatggtatccactacatatcgtttcactctcataagttcaccaccccgacactttgaatttcaacgttcggctccagctcactgtacgacagcaccgggacatcctgcatagtccgctccatcacttgccgcaaatacatccgaattgtcggcgacgttaacacaataggctgctgtccagattgaatgagacggttgatttgctccatcatcctttgatacaccgtttgcgtagacaccggatcaagagccaaatagctaccttgctccgactgttgcacgctttcagcaattttcttctccaatcctggtcccactgtaataacgcgtaacgtctccccttgttgggcaaattgctgcgtaatctgtcgggacaacgcctgacggacatattcagtcagcacgtcgggatcttttgtataagtaccgtagtcagctagcgtttcgaaaatagtcaccatatcgcgaatggagattttttctttcaacagcttggctaacactttttgtacatccccaatcgcaagcacagaaggaataagatcgtccaccagcactggataattctctttgagattgtcgaccagcgaccgtgtttcctgtctgccaagcaactcatgagcatgtttcttgatcgtctccgtaagatgagtagctacaactgaaggtggatcaactacggtataacccgatagttccgcaacatccttggtgttctcatcaatccagagcgcgggcaatccgaaggccggttctgtcgtttcaatccctgaaatagaatcgtcatcgtatcccggactcatagccaggtaatgatttaacagaagctccccgccgcccacggtattacctttaattttaatgacatattcgttaggcttgagctgaatgttatcccgaatacgaatgaccggcacaaccaaacccaactccaaagcacattgacgacggatcataataatccgatccaataaatccccgccctgctgtgtatccgccaacggaattaacccgtatccaaattcaaattcaattggatctacctgaagcagattaatgacactttctggactacggacttcttcaatttgttgctcctcttccagctgttcatcagctatctgcttgcgttccatattgccctgcattcttcgagccgcgaaaaacagcagaatcgccagtggaagagttgtaatgatatgaataggcgtgaagagacccaataatgcaattgtggcagccacaatgtagatcagttttggataagaaaagagctgtccagttaaatcctctgccaagttgccatccgatgtagcccgcgtaacaatcaagcctgacgccgtggatatgagcagtgcgggaatctggctgaccagtccgtcaccgatggtgagtacagaataagtcgacagcgcctcttgaaatcctttcccctgaacggccataccgataataaagccgccaaccaagttaatgatcaaaatgataatactagcaatggcatcacctttaacgaatttactcgcaccatccatcgctccgtaaaaatccgcttcccgttcgattttactgcgtcgttcacgggcttgctgctcattgatcaaacctgcattcagatcagcatcaatactcatttgtttacccggcatcgcatccaatgtaaaccgtgcgcctacctcagcaacccgctcagatcccttggtgataacaatgaactgtacgaccacgagaatgagaaagacaacaaaaccgacggcaatttgccctcctgcaatccaactaccaaacgtagcaactacttcccctgcatgtccctcacctaaaataagtttggttgtagagatattaagtgccaaacgaaacaacgttgtaatgagcagcaatgaagggaaaatagaaaactgtaaagcttccttcgtattcatagaaacgagtagaatcatcaaagcaatagaaatattaatgacgagtaggatatccagcagccatgatgggatcgggagaatcatcataagaacgataccgatgacgcctgcaaggacagttatttcttttattttcacgggtctctagccctccgatccctttatttcactttaccttttaatttatatacatacgccagcacttcggcaacggcctggaacagatcagctggtatcgcatctccgatttcggctctttgaaacagcgcccgcgccagcggcttgttttccatcgttattacgccgttttgcttggcaatttctttaattcggagcgcaacgtaatcttgccctttcgcaataatctgcggcgcttccatctccgaaccgtcatatttcaaagccacagcaaagtgcgtagggttggtgatgatgacatctgcattaggaacctcctgcatcatacgctgcatagccatacggcgctgacgctcgcgaattttccctttgatcagcgggtcaccctccattttcttgtattcatccttgatgtcctgtttggacattctcaggtttttctcatgctcataacgttgatacatataatccaacaccgctaaaacgaacagcaccacaccaattttgagtcccagttccattgttaatgaagctgtaaagctcaacatctgatcaccggacatttcagccagtttaggtaggtcagcttttgttttccagagtacgctgtacaccagataaccaattacggtcatttttaaaacagatttcaggaattcaactaatgatctcatggaaaaaatgtttttgaatcctttaatcgggtcaagcttgctaaacttgggcgtaatcccctctccaactaataaaaaaccgatctgcatgtaattcgctgctatcccgatgacaatagccccaataaaaataggcgcaagcataatcaagatttgcacgccgtactcacccatcatcagcagcgttgtgttcggcgttacctccatagagagccgattcacaaaaatatctcgaaatagtcgaactgcatggtccttaaaatacccgccgaaaatcatgaggcaaaaaaacgtaaccagcaggacaccagcggcgggcaactccatgcttttggcaacctgccctttttgtcttgcatcctgtttctttttgggtgtagctttttccgttttttcccctgagaacaactgcaggttcatagcatatttaaatgacaaactacgttcctccagaccagacattaaggacgattacccataatatccaacaaattgcgcatggattcgaacatcaccgaaaacaatttctcgaatataaaagcaaaacttggcatgagaagcagtaacatgaacagtcccacaaaaattttaagcggtacaccaatgacaaaaatattaaactggggagccgttttagcaagaaatccgagtcccacatccgttaaaaaggtagccactacaatgggagcagcaatttgaaaggcaagcataaatgattccgcaaaagaacgtaccaggaattcagttacactgccaccatacagctttacaaaaaaatcatttgtcagcggtacccaatcatagctgtataagatagcatttagcagatgatgatgcccgtttatgctcaaaaaaagcaatacagctatagcaaacttgaaattccctgttaaaggcgatgaagctcctgtcattgggtcaagcacattagccatcccgaagcccacctgaagatctataaatgaacctgcggtttggatcgctgtcataaacagatatgcggtaaagcccaacaacaacccaatcagcacctcacgagcaactaacaagacatacgccgcatctgccggtacctgttgatgtgtaccgtaggttagatacacgaccaaagctagaaatcctgaaattccaactttaaagatattaggtaccccgcgggttgaaaaaataggcgctactacaaaaaatgaggtaatccgacaaaaaatcaacaaaaaaacagggaaactctgtaacaatatgttcataacattcagcctaacctatatatttgtacaaattgtccagaatgttatacgtaaagtccactaatgtggtcaatatccagggcccgaacaaaagcaatgccagcaatacggcgacaatcttcggaacaaaggctagtgtctgctcctgaatttgggttgtcgcctgaaaaatactgataatcaaacccacgactagccccaaaatcagcatcggagcgctcaccttgagtacaatgtacaccgcttgcccagccagggaaataataaactccgaagtcattgccgtcctccttgattgctgtccttgcatgaagtattcatgtgttaaaactcagaagcaatgatttgactaccaaataccaaccatctacaagtacgaagagcagtattttaaaaggaagtgaaatcattaccggtggtagcatcatcatccccatagccatgagtgtactcgctactacaatgtcaataactaaaaatggtatgaaaatcataaagcccatctgaaatgccgttttcaattcactgattgcataagccggaaccatcaccgttagtggaatatcctgataattctttggtttttccatcttggtgtatttcataaagagtagtagatccttctcacgtgtatgagaaaacataaaggtcttgatcggtaccgatgccttatccagcgcctgagactgagttatatcccccttgagatacggctgaagtgcagtttcattcatagctgagaacgtcggtgccataatgaataaagtgagaaacaaagccagtccgacaagcacctgattaggcggcatctgctgggttcccagcgaagttcgcacaaagccaagcacaatcacaattcgcgtaaaacttgtcataagtacaagcaacgcgggcgctacactaatgacagtaataagtaaaataatagacagcgaggtggcaccgggctgtcctttgtccgaattgccgacttgaatatcaatgttcggaatcggttccgcagaggccgccgtcaccgaaatgaagctgaacaagacaagcagcaaacatgcaagtataatcttttttctcatgaatctcccgaccgatctgtagtattctcctcattgcgcagcttttcaagtttatccttgcgattcggcatttgccgaagcttggattcaaacatctcgtgaaaagatgtctcctcttcaggctgctgctgtgccgcgttgttccggcgaagcttatccgcaattttagcgaatagcggggcaatcgggccgcgctgcagagaagcttcttgctccagtgcggccaaaatttgctccacttcttcaggatcggatactttgtcaacaagccggatatcttctcccacaccaatgaggtacacactgctaccaacttcaacaagctgaagggatttattgggaccaagtcccacgcctcccagtatgcgaacggagcggttgctgaaccagctctgatttcttttactcaaaaaccgtatcaagtacacgatcagtacgatgataaagattagcacgaaaaggacccaggcaatgttgcctatattgctggatgtactcaatgcgtcagaggcaccctgttgtgtatccatactgggtgcgccttacacacccagtgttttgttgatggcttcgataacccgatccgattggaaaggcttaacgataaaatcttttgcgccagcttgaatggcatcaataaccattgcttgctgacccatcgcggaacacatgataacctttgcgttcgcgtcaatttgtttgatttccttcagagcggcaatgccgtccatttcaggcatcgtgatatccatcgtaatcaggtccggacgaagctccttgaatttttcaatggcctgtgatccgtcctgggcctctcctactacttcaaatccatttttggacaggatgtcccgaatcatcattctcataaatgcagcatcgtccacgatcaaaatacggtttgccatctgaaataaatcctccctaaattatgcttttattgtaatttttgaatacggtcccattggcttacaatatctgttacacgcacgccaaagttctcgtcgattacgacaacctcgcccttggcaatcagtttgttgttaaccaaaatgtccaccggctccccggcaagcttgtccagttcaataattgaaccttgtgagagctccagaatatctttaatttgcttttgggtccttcctaattctacggtgactctaaggggaatgtccatcaataaatttaaattgttttcatccacttgcgcaaatgcaccggactgcaagttagaaaattgtacaggttgtacatttacattacgtcccggtactgcaccgtagtgatgaggcgttccgtaaggagcttgcggcggtacgccagctggcattccataacccggtgttccatagcctggagcgccctgctgcccatatcccgggtcttgaggatacattggcggttgttgcccatagcctgcgtcttgcggcgcctgcgcggctgcaggtggctgttgataggctggtgcaggcggttgctgcggaacgctggcttgttgcggcgcttcgggagcagctgttgcagctacttgctgtgcggacgcttgcggttgttcttcatcctctccgccattcattaggatgcttaccatttttttggcgaaattaacaggcaacagttgcatcagcgtagagtcaataagatccccgatcaataaccggaaggatactgtaatgagcgtttcttcatccggcagactagatactccatcaccgtgcataggatccaaaatatcaatacccggtggagagatattaacaaaacgattaaacatggtagacatagaggtcgccgacgatcccatcatctggttcatcgcttcctgcacggcactgatgtgaatttcattcaattcttcatccgctgggttaccttcaccaccaagcattaagtccgctatcacctgtgcatcacgctttttgattacgagtgagttaataccctcgaatccatctacataatttacatgtacagctacgtgtggctttggaaatgcagtttcaaattcagaacgggtaataattgaaactttaggtgtcgtaatatccaccttttgaccgagcagtgtggaaagagccgtagctgcgctgccgaacgttatattaccgatttccccgagagcatcctgctccagaggagtcagaaaatcgtcaacggtcttgttggcgggagtagaatccgtccccgcttcagactgtttcagcaaggcatcgatttcctcctgggacaaatagtctttactcgtcaatttcttcaactccttcgttgacaatttcatcaatttgtacggcaacacgatctcttaccatgccgggacttcccataaacttcaatttatcgcccacccggatggatagtccttctttgacaggcttgttcaatgaaatgacatcccctaccgaaagacccagaaactcggctacatttatccgggattcacccaactccgcaataatagggagctctgctttggtgacccgtaatctcaaggcgtcgatctcttcgggcgcccttgatttcttttcggatgtaaaccactggtgcgtggacagtctggccataatgggttccaataccacgtgcgggatacagaggttaatcatccctgtggtatcaccaattttggtactaagcgaaatcagagcaatcgtttcattgggcgaaacaatctgcataaactgcggattcgtttccatcgcctctaggcgcggttcaatgtccagtaccgttttccaagcctcttgcaggctatcaaaggtacggctgaaaattcgctccatgatcgtcgtctcgatttcggtcaacgcagtaacctttgacggtgccgaacctgttcctccgagaagcctgtccaacatggcataagcaacgttcgggtgaacctcaagcaccatacggccttccagcggttcagcttcaaaaatgtttagaatggtcattttcggaatggagcgaatgaattcatcataaggaagctgctccacctgaacgacattaatttggacaaaagtacgaagctgcgctgaaaaatatgtggtcagataccgcgcaaagttctcgtgtatccgcgtcagactccgtatatgatccttggaaaacctaagcgctcttttaaaatcataagcgcgaactttcttttgggtatcttcctttttaagttcttccgcatccatttcaccggacgaaagagctgctaaaagggcatcaatttccccttgtgacagtacatccaccaatgttattcacccccttacgtgttcctgacaagttcacctggaatcaaatggctgccagcaaaaagtctgtaattttggcgttccccaggtgaccttcagggagcgacttgttgatgagatccgtcagcttgtcactgaactggtcccggcctttagccgttctgagctcatcaggtttggtgtctgcaagcaattgaataacgatgggcttaatactgatgtctttaattttttcaaaagattcttttgctttggcatcgttcaattgaaaagataggttcatctggacaatgtaatctgcgtctgccaaattcgttttgataccggtaatttcagagctcacttccaccaattcatctgctgacaatcttggaagttgttctgcttgagcagcttgcgcattcggtatgacttccgacttcttcccgctaagcgctggtataagtacaaaggccgcgcctgcaatcaaagtaatcgcgagtaaaattgtaatgagccatggcagcatcttcttcattcgtcttcctccatttgttgcacttttatcgtggcggcatgcatgccgatttcacggctgtaacccttgatcaaggagacgacatctgccgctttttccaatacaatcaaccgtttccccgtcaccaaagtgacgtatgtatccggtgtttcctccacagtctcaatgagcagcgcattaagccacataggcgagccgttcagccgcgttaacgggatcatcgtaacaccaacctcctgataggtgcggaggagcctctactcctccgcgtttaaatgagattatcgtttcaagtttacaacttcctgaagaacttcatccgaggtcgtaatgatacgcgagttcgcttggaatccgcgctgagctacgatcatttcggtaaattcgcctgtcagatcaacgttggacatttccagctgacctgagataatagctcccagaccatctgcgttagcagtaccgatttccaattcctctaggttagagttaactgtggtacggtataaacttcccccaatcttctccagaccttctgtattcgccactctagccacaccaatttgaagagcattatcagttgtaccatcttgcaattgctgcacaattgtaccgtcctgtgagatagagaaagatgcgacatcttctgaaagtgtaattggagttcctcctgtatccactacgaaaaacccatcggaagtaaccagatttcggttcgcatctacgtgaaaatcacccgcacgagtcagataaggaacttcctgtgcatcattcattttgaccaggaaaaatccgtcaccgttaatacgtaaatccgttgggttgttcgtagtcattgcactacctggaaggtgcagtgtatcaattgagctgaccgacactcccaaacctacctgcttggcattttgcccggcagttgttgttccgtctggtgcacttgcgcctgaactcgtttgactcaagatatccttgaacatcactcggctggacttgaagcctgtagtatttacgtttgcaatgttgttaccgataacgtccagcttcgtttgaaagcccttcatgcccgatacacctgaatacattgatctcaacattgagtataaatcctcctctgattggttgcttagttgaccgcatcagtcgatccgcggctttttcatggctttcctattcgggccagccacttcgtatacatttttatgaaataattacagcactatctatctgcgtaaatacgttatcctccatggatttcttatccatcgcggtaacaactgttcgattaggtacacttacaatcaaagccatatcctgcattaaaatcaatgattctttggcgcctttggcagctgctttatccacagcagagttgattttcgccatttggtcacttctcaactctattccccgctgctccagacgcttggctgcatggttgctcagcttgagcacctgttcctgcaacacctgaccgaacggtctggcatccttggataccgaatttactcggttttgtgagattgctgccggtggcacgttggcgggaaaaaggcgtccgaccgttatcctgtcattcatgagttctcaccgcttccagtagaggaagaaggggaagtatccgatgtatttgtagcgggagtcgttgtattagcctgactcactgatgttacatcttttaatgccacctcagccgctcccattttggcatactgcacaccgtcacgaataacgatggaatccacgattccacttttcactgtacccgcacctgtttcacctgtaatggagtcttttttacctgcctcaatccagctgacttcttttcctatcaaaccggaggctgtacctaaagactgtcccaatgcattcagctgcgtagaaatgttcatcagttgttctaccgaggaaaactgggccatttgagcgataaattctttatcctccaaaggctgcatcgggtcctgattttgtagctgggtgatcaaaattttcaaaaactgatctttacccatcgttttagtatccttggcacttgctgttttgacattattcacattgtaattcggccagacgttactggtggatacattgttgtctgtagtcgtcattgtgttctcacctccatcattacgcttgtgctgtaaaggagcctgtccgattcatatcatctgcgcgttgttcagctgtccagttacgaagctcttctgccatttcagctaccttcaaagcatcctcgctctcttctctacctcgagctttggaacgttgattggattgctgctgctgattagctccagatccgcgtccatcctgatacatatgggaggaaagcgactcattgtgcgttacttctaccttatctacctggataccttggctctggagactcgaacgcagctgcgacatttgctgttccagcaaatccttcgctccgctatgctcagtcatgaactgggcaaccagatgaccattttgcattgtcagcttaacttccagctggcccagatgatctggacgaagcatgatagtcgcttccgtcaaaccagtgtgttttacaatgtcaagtttctgcactacaaattcggtcatctccttggcaaattgccgtacatgtacgactggttgagccggagccgaaggtgttgttccttgcgtttgtaccgaaagctgtcccgcagtcgtgatcactggagtctgattgtcagttgctgtcgaatccgctcgctcagttgcatctacgaatgcactcgcttcatccgttacagtcgtcttaactgcagactgaacgagaatattagttgatgaacgttgcccttctgaaccttgttgattagtttcgccctgacttgcttgctgctgagaagcaacaacctgtttgtctgtagtcgctgtagctacggtctgagtaccatttgctcgatttgcagaaggctgaactgcttgtgaatccccaccatcaacaagttccacagctttcattacaccattccactgctcatcggaaatagctcccgtacctgccgttgcactttggagcgattgtagtaactgtgccacctgggacttttggtctccagaagcctgctctgctacattggcaagttgtgacaaagcgtcctgtaatgcaaatcgaagagtagccgggttggctgccaaagctgttaagcctgtcgcctctgtcgtttctccaccgtttaactgttgatttgttccgtcgccttgtaaaaactgttgtacttgctgaatccacgcttgcagagttgcaagcagagcaggatcagcagctacttgatcatccagcttttcaagattttgcagcaaaggagccagtgtttcggccagcggctcggttggagctcccgtggattctccagttgcaataagcggaagtaccataactaatggagaaccgttcgcatctgtgcctgctgagcccgtttgcccgcctgtcatcatttgcgtaagtgtttgattaaaagcacccgtggttgctccagcagctgtcgctgtagtcgttgttgaggccgttgtactgctagctgtctgactggtgccgagcgatacactttgagaaataagggtcatttatttttcacctcccttcatttaaattacttactgcccatcagtttgttcaaaatttttgcggtctgagcagcatccttggcagacatattttgtagtaaagaaccacgtgtcgaatcatctactgtatttaatatgtttaatgccttgtctggactgattttgtaagtttgtaaaataagttcggcaccgctcttcttgtccatggaagcaaatgtgctactgatttgagtgctttgcaaactcttactcgttgttccagctgtggtaccttgatcctttttcagacgagactgcaaggcagcaactgacaaatccgtagatggcgttacgtttttcagagccatagtaatatcggctgcttttttagcgtccatcttttgcaaaatctttgcactgttggcagggtccatgtagcttaacagctgcacagtctcttccgtggtcagattctccataatcggtgccgctttacttgctgtcatcccttcatacatgctagcaagatctctggcctgttttacataaggatcttcatttgttgttccacctgtagtttgcgtaccggcctgtccctgctgactagcctgtgactgctgctcctgttgcgtttgcagcgtattgacctgattctgcagttcagtaacctttttatcttgtgtcgtcttagcagcggtagcctttttaagctcctccgtctgcttggctaaatctgcctttaactgctcaatagttgcttcagaactttcagactgagccttctgatctgcctctttcgtctgggtagccttatctttcggttcaggtatccaatttttaacaactggtattttgttccctaatgaaatcatttcgcttctgaagtccatattgaacaatgtaagcaggaccccgaccagaacgattgtgaacacaatcggaatcaggaaaaacataaaccgttcaaatcccccgcctgattcttttcctaaatccatatccagttcattttctgctaacttctgtgccatcgtcttcctcctcaggcagctgatatgcgtatcctatgactttccgcttaccgggctttcatggcaaatcgcacggaagccatttcatccagctcgttctgctcgcgcaggagcatttcctgttggaatttcacgttggccttctctctcgctttcagccaaacctgttcatccagcattttatcggtcaaaacggtttgtttgctttgcacattttgctgcgcatattgaacatccctatgcttgcgtgtaatacattggtccagatgattaacataagcctgtaattcctgaatggtagagagtggcgcgcaatcctcggcagccttttgaatggctgatatgacccgattcctttcgcctacaagctgtgttaatgtctgctcctcagcctgcaattgtccgacagcactggaaagcaaccattcggcctgtgacttttcgttggttttcaagtctacaactttctgaaaggaatactgaaatctcatcgttcaaccttcatctcctcgtaaattcagaaatcaaacgctcccttacctcgtccagctcagccttttcatctgttctttgtcttgtaaaatcccatatatcccgtatgcgctccatggattcgtcaatttctgcatttgaaccctgctgataggccccgatattaatcaggtcctccgaatctttgtaaatggccatcaagcgcttaatgttctcggcagcgtctatctgatctcgtggtgcgatatccttcataacccggctaatactcgctaacacatcaattgcgggaaaatgtcctttgttcgcaattccacgattcaagacaatatgtccatccaaaatcccgcgaaccgcatccgcgatgggttcattcatgtcgtccccatcgaccagcaccgtataaaaggcggttatggagccagtaggacctgtccctgcacgttctaaaagcttaggtagactagcaaacacggaaggggtgtaccctctcattgccggtggctcccctaccgctaggccgacttcacgttgggccatcgcataccgggtaactgaatccatcattagcatgacattcaatccgcgatcccgaaaatattccgcgatggtcgttgcaataagtgcacccttaatacggattaacgcaggttggtcggaagttgccacaatgaccacggaacgttctagtccctccggacctaaatcgcgttcaataaagtccagcacttcacgtccacgttccccgatcaaggcaattacattcacatcggcttccgtattacgagcaatcattcccatcaaggtacttttacctacacccgaacctgcaaaaataccaacccgttgtcctttaccgatagtaagcaacccgtcgatagcgcgcaccccgatactgattggttcctgcacacgcggacgattcagcggattggacggaatattgaaggttgaatatctcgccattcgcgaggggatcaatgagccatccagaggctgacccaagccgtccagcactttgcctaacagctccgacccgacctgcacattcaacggcttccctgttcctacaacatcacaaccgggaccaatggactgcagttctccaagtggcatcagaagcactttattgtccctgaagcctacaacctctgcttgcaacggctttgccgttttacccggataaatgtaacaaacatccccgatactggcgtctggaccttccgattcaaccatcaggccgataacctgcgtaaccttgccatttacccggaccgggtccaactggcgcaaatgatccatgtagcgctgcgtattaagccccttcatgtcttcgctcctcattctcatgtgccagacgcagtagttcctttttgatctcagctaattgcgtatcaatccgcgcatccacgctcccaaaagaagaacggataacacaaccgcgatctttcacggtgccatcaggaataatttgcagttctgcctgcgaatcgacagttaatgacaattcttctcgtgcaccttgcacaaatgcgaaatgctgaggcgacacacacaatgtaatggttcctttttcccgcttacgagccaaatttttacgaattaattcaatcgtgtagtccggttcaaggctaagctgtttctcaatgatcttctcagcaatagcactactcagttcgaccaggaaaggctccgcttcctgaatcagttgttccttaatctcataggcctgacgcagaatatcctgtgcttcttccatcatctgctccgatttcgtttggagctcggcctcagccagcttttggccttcttcatatccttgctgaaacccatcagcttttaacgactgagtcaactgatcgtcatgctcgcgtcgttcctgccaccaggcttcaatctgctgctgtgcctcctgaagcatccgttccgcttcttcagctgcctcgcgaacctgacgttcagcaaaatccttggcatcattcagcatttcatcgcgcagccgttcagcctcgtgatctcgctgaggctccggctccgtatattcagttgtgatttcttcatccgtcgtttctggcgcatacgtatgtgccacatcaattgttttcaaagcctctacaggaacatattggaaagatttaatcaagttagacaatgatgtcatctcctccgccgcgtgcgattataatctcaccggcctcttccaatctgcggatcgtcgatacgatacgtgtctgtgcttcttccacatcacgcaaccgcaccggtcccatgtactccatttcctctttgaatgtttctgccatacgtttcgacatatttcggaaaatcacatcgcgtacttcttcactggacactttaagcgccaattgcaaatctgcattgtcgatatcgcggataatgcgctgaatggaacggttgtccacattgacgatatcctcgaacacgaacattcttttcttgatctcctcagccagttctggatcttgaatttcaagcgagtcgagaatcgtacgttcggttccgcggtctacgccattcaaaatctgaacaatggactcgataccacctgcattcgtataatcctgcgtcgcggttgcagacagcttttgctccaacactcgttccacctgggaaataacttccggagatgtactgtccataacagcgacacgccgggccacatctgcctgtttttcctgtggcagagacgacagaattgtagccgcctgctcaaattgcaagtacgaaagcacgagagcaatcgtttgcggattctcattctgtataaaattcaatatctggtttggatcagccttgcgggcaaaatcgaagggtcttacctgtaacgtcgctgttagacggttaatgacctcaactgctttttgcgatccgagtgctttctccaatatttctttagcgtaattaataccgccttgggaaatgtactcctgagccaaacaaatttgatgaaactcggccatgatggagtccttctcaatggcatcgaccttccgcacattggcaatttccaatgtaagttgctcgatctcctcatcacgcaaatgcttgaatatttgagcagatacctctggtcccattgtgatcagaagtatagctgctttctgtcttcccgttaaaccttgactgcttgcctttgccaatgaactcacctctattcgtcagccagccatgtacgaagcagattgacgaattcgtcgggtttctttttcgccagactttcaagctgtttacgcacttgactttcatttgtcacactttccatggtaatagacgggaactccgtcggcgttggcatgagttgcaattcttcatccaactcttcttcctgcttacgacgaccgcgtacgatgaggaagattacacccgccagcagtgccagaacagcagctccgatgccccatagccaagggttggaagctgagaagaatgtattcgtgctcgcaggtgctgcaacagcttgtgaaaacactgaaaccttcttagccaaatcagcgtctgtaatagtagtaccagaattcgccaacgacgctcttacaatattaaccaaaatgttttgaattgctgtctgagttgcagtatccaacgtttgctgacctgttggtggttcaactgcaacattaatggttaaatcttttacaatgtacggactttggataatatcccttgcaattcggttaacttcgtagttaatcgtacttgagctcttatctgagctggtattgccggaattagctcctcccgggtagcccggaacatcctgtgttcctgttcctgcaactcctccggtttgtccactactgcccgtatagctttcctgaatttgttgggcgctaatttcaatacccttcattttcgtttgatcaacaggtgtgaccatttgttcttttgatgtgactttgtcgaaatttagctgggacataaccagcacgttcaccttgtcgtctccaacaattttcgacaaaaattgttgaacattattccttacatcgctctcaaacttcttctgtagagccatgttttcctgaacaccactagtgagtccaccttggccgcccttggccgttggaatcaactcatattccttattggtgatcgtaatgttttccactggcagattcggcacggccgtttttaccagattaaagtatccatcgatcgcttgctgatttggagtaaagccgggctcgaattccatttgaatcgaagcggaggctttgtccttttcttcaagtccggcaaaaatgttttcctttggcatattaatgacagctttggagctttggacaccatccatccgttccaacagttgctgtatttcgccgttcaatgcattattgtacttcacattgaactcgttctccgtcataccaatcgcagaggaggactggtcaaaagcgctcatgccgattgaacccttctgaatcaggccttgagacccaacatctaccttcgccttatccgcattagcagttgggactgagatttgtgtcccaccagcattaagttggtacggtatacccgcagaatcgagatatttaatgactccggcagcatcgttagcatttaaatctcggaaagccacttcatactcggttttggtaaactgcatcgttagcactacaacggcgataatgatgaatgctaatgtcgaaacaagtaatatcttctgttttttgctgaaattattccaatacccggaaatcttatcccgatattgggcgattctctcgttcactccgtcaccccatccgaaactttgctaaaccctctttacatctgtgtacgcatgatctcctgataggcttcgatcgctttgtttcggacctgtgtagtaagctgcagggaaagcagcgcttgttgggaagtgatcatgacctgatctacatcaactttgcctgccatgaattggtcggacatctggtgcgtagcggcttcctgctgccctacttcattgagagcatcctttaggaaggaaccaaaatccttcaaggattcggaaggcgtcgctttcgtcaactcattgttaggcgattgaatctgctgtattgccggtgtctgtacattaaacatggcgttctgaatcatgttttactctccctattaagtagttagtagtcctagaacttagcgaccgatttcaagcgctttggaaaccatagcctttgatgcattcagagctgttacattggcttcgtatgagcgtgttgcggaaatcatgtcgaccatttctttcataatgtctacattaggcatatatacatagccatctttatcagcgtccgggtgacccggattgtacacaggctttaaaggtgactgatcttcctgaatttgcgaaaccttaacgccagcagcgcttgtgctacttccttccatttgagccttcaaaacatcggcaaagccagattggttcggctccaaaacaaccgtttttctccgatatggaactgcttgtccattctctactttcgcccgagttgtctctgcgttggcaatgttgctagatataacgtccatccgcaaccgttgggccgtaagagcagatgcactaatatcaaagccgttgttaatcttcacctagtcctatctcccttctaccgctgttctcatcatcttgatgcgctcattaatttcttggatgtaggtattatatcttagttgattttcagccataagactcatttctctgtcgatatctacgttgttcatattgttattcatgactgagtacccatctttggtgaccgtggcatctggaatggagttcacaggtcctatttgaaaatgtcttgaattggttacttttccacgtagtggtgtgacatcaccgtccatttgctgctgaagcagttcttcaaatgaaacctccgaacgcttgaaatacggggtatccgcattggatatattgtcggccatcacacgttgtctcgtatttgccgcctgtacacctgcctgaagcttttgaaagctcatatcacccagcagattcatttagctcctccctcccagcgtctactccaaagtaagattcaataaaacaagatttttcactttttttcgacaataaaatttcataattatacatttcttttaggtcttaagtagaaaacaataactttctgtcatatattctaagtttcgtagagttgggacctaattacaataagaaaaaagccctatcttttttaaaaaagagggctttagatgcataaaatgttaaatttttcaggtttatttcaagaaaatgaatgttttcttagcactttacacctgtaaaagattatacgtcctacttttggaatagacagaaaaatcatcaacttgaccattatctaggtctaaacgacggtgcaagatagtgttattctggacctcacaccctatttttagaaaccctattcataaaatatactgactaaggtccctgttttgggcaatatctcccagcttctcacgtacatattccggagtaatgatcatacgatccaatgtaagctctggtgcttcaaacgacagatcctccagcagcttttctagaatggtatgcaaacgacgtgcaccaatattttcggtgttgcgatttacagactcagcaatgctggcaatctcacggatcgcttccgcagaaaattcgacttcaatctcctcagtacggagtagatcagtgtattgcttggtcagcgcatttttaggctccgtcagtatcgacacaaactcatccaaagtcaggctacttaattccacacggattggaaaacggccctgaagctcagggatcaggtcagatggttttgcaacatgaaaagctcctgccgcaataaacagaatgtaatctgttcttaccggaccgtatttggtcatgatggtagatccttcgacaataggtaaaatgtcgcgctggacgccttctctcgacacatcggggccgctacccttaccctggctggcaatcttatctatttcatcaataaaaataataccggattgctcagcacgcttcacagactcctgaatcacatcatccatatcgatcaatttggcggcctcatcttgaatcaacaccttgcgagcttccttgactggtagcttgcgctttttcgtccgcttgggcagaaaacttccgaacatctcctgcatattcatacccatttgttcattcccttgcccagcaaacatatcgagcatattgggggcagtatcctccacatcaatctctatgacatcatcctcaagcttaccagacaatagatcgaatttaaccttacggcgcttttctgccaaagatccatcctgttgtggtggttcttcttctactgaagttcccgtgttattgccaaacagcatttcaaagggattacgttgcgatttgtttgacttttctgcaggtacaaggatgctgacaatccgttcatttgccatgtcttccgctttgtccttcacattctctgttcgttccgtcttaacgatgcgaatagaggtttccatcagatcacgcaccatggattccacatcacgaccgacgtaacccacttctgtaaatttggtcgcctctaccttgacaaaaggagctcccacgagccgtgcaagtctacgtgcaatttcagttttacccacacctgtcggtccgatcatcaaaatatttttaggcacaatttcatcccggatatcatccggcagcttactacgccgataacggttgcgcaaggcaacagcaacagattttttagcttccttttgtccgacaatatacttatccagctcggataccacttgtctgggcgtcaacgattgattattcattttgcactcctccacccttgaatactcagagccgatttacagttcttccacgataatctgattgtttgtatacacacatatttccgaagcaacctctagcgcttcccgtgccatgtcctttgcttccatgccagacccatggcgtttgaaagcacgggcagccgccaatgcaaaattaccacctgagccaatcgcaagcacatcatcatccggctctataatttcgccgcctccagaaatgagcaacattccggatgagtccatcacaatcatgagcgcttccagcttgcgcaggatacgatcctgacgccagtccttggcaagttccacggctgctctttgaagatttccgtggtgttcctccagcttattttcaaacttttcaaataacgtgatagcatcggccactgaacccgcaaatcctgcaacgacctgacctcgatacaatctgcgcacttttttagccgtctgcttcatgacaacactgttgccgaacgttacctgtccatcacccgcaatagctcctttgccattgtggcgtacagcgcagatggtggtagcatgaaaggacatatccataacgcgctcctccttttccttcatccttatgcctgtacttcagctgacataactcccgtttcgttgatataaccccgcaaactttccaacgcgcgattagcgagagcttcatttttttcctttttgttacgaatccgtttctctaactttggaagcaaaccaaagtttgcattcatcggttgaaaatgcttaaaatcagcggtggtaatataccgtgccatgctacctaatgtcgtttccgcaggaaatacaaacatttcctgtccacgcgctgctcgtgccgcattcatcccggccagcagaccagaagccgctgactccacatatccctctacaccggtcatttgtccggcgaagaatagattacttcttcccttaaactgataagttggatgaagttgctgcggagaattaataaaggtattgcgatgcatcacaccgtaacgtacaaactctgcctcttcaagacccggaatcattgaaaatacacgcttttgctccccccatttgaggtgagtctggaaaccaaccagattatacagcgttcctgcggcgttgtcctggcgaagctgaacaactgcgtggggcagttcacctgtatgtggatttacgagacccacgggtttcatcggtccgaacaatgccgtttgtttcccacgttgcatcatcacttcgatgggcatacagccttcaaaataaatttctttttcgaattccttgacttgcgctacctcagccgcaatcagggcctcataaaaagcatcaaattccgcttcgttcatcggacaattcaagtacgctgcttctcccttatcataacgggaagccagataaaccttgctcatgtcgatagagtccttttctacaatcggggctgccgcatcgtaaaaatagaaatactcctctcccatcagtgatttaatctgttccgacaaagccggagaagttaaaggccccgtcgcaatgaccacaataccgtcctgtgggatttcctgaagctcttcattaacaacctcgatcaaaggatgttgatgaagcgtctcagtaatatgaccggaaaatccgtcacggtccactgccaatgcaccgccagccggaacagcatgacgatctgctgcactcaggatcaaggagtttagtattctcatctcttccttcagtacacctactgcattcgttaggccgtttgcccgcaaggaattactgcataccagttcggcaaatttatctgtatgatgtgctggtgtttttacaaccggccgcatttcatataacttgactggcaatccacggcttgcaatttgccaggcagcttcgctgcccgccagacctgctccgatgaccgttaccttttgtagttcactcacgtttaaatccccctgctattgttgttcttaagaagtctctacgctctcatcgctctcttccagcatttcgctgtgatcgcagaccgtacagttgagcttcgtcccttgttttgtacgtttttcgaccattaggctactgcaacttgggcaaggcttaatggacggtttatcccaggaaacaaaatcacattccgggtagcggtcacatccatagaagatacgtccctttttactccgtcgttcgacgacatggccctcaccgcatgaaggacaattaatcccgatatccttaacaattggctttgtgttacggcaatctggaaaagcagaacaggccaggaatttaccaaatcggccaagcttatacaccatttgactgccacacttatcacaaatgacatcggatacttcatcttttatttcaatttctttcatttcttcttcagcgacttcaagtcgcttctcgaatgactcgtaaaagtcactcaacaccttgacccaattaccttcgccttcttcgacgtggtcaagatcaccttccatattagctgtaaactccacattcagtatctctggaaagaactcctccatctgttcgatgaccaattcgcccagctctgtagggaaaaatttcttttcttcaatagcaacgtacccacgtttctgaatggtttccagcgttggtgcatacgtacttggacgtcctatacccagttcttccagcgtcttcaccagtcgagcttccgtataacggggaggcggttgtgtaaaatgctgcttcggctcaaccgcttctttttttaatttatcgcctggttgaagtggtggcagcagtttatcttcttcggttttaccgtcgtcatttccctctacatacactttcatgaaacctggaaaacgaaccttagaacctgctgcccggaatatcgtctcacccgcttcaatatctacggacaaagtatccataatagcagaagccatctggctggccatgaaacgttcccataccaatttgtacaaacggaactgatctcgactcataaacggcttaactgtttccggatcgcgtaacgcagaggttgggcgaatcgcttcatgcgcatcctgggcgttggccgctttttttgaatattgacgaggagtttcaggtacaaaagcttcgccatatttttgaataattaattctttcgcttcctcttgagctgaagcggcgatccgtgtggaatccgtacgcatatacgtaatcagacccacggtcccttcttttcctaaatccacaccctcatatagctgctgagctacagacatcgttttagatgcacggaagttgagcttccgagccgcctcctgctgcaaggaacttgttgtgaatggaggagaaggattgcgtaagcgctctttctctttcacatcgcgcaccttgtaagacgattttccgatagcttccaacacttcttgtacatccgcttcgctggagagctctttcttttcaccgcgcagcttatgaaatttcgcttcaaaggtactgtctttaatagctagtttagctgtaatcgtccagtattcttccggtacaaactcactaatttcgttttcccggtccaaaataattttcaccgcaaccgactgcacccgcccagcggatagacccttttttacctttttccagagcaacgggctgattttgtagccaacaagtcgatccagtatccgtcgtgcctgctgagcattgaccaaatccatattgattttacggggtgttttaaaagcatctttgacagcctgcttcgtaatttcattaaatacaacacggcaatctgctgtatcgtccagttccagcgcatgcgccagatgccaggcaatagcctcaccttcgcgatccgggtcagccgccagatatactttttttactttttttcgggcatcctttaattcttttagaattgagcctttacctcgaatggtaatgtatttgggattaaaatcattttcgacctctacgccgatctgactcttcggtaaatccctgatatgacccatggaagccttgacgatatatttgctgcctaagtatttgccgatcgtcttcgccttggaaggcgattccacgatgacgagtgaatccgccataggctcttcctcctctcaattacacacatgaatatgatagacttcctgaaatgtggtgagttatgacgcgaagagcgcttcacagattggtcatttttccagatcgctgtgcttgttcagaaagattccatctgctccgctactgcgagtcataatgtcaacacatttcaggaagtggggaaggagtaggaatccgcggcgcggatgaataccatactgccctccacctgatgtttaaaattgaatttgtgcatttactaactaaggactttgcaaaaacaactactaaataagcttgtattttgtgcccgctagctgggcgatccttttttttatgattaacgataacagaactgcgtgtaaaagtccaaaatcccatgccgtagcatcaagcagttcatccagtgtcatggttccctgttcgagcaacagtatgacacggttttcctcagaagtctcactttctggcactttggaggcctccttcagattaagactctgctctctattgtatgaagaaacctcccttgtacgcaaatctgcttcatactcctcaataatatccgaagcttcagtgactgttttggctccttgcttaatcaagctcagcgtgcctctactcttcggtgacgtaatgggtccgggaacagcaaacacatctcgatttgcctctagcgcagcatcagctgtaatcaaggagccgcttcttgcatctgcttcgacgacgagcgttcccttcgttaggccagctataatccgattacgttgtggaaacattcccggatgtgacctcgtgcctggaggatactccgatacgatcaagcctttgctagccatctctgcaaataaagacgcattttggggaggataaatttgatcaatcgctgttcccagtacaccaatcgtgtttcctccccggcgtagggctgtttcgtgacaaatactgtcaatccctctcgccaatccgctaactactgtaatccctgcattacataatccctctgttagtatctccgctgctctacgtccataagcggtgggaacgcgagttcctaccatggctacagagcatgtatgcaaaagtgatttatcccctttggtatacattacccatggtgggtcaactgtttccttcattaataggggataatcctcgtccacataagttaccgttccaatatcaccggatagaactcgctgatatcgttcatgcacccattcttcatcgtaacactgagccgcaattcgtgcctgagcagggcttaaccctatctcaatccacttttgttcgctaaaatgcagtagctcatgcaatcgatagtcactcgaccaaatacgctgaattgtttttcttccgattccctctaactcatgcaagcctaacaaaagccatctttcttccaaactatggttcccccattcacggaagagtgaaccctcccttattttgtggcacaatgaatcattttgcaagcgtttccctgacaagtctgtcttaacgcaaaaaaagcaaccttttcatcccctgtttcagaagataaaaaggttgcttacctttctttcattatacactagcctgcggcaaatttcgatgcagttttatggcctgtatattaatgaagaaacacgatttaatgtgtcgtacacaaagtcaaaataccacgtgcttccagcacacttaccagtgtcgagcccatttcggaaggagtcggtgccaccttaatcccacaggcttcaagcgtggcaattttctctttggccgttccttttccaccagaaataatggcgcctgcatgccccatccgtttgcccggaggcgcggtcacaccgccgataaaaccaactactggcttcgtcatattgtccctgatccactcagcagcctcttcctcggctgtacccccaatttctccgatcataatgacagcgtgagtgttggggtcatcattgaaacgttgcaaaatgtcaatgaattctgaacctttaacggggtcaccgccaataccaaccgcggaagattgtcctatacctcgggtcgttaactgatgcactgcttcataggtcaaagtaccactacgtgacacaacacctacatgacctggtagatgaatgtaacctggcataataccgattttacattctcctggcgtaataacgcctgggcagttagggccaatcagaacggtctttttaccttccataaaacgtttgaccctgatcatatcaagcaccggaatgccctccgtgatacaaatcacgagatctagttccgcatctacagcctccaaaatggaatctgctgcaaaagccggtggcacgtaaatcacgctcgctgttgcgccagtagcttccttggcttcgcttacggtgttaaacactggcaatttgacctgttgtccgttctccagtgtaatttctacctcggtgccccccttacctggagaggtgccacctaccatttgtgtaccataatcaagtgcacccttggcatgaaacaacgccgtttttcccgtaatcccctgtgtaatcacctttgtatgcttatcgaccaaaatactcacgatcttcacatcccctatcgtttattcggcatatcggaatgcaaacaggctattgaacaagttcgacgattttttgggcgccatccgccatggaatccgctgctacgatattcaaaccggattccgctaaaatctgtttgccgagctcaacatttgtcccttcaagacggacaacaagcggacgagtcagccccaactgtttggcagcctccacgacgccgttcgcaatgatgtcacactgcataattccgccgaaaatgttcacgaaaataccttctaccttcggatcggacaaaatgattttgaacgcttcggttaccttttccgtcgtcgcaccgccccctacgtccaggaagttggccggatcgccaccgtaatatttgataatatccatggttgccatcgccaagcccgcaccattgaccatacagccaatatttccgtccagagcgatatagcttagatcgtatttagatgcctcaatttccttctcgtcctcttcatccaaatcacgcaattccaaaatatccttgtgacggaacaacgcattagaatcaaaattcagtttggcatccaacgccagtacattcccatcacccgtaacgactaagggattgatttctgcaatcgaacagtccttgtccacaaaagcttcgtatagtgccagcataaacttgaccgctttgtttaccagttcatttgggatattaatgtcatacgccaacttacgggcctgatacacctgaagcccaatcgctggatcaacaaccgctttaaaaatcttctccggagtggctgcagccacctcttcgatttccgtaccgccttcttctgaggccatcattacgatacgtccagtcgcacgatctacgacaacgccgacgtaatattctttacgaatatcgcagccttcctcaaccaaaaggcgtttgacctctttaccttcaggtccggtctgatgcgtcaccagcaccttacccaaaatttcagaagcaaaagtccgcacctcatccaaacctttggcaactttcacgccacccgctttaccgcgtccaccagcatgaatttgtgctttcaccaccgtaacagcgcttccaagcgattctgccgcagcaacggcttcctccaccgtataggcaaccttaccgttcggtacagccactccgtactgcttcaatacttctttaccctgatattcatggatattcattctggaatcctcctatcaacatgactgcaacaagggcggttcacaaggaaatctatactaaacctacatcattgtaacatgtttttaaaacgctttccttataatttaacctcatgaattacagtattttgatatcattatcattcccaaaatcgaatgtttggatattattggatatttctcttaatacaaattcacacaaaaaaagcacctctacaacatgggattacctaatccacattaagaggcactttaattcttcaagcatgattaggtattttttctttcagctgagaacaactcatgccataagattcgcaagagcaactgaaaacaccttatgatttttcaatttgtacattagcttgatgaacacgatcgagcagatcattgaactggagcagaagcgacccaaattgatcatgagtcatacttgttttttcctggatgcatcctggtacggacagagctttttcccgtaatgcgcttccctctgtcgtcaaagaaatcagcaccttacgctcatcctgagtggaacgctttcgatcgataagcccggcgttctgcaatctcttcaatagcggagttagtgtgccggagtccaaatatagtgcctcacccaattccttcactgtacactcttcacgctcccagagcacgataagtaccaaatattgcgagtacgtcacaccgagcttttccagataaggctggtatagcttcgtaatctctctggagcatgcatatatggcaaagcataactgattatcaagtttcaacgctgtaccttcattaggattgtcttccatgctgtctgatcacctactttcgtcattattttagcacattatataataaaatacatgctaattgcacaaaatactttacaaacaataattattttgataaattaaattgtgtaaaatataaattgagcgagaggcagtgattggattatgatgaccattcaacaaaaaatgtatgaaacaacagtaaaagcggttggtggacgtaacggttatatcgagtcttcttcccctgaactccgtttagatatcgataccccaaaagaaatgggcggcgcaggcggtgcaggtacgaatccagagcaattgttcgcagcaggctattccgcttgctttgacagtgccttaaatatggttgctcgcatgcaacgtattaagcatgaaggtactgaagtaacagctacggtccatttcggcaaagtggaagacggcggcttcggaatcggagtaagtctcgacgtactggtaaaaggcgtcgatcatgaaactgcagtaaaactggtggaaggcgcacatgaacaatgtccatactcccgcgctacccgcggtaatattgaagtgaaactgaacgttttgtaacttagattttctttagcacatgtaggggacgtcttcatctctcttcatggattcaatagtttcgttagaatgaatttcacaacaagcccctcaaccgtttttgtcgaggggctattatcctttcagctatcccttcgttaaagactgtttgtttttttccatcaagtaacatgggagatgatgtataaacgtatatacaaaattgatatactcatagtataatcactattgtcataatcttatttttcttctccagatctttattgtctggagctttttttgtccttttttccattttctattgtacatacgctttggaaaactcttttataaaaatgatggtgttatagctactaatttatcgcctttttaactttcgtgaaaactggcatttgctctatccatatggcggtattgaatagcttcagccacatgtgaagtcaaaattttatctgagtcatgtaagtctgcaatggtacgcgaaagcttgagaattcgatcatacgcgcgcatgcttaaaccgagtgcgtccattgtctggtcaagcaactctgctgcatttttttctaatacggcatatttacgaagcatctgaccagacagctcactattccatgaaaagggaagcttgctgtatctgtggatttgtatcgcttgagcagccagtacctgccttcgcatttcagcggacgacaatgattctttttcctcccgccaatccttcggctgcgatacttcaagctgaagatcaatccgatccagcagtggaccagaaatacgtgaacggtagcgggctactgctgcaggtgaacaggtacagcgctgatgttccgtgtcatttccgaaaaagccacagtgacacggatttaaagaggcagcaagtaaaaaatgcgccggatacttaaaaacagcacgtgaacgactgatcgtaacattgtggtcttccaaaggttgacgcagcacttctagtacatgacggctaaactcaggcaactcatccagaaataaaatcccccggtgtgcaagactgatttctcctggtttgggtatacctcccccacccaccaaaccagcagcagagatcgtatgatgaggcgaacggaagggacgaatattcatcagatgaggcgatgactccttccacttcccggcagcgctgtatactttggtgacttcaagcgcctccttttcagtcaaaggcggaaggatagatggcaatctgcggatgagcattgttttcccagcccccggcggtcccataagcaggatattatgcattccggctgcagcgatgactaacgcacgcttggcgtgcagctgacccaacacatcgctgtaatcctccatgttgctagttatcccttctttttcacacaacggtatatgctctgcctgaggtaaatggtcataggaacagatcatgacttgtttactggcagtataactctgatttatcgcttggctatcaacagtgccatgtgcacgatcttcaatcggaataagatctgctagatgccgtatagcgtaaatacgtatacccgtaatcagacgagcctcgcttgcgttttcctggggaagtagcacggagttgaatccttctcgcttggccagatcaaccatggacagtaccccattcacagggcgaatactgccatccagcgccagctcgccaataaacaacgtccgttctcccacgggtaaaacaacctgttcactggttgtcagcaaccctaaagcgatagcaaggtcaaaagatgaaccttccttacgcaaatcagcaggagctaaattaatcgtgacacgctgggacggatatttaaagccacagtttttgattgctgctctgacacgctccactgcctctcgaatcgccgaatccggcaatcctataatcgctgtctgaggcaagccattggacaaatcagtctcaacttcaatcagaacgccatctattccatacaaacaagctccgtgtaattttccatacatatcaaaaagcacctctcctcatattggaatgctccctctcgggaatcattgcatatatgaaaaaaggtgcttccaaattttcattctttgcaaatgtgacgttcgaaattttagctccgaaccatgctttcaaaattcttgactaagtttatctgacgacagattatttgtcaaacaaggtcagcttatcggctgccggagtacgtggtcttgattccgggataacgtcaggatagcctgcatatatcattcctattaccttctcacccggttgaattcccaagtgctcacggaacttaggcgaatacaaaaatggctttgtcacccaaaacgttccgattcctttgctccatgcggcaagcataaagttttgtacaagcgcgctgaccgctgcaaaatcctcatcccaaaccgcttgacgcgggtcttcttccaatactactaaaagctggatcgggttgtgcaaaatgccgctctcaaacttgttgtccttaccaatatcggctgcaattgcttttgcaagctttttccgtccttcaccagcaaacaacagaaaacgccacggttcacgcattttatgattaggagcccacacagcgacgtccagcagttctttgatcgtatctaccggaatggagtcggatttaaatcgtttaatcgtccggcgttcctgaattacatctatgacatgttcactaaaggtatgctttgtcacgtaaatcctccttcacaggtacaacttctagatattcattttaagatgaaaatgataactattctcaataaaatatacctgtagctttccttcctgtcaacctgcacatatgaattcagtcccgcactcttacctttgaataagctcttactcgtttaaaatgcgcctattaaatgatccgtaacaactgccttttcgtcagttaattgtacagaaatcatgtcaaagcggattggagcttctccaatcccgttcatatgcaaatatacagcggctgtttggcgaacttgggctattttacgcgcagtaactgattctgctggcgttccatacttggagctacttcgactacgtacctcaacaaacacgagtgtatgctcctgcttggcaatcagatctatttcaccactgcggcatcgccaattacgctctatgatacggtaacccaagttttctaaaaacaaagccgctgcctcttcgcccatcgctcctttggctttccgttgatccttgcctccagccttcatttcattcgacatcaccagtcatcccttgatgcaagcctatccatttgatatatataggtaagcacctctgccaccaactgatagagctcagcaggaatttgttcgtccaaatcgagtttggatagtacttcaaccagcgcagcatcctcctgtactggaacaccatgttctttagctttttctaaaatgctatccgcaatacggccgctccctttggcaacgacaatcggtgcttcgctctcaccaggcgtatatttaagggcgaccgccttctttatggaaggagaaggaggttccaacggctctttcatattttaagatcgactcctttatacggctgaggcacatagctttgtacttcagaagaggcgagactgttctgttcagtccttatgggcataggctcggtacgaagcgatagaagttggtatcctagtgactccaacgctgtgtgaatggactcacgcccactggataacaacgaagccgcccattcatgatcattatggagcttaacacttacaatccgatctacaacctggacatctaccagggtcgctccaagtcccttcatgtccaaatcaaaccaaagacgacagttggaggcgtccagctctccacgtttgccgcggcgggactgaatctggatcgtagctgtttcacgaccatccggtccaacgaacggtataaacatgtgtacttgggcaaaaggcgccgttcggtctgtgttgagcagcaactgctgacctgtcaggtgctgtacaacctgctgagccgcctctttcaaagcaggcggcagatcgtcactgctcatcagctggagcagcgccccttttacggtggctgcgtctgctgacaccgtgtccccagacgcagccgctaatcccggcagcggctgcggcgttccctctggcggctccatacgtgccgccgccccttgcgcgacctgtgtagtcgcgcggtgtacttgctgctcgtgctctgcaccgagcagcttcagtacgcggcccacccacgggtcctccgtggggctgagctgcgggctggacgccgcaggctgcgatgcagcggcgtctgcggcccgcgaggcgctagccattggctgcgccacttccgttgcgggctgctccggcgcagccgtgctcagtgggggcggcaccgccgcgcgtagctcttgcagcaacgtgcgcagccgctggagcgtcacctctggcgcagcagtgttacctgctgtggattgcggcacaggggcaccagcctgctgtgccgtgggacggtcagccatggccgcggttaaggctgtctttgcccccacaggttctgccgtggcagccgctggagcgccatccgcatccttaagttgtgtgcttgacgcagtagcttgctgtgactgctccactctagtgcgagaaccctttaatgcatcagcacccgattcttgagcatttacgctagcttccgatgccactgtcgctccgcgtccattgactgtctccgcttctcctggagcagtccctttggctgcagatgtagcccccgttgcagtatctgaatctgttgccaaagcactcgcttcactcactgcagcagcaaggttggctgcttgagtcccttttaacaattccttaccgcctgtggtttgtccagcttctgcctgctttacagcggtagaagcatccttggacaatataggagcttggccttcctgtccatctacaaccaccccggaagaagcacctgttggactagcagacattcgatcagcgctctttatagctgttgattcccccactgaacggtcagtgggtattccctgtcctggctgctttaataccgcttcaagctcttgctccagcgaagacaacagatcatttaaaggaggcccaaacatcgcttgacgcaatccgtttatgctttctgccgtcaatggaagcccccgctgaaaggcaactgccgccgcctgcacaaacgttcccaattgtacattgccgttttgcttcgccatagcttctcgcaaagacgcagcattttccgatgtcaacggcacaccgttcttttgcattgcctgtataagctccctgttctgagctgtatccggcagtcccaccgattccaatacatctgtcagcgctacggtttgctgtggtgtattagtcacatcgttcagaggcttaagcaccgtcattccgctgggggaagccggttgaacctgaaacgttgtagtctgtccaggttgaagaggggtctccagctttgccctgacctgagaaccttgtatttgcaacacagcctcgctgccgtcctcagacacctttagcacgactcctcgtacaacctgacctggctgcatatcaagttttttagcctctccagccttcacatctccaagtaatccacgaaatacagatccgatgttcatatcgcccctcctctcactctcccccattcaaaggggcttatggtattagttatgctttatatcggcattatcccgattcataataagtaactacagatcaaacagcgtcggttgctccgtcaacaaattgcccagaaagctgcgtctatgcatctttgtaggtcctagcgccaaaatttgttccctgtgtaacttggtagcgtaacctttatgtataccgatcccatattccggatacttcgcatcccattcacctttgcacagccgatcacgggttaccttggcgatgatagaggccgccgcaatagactgactgttggcatctcctttaataatagagagttgaggaatagacacatctaccttttctgcatccaccagtaaataatcaggagacacatgtaaagcctcaatagcctgcttcatagccaaacgggctgcttgcttaatattgatatcatcaattgtctgcgcgtctacatagccaactcctacagcaatggccttctccataattagctcgtagtatgcttctctcttcttgtccgtcaattttttggaatcatccacaccttccagtaactcacccactggtaaaatgactgctgcggccacaacatcaccaaacaggcatccacgacctacctcgtcaatacctgcaatccgctcacaagactgctcccagcattttttttcataatgtagcatgtccttcactacattctttttatcttccatattcaatacctgcccatctatatgtagtttaacgcgtcattcatgccgtagctctagcgattgaattcagcttaccacagaccttcatcgtccaaaacccttttctaactgccttcaaataccaaaaaaaccttcctcctctccggagagatggggaaggttcttccttgccacaaaatgctatgttctctatcggtgtaccagtagaatcagtaaggagcttccaaactgaaccgtcccagcttccctgcacgcagctcacgcaaaatgatttttgacgccttttcgagatccacacgtccgccgctaacaatacagccacgtttacgtccgatcgcttccatgacgttgacaatttcatcaggattttctgtatcttcaggacgttcggtgagctcaaagcgctctgccagtgcgtcccaatagtactgaaccaaatatttagtcgcaaaaaaggcaatatcctcgacattcagaatttcttccttgatcgcacctgtaactgccagacgatagcctacattctgatcctcaaatttaggccatagaatccctggtgtatccagcaattcaatttctccaatcttgatccactgctgtgccttcgttacccctggacggtcacccgtagctgcaatattacgtcccgccattcggttgatcagtgtcgatttgccgacattcggaataccaacaatcaacccacgcataggacgcgggttcattcccttcctaatctgccgatctatcttttccttaagcagcagcttggcctgaatcggaatttcttttagtcccgtcccagttgtggcatccaccggaaaggccacatgcccctgctccttaaaataggcaatccattgctgtgatactaccgggtccgccaaatctgctttattcaaaataatcattcgcggcttgccttgcaaaatatcatcaatcattggatttcggctagagagcggcaatcgagcatcaatcagctcaatgaccaaatcaattaactttaattttgcttcaatttggcggcgcgctctggtcatatgaccaggaaaccattgaatcgtcaccgtcatcaccccattgatcgtaactcctacttttacccttaggctcttagttaggattacggcagctatgctgcttattagttattctagtggttaatccactgcatatctttcgccggccagaaaataacgtcagcccgacctacaacttccttcaaatcaatatatccaatcatccgactgtctgtactattggaacggttatctcccattacaaaaatatgccccgccggaacttttccatccttaaatttctcatttggaaaatttgtaaacttgttgtaaagttcaccattttggtgcgcttcttctaaaggagctttcaagtaagattcctgaatcggcttaccatttactgtaatcgtgtcaccttctaccttgaccgtatctccttcaacggcaatgacgcgtttgataaagtctcttccttcctccggcacatgaaacacgatcacttcccctggtttaggggcacggaaatcatacaaaatctcatttacaatgacgcgttctccggtatgaaagttaggctgcatcgacgggccatccacaataaacggcttaaagagaagccagcggattaaaaagacaagcactaacgcaataatgatggccttgagccactcaaaaatctcattttttggtttacgcttgggcgtaccatcctgttcagttggctgctgtacagctccttgtcctacttcttgctccatagctcactgtcctctctttacggtcaataatccacagttccctatgtacgtagaaaaaacgaaaggagcttgtaaccaagcccctttcgttattcgttgtattaacgacgaatttctttaattctcgctgctttaccgcgcagttcacgaagataataaagcttcgcacgacgcactttaccacggcgagccacgtcgattttatcgattttcggggaatgaagcgggaaagttctttccacacctacaccgtaagaaattttacgaactgtaaaagtctcactgattccaccaccacggcgtttaatgacaacaccttcaaacaactggatacgctcacgagttccctcaataactttcacgtgcactttcaaagtgtcaccaggacgaaagttaggcaaatctttacgcagttgttcttcagtgatcgcttggacgatattcatctatgactccctccttccgtacaggtgttcatgcttcttctggaaacacaaccgtttccttcatcatccacagaggaccaccgtattacacacaacagatgtattgtatcatggaggataccgcattgcaacaacaaaaagggatttgaccaaacattatttaattgactccattataaaacaggtcactccctgctttcaaatccactcatgcctaagacgctttattgcttatcgcccaaacagtcagatttgcgctgctcctcaacccacacgcgctccttgcctgtcagttcaacctgttccaacaggtctggtcggcgttccatcgtgcgacgtaacgcctcttggcgtctccaagaatcaatattgacgtgatgccctgacaggagtacatcaggaactttccagccccgaaactccgcaggccgggtataatgggggtactccagcaacccggtactaaacgagtccgttaccgcactcgtttcgttccccagcactcctggtagcaatcgtgtcacactgtcaatgacggccatggctggaagctcaccaccagtcaacacatagtctccgatagaaagctcatccgtcaccaaatgctctcgaatacgctcatcataaccctcataatgcccacatataaaaataagatggtcctctttggccagctcttccgctttcttttgcgtaaaagtctcgccttgtggacacatcaaaatgatacgcggagattttatgtctgtgttacgttctatcccttcatgttgaataacttcgtcggcagtttctaatgttgattcctctgatttatccaacagcgcttccacggcagcaaaaatagggtcaggcttcaaaaccatgccgcccccaccgccatagggcgtatcatccacttgtccatgcttattgccggcatactgacgaaaattaaccgcttgcagtgatacaattcccttatcccttgcttttcccagaatgcttgcattaaatactccgtcaaacatctctggaaacagggtcagcacatctacccgcattacagcagaccttccattaaccgtaccgtaacccgtttttcgcgcacgtttacatccaaaataacatcctctatatacggcaatagcagttccttgcctttaggcattttgactacccatacatcattggctcccggagtcaaaatttctttgaccacgccgagctcatttccgtcttcggtcaccacttccatgccgactacttcatgaaaatagaattcattttcttccaattcgcctaaccgctcagcagataccttcaacaaagtacctttatatttttcaacttcattgatattgtgatattccttaaatttagcgacaaccatatttttttgaaaacgcgctgtttcaatagttacgggaatcggggctttaccttcagccgggacaatcaaaagttcactacctttagcaaagcgatcctctgggaaatctgtcgtcgttaatattttaagctccccacggattccatgggtgttcacaatttttccgacattaaacaattgttgcatcatgttcctcctgcttgttatcggtcccgctccatatcatcttcatcatgtacgaaaaagggttaggacatacatcctaacccactttcgtatatctttaagatatgatgtctacggtaacccgtttatccatcttaacggctgctgatgcaaccacagtgcgaagcgccttggcgatacgaccctgcttaccaatgattttgcctacatcctcaggatgcacactaagctcatatacaacaagccgatccttctccaaggtcttcacggttacatcttccggatgatcgactaaagccttagcaatgattatcactaattcttccatggttgaccctccgtatcagcaccttatttctgtagtttagactcatgaaactttttcattacgcccgctttgctaagcaagttacggactgtgtcggatgcttgtgcaccatcttgcaaccatttcagcgctttatcttcatcaatttttacaaccgctggtactgtgattgggttgtagtaaccgatttcttcgataaaacgaccgtcacgcggggaacgagaatcagataccacgacgcgatagaaaggagctttatgtgcacccatacgtttcagacgaatacgaactgccacgaaaattcacctccttcaaaaagtagactgtatattgttatcccataattccaagggcctattggccttagcggaaaggaaacttcatacctttacccatactcttcaactgcttcatagccttgtttttgccacccttaggtcccatcatatctgagaactgcttcatcatacgacgcatttcgtcaaattgctttatcagacgatttacctcagccagtgatgttccactgcctacagaaatacgtttgcgtcggctatgattaatcatgtctgggttttgcttttcctgtgtggtcatagaatgaacgatagcctcaatccggcccatctgtttgtcatccactttgatatctttcatttgcttcatgttgcccataccgggaatcatatcaagaatctggtcgattgggccaagcttcttaacttgatccatttgctccagaaaatcttcaaaagtaaactcggcattacgcattttccgttccatttccttcgccttatcggcgtcgatattggactgcgctttttcaatcagggacaacatgtcacccatgcctaaaatccgtgaagccatccgttcaggatgaaacggctccatcgcatccagcttttcacccaatgtagcaaacttgattgggcatcccgtcacagccttaaccgataaagctgcaccaccacgagtgtcaccatccagcttcgtcagtacaactcccgttaactccaagctattattaaagtgctccgcaacgttaaccgcgtcctgccccgtcatgctatctacaaccagtagaacttcatccgggttgacgttggtatgaatctggcgcaactcttccatgagctcttcatcaacatgaagacgaccagcagtatctataataacgtagtcattaccattatccttagcatgctgcaaaccctgttttgcaatttctaccgggcttgtctgatctcccagtgtaaatacaggagtattaatctgctccccaagaacctgaagctgcttgatcgcggctggtctataaatatcaccagctacaagcaatggacgatgattttgcttttgcagcaatttcgccagtttaccagacgtcgtcgtcttacctgcgccctggagacccaccatcataatgaccgtaggcggtttgtttgctttggcaagcttggcctgactgccacccatcaactcggtcagttctttgttcacgatgtcgatgatgaccatgcctggcgtaaagctgtccatcacttccttaccaacggatttctcctttaccttggcaataaagtcctttacaaccttgaagttaacgtccgcctcaagcaaagctaatcgtacttcacgcatcgcctgagctacatcatcctcagacacttttcctttaccgcgcagtttactgaatacattttgcaagcgagtcgataatccttcaaatgccatactttcgcacctccttgtctaccagggttgtttgttcttaatctatatgtcctacagttcctgcaggcgatttacaatttgatgaacatgttgcagaatgccttcatcggactcaccgattttaccgaatgcctcatacaacgtcttatttaattcttcgagatcttggattctacgctcatacttgcttagcaaaccaagcttttcctcgtacatttccaatacctgttcagcacgtttaatatgttcatatactgcctgacggctaatttgaaattccgatgcgatttcccctaaagaaaaatcatcatggaagtaatattttaaaaacatctgttgcttctctgtaagcagaggttcatagaagtcaaacagtcggttaatccggtttgtcttttccagccgattctcctgactcatcttgtatacctccatcgtcaaggaaaaacactttacagttcttttcaacgttccttatgatacataaaagaaaagaagatgtcaagcgttatcccttgtcatacaaaaaaaagccgatccactgccctcaaacggaagtacggatcggctttttgcccactcttacttaaacccttactggagtaagatacagcagaacagccagaaaatgaagtatgctacctgctaaaacaaacagatgccagatcgcatggtgatatggaaatgcccgccacacatagaaaatcgtgcccaacgtatacataagaccacctacgaacaataacgtcatccctccggcgggaacagtcgcaaccagaggattccaggcaatggtgatgagccagcccatcacaatgtaaaacacggtagacataaacaggaagcgcttggtgaagaacgccttgaacaacacaccaaacagtgcaattccccaaatcactccaaacagtgtccatcccagagtacctcgcagtgcaacgagcataaacggggtgtagctacctgcaatgaacaggtaaatgcaggaatgatcgaatatttcgaacaaatccttcattttcccttcacgcaggctatgaagcaacgttgaattggtgtacaacagcaacatcgtaatcccgtaaatcgtaaagctgacgacatgccaagtggttcctttcaagctagcaaaaacaatgagtaacacaagcgctgccacgcttaaaacggctccaattccatgtgtaatggcgttggctacttcttcccgtcgggagtaggtataggtgtttgccatcggtttttcacccggcttccttatttatatttacatacaacatacattacatatacggcatcgacagacctcttgctttcattatacatctgggcgaacttgaacagcaacaggatggctacttagtcccaaacgtagcatgaaagcctactttaaacgtatcagttctgttcttccacgtctgcagcagttgcttcgacggtctcttcctgaatcaaccccgcaaacaacgcatgaacgaattgctcggaatcaaacggttgaagatcattcactttttcacctaagcccaccagcttaacaggcaaattcagctcctgacggatggccacaacaatcccgcccttcgctgtaccatccaacttcgttagtaccagcccggttacaccgcttttctcaccaaacagcttggcttggttaagtgcattttgtccagtcgtcgcatcaagtaccaacaacacttcatgaggagcatctggaatttcgcgttggatcacgcggaaaattttgttcagttcctccatcagattgcttttattctgaagacgtccagcggtatcacacaacaaaacatccacttgacgctgcttggcagcctgtacggcatcaaacataaccgcagccggatcggaaccggattgctgcttaataacctctacacctgcccgttcgccccagacctccaactgttcaatcgcacccgcccggaacgtatctccggcagccaacaaaacttttttgccctcttgtttaaaacggtgagctaacttgccaatggttgtcgttttgccgacgccattgactcccacgaatagaatgactgtaatcccttcagcgctcattttgagctgactattgtcattcccccgcagcaactcggacagcttttccgacaatacaggctgtaattccgatgcgtcctcaattttgcgctttttcacttcttctcgcaggtcttcaatgaggttcataaccgtgttgacgcctacgtccgctccgatcagaatttcttccagttcctcataaaattcctcatcaatctttttacggcgaatcatcaagtccgttactttttcaacaaaacctttacgtgttttttccaaaccatctttgaactgttttgtgacagattcagttttgtttgcaatgctttccttcaatttcctaaagaaactcatggattccctccgttggtctgaaagtatgttatttaatgtcaggcaatctcagcttcatcgttgtctagcttgacagatacgagtttggaaaccccgccttcctccatcgtaaccccgtaaagcacatcagattcttccattgtgcccttacggtgtgtgactacaatgaactgtgtctgctccgagaattcccgtaaatactgggcaaaacgcaccacgtttgcttcgtccaatgcagcctctacttcatcgagtacacagaatggaacaggtttaacgtgtaaaatggcaaatagtaacgccatcgctgttaacgcgcgctcaccgcccgacagcagctgcaagttttgcagttttttgcccggtggctgagctacgatgtcaattcccgtctccaataagcgttccgggtcaagcagcacgagatcagcacgtccgcctccgaacagcttggagaataccgttccaaattcgcgccgaatagcatcgaacgtagtcttaaagcgcttggacatttcttcatccatttcacgaataacctgataaagtgttgtcttggcctccaccaaatcagacttttgctcatcaagaaacgtataacgctcatgcacacgctggtattcttcaatggcgcccagattcacctcacccaacgcggaaataccccgtttgagcctctctacctcgctctgcgtaccttcaatatcttcgggtatagggtaacgctgcttggctaactcatagctgagttcataatcatcacttaattttttcagaacgttttccagttccacatcaagccgatttactccaatttccgtttgacgaagcaactcctccactgacttgagctgaattcgctgttctttcgtgtcgttctcagccacttcaagctttttggacaagctgctgcgtgcagcccgtttgaattccaattgctgtgcagcttcttcctttttcaaacggtattgattgagattttcaatctgtttcacggtctcctgctcattggtcagcaaatctgcttcgatggaagcaagcaaggttttgttttgtctcgaatctttaccaagagtatcataatccccacgcaatctgcgcaactgctcttccaaagaaaagcgctcttggtccagctttccctctctcaccttgagattcgtgagctctccctgcagctgctctttggcagattcgttggctttacgggcaaattcagcagcgtgaatggcctgatgcgttttcttttcttcttcctccagcgcagccaactttaccaacgcttcttcacgggaaatttccagctccttgatttcctgatcaaagccctttttctcctgaccagacgcagcgacctgctccagaacatgacgaagttcatgctccaattgcttgagttccattgccatctgctgctcttcaccgcgcttcacatcgccgccctggcgcaactcgtccagacgggtctgtgtctcctccaactggcgtttggtatctattgcactctggcgcaaccttgcaatttgctgctccgtatctacaatgtcctggtccaactgatccagctgacgtttgcgtccaagtagattagcatttttcttgaactggcttcccccagtcatggaaccccctgcattgacaacatcgccttccaaagtgaccacgcggtatctatattggcaacgggccgcaatacggtttgcatcttccaacgtacgagcaatgaccacattccccaagagactgcctacaattccggcatatcgatcatcatactgaacaagatctgcaccgattccgacaaagccttcggctccttctgcaatttggcgttctcctgcaccgatttgacgcggacggataacatccataggcaaaaatgtcgctctgcccagttgacgttgctttagaaaactgatcgcctgtctagatacggattcattttccatcacgatatgctgaactgaagcacccaaagcagtttccatcgcctgctctaaatgctcaggcacccgaatcagctccgctaccgctccatgcacaccatgcaaagtttcttttcgtgcagccttcaatacctctttaactccaagcatgaagccgtcaaagtcatcctgcatttccttcattgtatctcgccgtgaaatttgagcctcacgtttttgttcccatttacgaaccgtaccctggttttcttccagtagtttttgcagggcctggtacttttcacttccctgaatatagccactacgcaaactactgatttcctgccccagcttctgaaccgcagcttccaatccctttttgcgctgttcaagttgtactttctgggcttcccatttgccggattcgtcacttacgcgagtcacacgccgttctaatgcttccttctgctggtctgtataacgaatttcgttacgcgcctgcgccatctgattcatcagctccagcagaccaccctttaggctttcttcctgctcctggctgattccgcctgtaacaccaatcagtttggcctcttcgtcagacagccgcgcacgcaactcgtcaagctctacattcagtgcagacagtttttcgttcagctgatccagttcactcctgcgctcggaatgccgtgattcgcttgtgctaagtgataagatcaattgttcccgattagcctccagattgcgtgtgcgctctttgagcaattcgccgtagccttcacttttctccgtcgcttcactgtattgcagcaaatccctttgcaactgctctacctgctcttccagctggcgcaattcgttgcggtcgctttccagcatcgcatcatggcgggacaccaccgtagacaactgaagctgctcctgctgcaacagagctagtttggaagtcgcatcgctccacgaagtatgaatttgttcaatttgatggacgtacattgaaatttcttttgatttcaattcaccgcgcagctctttaaaatgaatcgctttttcagactgctccttaagcggtccaatctgatcctccagttcactaaccaaatcgtgaatacgcagcaaattttgctccgtttcatccagcttgcgaaccgcatcttttttacgcgatttatattttacgatacccgaagcttcctcaaaaatacctcgacgatcctcagatcgggtactcagaatttcttcaatgcgtccctgcccaataattgaataagcttctttaccaatgcctgtatccataaacagctctgtaatatctcggagtctgcatgattgccgattaatgaaatattcactatccccacttcgatgtacacgtcgcgttaccgtgacctcaccaaaatccagaggcaacgcctgatcttcattatccaacgtaagcgatacttcaccgtaattaacagccttacgagcatcactacccgcaaaaataatgtcctccattttgccgccacgcagtgatttggcactctgttcgcccagcacccaacgaattccgtcggaaatattactttttccgcttccgttgggtccgacgactgccgtaatgccgcggacaaattccatttccgttttatctgcaaacgatttgaagcccgccagctcaatgcgctttaaaaacatgctcaatctcacctctaacatttcaaatatgcttgtacaacaccgtatacctgattgatatgaattatccctattgtagcataaactagcttgtataaagcacagtaccgacactcacattaaaccagcaaagccacgaaaaaagagcaaaacgcagtccattcgccattacgggccgggactccccgcggactgccctttgctcttactttgtgcccctgcttgcgtaacccgtccgggctgctcaggtaccgtttacgattctgccagcttcaaacggtttaaagctactgccgccgcttgctgctcagcttcttttttggagcgtcccgtacctgcccctagccgttcgctgtccatatatacctcggctacaaactcgcgctcatgggctggtccgcgctcctctacaatcttgtattcaagcatccccatgttatgatgctgcgtcagttcctgaagctctgttttgaaatcactcatctgaagctttccgtttaatacaatttgaggaaaaatataacgttccagaaacgaccggacggcctccagaccctgatccaaataaagcgcacctacgaacgcttcgaatacatcagccaacagagccggacgagtacgcccacctgtcaactcttcaccttttccaagcagtacatattgcccgaactccagcccgacagcaaatttcaccagcgaaggctcacagacaatagctgcacgcaacttggtgagttcgccttcgggtcggttagggtactgattgtacaattgctcggacaccgtcagttccagaacagcgtcacctaaaaattcaagacgctcattgtctgcatgctgactgaaccgatgttcgtttacgtaggaagcgtgcgtaaaggcctgcttcagaagctgccgattgttgaattgaatatgaagtttctgctgtaattgcttcaagtctccactcaacgaactgaccccttatgcttcatatttttttagaataaccgtagcattgtgaccgccaaaaccaaaggaattggacataaccacattcagttccgcttttctcggcttattaggtacataatcaagatcgcatgccgggtcttgattatccaaattaatcgttggcggaatcgtctgatgctgaagggcgagaccacagatcacggcttcaacgccgcccgctgcacccaataaatgccctgtcatcgacttggttgagctgatcgctaccttataggcatgctctccaagcgttttcttaactgcttccgtttcggatttatcaccgactggtgtagatgtaccatgtgcattgatataatcaatctcttcaggattcaatccagcatcacggatcgccattctaatgcagcgtgccgctccctctggatcaggctccgtcatatgatgggcatcgccagaaagaccgtagccaatcacttcaccgtaaatacgcgcaccacgcttcaaagcatgatccaacgattccagaataagaacaccagagccttcgcccataacaaacccgtctctttcggtatcaaaaggacgacttgccttttgaggctcgtcattacgcgtggacatcgctcgcatggaacaaaatccagccataccaatcggacgaatagtggcctcagctcctccgcaaatcatggcgtctgcgtcaccgcgctgaatcatgcggaaggaatcgccaatagcatgactgcccgtggcacatgccgtaactggtgatgtattagggcctttagcaccgagtgaaatcgatacttgaccggaacccatattagcaatcatcatcgggatgaagaaagggcttacgcgtttaggtcctttttcaatcagtgcgttgtgctgatcttcccaagttcccaatccgccaataccggaaccgacagatacaccaacacgctcagcgtccgcattttctccgattacaagtccgctgtcctcaagcgccaacttactagcagcaaccgcaaactgcacaaagcggtccattttacgcgcatccttacgttcaatataatcctctggattaaaatctttaatggaagcggctattttcgtagtgtactcacttgtatcgaaagcttcgatttcactgacgccggattttccagccatcagattatcccatagtgtgttcaaatcctgtcccagcgaagtgattacacccattcctgttatgacaacacgttgtttcaaagataatcacctctatgtctactgcatattgtattttaagaccgcacactcttgtgcgtaaaaataatatagaatcaactaaagttagtaatgccgcatacttctcagcctttgactaagtgaagctgagccaaactcaaaaacacgcggcaattccgtctttagttcaatctgtataattaggagaaagtcccgcctgtaacagaacgggacttttgatgacatgaattaggtatgagattgtatgtacttcacaacttcacctacagttgtaattttctctgcatcttcatcagagatttccatatcaaactcatcttccaattccattaccaattcaactacatcgagagaatcagcgcctaaatcatctttaaaagatgcttcaagtgtaacttcggcttcgtcggctcccaaacggtcaacgacaatgcgttttacgcgctccaatacatcggacatccggctcacctcctcttaggtattatacgaaaattacaattaaaatgccatagaagagagttttcattgacaactcttcatcggggcatgcggattggcaacatgctactacatatacatgccgccatccacatgcaaagtctggcccgtcatatatgaggaagcatccgaggccaagaacagcaccacgtcagcaatttcctcaggccgtccaagacgggccagcggtataccgctaagcatattgtcacgcaaatcatcagccagtacctgtgtcatctcagtatcgatgaatccaggagccacacagttcactgtaatacctctcgacgcaagctcccgagcagaggatttggtaagaccaattacccctgctttagcagcaacgtagttggcttgtcctgcgttgccaagtacaccgaccacggaggagatattgataattcggccagaacgctgcttcatcattggacgtgttgccgccttaagacaattaaacacacccttcagattcgtttcgatcacctgatcgaattcctcttccttcatgcgcatgattaaattatctcttgttatgccggcattattcaccaggatgtcaatcttgccccaagcgccaatcacatccttgatcaactgatctgcttcgtcagcgcgaccgacattagcctgaactgtaatagcctctacacctttggcacgaatctgctctgctacctcagtcgcagccgcttcactaccagcatagtttactgccacattagcgcctgcttcagccagcgccagcgcgatactacggccaattccgcgcgacgctcccgtaacgagcgccgtttttccactcaatggcttagacatcatagtccccccttgcaagtatataacccgttaaggcaatgattatacttttaacgggcctccaaggcttccgttacagaagcaaacgactccaggctacttatattatacagcttaaccgttttgtcgatttttttaaccagtccagtcaaaacacttcccggtccaaactcaacaaaggtgtcaacaccttgttctagtagccatgttacactgtcttcccacagtaccggagaatagacctgatccaccaacagttggcggatttcgctcccctcacgtacaggtttagctgttacattggcaacaactggaatctgagctttggagaaatttacagcccccaacttgccggagagcttggtcgctgcttccttcatcaatgacgagtggaaaggaccgctaacctccagagtaatagcgcgcttgcctcctgcttccttcacacgttcagcgacagcagctacgccctccttcgtaccagatacaacaatttgtccgggacaattgatgttggctagttcgaccagttgaccagactccgtaatatcacggcacaatgctgccaatgcttcacgatcagctcccaacacagcagccatcccgccttgcccatcaggaatggcctgctccatgaactcgccacgtgtacgaacgatctcaaccgcatcctcaaatgcgaggacaccggaagcgactagcgcgctgtattctcctagactgtgtccagccacataatcgggatgaacgcccattttttccttgaacgcttcatacaacgcaatgctcgccgttaacagtgcaggctgcgtattggatgtttgcttcaaagctgtgtccggcccttcaaaaatcagtgcgcttagtgcgaaccctaaccgttcgtccgcttggcgaaatacttctgttgcagctggaactgcttcataagcatctttagccatacctacagcttgtgaaccctgaccgggaaatataaatgccgttttgcccatcttgtatgcacctctctgtatccaatgcttgtcctgtaaaacactacacaaattcaatattatatcgaaaattccaactaattaccagacaagaaccgacgctccccaggtcaagccaccgccaaagcccaccattaatacacggtcgccttccttcatgcggccttcctcagctgcttccacaagagcgagagggattgatgctgcagatgtattcgcatatttatgaacattaacaactaccttttcctctggtaaatccagacgttgcatcgccgattggatgatgcgaatattggcttgatgcggaacgaacagatcaatatcatctttggacagccctgctttttccaacacatcaaccgttgccgttcccataacacgaaccgcgaacttgaacacttcgcgtccgttcatgtaaatatagtgctgtttattttccagtgtgtctgcactcgcaggcaaacgcgagcctccggcttccaacttgagtaagctgcctccggcaccttcagccccgagatcaaaggattggaatcctctaccttcaggcacttcgccaatcactacagctcctgcaccatctccgaatagaacacaggtattgcggtcggtataatctgtaatccgagaaagacagtctgccccaatgattaatgcattattataaatacctgtcttaatgaagctcgttgccgtagccagtccgtatacaaaacccgagcatgccgcagacaaatcgaaagctgctgcgcctttggctcccaatttgtcctgaagaatgcaggcagttgacggaaacgccatatccggtgtaaccgtagctacaataattaaatccagatcctgtgccgtcatacccgcggactccaacgccttaattgctgcttcataagctaaatcagatgtagcctgttctggagccgcaatatggcgctcctgaatccctgtacggctgacaatccattcatcactcgtttctacgattgcttccaaatctttattggtcagaattttctcaggtacgtatttccctgttccgataacaccaaccggccgtaatttattcatatcgtcactcacttcctgctgatttccttggatatactttccaccaaccggttttgcaaggccgtacgagcctgccttaccgcgtttttgacggcaacgccgtcagacgaaccgtgacttttcaggacgagtccactcaaacccagcaaaggagccccgccatgctctttataatccaatttacctttcagactgcgaagctcaggcataatcaaggctgccgcaagcttggtcttcaaggatttggtgaattgctcttttaagagagaaaatatggctccggctgtaccctccagtgattttagcatgatatttccagcaaatccatcacacaccagtacatcgcaatttccggttaacacatctctcgattcaacattacccacaaaattgacaggtaactgctcaataagtggaaatgccaacttcgtcagttcattgcccttcccagcttcagtccccacattcagcagacccacccttggagaagtcacaccgtgaactttctgacgatacaagctccccatcagtgcatactgggcaagatgctcaggcttggcatccatattggctcccaagtcaagcgccagaataccctgatcatcaatcgttggtatcatcggcgcgagagccggacgttcaatgccttccattcttccaaccaccagcaaccctgtggtcattagcgcgcctgtattacctgcggatatcatggcatccgcttcgccttctctgaccattcgaccagccacgaccatcgaagcatcctttttacggcgcactgcctttacaggctcgtcctgtgcatctatcgtttcggatgcatggcgaatgctgaggttcgtcggcaacgccctaccgttcagaaccgattcaattcgttcccggtcaccaaccagcgtaatgtccgtatccttccattccgccgccgcagatagcgcgccctctactgtcgcctcaggagcattatctccccccatggcatcaatggcgatccgcatgctgacttcctccttcgctatactcttcctccgtggagcgataaatgacaaagttgccttggaacaccatttcttctcctacgtaggcaaagacttccactttagccttccctttttgttctggattggaacgtacatatgccttggcaatgcacttctcacctaaatgaaccgggcggacaaagcgtatatccgctgacgcggtcaatgctatctcatcattaatcacagcaacggccaatgaattggcctgggcaaatacataatgcccccgcgcaatgccagtacgcgaaaaaatatgttcctctttaatttcaaaaatcgaaataccgcttcgatccaactgtagatcaacgatatccccgatcacttcatgcaaaggcaaggaacgaacctggtcgtaggagcgctcagccatcagctttagccgttcccgcaattccgggattcccagctccatccggtccagccgaatagtctgaatacttaccttcagctgtcttgtcaattcctgatccgttacgaacggattatcatcaattaattgagtcagccgctgctgtctctgtctcttcggcaaacgttcgatgtcaatgaggcctcctttctctacaataaactgtcgttcagacgacagtttgggttactttacttcactttctaacggcggacttcaagccgatttgtcttcttgtatgtataaaggaaccccttcggcccttctttcttagaacctggtactaaaacagtatatagcatgctgacgtaaaaaggaagcatgcagacaaaaaaagtagcgcctcactgaagtgaagcgctactctttctgcgaagattccaaagaatccgcttatcggacattattgagagatgatctctctagctttgtacgttccgcaaactttgcacacatggtgagcaagtttcaattcgccgcattcggagcatttcaccatacctggtactgccagtttaaagtgagtacgacgtttgtcgcgacgagttttggatgttctccgttgaggtactgccattcttcccacctccttaaccagatcaaccccgcataacgggtatgacttcttatctcattcaagactgaaagtaaatgctagaagcaattatcttacagccggtgaatcaagcctgcaacatccacgcatcggttcagtaactctccggcacaagcggatgatgatttttcagaattgaactcaattctcatttaaaaaaatccttaagccctgccagacgcggatcaatcttttccgtattgccatcgctactgtcatcggagccaatactccagttttgtccggtctttggtgcgattccctgacaatcctcactgcacaaaggcgcaaacggcacatgcagtacaaacagttcttcacaatacggtgcaatgtcgaaggagtcctccgtcactgcgataaaatcgccatcttcatcctcctcttcaacactcgaagaggtttgcttgaaccgttcacggaattcaatctttaaatcctcgtgcatcgggcttaaacagcgtgagcacagcatgtccagacctgcggtcaacgtgccttccacgctcatcaaaccttgacccagactaacggcgaccaagtcggtctccagcggggaaacggccgtaacatcagcacgatcatccaccaattcactcacattaagagattcacggataggaaaaggaccgtcacttgttgctactttgcgaaaaaatagttgcatcactatcactccaaacaaacaaaaattattataccgactgatcgagtcgtttgtcaacacctttcactttacaccactcacaaatccaccggttttccaatggttcgacaagttttatgcagaagcaaaaatgcattgtgctaaacatgtactgatgagtattcgtacccccgccactcttcgtgtacaataatgcgagtataaagctttttcgtccaggtctcaatggtcttgttcatgccgacgatgaaaaatcagtatagctgccctgaaaacaatcattgacgggtacttaaccattattatcaaaagagttacccaataagctactttaagaaaggagccgactacagtcttgaaaacactcggtatgattgtagagtacaatcccctgcataacggacatatccatcactgggaggaatctcttcgcatcactggtgcacaacgcacagtggctgtgatgagtggtcctttccttcagcggggtgaacccgcgattacagacaaatggtcccgcaccgaaatggcactcgccatgggtgtggacctagttctggagctgcctgtggcctatgccgtccagcccgcagaatggtttgcccgcggagcggtcgccctgctccatgcgacgggcatcgtcgacgcgctctgcttcggcagcggggcg

SEQ ID NO: 2613 - DNA, 12197 bp, Unknown
  Kingdom: Bacteria, Phylum: Firmicutes, Class: Bacilli, Order: Bacillales, Family: Paenibacillaceae, Genus: Paenibacillus
cacaaacgggggtcagttccctatacagggttccagctttttatttacctgatatttaaaaaaaacggtcaaaaaataaattttaaaataacttctttaaggaggatggcttcactccgtattcccggaaaaattgctctgaaaatgcactcacattgctatatcctacagccatcgcagcttcagtcacattgctttcttggcttcggagcagcttcatcgcataatcgagacgaatttggcgcaaatattcaaatacagtagttccaaagcaggctttgaatcctttttttaatttaaaatcgtttaatccaaccttttgggataatgtgatcagcgagggtggatcaatcatgctggattcaaggatctcccgagccatatgcagctttctgacatcttctttagacaaaccttcgggcataggtgttaaatcaaataattgaatcataaatcgatttaaaatctcaagtgccgctgcttccattaacaaaggcgatttatgcacacttttcaagtctttgatcaaatgttcaatcatcactatacttctgtgatccagttcaaaactaaagtgatggaatgcagctcccttaagaatttgattaaattctatagctacctgccgacgagccgctaactgtgaagccgcataattaaacaacaaaacaggaatgccaagtgcaaatgattggtattgttcgttaaccggaggatggaaacatgctttgaaatcctgtaaaaaaataagagccccctgccccatcgggagtgtataatccagaccagccacattcacatgacgttgaccggaaagcgcaaattgaagttcaatcatttgtcctctggaagaaaaattggtcggatacggctcgtgatattgaatgtgcgaatatacaatctcaattccgctgtaagttgtaactcggtaaatatgcccatgacccgcttccggtaacatcatatacgtatgctcattctgttgtctaaacggagttttttccaaataatgctgatatattaatgataaagagtttaaattcacaatcgtccacctcaaatgttttcattctgatgctccaaatgagaatcgttatcaataatagtagccgaatttgaatggtttgaccagacctattggagtaagctgtggagacattcgggggtgtattaatcccaatccatataaaacgttgccttcaatttacccttctcacatgttgggcagcttaaatgatgaggagcattgttttcaatgtgtttctgttccatgacactcgtacatctaggacaagcataagaactcctatactgtgatgagtcggatttcatctctataaacaattcattgcgcatagcctgacaggtcggacacacatatagagcgttataagcatcatatctcgtcgaagggttgcctatgaattcctcaatacgtcgtttaaggacagtatcctgtacaaacgaagcaatggaaaagtttcgattatggataatgactctcattcataaatccagcgttcaatgatcccctttactctttgcacatgttgctgtgataaggaacaaataataaccaattcgtttttcccattcgtatctaaccaatggtgaacgtcatcctcttcattaaccgtttcatgaatgattctgatggatttatgacttatttctgacttagccgaaaaaatggggttcatatccatgattttctgaccattagaaaaggaggtgttgtaataaggaatcacccagttctccttatcctgatcttgtactacatttagaaatacacgcacccaataatcctctagttctgtgtaactctgttcattcaacccattcaaattcatacatgtatccactccaagttattcattaaataaacgtaaaaaattctcggccagtgatctacatttccatgacggaatgcacaattcacagaccgagacttctttttcattctttattttacatcaacatcatttgtgattttctctattaaacttctcaaaccttggttggtttcatttaattgatcgataatattcataaactccgacacaagcttggcctgctcttgggaagatacagtaatctgcgtaatctcttgttccatgttataaacggattgtctgacagcttgcaaggattgctcgattcgtccagttgcttccttggtgcccgtagacatcttgcggatttctgcagcgacaactccaaaccctgctcctgcctcacccacccgagcagcttcaatggctgcatttaatccaagcaagtttgtctgctctgaaatatccttgatgtagcctgccacctcagtcacattaccagagtcctcaaccgcctttttcgtattgcttaaaatgtcctcggccgtcgcactaagctcctccgaatgagccgccacatgctgaatcccttcaactagcttgcttgtaacatcctctgcttgactcatcaacttcttcaattgatcttgatcatccatactataggtgatgcacattactgcctcgatctcattctgttcattcttaatcggatgaaagtaagcatcggcagcaaacccgaaaacttcggcatcataacgcactctggtcttttctccgcctactagcattttgaagttcttgtgtacatcaggaagagcttcgcctgccttgaagtcatagactaaacttttacccgactgaaagaatagaaatttttcccgatccattacggaaattaaaacatcttgtcgtgcagcttctttgataaatggcatggcggccaaaacagcttctacttgattcataatatgtatccacttccttatattttgatataagtcctatcctctatttcgacattttcatcccatgtgtttagtgaatttaaaagatgttgagtccctaacctataaacaatctccgtagtttcctgaagggaatccatttttgtggccgggatacatatccattcaaggtattgctttcatgtcaaaatgtaaattcaaacagcgcgtaccgattaaaatgggcacgcgctgacggtatgacttttatgaaacaggcactaaaattaatccagctgctctccattggtttcgatcacattcttataccaataaaagctcttctttctggatctagcaagtgtccctttgccttcattatccttatcgacgtatataaacccataacgctttttcatttcaccggttcccgcacttactagatcaatacatccccaaggcgtataacctattaggtctactccatcagcaatcgcttctttcatttgctcaatgtgttgcttcagataatcaattcgataatcatcgtgaatggagccgtcttcttccactgtatctacggcgccaaggccattttcaacaaccattaacgggatttcatatcggttataaatgtgattgagggaccatctcaatccctgtggatcgatctgccaatcccaggcacttgctttcaaatgaggattctttaagcccatagataaattccctcccaccttctcctggttaggatcggcactgacacaagtagaggaataatagctgaaggtatagaaatctacgcagccttcttttaagatgtcctcatcctcttcttgcattttgatctgaatgttatgatctctaaaatagcgtttggcaaatcccggataagctcctcttacttgaacatctgagcataggaaattgcttaagttatccttttgttgggccagtagaatatcatcaggatgacatgtaagtgggtaggaacacatataagcaatcatacaaccgattttaaagtccttgttgatttcatgacccagctttacagcctttgcactggcaataaattgatgatgcaacgcctgatacagaacctgctcatccttcactgtagcatgggcaagctctccattcccctccggcatcatagctccagccatgaacgcgccaaatgacaaggttaaaatattgatttcattaaaagttaaccagtattttacgacatctttgtatctattaaaaagcacttcacaatatctcacataaaaatctacgactctgcgatctgaccagccattatatttttgggtcaaatgaaacggtgcttcataatgtgagatcgtaaccaaaggctcaatattatactttttcaattctgcgaatacacgatcatagaactgcaagccttgctcatttggctctgcatcatctccgttaggaaatattcttgaccacgcaatggacattctaaagaccttgaatcccatttccgcaaataagcggatatcctcttgatagcggtggaaaaattcaatagcttcgtgactcggatagttcaccccttcttccagtataggtgtaattcttcgggaagtcgtatgcgttccagccgtaatcacatcagcagtgcttaagcctttaccttcttcattatatccaccttcaaattggttggcagccgttgcacctccccataaaaatccttgtggaaattccaatttagttgtatttttcattgtttaattcctcctcaacatttaattaagatcagactacgacggtcaataaatcctcttgatactcaatcgccttcttctctgtttcaatgacatccaggtaattcgtagtattggcaacgataacaggtgtggtcaaaacataaccagcctcttttatagcttccatatcaaactccataagcagctggccttttttaacagcatctccctgttttactttaggataaaaatgtttgccttttaatttgaccgtatctttgcctacatggatgaggacctcaacaccgtggtcacttgtaattccaatcgcatgacctgacgaaaataatgatgttaatacaccatctacaggtgaaacgaccttaccttcagaaggttcaatggcaatccctttacccagagcacctgtcgaaaaggcttcatctgttacttcagataaagacttcacttcaccttttaatggactcatcaccgtctcttgttttactaaaacttctcctttggctgctcctggtgcgctgtcttccttttttgcttctttcacttcatcatctttaaatccgccaaagaacataagcaagaaacctaatacaaagcttaccaggataccgataacagccccataaaatccgttgtctattcctgccggactgatatagctcgggatagcgaaaatacccaatccaccaataatgtagcctttagttcccatcattcctataataccgccgcctactgcagatgctatacagcttaaaataaatggtttcttacgtggtaatgtaatcccgtaaatcgctggttctgtcacaccaaaaatcccggagatgacggctggaatggaaagtgatctcagttttacatttttggttttaaacaaaatcgccagtacgacgcctgtctgagcaaaggaagctcccagcgtagccgcaagaatcggatcgaatttaagcactgctaagttgttcatagcgataggaacaagtccccagtgtaatccaaagataacaaacacttgccagaaagcgcccatgattatgccttcaataattggacttaagttatacacaaagagggttgctgccccaagcagttgacctgcccaagtcgagagaggtccaatcacaatcaatgctaagggtacaataactaacaatgtgaaaaacggaaccaaaaatgttctcactacgctagggattacctttttaaagaagttttctatttttgagcctacataggtggatatgataatcggaagaacggttgacgcataactcatcagaatgaccggaatacctaagaaagtgatatataccggtgactcaaatatagtcccgctaaatagagtgtatagtggcttgcccgaagctgttatcgtgctaaatgtcggatatacaagtgatgcacctatagccatacctataaaaatgttggcattgaactttttagctgacgtataccccaggaaaataggaaagaagtaaaacaaacaatcacctaaagcattgagaatttgataggtacccgatgtagtggccagccagcccaaagctacaaatagggcagtgaagcccttaatcatacccgtggcacttaagacacccaacgtgggtgtaaatacacctgaaatggtatcaatgaatctattgaacaaactcgctttttcacctgaggcttcttctgaatctcctgtctgaaaaccgcctacagcagtaacatcagcataaacctcaggtacatggttacctataacaacctggtattgcccgccactctttaccacagtgacaacaccatccatatttttcaaaacctctgtattggctttactttcatcttttagtttgaagcgcaagcgtgtaatacaatgagttagactattcacattttctttgccgccgacatttctgatgatgtcttttgctaatgtctcatacttcattgtaacttcccctttatttgtatttataaaaaaaggcgaaaccaaatagatcaaattcgatctaggttggtttcgcctgcattaccagtaacaatccaagggttattcaattttgtctttgggtcacacgctgaatatgaatcgttatatacagcttctcctcatctgacaataccgtatccaagtatttctcaatcttcagcatgcacccataggcctttttgtactttgctttcacttgcctccacaaaaaatcgtcttccagttctactttttcttttttatttaatcgctgaaagaagaatcttaaatgtgtaataaatcgctcataactgatcgagtgttcatctatggtggtattataagagtatttaataatattcaagatgtcgtgtattttttgagtttgctgagcaacgtctgctaccttgttgtaggagccgtttacttgagcgttgattaaatgaagagcaatattacctgcttcatcttctgacaatcgtttgtctgtttcttcttcaataaactccagtgcttttaagccaaccgcaaattctttgggataaaattttttaatctcccaaattaacggatttgcatttttaaacccttcatcaaacattttaaatgcattgttcatgtgatccgtaagcgaaacatatatataatcgctcaattgtgcttctaatatgctttttccatattcaatgatgtcatagcataacgaaacatattctgatggaacatcctctaacaataacttgaatttctctgaagcatctttatgtttaagcacaaagaccttttcaattagatgctcttctacttgttcgcctgtactctttttgaatgcaataccacgacccataacaacaaattcatctcttttttgatctttggctattatggcgttgttattaaatatcttcgttatgatcatctaactgccccccttatcccatcaaatttaaaaaaggatttagatgctgggcgaaatttcagataggtcacaagacggtaatagccgatcaaatcttcgtcgtaaatcaaattcaaatgtattgatttacaactttatgttatgaaaacgcattcataataagagacaaaagccttacgttttccatcattgatctttagtgctcccaaaccgatctgatattccgttctgaaaatggatatagtcggttaaccacgtcccatgacatcatttttcggatgtcgattcgttggtcgacgtcatcatctttgttgttcagcacttgtaaggctttatatcactcacctttctgcgttatggctgggcagatattcatatcatgcaggatatcgtaaagcttgtattctaaaaagaaaaggcaaaacccaacacatggaaatctaattccatgcctcgggttttgccttttcagtaacaatcccaaaatcataataacatcgaatttaagttttgccaacaaaaatgtttgcgctttcttttccggagcaaccacatcaaatacagcacattattatggtataaaatgtcatccaccaatgtaggacatgttaatcttttttttgttgttggctgtctgctccgtacgttcatcggaataccgatctgtacgttgttcccatactgaagtaatcacatcgagcaattcctggtcattcgccccgttgcgaagcatctggcgtaaatcaaatccgcctgaagcaaacaaacatgtataaaacctgccatcgcacgataagcgggcacgtgtacaagacgaacaaaacgattcagaaaccgaagtaataaaaccaatctgtgcgtcgctgtctttataacgataacgctttgccacttctccaaagtaatcccgatccatcggctccagctcgtacgcattcttaagtcgttcaacgatttcttttttggttagtacctttttgaagctccatccgttgtcattccctacatccataaactcgataaagcgaagggttattccctgctccttaaaataagcagccatcggcaaaatctccgagtcattaacacctttttgaactaccatattgatcttgatttcaaagccaatttctcttgcatattcgatctgcttcaaaataacatcaggcttaatcccccggccattcaaccgcccaaatagctcggggtcgagagcgtccagactgacattaagccgtcgtagccccgcgtcatagagaggcttagcctgctgtcctagcagcacaccgttggtggtcaagccgacatcttccactccgtcaatggacaggatttgggagaccaggtcggatagattcctgcgcattaatggttcaccgcccgtgagtcggatcttttttacgcccagggatacaaagagcttcgtcagccggtgaatctcttcaaacgacagacattcattttggggaagaaaggcgtaatcgtcaccgaaaatttctttaggcatgcaataggaacagcggaaattgcagcggtctgtaaccgatatacgcaggtcacgaatgggccgctgcaacttgtctttcagtggatgaaaattcatacgccccctcctttctagttgtttagcatcgttatcgttatcattagccgccgctgactgggggaatgaaggctgcaatgtctccatcctgtaatacatccgtagacaacgcatactcttcgtttatcgcaattcgcacagactggattggcatatctggatattgatctgttatccaattggataactcgcctaccgtttggcccgccaaatctgccaattcttctgtttttcccgtcacctcacggagtcccgcaaagtagtacagcttaatcatgactgatctcccccggctttttcttttgacctccgacccactgcgttccatcttcccaaatctctcgtttccaaataggaactatttctttaattcgttcgatcgcgtattcatttgcctcatacgcatccgaacggtgaggtgaagaaacggcaatgacaacggcgatatcaccgatttgaagctcgccaatgcggtgcgcgattgctactcgcgtcccttcccatttctgttcgatttcgcgaccaatctctgtgagttttttttgggccatggggacataggcctcataagcaaggtataaggtccgtacgccttgagtccattctcgtacgtgccctgtaaaaatagtcaccgctcctgcttccggccttaggacataatccgcataagcctgcgggataatgggctccgttacgatttcaaatacactcattttttccaccttccagccaccggacaagccactttccggtgacagactcttttaaatgtttctgctttttgtatctacatctcatttaaccgaacagctgatgatatagtttttgaccgttggcaacactccgtacatcgtgtatgagaagccttccgtttttgaataaaatcattcgatgcttaaaagcataaaattcaacgaaataaggggttctttttacacgatctgctataagcctgcccattttctctgcatcatcgagcgtaatcggacgttgtgggtctggaagaacctggaccacgttccgtccgcacagagccgcatacgccgagcggcgtggtgctgtcagtgcaggaaacgtaggatgttctccacaggttggacaatcttggttacggatgcgggaaatccctatgtccatctgcgtattctcccatagatcaaatagatgaaccttgcggcgcatcttatcacgtctgccgctcagccacttcatggcttctgcacattggagggcagctgtcacctggactgcgggtgagatgattccagccgtatcgcaggtctgattgatcgcaggcaacgatggcagaaggcagcgtaaacaagcagactctcccggcacgaatggaaaaacaacgcctgtgcttccaacacaggctccgtaaatccatggaattcctatcttcagtgcagcatcgttgataagtagacgagtttcgaaattgtccgtagcatccatcagcaatatacttttgctggcaagttcttgaacaagctcggcatccaagttatcgagatatgtgtgcaaccgcacgtcttctcgtatggctttcagccttttttcagctgccataaccttgggctgcatttccgcggcgtcctgctccgtaaacaactgctgacgttgcagattcgacacctctacataatcccggtcaacaagatgcagctctccaacgcccgctcttaccaatgtttcggcaatggcggaacccagtgccccgcaaccgataatggtgacgacagcagcggatagattacgctgcccttcgccaccaatgggtctaaataagatctgtctggaataacgttcattcattagattgtgtcccttgataatacagccatatgacgaggatcaggctagccagcgccacttgggagaggagcatgaatccaatggaatattggccagtagcggcatgaatcgtcgataacaggatcggagggaaaaagccaccgagaccgcccatcatggatacaattccgttaactatacctgcttgtttattaaaataaaatggaactagcttgaaaatgacaccgttccccactccagcacttacagcgatcgccaagcagcctactgtatacagggtaatccctggtgaaaaagccaaaagaatcgcagcgaccgtataaactgtgaacgtgcctaccagcaggaacaggggctgaaaccgatccgccagccagccaccgatgggacggaagaatgtggcaatcgcaataaagcctgctgtacgcatccctgcatccactttagccagctcaaaattcgataccaggaaattcggcaagtacaccgtgaacgctacaaatgagccaaaagtaataaaataaaagagcgagaaaaaccaaagcttttcatttttgtaaacccctttgatctgttccataataggcgtctttactttagcttcatgacgatcccctaagaagaaattcaaaacgataaaaacaagcagcagaatgagatacagcttcactgtaagggcccagccaatttgtgtagccacaataggggccgagaaggtagtgacggctgttcccaaattccctataccatacattccatttacaaacccatgtttttcctttggataatacttcggtagcgaagtcaccccaaccgagaacacagctcctccaatcccaaggaacaagccaccgataattaaatccgtcatcgtagaagcttcactaatgtagtagacgggaaacaaaagcaaaataaagctaacgagaaaaacgattcttgctccaacgatgttggcataataaccaagcggaatgcgcagaatcgatccaagcacgaccggaatcgccgtaaccatggccaattttccgggtggaatagcaatatcctccgtaatgaacggcataagagaagaaatgataacccataccatgaatccaagaatcaagttcaatgtttgtagcggcaattgcatttttctgatcatttaactcaccttttcaacgttttttctgtcgaattattgatttgaatttatgtccccattgtagccgctagttgatctgttcgaatataggggactcccctttacctgacaggggactccctgaaaatataaaaagccgcttctataagaagggaactgaccccataacgtgagacaaatcaaaacaccttcaagagaatcaagtcatgtcgtaaga

SEQ ID NO: 2614 - DNA, 3890 bp, Unknown
  Kingdom: Bacteria, Phylum: Firmicutes, Class: Bacilli, Order: Bacillales, Family: Paenibacillaceae, Genus: Paenibacillus
ctgttccagtgcgctgatggggaccatctgctactggctattcatcatatggtggtagacggcgtatcgtggcggatactgttggaggatttgtcgaatgcctatgagcaggctgtacgtggagaagccatacagctcccggccaaaacagactctttccgggtctggtcggagcggttatcagcctatgctgacagtcctgagatggaaagtgagcacgcatactgggagcaagtgaataaattggcggcatccgagtctttaagacttacagaattgttggattctaaaaaaacattgaccataaataacacagctactttgagcttgaaattcacgaaagaagagactgatcaactgctaaagcaggctcatcgcgcgtacaacacagaagtgaacgatctgttgctgacggcgctcggcatgacgttaagcacttggactggcagtgatcaggttgcaattcttctggaaggccatggccgggaagatatcatgaaggatacggatatatcacgaacggttggctggttcacgagccagtacccgatactgctgcggattaatggggaagatcatatctccgggcacatcaaacggatgaaggagatgctgcgcagcattccacataaagggataggatatggcatctggagatatctcagccagaacggaccgtccggggcaacatacgccgagccacagatcagctttaattatttgggtgaatttgatcagacgctacggcacagcgaaacgcgcatgtcaccgtactccagtggagcagatgttaacgaactgaccagaatgccgtgttccctggatgtggggggcattgtaacggatgaaatgcttgagctggatattcgttataacacaaaagtgttacaggaagataatgtgataaaactagccagggagctcaagcagaacgtgttggaagtgatccgccactgtgtatcacaggagcattctgaattgacgccgagtgatgtgctgcttccgggtttaagcctggaagcactggaccggatggtggcgcagattcagcctgacggagaactggagaatatatatcccatgacgccgatgcaaaaaggaatgctgttccacaacatgctggattcccagtcgagcgcctatgtagagcagtccacctttgaactgaagggaacgctggatctcgtagcgtttgctgccagtctggacttgttggtacagcatcattcagcactgcggaccaacttccggagcgatttgcaggacgagcccttgcaagtggtgtaccggaataaacgcggagaactgtacgtagaggacatacgtgagaaggagaaggtggcgcaagagcaatatatcgaggaattcgcgcgtcgggataagcagaaggggtttgatctggcaaaggatacactaatgcgggtatccatcttgcgtacatcagacgatgcataccattttgtatggagcttccaccatatcataatggatggctggtgtttgtcgctggttaccaacgaagtctttggaggatataccgcccttacagaagggaagccaccgcaattgcctgtggtaacaccatatagccgatacatcgaatggctggaagggcagaatcgtcaggaagcggcggagtattggagcggttacctgcagggccatgaggagactacagttttgccccaggccaaaacagggaaagcgaagggatatgaggccaaatatctggaatttaatttgggtatagacctgacaacggccctgctgcaactggcaaagcaagaacaggtaacgataaatacgctgatgcaaacggcctggggcgttttgttgcaaaagtataatcgcacagaggatgtcgttttcgggagcgtggtatctggacgtccagcggacattgccggagtagagcagatgattggactattcattaatacaatcccagtccgtgttcaaggtaaaccaacaactgcatttactgaattaatgaaggaaactcagcgacaggcgctttctgccaatgcctatgacacgttcccgctgtatgaaattcaggcactgaccgaacagaagcaggatctaatcaagcacattatgatattcgaaaattatccggtggagcagcaggtagagcagctgggaagtgatgggcagaatgtattcacaattttaaacgcggtggctacagagcaaaccaactacgatctgaacgtcgtcgtaatgccgggagaaggcataaatattcgttttatgtataacgcattgagctttgatcaaaccggcattgagcgtctgcatggtcattttgctcgtctgctggagcaaatttcgttcaacccgcatgttcgcgttgaagaactggaattggtgacaacggcggaaagacaacagattacaggcgagtttaacgacacggcttctgtatatccgcgcaatcagacgatccaaaagctgtttgaggagcaggctgcgcgtacgcctgatcatattgctgtagctttggggcatcaatctctaacctatcgggaactgaatgagaaggctaaccgaatagcacatacactacagactgctggaatgaaggccaatgagactgtcggcattctaacggagcgttcgttggatatgattagcggaacgttggctattttgaaggctggaggcgcgtatgtgccgatagatcctcaatatccggaggaccgtatccgctatatgctggaggactcgggagccaaactgctgctgactcaacaagatttactggaacgttgctattttgatggacagattgtcaatctgaatgaggatacgtcctacagtccagatacttccaatttaggaatagatggatcaggcgaacatgctgcttatgtcatctatacctcgggatcaacaggcaagcctaagggcgtcgttgttgagcatcaaagtgtcgtgcgcttggtgcgtaatacggattatgtgccgttcgatgaatcgatccgaatgttgcagacttgcgcgtttgtatttgatgtgtctacgtttgaaatttggggggcgttactgaacggcggtgagcttgtactcgtgcataaggatgatcttttggacgtagctaagctcaaggagaccatacgagaccatcgcattactatgatgtggctgactacaccgctatttaatcagctttcgcagcaggacagtaaattgttcggagatgtgaagtatttgctggtcggaggcgatgtgctgtctgcaccgcatatcaatcgggtgctgcgtgataatccggacatgaatatcattaacggctatggaccaacggaaaatactactttttcgacgacttatcatattaaagaagaacagcttgattctgtgccgatcgggcgtcctatccgcaattcgacggcgtatgtggtcgattcggcgtttaacctgcagccgattggagcatggggtgagctggttgttggcggagacggagttgcacgcggttacctgaaccgtcctgatttgacggctgagagattccttgccaatccgtgggtggacggagatcgcctgtactgcacgggagaccttgttcgctggcgtgaagacggtacattagaatacgctggacggatggatcaacaagttaaaattcgcggctaccgaattgagctgggcgaggtcgagtcggctatgctgaaaatagatcgtatccaagaggtcagcgtactggcccatgcaaacagccaaaaccaacacgaactggttgcctactacgtggcggaacgggaagtaacggggggcgagcttcgcaagcagctgagtgaagagcttccaaattatatggttccctcgtactttgttcagttggagcaaatgccgctcacacccaacggcaaaatcgaccgtaa

SEQ ID NO: 2615 - DNA, 96163 bp, Unknown
  Kingdom: Bacteria, Phylum: Firmicutes, Class: Bacilli, Order: Bacillales, Family: Paenibacillaceae, Genus: Paenibacillus
atcctaagaataaaacgcaatgagtttcggatccagttttcagggtgtaaccttgaatgtagaatttacgatgtaaattcatgtttggtggcgatagcggaggggttccacacgtacccatcccgaacacgaccgttaagccctccagcgccgatggtacttggaccgcagggtcctgggagagtaggacgtcgccaagcaataagtaaagagaatcataatctcgttgagattatgattcttttttttgcatatacgtatattttagaaatatccttacaaaaggaaggtaacatttttgttacggaatgtaggagtaaaccctgtataatataggtattgaatcccatacacacacgctgcattattgcagaattatgcaaactccatcataggattttgtatagtcaatcaggctggtaaggagggaagatcatgcggcgaaataaatggcttgctctattggtgctattcagtgtcgctgtcgcgattcttaccgggtgcgtggaagaggagccttcttggacatcgtttgagggtgctgccaacgagaagacgtttccggttcctaaagaagctagtaaaaccgatcgggccagcagtaattcggacatggactatgttcgctatgcactgccagcgttgaaggaaagtgatagtctacctgctccttatctagaggagattgcagcttggggctggactgaggaaccgaatttatccacctcgaatcagaaggtgtttcagaaaaataagcatatggtgcatttgtctgtgcatgatggttcttttactgtattggttccaaaagacagaaaggctgttgtgaagagcaaaagcgtggatcttaattagggacacggttttcaaccgagtaagtagcataggatttattgtagatcatatttatagtaaactcagcatattgtatgctgtgtatcatgatgaatgaagagatcggatatggggaagcactcaggactgccgttgagtagggagtggcttccttttatatatttgcatgttgatcaaatgctctacatgaataacgaggataacgatgaggaaaagttacttgataagagaataaagcgattttaattgttaaaccataaaaaaaggagtaaccgtttgaggttgctccttttttattgcttcagtctagattgttgataggttagttcagacctgagttttctatctgtacggataatgagtggttaaatttactgttgataatatgaggcatcttcatcgctaaacttcaacatgccgtcttttctctcgcctgtaagccgactgaggatgtatagacgcggtgcaataagccacagatgccagaagagtaaggatacagtaaaggctggtggagaccagagaatgaacacggctgataagcagataccgatccagagggtatgtatgtgcacacgacgaaagatgctatagcctatgtactggtctgtcatatagcctagccaaggtaatttacggtggaatgcccagcgtttgcggaaggatgttccgccaccgatgtataggacagatcgtgagattacgaagtgtacccataaggttaggaaaaaggcaagagcaaacaaaaacacgctagtccaggaaaaggcaagaagcagaaagagaagcataataacaggcagtgtgatatgactccatattagttgacgcggtatactgatttttttaatgagcttgtagtgatagtaggtagctttggttccggtttcctctgtcatgcgaacagtcctttcattaatctactgcatcacaagtggcttcccgtccacagccggaaaaagggacggtacttcgctcatgccgctttaaataagcatttaatcgtttttgtagaaatacagaatgatcgacatccagtgttagctagcctactctataattactggaaaagctatcactgatgaagtgttcaagggctccgatgaaagggtatccatacataagagcttttcttattatatcggcatagacggctgttttttaaacatacggggtacaaacaccataatggcccagatggaatatatatagagtattatcgtcgaactgggctatgaaaaggtttaaaatagtagaaagtgccccatactaatagtaaaagaaacaaggtgggatggatatgcatgatcaaggcggccaccgctgtattatatgcgggcagcacaagcatgaaggcatttttatcgtttccgagtttatctgtgatacgtgtgaagctgaaatggtgcacacggatgcaactgatgccaaatatcatttttttattgatcaactaaagcaaatctgggtacagaaaaatgcataatatcctttgctaattagtctttgaaggattggcattctaaggtctgtcgatacgggcctttttttctgtgagtaaaagtaggattccgcttgattttacgataaaataaggtagatataaagctttgtttggaaggattgcagaatgatggggaaaaaggcggtacatgcaccattaatggaagctctaatacgttaccggactcagggcaatgcttctttccatgtacccggtcataaaaatggacaagtatatgagcatgaaaatattgcatctctgttgcaagaagtgatgtctattgatgcgacagaaattactggactggatgatttgcatcacccagaagatgtgattcgtgaagggcaagagctggctgcaaagtgctttggtgctgaagagagcttttggttaattggaggaagcacggtcggtaatttggctatgattttaactgtatgtacggagccgggagatctactgctggtacagagaaatgtacacaagtctgtcctgaacggtctcatgctgtcaggggctaatgcggtattcctagatccggaaatagatacacgaagcgggctggcagttgccccaacgacggatacaataaaagctgcactgaagtcctatccttcggctaaaggggtgttacttacactacctaattactatgggatggggcatgacctgaaggcaacggctaaggcctgtcatgcagcccatgtgccgctattgatagatgaggcacacggtgcccattatgggctgcatcctcgtttgccagcctctgcgctatcctgcggggctgatgtagtcgtccagtcgacacataaaatgcttccagccatgaccatgggggctatgttacatgtgcagggagagagaatccatcgggaactgcttcgtcagcgtttggcgatggtgcaaagctctagcccttcttatccgttaatggcttcactggatttggcaagatggtatatagaggcgtatggaacagatgcttttacagtgggcttagcggcggcagatgcttttagaaagggcctggagcacctccctcgctttcgcttgctagaacctacacagcaggcactagatggagaatacgctcacaggggaatctctgaggtcctagaaagggctgatgagggaataagcggatattcagcccaggatccttttaaattggtgctgtatgatacatggggtatactggatgggtttggactcaagcatgagttggagacttacggatgtgttccagagatgagcgacgaaaaacatgttgttttattgtttacgttaggctctacggctaaggatgcgagtcacctgttgcaggctcttgtgcatatagataatgatataagatttaaggagacggctggtgagccgggggcaacggaaaaagagcagcaaagattcgaattagatttttccacgtggaacaatgatagaatgaagggatactctagtccggtgccgtttgggcttcggccgattagcccgaatcagatggagaccgtgcctgtagacgaatccgctggcagggtagcggctgaaatgattatcccgtatcctccaggtattccactgctatatgcaggagagacgattacagaagcgattgcattgcggatgagtcgtctacgtgagctgggagccaagtggcacggggtagcagatgaaaatatgcttacaattcgggtattccgtttacaataaagattagatactagagacttaacaaatacagaagactgaataaaagaagcatacgtagcctatgggtgacttttatttttcaggcaggaaagcagggaataacatgaatcggaaaggcatttttatcacactggaggggggagacggctccggtaaaacaactatgattcaacggctggcgaagtttatggaggaagaaggctatccagtcatcacgacgagggagccgggtggcatcgaaatttccgaaaagattcgttctatcattttggaccctgctcataccagtatggatgctcgaacagaggcacttttatacgcggcggcgcggcgtcagcatttggtggagaaggtaaagccggctattgaacagggagctatcgtattatgtgatcgttttgtggatagtagcttggtctatcaaggatttgcaagagggatcggaattgaagaggtagcttcaattaatcgcttcgcggtggatgattgggagccggatgccacattttatctggatattgagcccgaattgggattggcaagaattaatgcgtcacgaggagcagaaatggaccgcctcgacatggagagtatatcgtttcaccataaggtgcgagaggcatatttggagttggctcgcaaatttccagagcgaattacaattgttgatgcatctccggcgccagagcaggtggagcaagtattgaaggatttgctgaaaaagcggtttgttcagaattttagcatataattgtcgaaggatatacggtaaaattgagctagggacaaggttgtctctaatatgacttgaaggaggaatacaggatgaagctgattattgcgattgtacaggataaggacagtaacagattatccagcggactggtgaaagctaatttccgtgctactaaattggcgagcacaggaggatttctgcgtgctggtaatacgacatttatgatcggtgttgatgacaatcaggtggactcattaatgaacgtcattcgcagcagttgcaaggttcgtgaacagctggtcacacccgttacccctatgagcgggacgacggattcctatttaccgttgcctgttgaagtccaggtgggtggagcgacggtattcgtgatgcctgtagaccgtttcgagcatttctgaatctacacaatagggcctattctgccgatatgataggggaatcgcctgtatcttctcacatgatgagagtgagggcagatccactaaaacggcagcgctacagcgcagttcccggaaggccgaagaaaccctgagttctagattgaactgttcatgaagggggaaagtggaagcatccggggagaaagcaggtttatatgaaaataaatccgggctatcgccctttacaaagtacattgtctacaaatgaaatgagtgcaaagccaattcagcccaagagcttctccgacgttatgcagcaaaatggggagcaagcttcgcaggaggaattgaatcggcgctttaaggaaatacaaatgcagggagatcgtcttgcacgttcaatgacgattcgtgagctgaaggcctataagatgctggttaaacggtttttggaagataccgttcggcgaggcgtgtccatgaaggacacgaagggctgggatcgccggggacgcagcaaacgttataagctgattgatgaagtggatgagctgttgctcaaaatggcggatgagctgctcgaaaccgagcaaggcaagattgagcttttgcaaggggtcggtgagatcagaggattgctaattaatctctcattttaatgcagacttatgttataaatgaatacagacgggctgttgccacgaagaaataatctgcttgctgatcatgctggcagattatttttgactatgtacatgcccggaagaacaacgatttgttgagggatcacagttgttttcagtggagaaagtgaggaaatatgtcttttcaacatataatgggccaggatgtagccaaaaaaatgctgcaaagtgcactacggaatcatacggtcaaccatgcctatgtttttagcgggccgccgggaagcgggcagatgaacatggcgcagatctttgctaaggctttattttgtgagcgacagacggatgatgcatgcggggagtgtttgtcatgccgcaaggtagagcacgggaatcatccagatttgcatattgtagagcccgatggagctacgattaaaattgatcagattcgtgggcttcaacgtatattttcttacaaatctgaaagctccaatccgaaggtatatatcattcggcaggcggataccatgacagtgcaagctgctaatagcctacttaaatttctggaggagccccagattccagtggtcggcatactcatttctgaaaatggacaggcgttgctgcctacgattcaatcacggacgcagcaggttcctttccatgctttacagccggaggtgatgatgcaggcattaattggggaaggctatacggcagggattgtccggtcggtcgttcatattgcttcaggactggaatcatgtagagaaattctccagcagaattggtttgcagaaattagaaacgtagtgttacaattagtgaaggagtccatgagtcggggaagctcgtctattattctggctcaacagaagatttttaaaactggactttctgaacacctggatattctgtttcatctgtttcatttgtggtttaaggatatgcttcatttccgttacggaaggcacgaaagcattgttttcatagatcatttggagtccgtctccaaattggcaatcacccgcagcacggaacaatgggtctcttatatggatttggccgcgaattgcaggaagaagctccgttttcacgtcaacgggcaattatgcgtggagcagcttctgattgggttgtccgatacaagcggttctatcaccggctaacaggaaggcgcgcttgttccactctgcacaatccgcgacgccaggttcccggtttgtgcgacagtgagacttcaattgcggccattcgtacaatgtcggcttcaaatgaggtttagtggcatacaagggggttaatttttgtatagtgtagtgggtgtccgtttcaagaaggcgggcaagacttattattttgatccgctggatcttccagtggagaaagaaaactgcgtcattgtagaaaccgcgcgcggtattgaatatggcaaggttgtagtgggcaaaaaagaggtaaatgattcggatgttgtcctgcccttaaaaaaagtcattcgtattgctggggatgatgacgctcttgttgtagaagagaataaattggcggccaaggatgcattcggcacgtgtttaaataaaattaaagaccatggccttaaaatgaagctggtagatgtagaatttacatttgaccggaataagatcattttttattttacggcagagggtcgggtggattttcgagagcttgtaaaggacttggccagtatttttcgtacacggatcgagctgcggcagatcggcgtacgggatgaggctaaaatgcttggcggaatcggaccttgtggacgtattctgtgttgctcctcatggctgggggattttgagccggtatctattaagatggcgaaggatcagagtttgtcgctgaatccgacgaagatttccgggttgtgcgggagattgatgtgctgtctcaagtttgaacatgataactatgaaagcatgcgagaagagctacctcaggtgggtaagatggttatcacctctttgggagaaggtaaagtcgtaggtgtgaatgcaggtcatcgcacggtgcatgttcaactgtttgagatcagtaaggtcaaggaacttccaatggacgatgtagtcgtcaagtaaaccattaggttgcttcggggtggaaacttggataaattaaatgtttttgcgcgtattcacgaaatggaaacccaaatgggacagttgcatagcgatctgggtgaattgaaactggcagtaaaagagctgctggaggaaaatcaacgactaacgattgaaaacgaacaggtgcgcaagatgctcaaacgtgaaacctctggggaagaaaagacggcaaacaagccgaagcttcctcctccgatcatcattaaggatgaagggcaaacgggtgaggtcgtgggcgaaggctacgacaatctagcgaggctgtatcatgaaggatttcatatatgcaacgtgtattacggacatttgcgaacggaaggcgattgcctcttctgtctgtcatttttgaataaataaaaacaagccgtaggagcaagatgcctacggcttttttgtaaggaagtatgagtgaaaagcgattttggttataaaagatgggagagcattatgtacgaaaatgaaaagaagtcggaacgaattgatgatctgctttcacataatttgcgtataatccaaagtgatgaagtattcagcttctcgatggacgcagtcttgctggcacgttttgccggtattccacagcgtgggaagattctggatctgtgtactggcaatggggttgtcccgctgttgctaacgacacgaacaaaggcgtctattgaaggaattgagattcaaccacgcttggcagatatggctagacggagtgtcagcttgaatggattagaagcagcaattcagattcgggaaggggacctacgtgagctggttcacatcacgggacatggtgtttatgatgcgattaccgtgaatcccccctatatgccgctaaatggtagcgatatcaagctgaatcctcaccaggcaattgcccgtcatgaagtgaactgcacactcgaagaagtcattcaggcatccacccggcttgtccgtaatgggggaaaggtatctatggttcatcgcccgcagcggctgggtgagattataaccttgatgcgtaaacatagtttggaacccaaacgaatacgttttgttcacccacgagttcatatggaagccaatatggtcctggttgaagcattacgtgacggcaaaccggaggttcgtttgttgcctccgctcattgtatatcaggaaaatgggaattatactcaggaaataagagatatctatggagaagtaagcaagggggattctgtgtgaaagcagctgtacaaaaaagctttagtaccagcgaagaagaacggggaaagttgtatcttgttgcgacacctattggaaatctggacgatatgacctttagggcgattaacaccttaaaatcatgtagtattatcgctgctgaagatacacggcagacacgcaaactgctcactcatttcgaaattacaccggatatgctcttcagttatcatgaacataataaggctgctagtgggcctgaactgatacgttatataatagaaggaaaaaatttggcactggttagcgatgcaggtctaccggccatttctgaccctggttcggatctggtcaaactggcactggaagcggaaattagcgtcattcctatcccaggagcaaatgcggcactatcggctttaattgcctcaggactggatacagataggttcaccttcgctggctttccaccacgggagaaaaaggacctagagaagctgttgctatcgtttcaggtatctcacggcacaattattttttatgaatcgcctcatcgtattgtgaagacattgatggtgttgaaggaaacattaggttcacgcaaagtggtgcttgcgcgtgagctgaccaagctgcatgaggaatgggtgcggggaaccgtggagcaatgccttgctaaactagaggggaatccgccaattggtgaatattgcctggtggttgaagggaaagacgaagaggaagaggaacaggaacgtcaggcatggtggcagtctttatctttggagtcccacgtcgcacattatgaggcagagggactcacacgcaaggatgcaatgaagcgtacagccacagatcgttcaatctccaagagagatgtttataacgcactcttatgaatatctgcctaaacaaaaaagggccttccaacggttgggttcaaaccgtggaaggcaacaaggagtatatatgaaaaaggttagaattaacaatatctgataagtctattatatactaaaattctcagtttgtcacaggtgttgggatttcagaaatgcaatcttggcaaacaatttttcctttgaagtaaattacgttctcagcattgccgcagaagatacaagctggctcgtattttttaagcatgatgcgttcgccatcaacataaatttccaaagcgtctttctctccgattcccagggtacggcgcaattcgattggaataacaacacgtccgagctcgtcaacttttcttacaataccagtggatttcatcataataaatcaggctcctctcgccgtttaaaataatataagtgtcatgattcgacaaaattttctcttttctgatatttactataccaacgattcccaaaacagtcaaccttaaaaatgtagtaacagtctgattatgcaaaagtatttagattaaagagctttacttgtgtgtattgccttatcttattgatgatttattcagtttgtcgatttggaaatgtcgaaaaactataattcgacatattacgacaaagaatgtcgaatgagggaaaccatttaggattttattgtattttaatccattattccgaatattaaaggagctgatatcttgcaccagccactcagtgaagaaaaagtttttaaagacccggtacataattacatccatgttcaggatactgtgatatggcggttgatcaacacgccggagttccaacgtttacggcgcatacggcagttaggcacgtcgtatcttacgtttcatggagcggagcatagccggttttcacactcattgggcgtatatgagattacgagaagtattatttctcaatttgaacgtggagatttcccggattggccgaaggaggaaaggctggttgctctgtgtgcagctctattgcatgatgtggggcatggcccattttctcattcaattgaggaagcctttcatatgaaccatgaggattggacatgccgcattgtactgggagacacgaagatcaacgccgtgctacggcaagtcgacgagaagcttccacaaaaggtggctgcggttatagccaaaacgtatgataaaccgattgttgtcaacctggtaaccagtccactagatgccgatcgtatggattatttgttgcgggatgctcactcgacaggtgtcaactacggcacgattgatttggatcgtattttacgactgctgcgtcctcataatgggagaattgttgtgaaggaatcaggtatgcatgcagtagaagattatttaatgtcacgctaccagatgtattggcaaatttattttcatcctgtaacacgcagctcggaaatccttttacgtaaaattttcaagcgagcaaaggaattgtttaaaaacggatatgagtttggatttctgctggacccgttgccggatctgttgaaaggagatcttacagtagagcaatatctgatgctcgacgagtcattaatccagaccgtatttagccagtggaaacgagaaaaggacgagattttaagtgatttgagcagccggtttatggaccgtagattgtataaatatgtagagattgaaaatatggatacagataccattgacagtattcgagaagctttgaaagaggctggtttgcaccctgaatatgattttgaaattgattttccgacagatcttccttatgatgtgtttcggcagggtggctcgacggacaaccagattttactgcttggacgtcagggcgaggtgagtgaaatatccgaagtttcggaaattgtacgctcaataagtggtattcaccgagggaaatatcatatgtattttccccagaataaattgaacgcggtaaaagacaggcttcctgccgaaataaggaattattttgtcaaagaatagacaactatatagaaatgtaagtaaaaaaaggagatgtaagccttggatttattcgacactcatactcacttggatgcgccacaatttgacgaagatcgtgaagaagttatagcacgtgctgtcgaatcaggagtaacgcggatgatcaatatcggatttaatcgtgagaccattccatccaccatgaaattggccgagacgtatgattttatttatgcggcagttggatggcatccgcaggatgctattacaatgcaggagggcgatctagaatggattgcatcgttatgcagtcataaaaaggttgtagccatcggggagatcggtctggattattattgggatacatcaccgaaagatgtgcagcatcgggtgtttcgaaatcaaattggtctggctcgtgagctcaagatgcctattgttattcataaccgggatgcacatgaagatattgttaagattttgcgcgaggaaaaagcgagtgagattggtggagtcatgcactccttttcgggtagctgggagacagccaaaatggtgctggatatgggatttcacctttccttcggtggtccaataacgttcaaaaatgccaagcagccaaaagaggtgctcgcacaggtgccgctggaccgtctgctcattgaaactgatgctccctatctaacgcctcatccgtttcgtgggaagcgaaatgagtctgcacatgtgagactagtagcagaggctgcagcccaaatcaaagggattacagtggaggaattagtgtcaataacgacccgaaatgccctggaacgatttgacattcaatgaaaaagtgaagaaatcgatcaaaataaagagatagacgaagctaatcatgaatttgttgcaggaaactcgagaatattacaatattttaaccgaatattttaaaaaatgtacttgaaacctgctttacaacatgcatagaaacaggatatcatcttttcagtgaattgttgtttgaatgtaaacatcaacaagtcatttcatgaaccagtctcgctgagtcccttttacagggaacgggggaaccgatatggcttacagtacgtccggcgtatgtgcaagaagggaacgtctcttccgccagccggctcgacctaaattcttttcccggatgggattgaacaggtggaggagccgtatttcgatttctttctgggtcttcggggtgaatgtgaaggcgaccgccatgagcggttgacccaagctagggcgactctctacgtccgaacccgacagctaaccccgtaagcgtaacaagagagaagccatctcgtgcatgagttttcccgcatattcacacatgccggaagccacgaaagagctctctagtctctttctctggctttttttgttgtgaataaaagaaaatctgtcatcatactgtggttaaacaggggaggacagcatgccgcgaagacgggtacatggtgcaggacagtcgtagtttgggcttgtcttgtagaaaatctgttatagtcacgtcaaatctcaactatgtcttactccagacggcgggctatgtaaggaggacggaggaaatgggcattttccagaaaaaggatacccatgagtcacgctcatccagcatgtcttacgtattgcgttggaagcaagagaatgtgcgccaggctgctttggttgctatttttctaatcgcgctaacgattatgatttcaattctgatgtacacgcaatctaaaaaacaagtcttttttgtcatcgatggcaaggcgtctgcggtagaaacccgggaatccaagcttcaagatttgctgagcgagcattccatttcacttcagccgcatgatacagtttccatgccgctaaatggagcaatacaggatggcgatcgcgtagtcattaaacgtgccaatcaggttaaagtatcttcaggcaatgagacgaaaaagctgtacacaacagaaaatacagtagaaggtgccattcgtacctcgggctataaattatcatcaacggataaagtttatcctgcgttggatgcctctgtttcgtctaacatggacataaaaatcgtccgtgtgaagaaacagcaggtcgaacagaaaaaacaggtgccttatcaggtcatcaaaacggccgatccgagtctttataaaggcgataatcgggtcattcaaagcggcaaatcgggtgtggtcgtccagcacgttcaaaaggtatatcatgatggaaagttggtatccaaacagctggttaacaaggaagttgcacagaaccgtgtggataaagtcattgcggtaggaacgaagaaaaaaccggtcgttcttgctgcttccgtcggtcccaatgatgcggttaaggcaacaacggttagttcgggcagtgctgtccgtaaagcaggcgtaaattttaaatatagcaaagttttacaaaatgtctccatgacggcgtattcctcacaggagccaggtatcggtacacgtactgcatccggcgcacgtgtcacggaaggacgcaccatcgcggtcgatccgagtataattccaatcggctggtgggtgtacatcgaaggggtgggcttccgtcgtgcggaggataccggtggcgcgattaaaggccacaaaatcgatgtgtattatgagagtttgagccgagccaaccaatttggtcgtaagcacggtaaaaccgtatatgttatcggaccggtaaagcctgaaatcaactaaaacaggttgtgtatgttgagggcaatgcgatagtattaacaacatagttatgccatgctaagaagaggatatcctcttcttattttgttttcaaaagcagggaaagataaatatagcttgctatgtagcagtggagggaaacgcaaatgatcaaggaagtgatcgtggtagagggccgggatgatacggtggccattcgccgcgctgttgaagcggatacgatagaaactggcggctccgccattaataaaatgacgctgcgtaaaattgcattggcgcaggagcggcggggggtcatcattttaaccgatcccgatcatgcaggggagcgcatccgtaagattatcgcttccaaggtacccggctgcaagcaggcctttatacccgaggcagaagcgacgcgtaaaggagatattggcgtggagaatgcctcaccagaagcgatcagacacgctcttgcacgggtccatacgacagtggaaggcgccgacccgctgattgagtgggcggacctgattgatgctggactcatcacccatcccaatgctgctgcacgccgtatggccttagggaatgtgctgggtattggttattgtaacggaaagcagctacataaacggctctctgtatttcagatcagccgcgaggaatttgccggggcgctggcacaaattgaaagtgaaggattgtgatgtccgtatgacagggattcaagatatagcaacaccgcggcgtacgaaggaaattattcaacggcacggtttttcgttcaaaaagagtttgggacaaaatttcctgattgatcaaaatattctcaataagattgtaaatgctgctggattggatgagacgaagggtgcacttgagatcggtcctgggattggcgctttgaccgagaagctggctcaatcggccaaggcagttaccgctgtcgagattgaccagcggctgctgccaattctcgaagaggtgttggccccttacgagcatgtgaaggtacgtcatggagacgtgctgaagctggatttgcgagaggtgttcgcagccgattttgcagacgtgagtaaagtaagtgtcgtggctaatctgccgtactatgttaccacaccgattctgatgaggctgctggaggacaagctccctctggagaatatcgtcgttatgatccaaaaagaagtggctgagcgcatggctgcgtctcctggaacgaaggattacggcagtctgagcattgcagtgcaatattacagcgaacctgaattagtctgcactgtgccgaacacagtatttattccccagccaaatgtggagtctgcagtcatacggctgcgtgtacgggaagcccctccggtggaagtggtggatgagaagcacttctttgaagtggttcatgctgcttttgcccagcgtcgtaaaaccatttccaataacttaaaaagccgtttcttcaccaaagagaacagggacacgctggagccgctgttgcaacaagctggtattgaaccctcccgtcgaggagaaacgctaagtattgaggaatttgcgcgtctcagcgctgtgctgttggaggcaggtatatcctaagctggaaccaaactgtgcattcacccatacgatataggaggggtgatacagtgtgatgagtttaggggacttggtcgttcggaaatcgtacggcggagatgtcacgtttcgtgttgaggacatccagcgggataaagcgatcattaagggaatagaatttcggctgctggccgattccccggtgaacgatctggtcagagtgcctgcagaccagattagcggtaagactcagcaggcccacattaaggctggtgagtctcttaatctgttgcaacgggcacgccagcagcaagctgctcgtagtcaggcagctctggtaggggactggagtgatccggttgagtcaacatattttgaaatgccgggaaaggttcttcacctggatggagatcccagctatctgaaaaaatgtctcagtttatatgaacagctccgtgttcctgcagagggacatcacgttcacgaatcggcaatggcggacacgttgtaccgactgcttcctcgtatccgtccggatatcgtagtcattaccggacatgacggtgtgctgaagcagccacagccttacgatttgtacagcttgaaaagttataaaaattcgcaaaattttgtggcggcgattcaggtagcaagacaatatgaacgtcatctggattcgctgacgattgtagcgggggcgtgccagtcccattttgaggcgctgctacgtgcgggagcgaacttcgccagctcaccagggcgtatcctgattcacgcgctggaccccgtttacgtggctgccaaggcggcctttacttcgatccgtgatacggtcaacatgggggacctgtttcaccagacaatcagtggcagtcgcggagtgggtggaattgaaactaggggaagctatcgcatcggcctgccgaagcttgaaaatttatcaacgcttaaagtaacgccttccgcaatctaggattcaaatgtgccaataggattaacctgagcaaaaagcctctgctttcagaggctttttgtcattttttatataaattattcctgttcgcaaaaaattaaattgacaacttatttttcgtgttgttataatatttagcttgatttgacaatccctctaaaattcgttataatggacaaggaaagaggtggtcgttaggcaatggctaaaaatacgctgttggaaatcaaacgcagtctcgacgcacatgtagggcaaaaaattttgctgcgggctaacggcggacgccgtaagaccgtcgaacgaactggtgtcttggaagaaacgtacccttctgtttttatcgtcaagctggatcaggagcaacagacgtttaaacgtgtctcctacagctatgctgacattcttaccgagtcggtggaagtcagcgtatatgatcccgactcccatacaagtgtagttgaatattttgaaacaccttaattgatttcgtgatttataccagctttgcaggtttaacgacggcttcgtcatttcaaatgacggggccgttttgtatatatagagcaggatgaagcatgacatctctgcacatactaagccgggaatgatcttccttattccattgccgaaggaggcgtatgtatgagccgaagaagacggagtgtcatgtcggaggagctaaagtacgagctggccaaagatcttggattttacgacacggtcaaggaagaaggctggggaggcattaaagccaaggatgcgggcaatatggtcaagcgggctatccaacttgccgagcaggcagcttcccgcaaatcgtagctatcggtggtgctgatgaaaagcggggatatccgggattagaccgggtcatctccgcttttttgaacctcatgacttgacacgctgagtctgatataatatgttaagctgtcttgagggaaaagttgaaggtgggtgaacgccttgaaaatatatgaaaaagcaccggcgaaaatcaatttaatgcttgatgttctacgtaagcgggacgatggttatcacgaggtcgaaatgattatgaccatggtcgatctgtctgaccgattgacgatgtctgagttaccgcgtgataccattattatttcaagtcaagctgggtacataccattggatgaaaagaacttggcttttcaggctgctcgtctgatcaaagaacgttataacgtgtctacgggcgtccacattcatctggataagcatatcccggtggcggcagggttggcaggtggaagtagtgatgctgccgcagcgctgcgtggactgaacaagctatggaagcttggtatttcggatgccgaattaagggtgctgggtgcggaactgggctcagatgtacctttctgtattacagggggtacagctttagcaagtggacgcggagaactgctcaagccacttccgaatccgccacaatgctgggtgatccttgcgaagccgccgattaatgtatcgacggctgaagtgtatggtcgtgtcaaagcagatcagattgcgcaccacccgtctgcccgccagatggagcatgcgatccataacgcttcttttacggatgtatgcaacgcgctggggaatgtacttgaggatgtaacactaaagctgtatccagaggtagagcatcttaaaaactccatgatacgcttaggagcagacggtgtgctgatgtcaggtagtggacctacagtgttcggactggtatcgaaggaagccaaagtgccacggatttacaatggactaagagggttttgtaaagatgtgtatgcagtacgacttttgacctgattttagatatttctttcatattatagtggtaattgttgtacaaatacgtacgaagatgatatatttactattaaatattcggattttactatatcacttacattccgccagcaaccggccagtccgccggtgctttactgtacaaagcgggcggcaggagaatagatcgcgaggaattgttgtgaaaaaacttaaaagaagctcacgattggtggaaatgacgcaatttttgttgtcacggccgcatacgctggtgcctcttactcattttgcggatcgctacggggcagctaagtcctccataagcgaggatctggccatcatcaaggaagtttttgaggatgagggcactggcgagcttctgacactggcgggagcggcagggggcgtgaaactgatcccgaggctttccaagcaacatgcgcttgcgtttgcgaacgacctgtgtgcgcaactggagcagcctgaccgcatattaccgggaggatacctgtatttgtccgatttgctgggccaacctgcgatgatgaacgaagctggtaaaatattcgcgaccgcttttgccaatcgtcagattgatgtggttatgacggtggagaccaagggtattccacttgcctatgcaaccggagcacagctgaatttgccagtcgttctcgtacggcgtgatcatcaggtgacagaaggctcggctgtaagtattaattatgtttcaggatcacaaaagagcctgcatacgatgtctttatccagacgtgcgatgcgtgagaaatcgcgtgtgctcatcgtagatgattttatgaaggccggtggcacgattcaggggatggtcgacttgctggctgagtttgatgctgaggtggccggtgtaggtgtgctggtagaatcgggcgaggtggagaacgaagagcgcctgctgcacgattatatttcactggcgaatctgaccgcagtcgattctcgaagcaagcaaattacggtcaagctgggcaattattttgatgagtgaacagggcagtaaattgtcacaatccatcataaaatacctaaatatgtcgaaaagaaatcttttcaaaaaaattacctgaatttaggatacgaattaccgaaaaaaagaaggatttcgaactgctgtgtggaatgtatacaccaagtcctatttggaaaaaggtggtgaaacacacatgcagattacggatgttagactccgccgagtgaactcagaaggaagaatgaaggcgattgcatccattacgattgataacgagtttgttgttcatgacatccgagttatcgacggtaataacgggatgttcgtagctatgccaagcaaacgaactccagacggagagtttcgcgatatcgctcatccgatatcttcaggaacccgtgagaagatccaagctgctgtattgactgagtacgaacgtgcagctgtggatgaagaagttgctattgaagaaggcgcttaattcgcctaaagcaggattggggtacaaaagaaaaagagagccactaactgtggctctcttttctttttgtctggaatgagatatattctttagtgagttaacagtcagttttaaggcaacttggagccatccgggctgccgaagcggctttttcataagacagggactaggcagagatgcgtcccggggatgaatgtccagcacaagctggcctgaaaaaatagccattaaccaaaggttcgccgttatttttcaggaggattgtgaaaagttaagcaaaatctgatctgggaattaacgttttagccaaggggtaactgttattttcaggataggaggttggacttgttggaaaggttggcagtcattcttgccgcagggcagggaaaacgtatgaaatccaaattatataaagttctgcatccggtgtgcggaaaaccgatggtcgggcatgtgctcgacacggttcgtgaaatcggtgtgtcccgaagtgtagtcgtcgtgggtcatggagcagaggcggtacagtcttatttgggaccgtcggcagaatatgcgcttcaggctgagcagttgggaacgggccatgctgtcaagcaagccaaggacttgctcggtcaggaaaaaggtacaaccattgtcatttgtggggatactcctttgatcacagcggaaacgctggagggcttggtgcaactgcacgagagccgtggggcagctgcgacgattctgaccgctgagttggacgacccgaaaggatatggacgagttattcgtgatgcttccggggccgtgctcaagatcgtggaacagaaagattgttcacctgaggaagatgctgtccgggagatcaacacgggaacgtactgctttgacaatgccaagctgtttgcagcgctggacaaggtaacgaacaccaatgcacagcaggaatattacctgacagatgtcattggtattttgcatggtgaaggtgagcaggttgaggcgtatttgacagatgatgtgtctgaatccatcggtgttaacgacagagtggctttgtcgatagctgagggctatatgcgtgagcgcattgttcgcaagcatatgctgaatggtgtcactgtcattgatccgtcttctacctatatcgggagcgaggttgttattggttccgatacggtactgtacccgaacacatggctgcatggtcaaacacaaatcggagaagattgtgtgattggtccacaggctgagattcagaatacgattatccattcaggcgcaacggtaaaacattcggtgttgaacgaagcggaagtgggaagcagtacatctgtggggccgtttgcttatctgcgtccaggcgcgaagcttggcgaacatgtgaaaattggtgattttgttgaggtaaaaaatgcgaccattggagatcattccaaggtgtctcatttgagctatgtcggtgatgccaaggtgggtacaaacgtaaatattggctgcggggcaataacggtcaattatgatggatataataaatccattacagaaattgaagacgatgcctttattggcagcaacgtgaatctgatcgccccgattaagattggaaaaggtgcttatgttgtagcaggctccactgtaacacatgctgtccctgataacgatctggccattgccagaccacgtcaagagaacaaagtcggatatgcggacaaaatccgcgcacgtgccaaagcaaagaagaaaagatcggaatgaccttaatcagcaagctgttgaatctgtaatgaatgaaccagcacggagggtttctattaatgacttattgcgattccaaactcaaaatatttacttgtaactccaatccgaagttagcccaccagattgcggactacatcggcatcccaatgggggaatcccataccacgtcgtttagtgacggtgaaatccaggttaagctgtcggaaagcgtacgcggctgccatgtgtatattgtgcagtcaacttgtctgccggttaacgacaacttgatggagttattggttatgattgatgcacttaaacgcgcttctgccaaaagtatcaatgtcgttatgccatattacggttacgctcgtcaggatcgtaaagctcgttcacgcgatccgattacagcgaagcttgtcgctaacttgattgaaaaagcgggagctcaccgcgtaatcagcatggatttgcatgcgatgcagattcagggattctttgatattccagtagatcatatgttgggagcgccaattctggcccaatatttccgttccaagcaaattgagaacccgattgtcgtttcacccgatcatggcggggttgttcgtgcgcgtaagctggcagacttcctgagtgcgccgctcgctattattgataagcgtcgtccagagccaaatgtcagtgaagtgatgaacatcatcgggaacattgagggtaaaacggctattttaattgatgatatcattgatacagccggaacgattgtattaggtgcaaatgcgcttaaagaaggcggcgtaaaagatgtgtatgcgtgttgtacacatgctgtgctgtccggtcctgctatggaaagactggagaattcgccattaaaagaggtggttgtgacggatacaatcccgatcgttcacccgaatccgacaagcaagctgaaggtattgtctgtggctccattaatgggagaagctatcatccgtgtgcatgaagaattgtcgatcagcaaactgtttgaaatcgaataagcgctggctcattaaaaaaaggggttgccttttccatatggaaaaggtaacccctatcagcatgtcaggctaaaagcctgggcgagatatgaatgtgaaacgttgacgattgtatagtgtgtcctctatttcgacgaaatgctcattaaaacgcgcaacgatgccaatctgaatatgtacattcccgtcatagatctggacaggaacggaatgttttaaatgatatagaaaatggctgtcatataagaggatatcaccttgattgagcataccggcacgcaccttcctattcaatacaactattttaccaaaaaatcaagactgcgaaagagggtgtcaaagttatgaagtggattgtaggattgggcaaccccggtccccaatacgagaaaacgagacataatgtcggatttatggcattggatgctcttgcctcgcgtcataacatccagattaaccaaagcaaatgcaaggcgttaattggagagggtcacattggtggcgtaaaaaccgtactgattaagccaatgacctatatgaatctatcaggcgagtctttacgtgcttatatggactattataaggccgatatggaagatctgattgtcgtgtacgatgatctggatacagaagtcggtaaaataagattgcgttatcaaggtagcgcaggcggtcataacggcattaaatcgatcattcagcataccggcacgcagtccttcaatcggattcgtatgggcatttcccgcccggagcctggacatgctatcgtcgattatgttctgggtacctttcccaagaaggaaaaagaattactggccggaatgatcgaggacacgtgcaacgccttagaacacagcttgagtcatccgtttgaacggacgatggctgaattcaacaagtaagttcagacgtaggcagacgggcttaaatggaagattgttggacatactgaaaggtatagaaaactttcaggaggcatatacattacatgattgttaattatgtatgcagacattgtcgaactttcttgggacgaattgattccgcggcaataaccgaagaaaggttgggcttccattccttgacccctgccgaacgtagagatataatagcgtataattcgggtggtgaagtgaccgtcaaagtcatttgcgagcattgcagtcaggcattggagaataatccagagctgagtctgctcgttaatccgctccaataacaggtattcaactggtaggatgtaccagcttgagaggtgaagcggcaattccgcttatggagccttggcagcattgctgaggcttctttttcggtttacatgtaactatttataagcataaaggggtgccttttttgttacaagcacttattcaggcttttacgaaggatgctgattatgcatccattgcagcaggtatttcatcagggatgaaggaacaactgatatcaggtttatcaggctcttcccgacaggtactgatggccgcgcttgccgaagataccggacgaccgttaatggtcatgacgcacaatatgtttgccgctcaaaaaatagcagatgacttacaggaagcgctttctcctgatcaggttttattgtatcctgctaatgagctggtagctgctgaagctgcaatatccagtccagagacattgtcccaacgaattgatgtattgatacgctgcgcccagggttttcgtgggattgttgtcgtgccgttttctggtgtccgacgtttactgccaatcccggaaacatggcgtgaggctcgtattgagctgaaagaaggcgaaacgattcagctggaagcgtttttgctacatatggtcgagatgggctaccagcgtgtagagcgtgtggaatcacgtggagagatgagcgtacgcggaggaattattgatttttatccaatgacaacccgttggggctatcgtgtggagctgtttgacgatgaaatcgattcgatccgtaagtttgatccgcaagatcagcgttcggtggaaaaggttcaggacgttaccgtaacaccgtgtaaggaggttattgcgaataaccagcgtatggaccaggcggcggatgccgctgctattttgctggaggagcagctgggcaaaatgacggatcgtcaagctaagcagcacctgaaagaagagattcatcgtgaaattgagttgctgcgagagcatgtgtattttgacgaaatctataaatatatctccctgctgtatccagaacgtaaaaccctagcagactatatgccggaagatacgattctgattattgacgaaccggcacgtatgctggaaacagccaagcaactggaacgggatgagtcagaatggaatctgcatttgcttcaaaacggtaaaacgttaccgcagctagaactgtcagatgacgcggacaatctgctgtacaaccggagatttcagacgttgttcctgtcgatttttctccgtcaggttcctcatgcccagccacaaaatattttgaatttcatctgccgaggaatgcaggatttccatggccaaatgaatgtgctcaaggcggagatggatcgttggcgcaaagccggcacacaggttatgatgctggcaagtggagatgaacgtctggaccggatgcgccgagtgcttgaagattacggtattgatgagccaacgatggctatcggcaatctgcaaagcggttttgaaatgccgtctattcatctggcggtcattaccgagggtgagatgttttcccagaagcagcggaaagctcgtaagcagggccggcatgtggacaatgcagaacggattaagagctatagcgagctgaaggtgggcgactacgtcgtacaccaaaatcacgggatcgggaagtacatggggatcggcacgctggaggttggcggtatccataaggattacatgcatgtcctctacgcgggtggagataagctgtctgtgccgattgaacaaattgatctgattcagaaatatgtcggctcagaggacaaggaacccaagatttataaactgggtggcaatgagtggacacgggttaaaagtaaggtgcgcagctcggttcaggatattgcggatgacttgatcaagctatatgcagaacgacagtcggcaccagggtttgcttttgaaaaggattcaccggagcaacaagagtttgaggatatgttcccgtatgatgagacacgtgaccagattcgggccatcgaagagattaagaaggatatggagcagagccgcccgatggatcgtttgctatgcggtgatgtaggttacggcaaaactgaagttgccattcgtgctgcttttaagtctgctattgaaggcaaacaagtagcggtgctggtaccgacgacgattttggcacaacaacactatgagacattccgtgaacgtttttcagggtatccgttcaatattcaggtattgagccgtttccgctcgcgcaaagagcagaatgagacgattaaaggggtccggcaaggcacggtcgatattgtcattggtacccatcgtctgttgtcgcaggatctggtgtttaaggacctcggaatgctgattgtcgatgaagaacagcgatttggcgtaacccacaaggaaaagctgaagaagctgaaaacgaacgtagatgtgctgacgttaacggcaacacctattccgcgtacgttgcatatgtccatgctgggtgtacgtgacttgtcagtcattgagacgccaccggaaaaccgttttccagtgcaaacctatgtggttgagcacagccaaactctagttcgtgaggccattgaacgcgagatggcacgcggtggacaggtgtactatttgtataatcgcgtgcagggtattcaggagatggctgccgagatcaatgcgcttgtaccggaggctaaggtgggcgtgggtcacggacagatgtccgaaaccgaactggagaaaacgattttggatttcctggatggcgaatacgatgtgctggtcagcaccagcattatcgaaaccggcgtggatattccaaatgtgaatacactcattgtgcatgatgccgataaaatggggctatctcagctttatcagctgcgtgggcgtgtaggtcgttccaatcggattgcctatgcttatttcacgtaccagcgggataaggtgctcacggaagtggcggagaagcgccttcagtcgattaaagaatttacggagctcggctccgggttcaagattgcaatgcgcgatttgtccatccgtggagcgggtaacttgcttggcgctgagcagcacggattcattgcatcggtcggttttgatctttactcgcagatgctggctgaggaaattaataaacgtaaagtcagcgtacttggagaagaggatcagtccaatcggaattggagtacgtcgattgatttaggcgtcgatgcttacctgccgggagactatatttatgacagcatccaaaagattgaaatttataaaaaggttgcagcggtcagcacctttgacgaggcatccgaactggaggatgaactggtcgaccgatttggtgatctgccagaggctgtgcgtcatttgctagccgtggctcgccttaaggtatatggacgcatgtatggcatcgagtccatggtgcaacgggatgacaatatagtgctgaaattccatgaagggcgccagcaggcggtacagaccgccaaacttgccgagattggcaatcgctttgaaagacgtgtacaatttgaacagggcacttctatgagcgcacgcataaagggcaaaggtctaaatgatccacagttgctagaactgctggaacaatttttgagtgcattgaaagaagcattcacattgaaggaggaactgcaaaatgccacaactaaataaaagaaaaccttggagaatgctctccttgggaatggcagcgctgctagctatatctgtcctggcagcatgtacgaagcaagcggatgagaacaaggtcaaggatgaaccgaaggacaacagcaaggttgtcgtgacctataagggtggaaccattaccgaaaatgagttcaaccaagaaatcagcatgatgaaattcctttacccggaatatgaggctgcgttagcttcggatcaggtacgggagcaaattgtaaagcaggaagtggtgtacaagcttctggcggccaaagcggacgacaaagccaaggagcagggtgccaaagaagggaacgaacagctggagcagtataaaaagtcagtcggagaagataagttcaagacatttctgagtgataaaaaactgaccgaacaaggtgtgaaagattacttcacgcgtgtaatgacggtaatcaacagcgaaaccaacaaagtaacagatgatcagctaaaacaggaatttgagaaaaataaagatcaattcacaacagcaactgtgcgccatgtattgattaacttcgaagatcctaaaacgaagaaacagcgcaaaaaagaggataccctcaagctggccaaagaagtgaaggcgaagctggatggaggagcggattttgcgacgattgctaagaaatattcagaagacccaggttctgcgtctaacggaggtctgtatgagaatgcatccgtagcgcaatgggtacctgcttttaaagaggccgctgagactcagccgattaacaaaatcggtgagccagtggaaacggaatacggatatcacgtgatcaaagtggagtcccgcaatgagccaacgtttgataaattgaaagacaacgaaaaggcagccctgaaaaataaattggccggggaaagtatccaaaactttagcgaaaatgatttggcgaaacttgatttgaaaatcaatctgccgaaggtaccagctacgcaagagaaaagcggtgcaacttccggtgccggtagcacaactacaccgggcgcaacaacaaacggtacaggcaataccaacgcaggaacagccaaagatggagctacaaacgaaggtaaataactgaacatgcataaggaattgggaacagatgaatactatggtcagatatcaccataaacaccatgaccgtgacgttcttcgtgaccgcttctgggggagtggaagcgtctttcgataccgtcagtagtttactaaattcttcttgagaaagtggggcaacatgtgaaatgaaagctactggtatagttcgccgtattgatgaccttgggcgggtagttattccaaaggaaattcgccgcaccttgagaattcgtgaaggagatccgcttgagatttttgtggatcgtgacggagaagtcattttgaaaaagtattcacctattggtgaacttggtgatttcgccaaagaatatgctgagtccctgtttgaaagcacgggccatattacaatgattaccgatcgggacaccattattacggtggctggaggctccaaaaaagattttctggacaagccaatcggtagcattatcgaaggtagtatggataatcgcaaaactgtgctggagacagccagcggctcttatgagctaacgcgagaccacgaagaaacactctcgtcctttgtggcggctcccattgtttccggtggtgatcccattggttccgttgtattgttgaacaaggacgaaaatgtaaaaatgtccgaaatggaagtcaaaatggctgaaacagccgctggcttcctgggcaaacaaatggaacagtaacatcccgtttcacccctgtatgacgtacagaatggcgaaagccgtcctacgttgtacagggttttttttctttccgggagaagaggcggtataataggactcgtgaaagatgcatatttcaggtgggagtgaagacggagaatgcaggaaaatcgcgccgcttcgcggctgctacggggtgctgtcattttgacactggcagcagtagcgagcaagctgatcggcacagtgcaaaaaatcccgctgcagaatatcggcggcgacggcgtgtttggcatttataatacggtttatcctttttatacgctattcattaccattgcagctgctggatttccggcagccatatccaaatttgtagctgagtttgaggcagtgggaaaccgggcagcggggcaacgtgttgctcggctatcttcgcttgtcttgggtgtgtttggattgatcctgggcgtgctgatgtatacgtgtgcgccgctcattggtcaatggatcgacaatgctcacgtcattccgtcggtgagggccgcggcgtttgcctttttgttcgtgccggttatggcgggattgagaggatattttcaaggtttgcaaaatatgcttccgactgctatctcccaagtgacggagcaggcgatacgggtaagcgtgatgattatgctgttgctgctcatgctgtcacaaggagcgggggcggatatgattgccgccggagcagtgtttggttcagcagcaggcggagcagcgggcttggtcgtcatgttgctatattggcgaaatcacaggaagaggcttagaaggcaagggacggtcatggtgacagtgcaagcacagactggagagctacacccagcggaaagcaacggtgccttactaaaggcgctgctgcgttatgccttgcctgtttgccttggagcgctagccgttccgttaattagtctggtagacacatttaccgtacctcgattgttaaagcaggagggtttggacgatactgcggttatggtggcctttggcgtgtataaccgaggtctgccgctggtacagctagtcatgatgtttgccaccaccttgtcggcattattcattccatcgctggctgaggcccggataaccggcggtacggagctggcacgtcgccagtgcgagcaatcgctgcgctggttttggctactgggactagccgctgcgacaggcttgatcgtgctggctgtgcccgtcaatgtgatgctgtatgcggacgacaccggcagcggggtcatgcgctggatggcgctaaccgccgtaggcggcacgctcagcatcatctcggctgcgctgctgcaagggcttggcgcggttcgcgcgccggctctggcgatgctcgcggctgcagtagccaaggcgctgctaaactggctgctcgtgccgcagctaggcacggctggagccgccattgcgggggctgtcgcctatctgctggcggcggtgatcaacatcgtgctgctggctcgcttggtaggcctgcgtgggagctggtccgccagcgtgctcaagccggcggcactgcttatcgccctggctggtgcggccggggcggcgatgtggggcaccagcgctgtgctgggtgccttggggtgggctgccggaggtcgtgccacggcagccgcggagagcctgctgggcgtagccgcaggcgccgtagtgttcgtgatcggcctcgcacgcttgaggctgatcacgaaagccgagcttgtggcggtgcccaagctcggacgcccgctggcagccgtgctgcgcaggctgcgtgtactggcttagcccaggcgtagggcttagggcacgaaagcggcacagccattttatgagcctataccactttgtggtatagtaaatgccaaagcaaaggaagcggaagcgggttaggccgtgtatttttcgagcatgaaccttgtttctgcgaaacggaggattgaatatgagcgtaacattaacggtcgtaggtctgggctcaggagatccggatcagcttacgatagggatattgaacaaaatgcggggcgcttcagcactctatctgcggaccaaggagcatcctgcggttcaagtgctgaatgagtttgaagtggcttttgagtcgtttgacaaggtatatgagacaaaggagtcctttccagaagtatacgaggaaattaccagccaattaattacgacggctgctaaggcggcagacggaagcgaaatcgtctatgcggttcccggtcacccgatggtggcagaagcagcggtgcagttgcttaaggagcgttgtcctgcgcaagggattgaactgaacattctgggcggcgaaagtttcctagatgaagcttttgtgcgtcttggttttgatccgattgagggtttccagctgttggacgcaggtacactggatgccagctggctccagcctcagctgcatacgctgatcggacaggtgtatgacaccttcacggcatctgatgtgaagctgtgcctgatggagcgatatcctgacgattatgaggtgtatgtcggtcacgctcttggggtggaaggtgaggaagcggtgcacaaggtgccgctgtacgagctggatcgagtagagggctacgggaacctatccttggtatacatacctcgcagtgaagatgaggcgctgaaacggcgttcttttgaccgtctacacgagattgtcgatattttacgcagcccggagggctgtccatgggatcgtgaacagacacatcagtcgattcgcaaaaatctgatcgaagaaacgtatgaagtcatcgaaacgatagatgaggacgaccctgagcatatgaaggaagaactgggtgatctgttgttgcaaattttgctgcatgcccaaatggaagaggaagtcggaaccttcaatgtgtatgatgtaattcaggggttgaatgataagcttattttccgtcatccacatgtatttggtgacaatcaagcgaatgatgcggaagaggcgctgcaaaactgggagcagatgaaggctgaggaaaaacggcttaaaggcacgacggcagcatacccttccgtactggatggggttccacgtgatctgcctgctcttatgaaatcgtacaagctccagaagaaagcagctaaagtaggctttaactgggatagcattgaaggcgtatttgataaattagacgaagaagtggctgagttgaaggaagcggttcgtgaagggcatgccgtggaagcccagttgctggagttaggcgatgtgttatttgttgccgtgaatgcagcccggttcatgggagtagatccagaagaggcattgtccgccaccaatcgcaaatttgtcgaccgtttccagtatattgagcagaaattacgcgagcaggggcgtcgtcccgaagaaagcagcgtagatgaaatggagacttactggcaggaagcgaaaaagctccttggcaaagcgtgattccacacattcgcttttggctgcacagaccagtaaaatgagacatatgcagggttgaaagaaggctcagtttgagaagacttgccaatggacagagttttgtagtaggatgttggcttaactggggtcgaataaaaaaacgcctgttattgcaggatttttacggacaagccagaataacttgtagtaattctgaaaataactgtagcttatagttaagcgtgttacagtgacattcaggagggcttcggccacagttggacctcacgtctgctccatgaatggacatgcagcgtgatgattattttttgacatttgggaggcttttatcttatgaacaagacagatctgatcaacaatatttccagcaaaagcggtttgagcaaacgtgacgttgaagctgtattgaatggcgttcttggtgaaattacagatgcacttgctagcggtgacaaagtgcaactgatcggctttggtactttcgaaacacgcaagcgttccagccgtacaggccgcaatccacaaaccggtaacacgattgaaattccagaatcgaccgttcctgcttttaaagccggtaataagcttaaagaagccgttaactaatgcgtcttgataaattcttgaaagtctcgcggctgattaagcggcgtacggtagccaaggacgtctccgaacaagggagagtgctggtgaacggacgcgaagccaagccgagcagtgcggtcaaagtaggcgatgaaattaccgtccagtttggccagaagctggtgaccgtgcgagtggaacggctcgccgacactacacgcaaggacgaggctgcaagtatgtacactttggtaaaggaagagcctattgccagggacaatggtttgaactggtaagcagacatctgattttctcataactgtacatgaaagcattccttcattattttatgaaggagtgctttttttctttagatgacgagttttcgtccatcatatgctgattaacagcaaaagcggttctaaatcatacggcccccttcataagctaagaacagaaggaggggtacatgccatgattgaacaagggaagtccaagcaccatgatctgcgcatgcaaagccgcaagcaactcgatatttcaggcgtcagcaatgtggagagctttgacagtgaagaatttttgcttcagaccgagctgggccatctcaccattcgcggacaacatttacatatcaaaaacctcagtctagaagaggggctgttgtccattgaaggtctgattacttccctcgtctacctggagcccggggccccggccaaaaacggaaaaagcctattcggcaagatcttcaaatgaacccttacacgcaatggctgacgttgacgtggatgctgttgtcgggcatagccatgggagtggtgtttgacagctaccgggtgctgtccatccgctttcattttgcccgctggggcgttcatatgttggacgtgctctactgggtggcctcggctttgtttattttccgtgtgctatacgcgagtaatcgcggtgagctgcggttttatgtctttttaggactacttttgggggtttggctctatttttgggcctttagtgttacaacccaacgttttgtggtaatgttattagagatagttcgcagactgacgttgatcgtgaacagcatactgcgcatcctgattgttcttccggtgttagcgctgtatcggctgttacgcaagctggtcggatggacatgggcacttattgtgttcctgggaaggatgctgatatacatcctgatgccggtttggaagccgatcctatggctgatcggtccgcttaaagcgcgctggaagactccagagttgctcgtaaagctgggtatcagactgaaaaacacagcgaaaagatggtttggaaggaggtagtatcatgcgtaattcgtctgtagatcgccattcatcttctacgtccaagtccaacgcgggcgggcgcaggcgaatcatgatttggttgctatcgcttgccgcctttggtagttgggcaatttttacctttttttctcaaggcatgattatggccgatcgaagtgaacagctcacccagaaggaaaaacagaagcaagctgctacacaaacggaacaacagcttcaaaccgaagtgaatcgtctcaaggaccctgagtacattggcgagattgccagaagcaagtacggtctttacaaaccggaagagacgccaatcatcggagatcaaaaataggaacattatcgggccaatgcttagttgaccttggttccgccattttgtataatcaaatcaccacagcgggatttttttgcaaaaaaatcggttgtatattttaagggaggatcattttattctatggcaattgaagtgggcaccaagttagagggcaaagtgacaggcatcacgcattttggagcatttgtggatttgtctggaggtgtcacgggtctcgttcacatctcggaaatcgccgataactatgttaaggatgttaacgaccacctgaagattaatgatgttgtgacggtgaaagtcattaatgttgacaaagatggcaaaatcgggctttccattaagcaaacgattgacaagccggcaagtgaagcccgtcccccaagagctccaagaccggagcgtacaggaggaccaggcggaggcgaccgtttcggcggtggaggttcaggtccaagtcaaggacgcggtggtggtggcggtggtttcaaccgcgatcgtggaggccgttctttcaagcctgcaccgggtaaaccttcatttgaggataaaatgtcacgcttcctgaaagatagtgaggaacgcatttcgtcgctgaaaaagaacaccgaaggtaaacgcggaggacgcggcgcgaagcgtgtttaattcactttgacaaccgtatcaatcatacacggaaaaccgtacagtcgagagactgctacggttttttttgcgttctaccgacaacggatgcgataagcagcgattgttggcgctgaatccagtggttagtcgtacgggcatttatgagattcgcaattttgatgaagaagaaaagagcttcgatgctggaaagcggatgttttttttgtcgtgaggacataatcgtccgacaaactccaacggttttccgtctatcttctgtgcaaatcgctagattggacatcaggatgaacgacatcgagaggtcatataaggagtagcgggacgtttcttccatcggcttccatacgggcgtagcttgatgttcagagtgatgctctgtcctttcgcgcagaacgtttttttgtcggaaatttcttggaataagacgtggggttctgacaaactttctcagtcgttccggtttaagataggaacatcaaattgatgaatggggtgcctgacgcatgatggagaaatggaacgtggtacattttccggggttaaaatctagaaagtccaaatccaaagagcgtacggaagggtggtcttccagactcaagaaacggctggattcacataaagtggtgcaatgggtaacggcgcaaagatggatgctgctattgtcagctatgggagttctactgggacgcgccactattttggacgagctttctccttttgccctcgcttattttgcggtcataacgtttcttcggcgtgatctgatgctgcctgtagctgtatccgttgtgttaggcagcctattagctccttacccatcgttatttatgattggtggcgagctactggtattttatctcctgtatcgcgggctacgaaccttcgaccgtctggaattatcctatgccccgcttatggttttcttgtcggtgtttatggtcaatttatttaacgccgtgatggctccaactttcacatggtatgagcttatcattgtgggaacggatgcggttctcagctttatgcttacgctggtgttcacgcaggccataccgttgtttacgtaccgcaagaagacaagccagctcaaaaatgaggaaattttatgtcttattattttattagcctctgtgatgacgggagcagtaggctggactgttcattcattgtctgtcgatcatgtactgtcgcgatatttggtcttggtgtttgctttggtgggaggtgcttcgctgggtgcatcggtcggtgtaattaccggtttaattttaagcttggccaatatgtctgcaattgtgcagatgagtttactcgcttttgcaggtttgctggcagggatgctgcgtgaagggaaaaagggtgctgttgcgcttgggatgctgctaggctcctcaattctgacgatctatttggacggaaccggagacgtgctgacgtcaacctgggagagttgtgcggcgattctattattcttaatgaccccaaaaagtttctttaaagcggtttctacctatgttcccggtacgcaggaccacgccaaatctcagcatgaatatgccaaaagggtccgcgatctcaccgcagagcgggtaacgaagttttcccgtgtattcagtcagctatcccgcagctttcaccagatatctgcgagtgagagcacgaagtcggacggagaaatcgaacactttatgaatgcggtggcagaagggacatgtgcctcctgcttcaagtgtgagcagtgctgggacggcaagtttatgcaaacccatcagtatatgacggaaatgatgagcgccattgaggataacccggatttggagccggagcagatacccccgcaatggagcaaggcatgtgctaaaacgggcgctgtcctgcaagtgatgaagcagcagtatagcctctaccaacataatatgcagtggaagcgccaagtatacgatagtcgtcagcttgttgctgaccagctatcgggtgtatcacaaattatggaggatttagcgcgagaaattcagcgggaaggacagaccatgcatcggcaggaggagcaaatacgagaagctcttgatagactgggcttgtccatccaatctattgagattattaatctggatgcaggtcaggtagaaattgagattgtccatgcctatacaaggggatttgatgaatgtcggaaaatcattgctccacttctgtcggacatactggacgagcatatagctgtgatgcgcgaaacggaggcagatcgccgccaaggcttggctacagtcatgttcggctctgctaaaacgtatgagattgctacaggggtagctagtgccgccaaaggaggcgattttttctcaggtgacagctacagcatgatggagctagggaacgggacttttgcagtctcattaagtgatggtatggggaacggagagcgcgcgcagcaagaaagcagtgcagcacttaacattttggaggaattactgcaatcgggtatggacgaaaagttggcgatcaagtcggttaactctgtcctgatgctgcgatcacctgaggaaatgtacgctacggtcgatatggcgctgattgatcagtacacggcccagacaacttttatgaagattgggtctacgccgagctttattaaaagaggggaggaggtcatccctgtatctgccagcaacttgccgattggcattatacaggatattgaaattgatttggtatcactacagctccagccgggcgatattctcattatgattacagacggtatatacgactcaccgggttacgcggttaataaggaaatatggatgaaacgcatgattcaggaaattgaaagcgaagatcctcagcagttggccgactgtttgctagaacgggttattcgataccagcaaaatcaaatctatgatgatatgactgtagttgttagtaaaatcgaccacttccgcccagagtgggcaactctccatgtacctggcatgaggtggttggaacgtccacggacggtgagctaagccgacattgcccgggaaattccttacccatttttaaaaatccgcatccttcgtttgaatcgttccggattaggcaaagatagaatctatcgggatagattaagaggaagcggaggtcaaaaaacgatgaagcaaattttgatcattacagacggatgctcgaatgtaggtgttagtccagtcatggcggctgcccaggctttacgggaaggtattacagtgaacgtcgccggagtcatagattatggaactattggcgagcttggcagtgcggagattcaagaaattgctaaagcagggggagggtttagccaaatcgtagggacgaagcagttggcgcagaccatgcagatgatgacgcgcaagacggtggttcaaaccattcagcaggcggttaatagagagttaacgcacattctgggtgagggtggcgccaaacatatcggtgaacttcctccggccaaacgagcccaagtggttgaggtgatggatgaactgacagaaacaagcaccctggagattgctttgctcattgatgcaagtgcgagcatgaagcccaagctacctgctgtagaggacagcatccgtgatttgctactcagtttacagtccagaagcggacacagtcgtatatctgtgtttcattttccgggcggcaaaatgggagaagacgcagtcatggatatcggttggacctctgagcttaaccagatcaaatcgatatttggacgcttgcggatgaaaggggcaacaccgacaggtcctgccattttacaagtgattgattattaccgatatgttacactaggagaacagaaagatctggaagaatcctatggcaaaggagaagggatgctcggtgactacgtcgtctgatcccgttcttgcacccggaacggtcatcaagggcaagtggaagcggagcagctatgtcatccagcgcttgctgggccggggagcgaacggaactgtatatttggtaaaagaagcacaggccgatcggcaatttgctctgaaaatggggaagaacacgcttgatctgcaatcggagattaatgtgctgaccacattgcagtctcaggggactcaggccgcccttcagcgcaatggaaatccttcctttttgtttgaggtggatgatgtagtgttacgcagcggagaaatccccttttatgttatgcgatatgttaagggtgatccgcttcatcgttttgtggcagccaaagggccggaatggtatggtgtggctggaaccggtatactgaatcgtctggcggatctccatcaggcaggatgggtgtttggcgacctgaagccgcagaatattttggtcaatgcctatggagaggctgaattaattgactacggcggggtgtctcttgctggtcggagtgttaaacaattcacagagtggtatgataggggattctggaatgctggcagccgaaatgctgattcccagtatgacctgtttgccttcgctcttctaacgattcatatattggagagcgaatcattaaagaccgctgcgagtaggctgccacagctgcggaatacggcagaattgacggtcatcattcgccgtagccgtgtattgcgcccctatgccgaatggctgctgggtgcagtgcgtggagaatattccgatactcgtgcagcggcccgatcttggtcacgtttggcttccgcacatgtcaggcaatcgtcggtcaaaaaagggaacccacgctggctgggatatgctttcacggtatcgcttttgctgcttgccggagcgctctggattgcgttaaggtagcagcagacttacataagataacagatgatcatcatttttacggtcgggagaaaagagggtcgtgaatgggaacaacaaaaccgaccggtgttgtacaggaagtgctcgccttggcgcgagatcattcactgtggagccccggagaccgcattgtggttgctgtatccggtgggccggattcggtggcccttttgcacattttacatgaaatatccgttatacatatgcctttacaactcgtctgcgctcatgttcatcatggcttcagaccagaggaatcggatgcggaggctgaagaggtacgcaatattgcccaaaagctcgaacttccatttgaaatgactcgggtggatgtacccgcttatatgaaggagagtgggaaggggccacaggaagcagcccgcgagctgcgctacagttttttacatgatatggctacaaagtgggaagcacagcatattgcaatggctcatcacggcgacgatcaagccgaaacggttctcttgcacttgctgcgtggtagcggcccagcaggtttggcaggtatgcgtttggcgcgcagggaaaaaaatgtgcaactcattcgcccgctgctacgtatgtacaaggctgacctgattgagttttgtaacttttatgatctttcctatgtgatagacagcactaatttatcatccaaataccgtcgtaacgccattcgcatggatgtgcttccttttttggggcaatataatgagcgactgacaccgtccctaaaccggctggccgaaacgatggctgacgaaaatgactttatggaggcatccacgctgtcggcatacgagaaaatggtgcgcttggataatggcaggtacatgtttcccatcgcttcataccgtaagctatccgttgctttacaacggaggttgattaaactaatattaaattatctgccttcggacagtgaaaattttgattttcgtaaaattgagaccgttcgactaagacttctccaagaggcatcgtctacatggagtttggacttgggaggcggtgcggttggagtccgcgaatatgaccaggcggttttgtttgaccgtacgcaagtcgttatgggcgaatggtgctatggactaagtgtattgcctttttccggtgagctagagttgcctgaggcaggtggtatacttcggtggcgaagggcttcctattcggatgcggaccatccggcgaataaggaggaagcgtggttcgacgcagatcaattgagtctgcctttgactgtacgctcgcgattacctggagataccatgtatgtaatgggattaaacggaagaaaaaaggttaaagatatttttattgatgaaaaaatacctccttcaatgcgttccgttactcccatcgtctgcgaccacgctggaactattctctggattccgggcgtacgacgttctgtacatgccgcagtgcaaaagcacacgtcttcggttatatatatgtcatggcaaagacgagagagtccggggcatcggtaattgcgcaggaacggctttcatagtataaacttaggaggtttacaccgttgcaaaatgatattcaggaaatattgatcagcgaagaagaaattcagagtaaaattaaggaattgggtgcacagctcagcgtgaaatatgaaggtaaaaatccattggtgatttgcgtactgaaaggtgcgtttatctttatggctgatttggttaaaaccattacagtgccgttggagcttgatttcatggctgtatcaagttacggagcatccacaaaatcctcaggtatcatcaaaatcattaaggatttggacgcatctgtagaaggacgcgacgttctgattgtcgaagatattatcgacagcggcctgacgctgacgcatttgattgaattgcttaaaaaccgtaatgccaattcggtatgtgtcgtaaccttgttcgacaagcctgcacgccggacagttaatcttgaagcagattatactggatttacgcttccagatgcgtttgttgtcggctatggtctggactatgccgagcactaccggaacctcccatacatagggattttaaagccggaaatctacaccagctaatctcagcctccagtcctaggactaaataaggccctttgttgagaaggacttacaggctatggtaaaataacttaagtgtctcgagaggaggtaggggatgaatcggttcatccggaattctggtttttatttgattctttttttagttgtggtgggtatcgttcagtttgttagcaacagtaacgaagcctccgatctccctagatatgaccaattacggcaagaggttaaagctaataacatctctaaagtaacggtccaatttgacggttacgcctatcttgtaaccggtgcatataagaagcagccggctaatgctaaatcgaccaatttttccgtatatgttccaccaacggatcaagcactaagtgaactggtgaatgccagcgaaacgaacgggtttgaatacgtgcagaagaaaatggaaggcgaaagcatttggctgacgtttttgacttctatcattcctttggtgatcatgttcctgttgttcttcttcctgtttaatcaggcacagggcggtggcggcaaagttatgaacttcggcaagagcaaagcccgtctgtataacgaagagaagaagaaggttacgttcgaggacgtggcaggggctgacgaagagaagcaagagcttgtcgaagttgtagaattcttgaaggacccacgcaagtttgcagctgtgggcgctcgtattccaaaaggtgtcctgttagtgggccctccaggtacgggtaaaacactcttggcgagagctgttgcaggcgaggccggagtaccgtttttcagcatctcgggttctgattttgtagaaatgttcgtcggggtcggtgcttcccgtgttcgtgatttgttcgagaacgcgaagaagaacgcaccttgtatcattttcattgatgagattgatgccgttggacgtcaacgtggcgccggattgggtggcggacatgatgaacgcgagcagacgctcaaccaattgctcgtagagatggatggattcggcgcaaacgaaggtatcatcatcgtagcggctacaaaccgtccggatatcttagacccggcgttgcttcgtccaggacgttttgaccgtcaaattacggttgaccgtccagatgttaaaggccgtgaagcggtattgtatgtacatgctcgcaacaagccattaacaaaggatgttaaactggacgtaattgcgaaacgtacaacaggctttacgggcgctgatctggaaaatctgttgaacgaagctgccttgttggcggctcgtcgtaaccgcagagatatttcgatgcgagaagtagatgaagctatcgaccgtgttatcgtaggtaccgaaaaacgcagccgcgtaatcagtgaccgcgagaaacgaattgttgcttatcatgaagcaggccatacgattattggtttcttcttggaaaatgccgacatggttcacaaggtaacgattattccacgtggacgtgcaggcggatatgtcatcatgcttccgaaggaagaccgcatgctgacaaccaagcaggaattgctggacaaaatcactggattgttgggtggacgcgtatccgaggaactgttcattggtgagatcggaacgggagcctatagcgacttccagcaagcgacaagcattgcacgcagcatgatcgtagaatatggtatgagtgagaagcttggtccgatgcagttcggtacttcacaaggccaagtattccttggacgcgatatcggtcatgagcagaactacagtgatcagatcgcttatcagattgaccaggagatgaatcgcttcatcactgagtcttatgagcgtgctagagaactcctgaccaagtattccaaagaggttcatttgattgctcaaaccttgctggtagaagaaactctagaacttgaacaaatcaaacgtttgatcgagacaggttctttgaatggtggcacaacggagggagaaggaacaccagaaaatggtgagcctgtgatcgacaacattggagacgtccgtgtacgtattcaaggtaaggatgacgagcctaagaatacaacggatcaaccgaatgatatccctaatctgaaaaagccagaggatgataacaattcgggcaactccggtggtactccaccgacaacaccctaatcatccgatggatagttgaataagcgtataggtaagctccggggaaccaggtattattggttttccggagttttttaaatggaagattattgctaatgtgatttgacagacatcggaacgttgtgtacatttattgttaaataaacggctgtcgtcttcttagcgtataaaagccaacagtcgctgcaatcgactctctatcattttgaacatatacgtgagcgcatactgtagaacctttggtgtgcgctattcttctgtgaaatcaggtgaaggcatgattccaagatatctagttgattttgatgtagcggacttgacccgattggaggccgacgtgttaattatcggctcgggcattgcgggcttatatacggcgattaaggctgcggagaatcggaaagtgttgctgattaccaagaagactttgatggaaagcaacacgcgttatgctcaaggcggcattgctgctgtcacatcggacgaggatacaccagcttatcatatggaagatactctgattgctggtgcaggtctgtgtgaatctgaggcggtcagtacccttgtccatgaaggtccagttggtattcaagagttaatacgtatgggaacggcttttgaccgtgtggatggtgaactagcgttgacacgggaaggagcgcatagtcaccggcgtattttgcatgcgaatggagatgctaccggttatgaaattgtgcgtgccttatcagaccaggttgctgcccatcccggtatcgaagtgtgggaagaatgcatggtaattgatctgctgacggagcatggtgagtgtattggggccctcgtccaaaagccaggtggggaaaggtcgtatatcactgctaatgcaacgattttgtgctcaggaggtagcgggcaattataccgttatacgaccaacccggatattgcaaccggggatggtatcgctatggcatatcgtgctggggcgattgtacgggatatggaattcatacagtttcatcctaccgcgttgtgccatccgggcgctccaaggtttctaatttccgaagctgtacggggagaaggagccgtattacgcaatattcacggagaacgcttcatggacaagtatgattcccggcaggagcttgcacccagagatatcgtagctcgtgctatcattcatgagatggaacgcacccaagctgcgtttgtatacctggatattacacacgagccgcctgagcgggtgaagcaacgttttccaaccatttatcggacatgtctgtcatttggtttggatatgacgacagactggatccccattgcgcctgctgcccattatatgatgggtggtgttcagactaatctacagggggaaagctccattgcgcgtttgttcgcctgcggggaaacctcttctacaggtgttcacggagctaatcgtctggcgagcaattcgttatctgaagctattgtattcgccagcaggattattgagcgactgcattcattgccaccgctagtcggccatacgttgatatcttatagcgataaccgtacagagttcccggcttcatccgtcgcggagcagcggcataggctgcaagaagcaatggttcgttatgctggggttcgtcggcacggcgaagggctgcaagcagcattagatgagttgcaagggctaatgcctatttttgaggctgtgatcgctagccgggaagagatcgaatttgccaatttgctcacctgtgctttattagtaacagatggtgcgctgctacgtgaggagagccggggagcgcattatcgcgaggattttcctgagacagatgatagcgtctggcgaaagcatgttcagcagcgacgtgagcaagggataacggaggagtacgttcatgacatctaacagcgagctttatggagagtttagtggatatcaggaagaactgacggcacaaattcgcagctggctgcgagaagatacgggctctggcgatgtgaccacgcgctggacaattgagcaggaccaccaatccaaggctgttattcatgccaaggagagcggcgtggttgcggggttacccgtggctgcccttgtatttcagatagtggacccttccttgtcgttcactccgctggtagtcgatggacagtggattgaaaaggggagcgttttggcagaagtaacggggagtacccatgcaattctgaccggggagcgattggcgttaaatctgctccaacggatgtctggtattgccacgcggactcgggcttttatagatcaattgcatggtctgtccactcgcttggtggatacacgtaaaacaacaccgggacatcgactgctggagaagtatgctgttcgtgtaggcggtggctcgaatcatcgctttggcttgtacgatgctgttatgattaaggataatcatattaagggcgcaggtgggattgaacaagctgtgagtcgagcgcgcgctaatataccgcatacgatgacgattgaagtagagacggaaaacatgaaacaagttcaggaagccctggaagctggggcggatatcattatgctggataacatgtctgccccagatatgaaggaagccgttcggttcattcgggaacgggcaccacatgtcaaaacagaagcctcaggcaatgtatcgctggatacattgcgtgagatggctgagagtggcgtagatgtgatttctgtaggcaggctgacatactcttttcataacctggatatcagccttgaccttaacgcaaagaaagataggtgacacccattgattcttgtagtggatgtaggcaataccaatattgttctggggatatacgaagggcgggagctgttgcaccattaccggatcagtacctccagacaggcaaccgcagatgaatacggcgtactcatacataatctttttagtatgggtggcgtattaaaggatgacatccagggagtgattatttcctctgtcgttccgccattggtccgtgtattagaagaaatgtgcgataaatacataggcaaaacgccgttaatcgtcgggccgggaatcaagactggtcttaacctgcgttatgagaatccacgtgaagtaggtgcggatcggatcgtgaacgctgttgcggctgtcgaacgattcggcgggccgctggttgtggtggactttggaacagcgacgacgtttgattgtattgacgataagggaaactacttgggcggtgtcattgtgccggggatcgggatttcgacggaggcactgtatcaacgggcttccaagctgccccgcatcgagttggagaaacccaaaaaggttattggtcgtaatacggttcatgccatgcaagctgggattatcttcggttatgcggggcaagtggatggcattgtgaggcgcattaaagaagaaatgcaggtggaacctacggttattgctaccggaggtcttgcagagctaatcgcatcagagacagagagcattcagaaagtgttgccaatgttgacgctcgaaggattacgcatcatttaccaacgtaacgctgaataaaaaagtggatataagctgccgctgagtccaaccgatgatcttatcggtttggattagcggcgtttttcgtctatactgaaatatgttacgtttttgaacaattcgcgtgatctgtcgatgcaggttgtttatataataggaaattatgcttcaatgatgagccatactaacgaaaataagcagcatagctgtcctggagaataggggaggatatcaatatggaaaataagcaagatcgacttattcgtggtacagccatggatggaagggttagagcttttgctgttcggacaactcaattggtagaggaattgcggagaaggcatgatactcatcctacggcaaccgctgctttggggcgaaccctcacagcaggtgctattatgggttctatgctaaaaggcaaagagcgattgaccattcaagttaaaggtgatggaccgattgggcaaatcgtcgttgatgccaatgctgtaggggaagtacgaggttatgttactgaaccgcatgtgcatttgccgagcaatagtatgggcaaactggatgtagcgggtgccgtaggtacagaggggttcattcatatcatcaaggatttggggttaaaagaaccgtatcgcggcagtactccgattatttccggtgaactgggtgaggactttacctattattttgccaaatcggaacagaccccgtcagcggtgggcttgggtgtgctggtagatacggataactcggttattgtggccggtggatttattattcagttgcttccaggcttgaatgatgatgagattactgcgatcgaaaatgcagtcagctccattccacccgttactgctttgctggatcaagggttggaacttgatgaaatgctgcgctggatgctgccggacgttcggattctcgatgaattggatattcattttcaatgtgagtgttcacgtgagcgcgtggaaaaaacattgatcagtttgggagaaagcgaattagagcagttaattgaggaagaaggacaggctgaggtcgtatgccacttttgtaatgaggcttatcaatttaataaagatgaattgcaaaatctgttagatcaggccaaagcctaaccggatgggcggtgcaagcgatgactacacgggaaaaaggattatggacagctgtcattattctgaccgttagcgtcgccgccttgggtggtcttatcatgcttcgggggctgtcaaagccgggtgatgtaagcaaggatgacggcgatcatactgtggcggagatgggtcaggaaggcatatcggaggaacagtgggtagcggaactgaaaaagcgatatggaaccaatacgctgttgcaaatgttgaatcgtaaagccgtgcaggctgaaaccaagcgtctcggtatcaagatcacccaagaggatctacagcaggtgctggagcaggatagtaaagggtatgactcagatcatgcctattttgatgaaatgcagcgacagtttggcttaggtccggttgatttgcggaatgaagcggaataccggattggtttggagaaaatagctactcagggtattcaggttcaggaagctgagattgacgagtattgggagcagcatcctgaggaatttgccgtcggtaagcagatccaattggcagctctttatgtggataatgcggaggaagcagaagcgttgctagatcgggttaagcagggggagagcttcgatgtgctgattcaagagcatgcaggtaagcctttcgacaaagatagcagtggacagctgggatgggtggatgaatatgatccattgcaaccggaggcgatcatgaaggcggcgagagagctaagctctggggatgttgcaggtccgatctctgttaacgatggctatgctgtcatttatgtacaggatgtaaggttgaagaattctccggataagcagcagatccggcagcaaattcgccgatctcttgcgcttgcacaagccgctcctttggaagaggtcgagaagggtctgcgtgataaatatggagcgcgtattttatctggaaagaatgcatcctaaacttctctgcaacgtagtgaaagaatattggtttgaaggaagcacgatgctgataacgcgggttgacagcatcgcggcttattcactcgtattgacattggaattgaagattgttatgattagcgtataaaaccaactatttttatcggaaattaatgaacggcaccaaattaaagtaattgactaagaatcatctacaatatgatttcgcaatttttaatatatcatctacagtcagggaggaattatcatggctaaagttgttaataacattaccgaacttatcggagaaacacccctcgttcgcctcaaccggatcgtaccggaagatagcgccgaaatctatttgaaactggaatatcagaacccaggctccagtgtaaaagatcgtattgcgattagcatggtagaagaagctgaacgtgaaggtctgcttaagccaggcggtaccattattgaagcaacaagcggtaatacaggaatcggcttggctatggtagctgctgcgaagggctataaggcagtcatcgttatgccagaaacgatgagcatagagcgtcgtaatttgttgcgtgcttatggagccgagcttgtgttaacaccaggatcagaaggcatgaatgggtccgttaagaaaatggaagaattgctgagtgagaatccggattattttgctgctgagcagttcaagaacaaagctaatatcaaaattcaccgtgaaacgaccggtcctgagattgtggaagccattcgttccattggcggaactctggatgcttttatagcgggaataggcactggcggaaccatttctggtgccggagaagtgcttaagaaagaattccctgatattaaagttgtggctgtagagcctgcctcttccccgttgttagcaggcggtaagccaggaccccacaagatccaaggactgggtgccaactttattcctgaaattttaaaccgtgatatctatgatgaaattattcatgtagaaaacgatgaagctttcgaggtagcacgtagagtggccaaggaagagggcattttgtccggtatttcatctggcgcggctgttcatgcggctttgaaacttgctaagcaattgggcaagggtaaacggatcgttgtcattgttccaagtaatggagaacgttacctgagtacgccactatacaatttcgagctgtaattatgtcgtaattgtgtatactatacgtaaggattccctcatttccctgttgcaggggggtgggggtttctttttaaggagagaatgtagacttattgaaaagtagggaaggggaagcacacacggatgaaatcgacagctagagtgacggaggcgcagtggcaggtttggcaggaggaaggctggagcatacttccctatatcgctgagtacccattacctgtgggagggctaccgtcatcgtggcggaaggcttgggaggattcgtcgccatatgcctttttgctggagagcgctaaaggtgggaggtacacctatctggctttaaatccggttgctatattggaaggcaagggagaacatgcagtttggaccgatttgcaaagtgggaaacatggagatatacatggtcaacctttgaaagtcatgaacaactggatcgctccttaccgtgcaccgcgtgtacctggcatgccttttttctccgggggatttgcgggttatcttggttacgatgtagctcgctcgttggagcgtttgccatctcaagctgcagacgatacgggcatacctgattatgtatggatgagggtgaatgagctatggatttatgatcacgaaaaatcctgcatatattgtgctgttcatatgcctgctcctgcgcattccgataaagtcagccgtgataccgatatgaccaatcccgttatacgggatgggccaaatcccatactttgcgagcattatgcggaagctgcccaacgtgcagaacgtatgctgattcagtggaataacatcataaatgcaggagagattgatcctgcgtaccctcgtcgttgtgctaggcttgccgaagaggggctagaggctgctcatcaagaatctgatggttggacagcggcatttaaccaacaagaatttgaacatgccgtaagacgtgtgcaggaatacattgcccaaggggatgtattccaggttaacttgtcgattcgtcagcaacgtgcgcttacagccctccctgaaaatatatatgaatggcttcgtctgctgaatccttccccttatatgggtatgctgcgtatgccagatttacggatcgtcagtggctcgccagaattgttggtgaagctggaggatggacgtgtgagcgcccgacctattgcaggtacgagaagaagggggctaacaccggatgaagatgccgctatggcagcagagcttctatcaagcgaaaaagaacgcgccgagcatattatgctcgtcgatctggagcgtaacgatatcggacggattgctgaatacggatcggtgcatgtgcctgaactgctgactgtcgaatactattcgcacgttatgcatctggtatctcaggttgaggggaaattagcccagggtcgtacagctatagatgtaattgctgctacctttccaggcggaaccattaccggggcacccaaggtgcgcaccatggaaatcattgaagaattagagcccgttcgtcggggtccttatacagggtctcttggatggattgactataacggcaatatggaattaaatattataataagaacactagctgttaaaggcagcactgcctatttacagacaggtgcggggatcgtcattgattcagacccgtacagggaatatcgggaatgtcggaacaaggccagagctgtcatgaaggcggtacaatgtggtgaagaagaagctgctttgagcagaagcggtatcacaggagggtgagtcgtatgattttggtgattgataattatgattcgtttacgtacaatcttgttcaatatttgggtgaacttggcgaagaagtaaccgtaaaacggaacgatgagattgatgtgaagggcatagaagagctggcaccagagcatattttgatctcgccgggtccatgcacgccgaatgaggcggggatatcactggatgtgatcagccattttaaaggtcgcattccgatttttggcgtttgcctcggccaccaggccatcggacaggcttttggcggtaaggttatccgggctgaacgactcatgcacggtaaaacatcaccgattcttcatcacaatacatcggtatttgaaggcttgccttctccgttcacagcaacccggtatcactcattgctggtggagcgcgagagtctgcctgagtgtctagagattaccgcagaaaccgcggaaggtgaaattatgggtttgcggcataaagaatttgccgtagaaggagttcagttccatccagaatccattattacggattacgggcatcaactattacgcaatttcctaaaacgcaaggtaggcgtctgattcatgaaatatatcggagtcaacggcgtcctcacggaagccgcaaaagccgtgattcacgtaagtgatcacggctttttatacggaatgggcttgtttgaaacattccgcacctacaagggtgtcccattcttgctggatcggcatctgcatcgactgcaggaaggttgccgaatgctcggcattccttttcaaccggatgaggagcagcttacgagacacatccaacatctgatggtggcgaatggactggatgaagcctatgttcgttacaccgtatcagcgggcgaagaggtgctaggcttgccgacgggggactatacgcgccccaaccatattttgtttgcgaaaccgttgccctctaccaatacacaaaccgggcaatccatttctccatcggcgcttcagttgttgcgaacccccagaaacactccagagggtggggttcgtttaaagtcgctccattatatgaataatattcttgcgaagcgggaacttcagcagtatgtcgaggctgtccgttataaggctgaaggaatgatgcttacggccaatggttttctggcggagggaatggtcagcaatctgttttttgtgcggaataatacgctgtatacccctgacttgtgtacagggattctgccaggcattacgcgtgaattcattttggagctggcgcatctgcgagacattccttgtgagcaggggttgtaccgctgggacgagctgaaacaggctgatgaaatttttatgaccaactctatacaagaaatacgacccgtggatttgttgttggagccgggtggagcaacgaaccatgtatcggttcccttgacacaaccccggtccataacagctttgctgttgcacgattatagacagaaagcagggatcaagtgaacataccgaccctttatcaacgtagttaccgaatgggggatgccgagcttacgctcggacactccacacagatcatgggtatactgaatgtgaccccagattcattttccgatggaggattacattatagtcccgagattgctgttttacatgcattgaagctggtggaagatggagccgatatcattgacattggtggggagtctacccgcccgggtcatgacccagtaggtgtggaagaggagctggcacgggtcattccggtcgtccaagccatccatcgtattgcaccgcacattccgttatctgtagatacttacaaagccgaagtagccaggcaggcgcttgaagctggtgcacatatcattaatgatgtgtgggggtttaaggcagaccccgatatggcacgtgtagctgcggaattcgattgcccggtcattttgatgcataatcgtcatgatcgtaattatagtgatttggtttctgatatgctgtctgatttaaaagagagtatccgattagcactgaatgcgggggtacgtgaggaacagatcattttagacccaggcatcggttttgccaaggattatgatgaaaatatccatgccatgacttctctcgatacattgagtcagctaggcttcccactgttattggctacgtcacgcaaaagatttattcgtacagcactcgatttgcctgtgaatgatgtggtggagggtacggcggctactgttgcttttggcattgctcaaggttgccagattgtgcgtgtacatgatgtggcacaaatcaagcgcaccgtacgtatgtgtgatgcgatggtgtacgggtctaaaaatgcactgagttatggtggttagaagacgcttcatgaatgatttgatcctacgatcgctgttgcaacgggattctttgaattggtaaaacatatgactgtaagaatcccgttgcaaaggcgagcgctccgcttcttcggattcaaatccttcattacgctaccaccagcataaagtcacttgattagaaaaatctaataaaaaacagggggtctacccacgatggataaaatggttttgcatcgtatggagtattacggatatcatggcgtttttccagaggagcgcaagctgggacagcgtttctatattgatttggaactggagcttgatctgcgtgaagcgggtgagcaggatgctttggacaaaacggttaattacgccgaggtacattacaccgttaaagatattgtagaaaaggaatcttaccaattgattgaagctttgggcgaacgtattgcatcttccctactggacacttatactagtgtcaatgcactgactgtcaaagtcacgaagccgcatccgccgtttgatattcattttcaaggcgtgacggttgagctttatcgcgcaagaaagtaggaacgatacatgaatgcacattcgacctctgagggatcagaggcttatattgctttaggggctaatttgggggagcgcgagcataccctgtatgaagccattacggcgctggacgaacatccgggtatacgggtgctgcggtgctccagcctgtacgaaacagaacctgttgggtatctggatcaaccttcttttttgaacatgacggtagccgtatctacaacacttgctccagaggagcttctggtatatatgctggaggtggagagtcgtctggggagagtaagacatattcctaatggtccacgaaccattgatctggacttgttatggatgggagcggcgcaactggctacaccggatttggagcttcctcaccctcgtatgttggagcgtgcttttgtgctggttcctttggctgacatcgttccgaaccaagatccgtccggtctgtacagtatcgtgcatactgcattgaattctgtggatggaaaggacggcatacagctttggaaaacatgcagctggcgcaacgactccgcgcctttcggaagctaaaagggttcacacagcaggagttggcagaacgtactggtatatctttgactgtattaggtgctgtggagcgaggcaatcgtacagtagacccagacatgctgaacatcatcgcccaaacgctagagattgaagtccgggaattgacggattgacgataagtatacgatataaaagaaggaataaaggggtgaacagatatgttgaaaatcggcgatattgaaatgaaaaaccaagtcgtcttggcacccatggcaggcgtgtgcaatcctgcttttcgcttgatcgccaaggaattcggtacaggcttggtatgtgcagagatggttagtgataaggccatcattcacggcaacaagcgtacacgtgagatgctgtttgtagatgagcgcgagaagccgcttagcttgcaaatttttggaggcgaccgcagatctttggtggaagctgcgaaagtcgtagaccaggagacgaatgcagatattattgacatcaatatgggctgcccggttcccaaagtgaccaaatgtgatgcaggcgctcgttggctgcttgatccaaacaagatttatgagatggtatcggcggtagtggaatcggtaagcaagccggttaccgtcaaaatgcgtattggttgggatagcgagcatatttatgccgtagagaacgctcgcgctgttgaacgtgccggaggtcaggccgttagcgtgcatggccgtacacgggagcaactgtatacgggacatgcgaattgggatattataaaagaagttaaagaagcagtttccattcctgtaattggaaacggtgatgtggcatcaccggaagatgcccgccgtatgctggatttgaccaattgtgatggcgttatgatcggacgtggtgctctggggaatccgtggatgctctaccgtacgattgagtacctacaaacgggcgagctgttgcccgatccttcaccggaagaaaaaattcgtattgccattctgcatatggatcgtctggttgcattgaagggtgaagcagtagctgtccgtgaaatgcgtaagcatctggcttggtacctcaaagggtttaaaggttcggcacgtattaaggatgtcattatggaagaaacaaagcgcgacgatatggtacgcattttggatcaatttgtatctcaattgcacatggtagataacgatgagtcttctacaagcgctgcttctcctgctgctgttgcgcaataaggaacctgtaccggcctgtgcacgcgattgacttttccaattgcttgccctataatcgttcagtataaaatcttgatgtatgctacaaattgtgtgcagctctcaagacaacagaaggaaatgttctcattccctcagagtggcatattatgttttgaaagcgtgcattccgatgcacttttaaacttttcccatgacaggagaatcggttaagatgagcgataaagaagtcattctgacacaggaaggtcttagaaagctcgaagatgagcttgagaacttaaagtctgtcaaacgccgcgaagtggctgaacggattaaggtagccatcggatacggagatattagtgaaaactccgaatatgaggatgcgaagaatgagcaggcctttattgaaggccgtgtaattacgttggaaaagatgctacgcaatgcccgcattatcaatagtgatgaaattgacaccgatgttgtgggagtaggcgcaactgtgaccgttgaagatttggaattcggagatattacagagtatgctatcgtaggttcagccgaatctgacccgctacaaaacaagatttcgaatgaaagtccggttggcaaggcaattctcggtaagaaaaagggaactgttgtggatgtcaccgttccagcaggcgttattcaatataaaatcgtggatatcaagaaataagacacggactttggaatttagtgtaaaagcttccttgtggaagctttttttctctacacccggacggaccccggcccgtctattcatattgaaggagctgatttagcaccatgtcggatgaaactactaaccaggaatcacaagaaaatcgcgaggaattaagtgaactattgcaaattcgccgtgccaaattggacgagcttcgctcattgggcattgatccctttggacgcaaatacatacgcacggctgaagcgggcgtactactgagcaagtatgacagtttgactaaggaagaactggaagaaaagaatattgaagttagcatagcaggccgtattatggctaaacgtgtgatggggaaagccagctttgctcatatacaggatcttagcggacgtattcaaatttatgttcgtcaagacacggtacctgaatccaaatataaagcatttggtattttggatctgggcgatattgttggtgttaagggtgtgctctttaaaaccaaaacaggcgaaacgacaatcaaagtgctggatattgaggtcttgtccaaatccttgtatccattaccagagaaatatcatggcctgaaggatgttgaattgcgttaccgtcagcggtatgtcgatttggttatgaaccctgaagtacaaaaaacgttcattacacggtcccgtattattcaatccatgcgtcgttatctcgattcgctcggctatttggaagttgaaactccaacattgcattctattgctggcggggcggcagcgaagccatttgttacgcaccataatgcattagacatgcagctttatatgcgtattgctattgaactccatttgaaacgactaattgtcggcggaatggagaaagtatatgagatcggtcgtgtgtaccgtaatgaaggtatttcgacccgccataaccctgagtttacgatgattgagctgtatgaagcgtatgctgattataaagatatcatgcaattgacggaaaacatggttgcacatattgcgcaggaagtactgggcacacagcacattcaatatcaaggccaggaagtggatctgacgccgcaatggcgcagagtctccatggttgatgctgttaaagaagtaacaggcgtagactttagcgtgcagatgagtaatgaagaagctcatcgtcttgcgaaagagcataaagtttcggttgaaccgcatatgacatttggccatatcctgaatgcattctttgagcagttcgtagaggaaacgcttattcaaccgacctttattactggacatccggttgaaatctcaccgttggccaagaaaaacgaacaagatccgcggtttacggatcgcttcgagctgttcgtggttgctcgtgagcatgcgaatgcgttcactgagctgaatgatccaatcgaccagcgccaacgttttgaagcacaattgctggaacgtgagcacggtaacgacgaggcgcatgaaatggatgatgactttatccgcgccttggaatacgggatgccaccaacaggtggactgggcatcggcatcgatcgtttggttatgttgctgacagatgcgccttccattcgcgatgtgctgcttttcccgcatatgcgtaaccaacagtagaataacataacattatgaatatagaggatcagccgggcttcccgtgtcttgttcctctttttcataagaacggatggagagaatactctaatgaaacgcagcgtcaagcttagtcggtttgcatcgcctccttttatattggtcatcggatatttattgattattgcattgggtactttgctactgatgcttcctgttgccaatcatagtggtcatgctccgcattggattgattcgctttttacgtccgtctcagccgcttgtgtcacaggactggtcgttgttgacgtcgattcaacgtatacgatgtttggcgaaactgtcattttggtgctgatgcagctaggcggtctggggtttatgaccttagcgaccttgtttgcgctgttgttggggcggcgattatcgttaaaggatcggttgctgcttaaggaggctattaatgccgatagcatggaagggatcgtgcgtattattcgcaaggtgctgatcttttcttttaccattgaggcgatagctgccgtcgtcttggctttgcggtggatgcgagagatgcctgtcggacaagcaatctattatggaatattccattccgtttccctctttaataacgggggattcgatctgtttgggactagcttccaacagtacgctggagattttgttttcaatataattgcatctgtgctcgttatatctggaggcttaggtttccttgtacttagtgatttgttcgattttcgccgtacccgaagactgtctctacactccaaaatggtacttagcgtgtcgggagtgctcattgtgattggtgcgctggttatatttatttttgagtttacaaatgcacgaaccttgggcgcgttgaactgggaaggcaaagtatatggagctgtctttcaatcggtctccacgagatcatcaggtacgagcacagtcgatatcagcgggttaagacaggcaagtcagttttttattatgttgctgatgattatcggtgcttctccgggctccacgggaggaggaattaaaacgactacgttcctgcttatggtaggtgcgctaatcgccgtcatgcgaggacagaaggaaattgtatttttccgccacagggtccctaacgatatcatgatgcgggcgctgaccattattgtactggccctatttatattctcgattgtggttgtactgctcctaatgacagaggatgccccatttctctcccttgcatttgaggctgcttccgcaatcggaacggtaggcttgtccgtaggagtaacgccaggattgtctgatgcaggcaagctgattatttgtgtgaccatgtttattggtcggattggtcctcttacgattgcctatgccattcgtccacgctcgaccaagacattgtaccgtcgtcccgaagggcatattgtaattggatagtgtatctgtaaaaaagatgtacccgtgctgatcagcataggtacatcttttttcatttcagatcatcataattctttatgggtagcatatcatgtaaaatgcccattttgagaacaaaacgaaatgatctgaacagatactgtttttcgcagaaaaaaacggctatttgtttccttttatgtaattatagacaaaatactaggaatattatgtataatattgtatgatagtgggcatgaaagggggatagttgaggtaaataccaatttctaatttgaaaggaatcatctattatgtatttatttattattagtgctgaagttttattttgggtttttgttgttgcaggcttgatcgcaaggtatatgtttggcttgaagaagttaggcggtcttcttttactatttacccccattattgatatcctgttactgattgcggtgttcatcacggtgaaaagtggcatggagattacgactgctactggcttggcggcctgttattttggtattacagtagcatttggtcataggttaattaagtgggcggatgtacggttctcccattggtttggtaagggacccaagcctgaacgcaagtatggtgctgctcatgcaaaagaggaacggataggttggttgcttcaccttttgggttgggctataggtaacgctttgttgctcgccatcattgtgtatgttaatgatcctcagcgtacgatgtctttggagggcattatgcaaacatgggcaatcgttctggcaatcgactttgttgtctcctttagctatactgtagctcccaaaaaacaaaagcgtagtctataaaggttaaggctttacacttagatgatatctggctggtcactcaggatgttcaaatcggaagagtcattgttggtgaaaatgaagtggttacttccggtaggtgggtgattctgtcatcggaatgtaaatatttacaaaaatatgcggattttatgtttaactcgctttgacagtcaccttgtttttgcctcgctaccttttttcacacacatgtattcctttcgatttgaacacgaccaacagaagcaacacaactatttcttgtgagatgacagacagtatacacgatgtgttacacaaattttaaaataaattttgtgatttgcctaaaacgtcgcctatccaagtttggcaattaacgcgataatattccaggaaagattacatatgtctataaatgtagacatacgcaattaagttgttattttgtttaaaaatgtaaaaaagaaaggtggtttctgtggcagtactactgagcggtaagaacattttgattatgggcgtggctaataacaggagtattgcctgggggacagctcaatctttagctgctgaaggggcacagctcatttttacttacgaaaatgagagggttgcagagcgggtactaaagctcgttgaaaccattccgggagcactggtctgtccttgtaatgtacaaagcaatgaagagcttgatgcattggcggattttctaaaagaaaaagtaggcgtattgcatggttattttcacagtgtcgcctatgctaaggctgaggacttggatggcttgttcgttgacacttctcgcgagggattcgccgttgcacaagaaatcagtgcctattctctggctgctgtatcccgtcgagtatacccactgatgacagagggtggaagtatcgtcaccatgacgtatattggcgcagaacgagcgatcaaaaattacaacgttatgggtgtagcgaaggcttcactggaagccagcatgcgctatctgtcgaatgatctgggcacatatggcattcgtgtaaatgcgatttccgctggtccgatacggaccttggcggcctatggcattaaagattttaacacaatgctcaaacatattgaagaaactacgcccctacgcaagacggttgatacgtcggaagtcggagatacggcgttattcctattttcccatttatcgagaggcattacgggtgaagttatccatgtagatgctggataccatattacggggatgtaaggagggaacgttgtgcttattacgcatacagattgccgtattatctcacctgaaggagttatgactagggagcgtctggagcgagacgttacgatcttctcccggatgttgacgctcagaggaattcccgaagacggtagagtgattctgaaagcggccaattcctattggtttgttgtgtctctgttctccctgtgcaatattgctgtttcggtgactgtggtggacgagcagactgtgctcgatgaggtggcccaaatctatgatgaagcgggtgcctgttgcatccttacggattccgatttagaacttcctcatgctctcgttattctgattcaagatctgattcaagaagaagcagtacacccggattgggtgggagagccaaagcttgaagccctcgactttagcaagtggtgcgagaggtcagatgcgctcattctgtattcttcaggtacgacgggcaaacccaagggaatcgtgaaggctggttcagcttttatggagaatatcaggcattccatacacgccatgaactacctaccgtctgaccatatgctccccgttgtgcctttttctcatttttatggaatctcacttatcttctcctggtggttaacttcatgttctctcatcatctgcaatccaaaaaacctctggagcgtcattgcaagtattacgaaagaccgggcgacggtcgtagacgctaacccctctgctttttacaccttgttgcgtatgctaaaccgaaaacccgaacaactggaaatggtcaaggaagctccggtgcgcatgtggtgcgtaggcggttccccacttacccaggaccttgaagagaaatttaacaacatatttggacagcccctgctgaatggttatggcctttctgaactgggcaacgttacgctggggacgctagagtgtccgaagggttgtggcctaccattacctggtgtggatctgaaaatactagattctacaggcaaccagcaggcggacggtatcgtaggcgaagtgtggatacgcagtgctggatgcatggaaggttatctaaatcgtccagacctgacgcaatccgttttacaggacggctggttcaagacgggggacctgggctatctggatgacggaatgctgtatgtcattggtcgcagcggtaagacggtcaaccggatgggctatatggtctctccagtctatatcgaggaccgaattggttcgctaggctaccgatcctgcgtgattaccttggaagatgaggctaaagggacattgcttgtcgcattcatcgaaagtgattcctcacaggtcgtgcctgtgctccgcaaagagatgagtcaggtactcccttcatacatgtttcccgatcttttgcttccgctcgatcattttcctttaaatcgcaatggaaaagtagatcgtctggagatggagcgtgttgctctagagaaagctgcttctcgcaaagcataacaagatatataccaaaactgcatacaggaaagggagaatgtgccatgagtataaatccagaactggcagaaaacacactgtttctgaaaaggcatgaatctattctgaaatgcctcaattatttgattgaaaatcggcaggaagtgatggatattctcacacaattttcatcctatcgggctgccaatgcagaaattgactccacgatcctcacacttcaaggcgctctgcaagaagttcagacctatcagccaagctggcaacaatctatggctgtatttatgccttccaacgtcattttgtactcctatgcattatacctcttgattccgtccctgtacgttgaaaatatagactttcgtccttcttctcacgtaaacgagtacgttaacatgctgcatgaaaagcttcaggctgtacatggattacccatctatattcgtaaagttagccagaaggtgttcatggagaattccgtgatgccagctgatattgtggtgttcaccggaagctataccaatgcagagaagatcaaaaaacagattcgaaaagatcagctctacattttttacggacaaggactaaatcctttcatcatcggacctgatgcagatctggagctggcggttaccgatgtgatccgaatgagattgttcaactctggacaagactgcctaggccccgacatcattctggtacatcaagatgtgagtgagcatttcaaagatctgctgattcaacagcttgaccaactcgtgtttggtgccaacgatgatccgaacgcaaactatacccctatattctataaagacacgctatattcggtttccgaatatttcaacacgaacgataagtttattatttacggcggcggcattgatttccgtacaaaaaagatggagccaacggttgtatatagtgaattggatcagaatctggagattattgagtatttttcgccagtcttcaatgtagttagctaccaagacgacgagcaattgatcaagcgtatttcctccagttatttcagtgaacgtgcaatgggttgcagcttatacggatcggagcacctgactgacgttctgcgaaagaagcacacgctgaccattaatcagacgcttgaggatgtggatcaaggtaataagccttttggtggatacggcacgatgtcgaactatattttttacgatttcaagctcatttcgaagccgatcttgatttcagaaattgtcgcagaatatttgtcggaaaagaggagtttggtatgactgcgagcttctttccctgggatgccatcattggctacttaaaatcggctggggttcagcatctctttggattaccaagtgatgatctcaaaatcgtatcgtcactcccctcatccggtatggattttatcctgtgcaaagatcaacgtaatgctgtgttcatggcagcaggttatgcgctcaccaccaaccagatgtccgtatgtgttgtgggtaaagggcctgcgctcagtaatacacttacagggctgctggaagccaagaacctgggcgctccgctcctgcttctggcgcttggtaccggaggagataagctgggtacccgatcctttcaggaagccgatcaaatctcacttgtgaagccgcttgtaaaatgggcttatcgtgtcgagcatgtagatcggcttgtatgggcgatggagcgggctgcctttttggctatcaatggagcgccgggtcctgtctatatcgaactccctgaaaacctgatggaccagcctgtgccaacaggacttcagtttaccccaccagaaaagctgtcgtgctctccgtctcatcgggagttggatgcatcgtggggaattattgagaacgcccgcaggccactcattctagtcggaggcggaatgaagtcaggtacaggtgatgtgattgagcggtttgctaaccaacatggagcggccttgttcgcaaccgcctcgggacggggtgtagttgatgaagaccacgaactcttctgtggtgttgcgggactctatacagatcttagtctaagacaaatctggaaggaatctgatgtggtaatcacactgggcagtcgattggaagaaacggctacttttgagtgggatattttgctacaggatacacctttgattcaagtcaatgtaaatctggaggattttgcacacgagtacaggggtatcaaggtgcttggtgatggatatgcagcggtggaacagtggcttgaacggcgcagccaggagcctgatggagtgtggcttgaaacgattaggagctgtaaacaggaggctttttctcacagggctatttatttggaagagctgaaaaagacccctggaatccacgttcctgagctgttggacatgattcagacggagtttcctgaaaatctggtgcttcttcaagagaatggattgcaggatatgtggtcctatttttatccatattttcgctttgcccaaggctctctttcgattgttcctagtgatcaaacgagtcttggattcggtgcggctgctgctctgggagcaagcgtggcaacacaacgtccagtagtagcactcgtaggtgacggtgcgttcaatctcttttgttcggattttatgacggcggtggagtatcaaataccgttaatctatctcgtactcaataatggtgggtatggttggttacagaatcagatgaattataagcatctcacagggcagtccctcccgtttgtttctgaggcggctaagacaggaattcaaattcctcagtacgagtttgtggaaagccttgcaattcggagtaagggagaggcacgcgaacagcttcagcttgcttggcaaaagtatcaggagaacaagcttgtggtcgtcgaggtatatgctgatcttgcggatgtgcatgaaaaaatcagccaagtgtatggcgactttcctctctacgagcaacaggcttccaagaattaatttcaacgaaggacgtggatacagtgagaagacgtgttgtagtgactggacagggagtcgtaacgccggttgggcttaatcttacggatttctggaattcattattggaaggaaaaagcggaattggacctgtcactgttttcgatacagcggacattccgacaaagatcggtgcacaggttacgggttttgacccattgcaatatatgagcaagaaggaagctaataaagtcgcacagttcactcagtttgctttggcggctgcccgccaggcagtggagcaatcaaaattagtgattgatgagcggaatgcaagtcgcgtgggagttattgtcggctctggagcaggcggcctcgatgttatagaggagaactatgggaaattaacaaagcttggtcccaaaagagtttctccttattttgtttcctcgatgatgattaattcagcacctggtgaaatctccattgctatcggagccaaggggccttcttttgctgtggttacggcttgtgccacaggaagtaacgccattggtgaggcattacgtacgatccagtacggcacggctgatgtcgtggttgccggtggagcagaagccaattttagtcagcttgatctggcatcttttgcgaatatccatgctctctccagacgtaatgaagagccgcagaaggctagtcgtccgtttgatgtggatcgcgatggattcgtcatcggtggaggagcaggagtcttggtgctggaggagttggagtatgctttgaaccgcggagccaccattctggccgaagttgtgggttacggatgcacaactgatgcgtatcatatcacggctccagatccctctggctccggcccggcagaagcgatcaatatcgcactgcaggatggcggcttaacaccgcaggaaatcgactatgtcaatgcccacggtacgagtacgccatttaatgatcgtatggagattaatgctattcaaaaagtattcggggagcatgccccccgtttggcgatatcgtctattaaatccatgactggtcatttaatgggcggtgcaggggcagtcgaattaattgcgactgtgcagagtatgattcacagcaaagtaccaccgacactcaattgcgacaatcctgaggctcctgaattgaattttgtgccgcatgtatatcaggaacgcgaggtccgcgcggcgattagcaattcatttggtttcggagggcacaacgtctgccttgctgttcgcaagtgggaaggggaataagcctgtgagcgaagagctaatccatatcccggatgtgcttccgcaccggtacccatttcttctgttggatggcgtgaccgggtacgaaacgtcgcaatgggcgaagggatacaagcttgtcacctggagtgagtggttcattactgacactaacccatacatgcctcctatgttgattgtggagtcgcttgcacaattagcggcattcgctgcgattgataaaaaaggtatttcatacctgactaacctcaatggaattcgattccacagcttggccaagcctggagaccgaattgatctctattttgaagtgatcaagcgtcggcggggctatattctcggaagcggtcgggcttccgtaggggatcgattggtggttgaggcggaagaaattgtttcactggatcaatgacggggtggaagcgcacgttaaactgtccttttgtcctcctgactgccaggtgcagcgggaggatattcacatcatggaataggagtgaatgagatgaatgacatgcagttatatgatttaacaaatgcgcagaagcgtatatggtataccgaattactctacccagatacgtcagtgtcacagctttccggtacagctaagatgaaggggcatatcaatattgctgcctttatgcagtccattaatttgattatcaaacagtatgatgcgttccgcatccgtattacctcagtggatggagtgcctcagcagtacgttgttccttatgaagagagacagttggagtgcctggatcttagtcactatgaaagtgtatctgaggtggaagccttacttgagcaacacaaaagaaaccccttgcccctgctcgattctgagctcttccagtttttaattgtgaagattagcgaggaagagtattggattaatatcaagatgcaccatattatttctgacggaatatcaatggtggtctatggcaatcagctgacagcattttatatggagttaattcaaggaaatgaaccggagctgggcgacgattgctcgtatattcaatatattgcagatgagaatgcatacgaactttctgacagataccaaaaggataaggcttactggctggataaattttctgatttgcctgagcttacgggttggaagtcatataatccgttatctttaagcacccacgccgttcgggagcattttaccgtaccagaagtgctatatcacgagctgcaagcattttgccaacagaacagaatttctttgttccagttcttcatgggtgcgatgtatatctacatacacaaaatgacgaatcagccggatgtggtgattggaacttcgttcgctaaccgggggaacaaaaaagagaagcaaaagataggtatgttcgtcagcaccgctgctgccagaacatacgtcaaaaaggatatagatgtattgagcttcctgcaggatgtagccagagatcagatgtcagtcctgcggcatcagaaatatccatacaatcagttaattcaggatcttagagaaatgcatgggaacaaggatattcagcggctttttggcgtttccatggaatatcgtcttatcaattgggttgatttggatgatgtgcgtattttgacagattatgatttctgcggggacgaagtgaacgatttcgtgcttcatatcgtggagatcctggatgaaggcgaactggtactggatgtcgattatcggacagagctgtttgaacgcagtgaagttaaggacatggtttcccagttgcttacgatcgccgagcagatcattcattcacctcagctttctattgcagaggtaaacttattgggtgaaccagaagagcagtccattttggctctttcggaaggcgccgcagtcgattatccacgtgagaagaccatccatggcttattcgaggaacaagccgagcgcacgccagatcacgtagccgttcagatggacgagcagagcattacataccaagctctaaacgagcaggctaaccagcttgcgagatatttgcgctccgagggagtaggagcagatacgctcgtagggattatggctgaccgttccttggagatggtcatcgggatgttggccattttgaaagcaggtggtgcctatgtaccgattgaccccgattatcccgaagaacgtatccattatatgctggaggattcaggtgtccgtctgttgctcacccaaagtcatctatgggagagcaccgcttttgacggaaagcttgtgagtctggacgaagctgcaacgtatacaggagatgcttccaatctggagagtatttcgggaccaagccatctggcctatgttatctacacgtcgggtacgaccggcaagccgaagggcacgctgattgaacacaaaaatgtagttcgactgctctttaacgataaaaatttatttgatttcaacgctcaggatacgtggacgctgttccattcgttctgcttcgatttctccgtttgggagatgtacggagcgcttctttacggagggaaattggtgattgttccatctctcacagccaagagcccagcagcttttctggagttgttgaaagacaaccaagtcaccattttgaatcagacgccgacgtatttttatcaggtgctacaggaagagttaacgcactcctcgacagagcttggccttagaaaaatcatttttggtggagaggccttaagtccatctcttctgaggaactggcgggtcaagtatcctgatgtgcagctgattaatatgtacggaattacggaaacaacagttcatgtcacctataaggaaatcacggaacatgagattgaagcggggaaaagcaatattggtagaacgatccccacacttagcgcttatattctcgatgagcaaagacgccttcaacctgttggggttccaggagagttatacattgcgggggacggtcttgcccgtgggtatttgaatcggccggatttgacgtctgagaaattcgttgagcatccgtatcgggcgggagagcggctgtaccgaactggggatcttgctcgttggttgcctgatggcaatattgaatatttggggcggatcgaccatcaggtcaaaattcgcggctaccgaattgagcttggtgaggtagaagcccaaattctcaaggctccaagcgtacgagaaacgattgtcctcgcacgggaagacgaacagggccaaaaattgctgtgcgcctactatgtagcctccagtgatctttcgccgggggaattgcggtctcagctggctgcggaactccccgcttacatgattccttcttattttgtccggctggagcaaatgccgcttacaccaaatggcaaactggatcgccgtgcgttgccggctcctgaaagcagcgtacaatccggcgaggcttatttggctccgagaactgctgtggaagctcagatggtactcatctggcaagatatcttgggcgttgctcgtgtcggtgtcagagataatttctttgaaattggtggtcactctttgcgggcaacagtgctcgtttcacggattcacaaagagttgggatgtagcatttcgctacgtgaggtgtttcagtcacctacggtcgaatccttggcgcaacttgtgaagaaacacattccgaccatgtacgaatccatcccacaggcaacggaaagcgaagcttacccagtgtcctcagcgcaaaagcggttatacgtgctgagacagatggacgggggagagctcagctacaatatgccaggggtcttcacagtggatggaccgttggatcgcacgcggctggagtctgcgttccaggcactgatccagcgtcatgaatccctgagaaccggcttttatatgcaggatggagaacttgttcagcgtgtgcataggaatgtgccgttcgcgttggactacacagaagcttcggtggaggagacggatacgctcattcacaactttattcgtgcctttgatctgagccaggctccattactgcgtgttagcttggtgaagctccgggaggaacgtcatctgttgctgtttgatatgcatcacatcatttcagatggggtttctattcaaatattgatagaggaacttactcatttgtatcaaggagaacagctaccagagctgcacatccagtacaaggattatgccgtatggcaacgggaacagtcagagaaccaatggcaagatcttgagaaatattggctgcaatcctttgaaggagagttgccggtattggatttgcctacagacttcccacgaccttcagttcggagcttcgagggtagccgaattgatttcacattggatgagcctggcaataaggcgatacaagagcttgcatcccgtacaggtactacactgtatatggtattgctggccgcttattcggtactactgcacaaatatacaggacaggaggacatcgtcgtaggttctccagtagccggaagaccgcaggctgagcttgagggcatcatcgggatgtttgtcaacacactggccttgcgcagctacccggcaggagataaaacctttcaggattatcttctggaaatcaaggaaacggcgctcaaggcgtttgagcatcaggattacccttttgaaaaattggtcgaaaagctgggcgtaggacgtgatgtcagccgcaatccgctctttgacaccttattggtattacaaaataccgagcaggaagagcaggaaatggacggagtgcactttactccttacttgatggacaccgtcacagccaaatttgacctgtccctcaatgtagaggagaagggggcaaaattagcctttggcctcgagtatagtacagctttatatcggcgtgaaaccgtagagcgacttgcaacgcacttgctccgggttctgcatgcagtctcggctaatcctcagttgcaactggccgagatagaaatgatcacaccggaggagaaagtacagatcgttgaagtatttaacgcgacatcggctccttatccaagggacaagaccattcatgagctgttcgtagaacaagtcaagcgtacaccagagcagacggcgcttgtattcggcgatgtccagctaacgtaccttgaattgcaagacaaggcgagccgactggcccaaacactgcgtcgtttgggaacgttgagggagcagcctgtggccgtgatgggccgacgaagcatcgagatggtcattggtatgctcgcggtgcttcaggcaggtggagcctatgtgccgattgatcctgattacccggaagatcgggtccgttatatgcttaatgattccgacgccaagctattattggtgcaaaagagcgagcttataagtgtagactacggtataccgattgtcgatcttagcagtgaagaggcctatgcagctgaacctgcccagccggagactgctcagggatcgcaggggcttgcttatgtcatctatacatcgggtacgacgggtagaccgaagggcgttatggttgaacaccggaacgtggtccgtctggtcaaagagaccaactatgtggagctgaatgaatccacacgaattttgcaaacaggagccgtggcctttgatgcttctacattcgaaatatggggagcgttgctcaacggtgggcagctctatttcgtggagaacgacgatatcctgattgccgataggctcaaagcggccattaccaagtacgggattacaacaatgtggctcacttcaccgcttttcaatcagctttccctgcaggatgagtacctgttcaaagggctaaaaacattgctggtcggcggagacgtactgtccatatctcatatgaaccgtgtaatcgaggctaatcctgatcttgtccctatcaatggctatggtccgacagagaatacgaccttctccaccacctacaagattctgggtcgtgccgaaggggtcgtgccgattggccgcccaattagtaattctaccgcttatgtggtcaatggatcgctgcaattacagcctattggtgcttggggtgaactcattgtcggcggtgaaggtgtagcgcgcggatatctcaatcgtcctgatctcacagcagagaaatttgttcctagtcctgttaaggacggagaaccctgctacagaactggggatttggtacgctggcttccagatgggaatttggagtttaaaggaagaattgatgagcaggtcaaaatacgtggttaccgcatcgaactccctgaaatcgaggcccaactggccaaggtggagtcagtaatcgacgccgtagtggtcgttcgcgcggatgagcttggcgagaagcagctttgcgcttattatgtggcggatcgtacgctcacggcaggcgaagtacgcctttccctatcgcaggtacttccaggctatatgattccatcctactttatccagatggatcgtatgccattaacgtcaaacggaaaagtggaccgcaggtctctgccggctcctcaagtaggcgcgcatacaggacggaagtatacagctcctcgtacaccggctgaggaagctttggcatctgtctggcaaggggtactgggtgccgaacaggtgggtatccatgacaatttctttgaattgggtggagactccataaaagctattcaggtgtcgtcacggttactgcaggccggctatcggttagagatgaagcagctgttcaaatcgccaaccattgccgagctaggcgcggaaattcaaacggctgtgcatatggctgaacagggagttgtgcgtggaacgactcgcttgactccagtccaacagtggttctttggacggaagcaggcagagcctcatcacttcaatcaatcggttatgttgtatcgtgaacagggatttgaggaaaaggccttgcatcaggtgctaagaaaactcgctgagcatcatgacgcccttcgcatggttttccgtcagacagagcatggctacgaagcttggaatcgtgatcttgaagaaggagagctttatagcctgttcaccgctgatttacggaatgaatccgatccgactgcagccattacatcgctgtcggatgacattcagcgcagtatcaatctgacagaaggtccgctgctgaagttaggacttttccattgtcaggatggagaccaccttctaatcgtgatccaccatttggtggtggacggagtatcctggcggattttgttcgaggatattgcagcaggttatgagcaggtaattcaaggacaagcactgacattcccgcagaagacggattccttccgtgactggggagacgcccttgctcattattcggaaggtccagaaatggcgactcatcgggcgtattggagagagctggaggatcagccactcgaacagttgccgaaggatgaggctgtggaaagccttcttttacaggatagcaaagtagtaacagcacaatggactctagaagaaaccgaccaattgttgagaaaagcccatcgtgcttatcaaacagagacgaatgatctgctattgactgctctgggcatggcggtatccaaatggtctggcatcggaaaggttgctgtgaatctggaaggacacggtcgtgagccgattataccgaatatcgacatcacccgtaccgtaggctggtttacaagtcaatatccggtgattttagacttggggaataacccggaagtggcctccttgatcaagtctgtgaaagaagggctgcgccgaattccgaacaaaggtattggctacgggttgctcaaaacgatggcaagtcagttggatgaaggcagcttcagcttgcagcctgaaatttcttttaactatctggggcaatttgatcaggatttgcaaggaagctcgttgcagatttctccttatccgaccggaagcgcgcaaagcttgttggaggaaccggcctatacgctagatatcaatggcatggtgacggacggagccctgactctgacgattacttataacggaaaacagtataagtcatctacgatggaacagctcgctggatatattgaagaaagcctgcgggaacttctccagcattgcgtaacccaagaaaaaaccgtattgacaccaagcgacgtgcttgcgaagggtctgagcattgccgatctggaggagctttctaagcagaccagccacataggcgatattgagaatgtatatagtctgacgccgatgcagaagggcatgctgttccatgatatgtttgaaccgcatacaggtgcttattttgagcaggccgcctttgattttaagggtagctttgatccgatcgccttcgggcacagtctggatgcagtagtggagcgtcatgctatcctgcgcacgaacttttacagcggatggggcagcgagcctttgcaggttgtatttcggcacagaggcgctaaattggtgtacgaagacctgcgggagatgaatgcatcgcagcgcgaagcttacttgaagacatttggtgctaaggacaaagcactgggcttcaacctagctgaagacgagcttctccgtgtatccattttacaaacagatgaagagagcttccgtctcttatggagttttcaccacatcgtcatggatggttggtgtgttccgttaattacacaggaggtatttgaacactattttgccctcctggaaggaagagagccgcagttggcagaggttcatccgtacagtcgatatatcgaatggctcgaacagcaggatgaagcagctgcgtccaactattggagtcgatatctggccggttacgaacagcagacgcttttacctcaagtcggtggagcaagtaagggagaaggctatatagcagaaaagctgaattatcctctcagcagggaattgactgggtgccttgaaaaggtggccagggatgctcatgtcacgatgaatatattgctgcagtccctctggggcattgcgcttcaacgctataacggtagccgagatgtcgtgtacggaagtgtagtatcaggcagaccagcagaaattccgggcattgatcggatgatcggtttgttcatcaatacgattcccgttcgtgtgaagacagaggagaatctccccttcacagttctgatgaagcagcagcaggaacaatatatggcttctcatatgtatgacacctacccgttgtttgagattcaggctcagacggatcagaagcaggatctaatctcccacattatggtgtttgagaactatcctgtggaggaggaggtagagcgtctgggtggtggcgaggctgcctttgagattgaggaagcggagcttcttgagcaaacgaattatgattttaatttaattgtcctccctggcgaagaaatgagattgctgttccagtacaatgcacttgtttatgacccagtgacaattgagcaaatcaagggccatctggttcacctcatggaacaaattgtagagaaccctgccatttccgtggatgcactagaattagtcacgccgcaggagagagaacagattctgaacgtatggggaaatacaaaaggcatttacgagcactgtaacacgttccacgggctgttggaggaacaggcgggacgaacgccggatgcgactgccctttggttcgaggatgagatgctaacctatgccgagctcaatgcaaaagccaacggactggcgagaaagctccgtactcagggaatcaagacgggagatctggtgggactgattgctgaacggtcgctcgaaatgatcgttgggatctacggcattatgaaagccgggggtgcctatgttccaatcgatccagagtatccgaaagaacgaatcagttacatgcttgaagattccggggcgaagctgatccttacacaggcccatcttttggagcatctcggatggacggaaaatgttttgctgctggatgaatcatcgacctatgatgccgacacctcgaatttggaggctactgctagcccggatgatctggcttatgtgatctacacttcaggtacgacgggtcatcctaagggcgtattaatcgagcatcggggactaccaaatctttcggacgtatacggaacacacttcgaagttacaccgcaggatcggatcgttcagtttgcaagtctgtcgtttgatgcatcggtttcggaaattttaacggcgctgagccacggggctgttctgtgcatcccttctacacaagatattttagatcatgccctgttcgagcagttcatgaacgataaggggattacggtagcgactttgccacccgcttacgctatccaccttgatccagagcgtttgccaacactgcggtgcctgctaaccgctggatcggccgcatcggtcgagttgatcgaagaatggaggaagcatgtacgttactctaatggctatggcccaacagaggactctgtatgcaccacaatctggtctgtcccggacagtgaggaagcaacggatattgtatctattggacgacctattgctaaccatagtgtgtacatcttggatgaccattttagattgcaacctgtcggtgtagctggagagctatgcatttcgagtatcgggttagcacgggggtatcataatcgacctgagttaatggatgagaagttcgtggacaatccatttgctccaggagagcgtatgtatcggacgggggacctggttcgctggttaccgaatggaaccatcgagtacttaggtcgaatagatcaccaagtcaaaatccgcggctaccgtatcgagctgggcgaggtagaagcacaaatgctcagagtgccgtccgttcaggaagtcgtagccatggctgtagagggcgatgacggctacaaagatctagtcgcttacttcgtagccgctcagaaacttgaggtatccgaacttcgggctgttctgtcggagatgttacctggatatatgatcccttcccgcttcatacaactggaggacatgcctctgacgtcgaacggaaaaatcgaccgaaaagcgctgcagggcgagcgtggatgggcagcggcttcatctgaggctccgaggacacctgtggaaattcaattagccgaaatctggcgagaggtgctgggtgtagagagcgcgggagtgaaggataatttcttctattttggaggtcattcactgcgtgcagctctgctagtctcacgaattcgcaaggaaatgaatcgcgagattagtctgagagcagtgttcgagtctcctactattgaaggattggctcgtgccattgagggctatacaccgctgaatttcgaagaaatacctacagccggagcgagagagcattatccattgtcctcggcccaaaaacgactgtttattctaagtcagctggaaggtggagagctgagctacaatatgccgggtatccttaccgttgagggagctttggatcgggaacggctagagcaggcattccgtcgtctaattcatcgtcatggttcgctgcgaactcgttttgtgactgtgaacggtgaacctgtacagcagctcctgacggatgttccgtttactgtggaatatgcggagttgagcgaggaagaggcaggagctacccttcagcagttcgtccgtccttttgatttaggtgtagctccattgctgcgggtcggccttattcgaattgcacatgagcgccatttgctattgtttgacatgcaccatattgtctcagatggggtttctatgaatattctcatagaagagtttctccgcttctaccaagaggaggacgtatttcctgagctacagatccagtacacagactatgctgtatggcagcaagagcagctcggaggcgagcgtcttaaggcccaggaagcttactggctggatgctttccgtggaagcttgccagtgctggatttgccaggagatgaagttcgtcctgcggtgcgaagctttgcgggcgatcgaatcgacttccaaattgattcttctctgagtgcttcacttcaggagttggctacccgaacgggttccactctgttcatggtactgctggcagcctatacagcgctcttgcacaagtacacaggtcaggaagatgtcatcgtcggttcacctgtggcaggaagatctcatgcgacactcgaaggcctcatcggtatgttcgtcggcacagtggcacttcgtacttatccagaaggagagaagcctttcgaggcttatctgcaggaagtgaaggaaacagcgctgcgggcctatgaaaaccaggattacccgttcgaggagctggtagaaaagctggagcttcagcgtgatttgagccgtaacccgctatttgataccatgtttgtcctgcaaaatattgagcagggagaacaagaaatagaaggattgcgcttcactccttacgataatgtacatccggctgccaagttcgatctcacgctgaccgtgagtgaagcagacggggcattgaactgtacgcttgagtatgcgactgcgatctacaagcaagagactgctgagcggatggcaggccactttgtacagcttattcgggaagccatcgccaatccggcactgccgttgtcatcccttgatatcgtgacacctcaggaaaaatcaaggctgatgaaagcgccggacgaagccaaggcagattatcctcgtgacaagacgatccatgcgctgttcgaggagcaggccgcacgtactccgaatgcagtggcagtcgtatgtgaagatgcaaccctgtcctacagcgagctgaacgagcaggccaatggacttgcccgaacgctgagggaacgtggtttgcaaccagacggtttggctggaattatggcggatcgttcccttgaaatggtggtcggaattttagccatcttgaaggcaggcggggcctatgtccctgtagaccctgaatatccagaggaccgcattcgctttatgcttgaggattcgggagccaagctactgctgacacaagcgcgtctggagcaacgtgtctccttcgccggggatatcgtaagtctggacaaaacggcttcctacaaggaggatgtctcaaacctgcagcctgcagccggaccggagcatcttgcctacgtcatctacacatcgggtacgacaggcaagccaaagggaacactgattgagcataaaaatgtagttcgcttgctctttaatgataaaaatatgtttgactttggtcctcaggatacgtggacactgttccattcattctgttttgacttctctgtatgggaaatgtacggagcattgctgaacggaggacggttggtcatcgttccatcgcttaccgcgaagagtccagatcgtttcttgcaattgcttaaggatcagaaggtcaccgttttgaaccagacaccgacgtacttctaccagttgctacaggaagagctcggtcatcaagcggcagaactgaccctccgtatgattatcttcggtggagaggcattagccccggccctactcaaggactggagaacgaagtatccgcaagtgcagctcattaacatgtacggcattaccgaaacgaccgtgcatgtaacctacaaggaaattacagagttggaaattgaacagggccgcagcaatatcggcaccacgattccgacgctgcgagcgtacattttggatgaacaatgccgtccacagccgattggcattccaggtgaactctatgtggcgggcgtaggtctggcgcgaggttatctgaaccgaccggaattgacggaagagaagtttgtcgctcatccgtttgaagcgggcgagcgcatgtaccgctcgggtgacttggcacgctggttgccggatggcagcatggagtatttgggacggattgaccatcaggtaaaaatccgtggttaccgtatcgagctgggcgaagtggaagcgaagctgctccatgctccgtctgtaagggaggccgttgtgctcgcccgagaggatggaagtggacaaaaagtgcttgtcggctatttcactgccgatcagatgctgacggtaggcgagttgagaaaagccttggctgccgaactgccgacttatatgattccatcttactttatgcaattggaacagatgcctttgacgccaaatggcaagctggatcgcaaagcgcttccggctccagaggccaatgtgcagactggagcggtttatgaaccgccaaggacgaagactgaggaagccttggcttccgtatggcaaggtgtgctgggagcgcagcgggtcggcatccatgatcatttctttgatctgggtggtgattccatcaaggcgatccaagtgtcctcgagattgttccaagccggatataaattagagatgaaggatctcttcaaatatccgacaattgccgagctaagcccgtatcttcaggcagccggacgtacagcggaacagggcgaaattaaaggtgcagcagagttaatgcccattcagcgttggttctttgaacgccatacagcggagccgcaccattataatcatgccgtcatgctctatcggaaagacggctttgatgaagctgcactccggttgacaatggaccaaattacgatccatcatgatgcgctgcgtatggttttccggtctacagaagctgggtatgcagcttggaatcggggaacggacgaaggcgagctctacacattggacattgccgatgtgcggcaggcggaagaccagacagctgtggttcaggcccaagccgatgccattcaggcaagctttgacttggaaggtggcccactgttcaagctaggcctgttccattgtgacgatggcgatcatttgttgattgtcattcatcacctcttggttgacggcgtatcctggcgcatcctgtttgaggacattgcagcggggtacgagcaggcattgaatggacaagcaatcgtccttccacaaaagaccgattcgtatcttgtatggtctgagcaagcgacgaagtatgcagcagggcctgctctggacaaggagcgtgcatactggcagctgatcgaggaggcgattttggcccgactgccgaaggatgaggatcagaagccgggcaccatccgggatactgaatcggttacggtaacgtggtctgcgcaggaaactgatctgctgttgcggcaagcgaaccgggcgtatcatacggagacaaacgacttgctcttgactgctctgggggcagccattcagcgctggacaggcatggagcagattttggtcaatcttgaagggcatggacgggaaatgatcgtaccagacctggatattacccgtaccgtgggttggttcacaacccagtatccggttctgctgaacctgcaaggcggacaggaagtatctgcgcgcatcaagcgcatcaaggagaatttgcgagaggttccgcacaaaggaatcggttacggtcttctgaagtatatggcaccggagaaaagtgtcggatttggcgtggagccggaaatttccttcaattatcttgggcagtttgatcaggatctggagggtaatgcccttagcctatccacacattcagttggtaaggcgctcagcgacctcacaccacagcaatatgctctggatgtgaatggcatgattgctgaaggccagctatcactgacgattacgtacagcagcaggcagtatcgtaacgagacggtgagtcattttgctgaattattacagtcaagccttagtgaggtcatccgtcattgtgtggctcaggagcgttcacagcttacaccaagtgatgttctgttccaaggattaacattggagcagcttgatcgactcacggcgcagacggctcacatcggagagattgaggatgtgtacaagctgacgccaatgcagaagggaatgctgtttcacagcctgctggagccggactcctcttcatacttcgaacaggcaacgtttgagctgcgtggtagcttcgatgtagatatcttcttcgagagcttccaggctttggtgcagcgacatgccatactacgtacaggattttacaacaacattgctgatgtaccgctgcaagttgcctttaagcaacggttaatccctctgcactacgtagatttgcgcgacgcatctatgcaggaacaagaagcccgaatcaaggcttatattgctgaagatatggttaaggggttcagcttgtcagaagatccgctgatgcgggtgaccgtcttgcagaaggatcaaagctgtcttgtattgtggagcttccaccatattgtcatggatggctggtgtatcccgatcattactcaggagctgttcgattattattctgccaagaaacagcaagtacagcctgtcctaccgccagctcagccctatagccgttatatcgagtggcttgatgcacaggatgatcaagaagcttcaacatattggagccaatatcttgaagattatgacgggaacaccgtattgccggaaggtaaaacgaaatctcaagcaaaagaagcgggctatgttctaaaagagcatgttctccatctgggtgcatctttgacaggtaaaatggatgtggtcgcgaagcgcaatcacgtaaccgtcaatacactcatgcagacagcttggggactgattcttcaacgttataatgccagctcggatgtcgttttcggcggcgttgtgtcgggtagacccgctgagattgcagggatcgaaaatatggtgggtctgttcatcaatacagtacctatccgtgtacagtcatccaaagacgaagcctttgtcgaagtgatgaaacgtacacaggcacagtcattggctggtcgtgcctacgacacctatccactgtatgagattcagggcaaaacaacccaaaagcaggacctgatttctcatattatgatctttgaaaattacccgctcgacgagcaggtggagcaatcgggtaaccaaacggaggacaatctcgaagttgccaacttcaccatgtttgaacaaaccaactatgactttaacctggttgtgattccaggcgaagatatcaaggtctgcattcgctataatgcttcggtttacgagcaagaaagcattgcacgtatcggaggacacttgttgcagatgctcgatcaggtggctgctcgtccgcaggcgacgatacaggaactggagattgtaacatccgaggaacggatgaacctgcttgactggggcggcaaggcacatacctatccaagtgatcagggtctgcataccttgtttgaagaacaggttgtccgtacgccggataagattgcggctgtaaatggggacactcagatcacgtatagggagctgaacgagcaggcgaacagactagcttctaccttgatagaccaaggactacggagtgaacaagtggtaggtctgttggcagatcggtctgtagagctgcttgtcgccatcatgggtgtgctcaaagcgggtggagcctatgtacctattgatcctgaatatccgcaggagcggattcagtatattctgaaggattctggcgctgaaattctgctcacacagagccacctgacggagttagcctcatttgaggggacggttatggaattggattccccgcacatttacggaaccgaggtggataatcccaatattcctgttggaggaaacgatctggtgtacttaatctatacctcgggtacaaccggaaatccgaagggaaccatgattaaccacaaagggatcgtgaactacatctggtgggccaataaggtctattgtgctggaaaaccaacggatttcccgttgtattcatccatttcctttgacttgacgatgacatcgatctttactccattaattaacggaggaatagtacggatttatgatggcatagataaggcggaggttgttcagcatattttgcgcgaaaatgcggtggatattctcaagctgacgccgacgcatctcagtctgattaaagatatgaccattccagcagaaagtcgcattcagcagctcattgtaggtggagagaatctgaccacacatttgtcaaaaacgattaccgacctctttggtggcaatatcaaaatctacaatgaatacggtccaaccgaaaccgtcgtcggctgcatgattcacctgtacaatcctgcgaaggatacgcgtgaatctgtaccgattgggttgccagcagacaatatatacatccatattctggatgatcagcttcgtctcgtaccgttaggcgtggagggcgaaatgtacatcgccggggacggggtagcccgtggatatctgaaccgtcctgagcttaccgcagataaattcattagaaatccgttcgcttcggaaggaaatatgtatcgcactggggatttggctcgtcgccttcctaatggagacattgagtacattggacgcattgaccaccaagttaaaatacggggctatcgtattgagcttggtgagattgaggccaagctgctggacattccacttgtcgaggaagctctcgttgttgcgtgggcagatgctcatgggcagaaatcgctgtgtgcttacttcgtagctaatcgcgaaatgtctgtcagcgagctgagagacgaactgtctgccggactgcctgcatatatgattccgtcttactttgtccaactggacgtgatgcctctgacaccgaatggtaagctggatcgcaaggcactgcctgaaccgaactcgggtataaaggcgggagcagactttaccgctccgcgcacggatgtggagaacattttggcttcaatctggcagggtgtactcggcgtgccgcttgtcggcgttcatgataatttctttgagcttggaggtgactcgatcaaatccattcaagtatcctcaaggcttcttcaagcaggctataagcttgaaatgaaggatttgttcggttatccgacaattgcagagctggcacagcgcgttagtgtggtcagccgaattgcggaccaaagcgaggtacacggagcggtaagactgggacctgctcagcacagattcttcgatgaacagtcgatggatctgcatcactttaatcagtcggtcatgttgtaccgacgggatggcttcaataccgatgcgctcgccgaggttgttcggaaaattgcagagcatcatgatgctttacgactggtgttccgccaaggagagcagggattggaggcctggaaccggagcatgggtgagggtgagctctatagcctccaaatccacgacctgcgggatgagacagacccggcttcagcaatagaagcaggtgcggaagccattcagcgcagcatctctctggaggatggacctctctttagactgggtctgttccgctgtgcggaaggcgaacatctgttgatcgttatccatcatctggctgtggatggcgtatcctggcgtatcctctttgaggacctgcaggatggctacgagcaggcagcacgtggagaagcggtcaagcttccacagaagacggattcgtaccgtgcatgggttgagggaatcacacaatttgcgaatagtctggcggctgaacaagaacgcagctattgggaagaggtagagggagatggctttgtccctcttcccaaagacaaggtagacggcgctcttctcatcaaagacagtgaggctgtcacggtgagatggtcaccagaagagacagagcagttcctgaaagaagcgaaccgcacttacaatacggaggtcaacgatctgctcctgacggctctgggtatggctgttcacgagtggacgggaatcgaacgtgtaggcatccttctggagggacatggccgggagcctgttgtgccggaactggatattactcgcacaataggctggtttacaagtcaataccctgtcgcccttgagatgggaggggaattggagatcggcgccagaatcaagcacgtcaaggaaggcttgcgtcgtatcccgaacaaaggtgtcggatatggtattttgaaatatttaagcgacggttccgacgtctcctctttctcggctgaacctgagattaccttcaactacttgggacagttcgaccaggatcttgcaggagggatgatggaagtatcgccttactcagtaggacctgaggtcagtgagcagatggtgcagcatcaggcattgaacattaatggactaattgccgaaggacagcttcaactttcggtcagctataaccgtcatcagctcgacggggagtccgtgactaagtttgttggcattctgaagaaccgtctcagcgaagtcattggacattgcgtaagtaaggaaagaacagaacttacaccaagcgatgtactcctcaaagatatcagcttggaaaaaatcgaggagatagaagagcagacacggcatatcggcagtattgaaaatatgtataaactgacgccgatgcaaaaaggaatgttgttccacagcttgctggagcctcattcggaagtctactttgagcaggccaaatttgaaattcagggagcattctatcctgaggatttcaaacgcagcttaaaatatctgatgaaacggcatgccatattgagaaccaatttccacgccgggtggggcgatttccctattcagattgtgttcaaagaaagagcgtgtgacttcgtatacgaggatctgcacgagctggaagccgatgaaattcaagcgcgtcttgcagcttatactgctcaggacaaagcaagaggctttaatcttgctgaagaagcattgctgcgtgttgctattctacgtacagcagaagaggcttaccatctgctgtggagctctcatcacatcattttggatggctggtgtatgccgcttgtgctccaggaagtgtttgagacgtatggggttctgcgtgagcaaagggagcctgagcttcctgcagctgtatcgtacagccagtatattcaatggttggagaagcaaggcgaggaagaggcatcctcttactggagaggatacctggaaggctacgagcagcagacgaagctgccacaagccatcacacagccatcagcaaaagcagaagcctatgtgtcggagaagctggtattcacgttggatgcggaattgaccgatcgcctggaacaggtggccaaacagcatcaggtgacgatgaatacattgatgcaagcagcctggggaatcgtgttgcagcgctacaatagaagccaggatatcgtcttcggcagtgtagtatcggggagacctgccgagattccgggtatcgaaagtatgatcggtctctttatcaatacagttccggttcgggttcaggccgagggaagtgattcgttctcccatgtgatgaaaagacagcaggaattatatttggcaggacatgcttatgattcctatccgctctatgagattcaagcacagagcgaacaaaagcaagatttgatttctcatattatggtgttcgaaaattacccggtagaagagcatctagaagagaaaatttccagtgaagaggctgaatacagaattacggatgttcagatgtttgaacagacgaattatgattttaacctcattgtgctgccgggccgtaatctggagttcttgtaccgttacaatgcccgcgtctatgatcgggagagcgtggaacgcattcaaggacacttgacgagaattctgacaagcgttgctgttcaacctaccatccgtattgatgagctggagttgatcacgccagaagagaaatcgcagattatagaggtgtggggcgatacagcagctccttatccgcgtgagcagacccttcacggtatatttgaggaaaaagcagcgctcacaccggatcgtacagcacttatttacggtgaaacggagcttacctatggagaactcgatcagcaggcgaaccgtctcgcacgtacgctgcgtgcccaaggggtcagaccggaccaaccagtcggcatcatggtcgagcgctcgcttgagatgatcattggtattcatgccattctaaaagctggcggggcctatgtaccgattgatccggagttcccagaagatcgtattcgccacatgctggaggattcgggagcgaagcttctgctgacgaagaaccatctcaaagatcgttttccgttcactggcacgatcctggcacttgatgatccgcaggcgtatcatgcggatagctcgaaactggagccaattgcggggccggagcatctggcgtatatcatttacacgtcaggttcaactggtaagccgaaaggggtaatgattgagcatcgcgctgccgtccatacgctgagtcagttggaagctgaatatccgatgttggcaggcgaccgtttcctgctcaaaacgacattcacctttgacttctccgtgccggagctgttctgctggttctttggacaagggactctcgtgatcctgccacaaggcgtggacaaagacccgatggcactgctagaggccgtggatacgaaccgtatcacgcatctcaatttggtgccgtcgatgctcagtgtgctcgttcaatacttgaaagaaagcggcaaccaaggattccttactctgaaatacctgtttgcctgcggcgagacgctgcctgccaaacttgtggaagagtattataaagtatctccttacgcagtactggaaaacatctacggtcctacggaagcagctgtatatgcgactcgatatacaacgagtcctgaggccgcagctctaacgcatgtgcctatcggcaaaccgtacgctaacgtccaagtatggatgatagacggcgcctctcaggtatcaccagtaggtgtaccaggagaactatgtattgcaggcgaaggggtagcaagggggtacttcaatcagcctgaactgacggcagagaagttcattcctcatccgtacaaaccgggagcacggatttaccgaacaggcgatttggcccggtggttgcaagacgggaatattgagtatttgggacggatcgatcaccaggtaaaaatccgcggttaccgcattgagttgggagaagtggaagcacaaattctgaaggtgccgtcggtacaagaagcggttgttctagcactggctgactccagcggaagtactcagctttgtgcatactttgtggccgaggaagggctcgcagcgggcgtactacgtgaggcactggccagcgagctgccaagctacatgattccgtctgccttcgtacagctcgcacaaatgccgctgaatccgaatggcaaattggatcgcaaagcgctaccggcaccggaaacccttctgcggagcacagcggagtatatcgcgccgcgtacgcagacagaagtagagctcgctcagatttggtccgaggtgctcggcgtacaggaaatcgggatcagggatcatttcttcgaacttgggggccattccctgaaagtattgggcttgatccaaaggatctcgtccagtatgggcgtccatctcccactccaggccgtgtttaatctgccgactgtggaagaaatggcgcatgaaattttcaagctgcaggcaacgaatgctgccgacgaacaagaaatggaaattatccgcttcccaggaaaaggaacgattaaagtgttttgcttccctccacgggtaggccactctctggggtactatgagatggccaaggagctggaagggttttgcgaggtgtacggaatggaatttatcggcgatcggtaccagggtcaagatatgctggatcgatacattgatgccattgtggatattcaagcagagggcccatatgtattcctaggatactcacttggaggaaatctcgccttcgaggtagctaaagccatggaaagccgaggtcaccatgttagcgacattattatggtagatgctatgagaaagatgtccaaggatgaatcgacaccagaggagctcgaagagattgtcgagacggtactggacagcattagggaccagtacaaagcattcctcgccgatccagtggacagggagcgagtcatggacaaaatgttggtgtactccacctaccgcgatgagcttattaacgcaggtgaagttcatgcgaatatccatgctctgattgcagaggatgatagtattggtccggatacatcattagataaattgttatggcaacaggcgacacgtggtcaatacaaagaatacgaagtcatcggaacgcatgatgtgctgcttgattccggttttatcggggaaaatgctaaagtactgagacagatacttggcaaggtcacagaggcttcatctaataacaagcccattttgtcctaagctcaatcaagcataataagtattaggcagcaaagacgcccggattcctttatatagaaggaactcgggcgtcttttgtttttttaagctgtccttaacatataaagtccctaatcatctgtgaatgctttagacgtggttgactgaaagtgactggtgtcggtgatgagttcacggatgacttggatgacaagctccggttgatcatggatgatcatatgctcgcttttcttggcaacaattaatttgctgtttgtagagatgttaagcatctcgcgctgtccgatttgccagctttgttcaatctgattatttccgcgtttactaataccgaactgagtcaaatcttgttgaatgccccgagcaattacacgtacagggagattacccagatgttgtccccgtatggcatcttcggtagtgctcgctaggtcaccctcctctgcaacagaccgaaagtatttagaagaagcgacaatattcacaaaagattttctatcttgatattcgacccgacccgtcagcataaaattggggaacaggcgaaaagcccctgatttttctaggagaatggatattaacggggagggattggccttaggccgttccttggcatagatcttatttgtccgtcgggcgtcattctcaggcctggcatccaccagaaccaatcctgccacttcgtctctgtacgtctgcgcgtacagtcttgagtacatccccccgagggaatgacctacaaggatataaggaggtcggatgtccgcattctttagagcagtatgaagctcccgaacgatgttttccccggtgcgtggtgtatttgcctcctcgctccatgcatagcctgcccgatcataggatacaacggtggcgaatgatgacagcttttcgggaatatctctccaggagaggctactttccccgctccctgattcaagcaatattgttggagaaccgttaccgagtttacgaatatgaagtcgatagcccccggcatcgaccaattcccccggaggtgggtattgtgatttatccttcttggatgcaatccactcatacacaaatccggagatcacgaaaagcaataagcaagagatgataagaaacacaattctcgtccatgtttgccttcgttgcttcattagaaaatctactcctctatacagctataattaatcattacctaaagttgcgtgaaacaatagctgctacagtatggtttgtggctagctccttatctttttacccatcctttctttgtcaaatcatcaatattaaagaaaaaaacagaatatgcacttgagttgtaatgagcaacccgcgtattcttgatcattgaatggatatcacgtcgttcttggatgcggataactaagtccatttggcaaaagtacagtgtacacagggtaaaattacaacaataaagatagtaaaaactattcattaaaaagggttgcatttaaatatgcagaatggtatactctaattccggccaagaaatacgatattgcgagcgagtgtttcaaaaaaagattctaaaaaatgcttgcaaagttggttcggacatgatatgatataagagttgatgaggcgacagactgaatcaacgagaaaagaatgtttgatctttgaaaactgaacaacgagtgagtaaaacgattttgttcgcaaaatcaaacaagagatatttttatct

SEQ ID NO: 2616 - DNA, 36486 bp, Unknown
  Kingdom: Bacteria, Phylum: Firmicutes, Class: Bacilli, Order: Bacillales, Family: Paenibacillaceae, Genus: Paenibacillus
actttaaggggtcacttcaaatcggactgccttgttttaattttttcatcgatattcatcgttgctaactgcatttgttattagttggagatagctttaaggcggaaggtagagctggcgaaatctccagagagatccgagacaacaagcccaattttcattaggcggtcacctccaaaaatttcgccatcaaatgctacgcagaagggggaaccgccatcttccactaaggtattacccgtatggactgctgtgttgcccgtcgctccgtgttcgattatatactttttatctgggtcaagtccttttagagttagtcgccggatgggcccattcggttcagctagtacgcggaagtaagcgacaaaagcttcggattggtcctcgctaacgaacatccaggccgtatcgcctcggccttcaaatggactaaggagtcgatacatatctccctgctgtacgagggaacgaatttccttatactgagcaatttgtttggcagcgagctccttttcttcatttgtaaaggcagttagatcaagttcgtagccaaaattcccgctcattgccacgtcgccgcgtatagcgagggaggtgattcgccccacctggtgatttggtacgttcgatacgtgtgcgcccatggtactggctggatacacgatgcttgtgccgtactggatagccaatctttcaatggcatcggtatcgtcactggtccatgtctgcggcatatagtagagcattccgggatcgaatcgtccaccgcctccggaacagctttcgaacaagatgtccgggaactgggaggtcagacgttccatcagatcgtaaagtccgagcatataacggtgtgcagtttccttttgacgtccactaggagcagtagccgaagcaatctctgtcatattacggttcatgtcccacttgacataagtaatcggagcgatcgagaatacggagctaagcgtctcatacaagtagtcacatacttccttgcgggagagatcgagcaccagttgggatcggccttccgtccgccgccggccttctgcatgcaggcaccagtcgggatggctgcggtacagttcactatccggtgataccatttccggctcaacccacaagccaaactgtaatccttgttcattaacccgttttgccaggtcagcaagcccgccaggcagcttgcgacggtcttcaaaccagtctccaagcgaactatcatcgttgtcgcgcttaccaaaccaaccgtcatctagaacaaagagctcaattccaaggggtcctgcttccttggcaatcgcttcgattttgtcggcgtcgaagtcgaaatacgtggcttcccaattgttcacgagaatcggacgttctttgtcacggtaagcccctcggcacagacgtgtgcgatagagtcggtgataggtgcgtgacatgcctccaagaccttcttcggaaaagaccaatacggcttcaggggtctggaatgactgacccggctcaagccgccaggagaagtcaaaaggattgattccgatacttacacgagtctgattgaactgctctacttctgcctgtgcgacgaagttgctgctgtagattagactgaaaccgtaaacatccccacgatcttcagtcacatcaggacgaagcagtgccagaaaggggttcatttggtggctgctggaaccccgtcggctctcgagccgaatggagccgggtccgagatcacggcgttggatatgtctttcccgaacccaggctccagataagtagagagcttggtagttggaatcggcgaagtcgacagaggcactcatggcatgttcaatatttatggtagcgcttcccttttgttcaaaaagagcagacctagcaatagcactgtggttcgcaaatacagtatagagcagtgtagtcttaagccccgagtattgatcctcaaggatcaaaaagagggttgtggcttcatcatccgattcggtatagacggaaggaagtccctcgagctttggtttacccggttcaatacggtaaccactatatttcagctccgtagtccgagttccgtccgcaagtgcaacctggtaagctggttgacgaaagtcgcttgttccatactgggggtattcctgaggaagcgtgtccaaagaaattgtacggctggaagaaacgggagtgggagagaaggagcaacgctccctaagctccaatatacttgcgagactttggtcatgatgaagttgagctccccaatagacatgtgcgggatatccttctacaagctggataatatagctgcaatccttggactgcaaatgaaacaaaccaagcgcctcgttaacatgaatgttcatgatattcactccttagggggttatcattattgttttacgtaaggatactgatcaatgacaacaagactctcaagtactgatgttagccttttttgcatgagctctcccgaatgacaagcttagtcccgatcacgctgtacgcaggtggttcacgtccctcaaaccgttcagagagcagttgcacggccgcctttcccatctgttcagggtaggcgcggacagtggttagcggaggctgcacgaaggctgccatctcaatgtcgtcgaagccgacaacagccatatcctcgggtaccttgactccatgtccatgaagggcgcggagggcaccaatagcgagcggatcgcttgcagcgaagcaggctgtcggtcgttcctgttgggttaggagttcgttcatcatgagataaccatccgcggtactccaggcacctatacggacgaattgaggattgtacaacccctgttcccgcatgaatcgttcaaaataatgcgctcttcgctcaccgtcgttcttaccgccgataaatccgatttgtcggtggccaagctcaagtagatgaccgagtgcctgatcaacagcttgccggaaatgaagtcgtacagaatcatactccagctgttcatggtactggtcgacaaggacaatggtgttcttgtcaggatgaagcttgaatacctcttcagggtcaacgccgcccacaacaatcagaccgtccgccttctgcagggtgccgatggatgagcggcctcgcaaggtctggcccaacgtcaggccaagctcttcacagcgcagttcgattccacggcggatcgaagcgtaatacggatcgtctctttcctcctcaatagaacaccacagcaggagggagaccgttttcccggcacgttccgtattctgctttaattgcctcagccgggtaggcttatacccgagttgctcggcaaccccaaaaattctgtttttagtgtctgggcttacggacagtgacagatcgttatttaaaacccttgaaacggttgcggcagacacacccgcttcgcgggcaatgtctttaatggttgccaaaagagctcacacctttttagttaataattttactaaaaatcgactttatcctaacacatctctaaagcactttcaagaagaacggttgaatttttttaactttatttttgaactactactgtagagattgtttgtgttaacatgatgaatattctcttgatgacggaggggtcctagttgaatattttgtcactagctcgtaagtggttcggtcgacttcgctttaaaagcaaggttataacggtatttcttccgctaattattatttctctgcttattcttggactattgtcaaaccaacttttcagccgttctttgatagatcgaaccaccagcaatgtggtcgatgagtctcagctcatcttgtctaggaccgattatatattcaggagtgtggaaacggcggccaatattatggtcacgaatattaaccggatgtatgattcatacggtgccaaacctaatactgccatggagcctattcagtttggaaacttgatgcagagccgcttatccattgatttgtcaatctttcgtgaggtggatgccgctgtattcattgataacgaagggacgattttcgcctcttataccgaaagcggggatgatcgcaagatctatagcatgcttaagcaggtaagggaatctgaaagttatggacaggccctctggtttgatatggagaagagggatttcctaacaccagatcggagctctcccgttttgacgctggggaagatggtcattaatatagacaccggcgaaccctatggaacgctttttctgttagtgaaggaagaaggtttgtctgattactttcgttccagcgatccagatgcacccaaatcttattattttttagataacgaaatgcgcgtggctgtggcagaagacaatgagatgttgatgaatctggtgaatccacagctgggtgaggccatccaacgttgtgcacctaatgcatcccatggaacgagctcattcgagtatgagggcaatctggtaacggtcacggattataaccggatggattggaagttggtcaatattgtttctcttagcctgcttacggctgatgtccggcaaaatgttagactgtcgctcttaatcggcgtgttatgccttattttttcctggctgggcgctagctttctatctaaaatggtcgttagccctctcgaacaactaactagggccatgcggactgttgtaaccggtgacttgcaatcggttacaacagtccgcacagaggatgagatcggtaccattgctgaagcgtttaattttatgataagacgagttcgggagctgctggatgaggtaaggcaggaacagaaccgtaagcgtgaatatgaacttgcactaataagtgcccaaattaaaccgcattttctgtacaacactttggataccatttatgcactcaatgagttagatcgtaatgaggaggctagagatactacaaaagcgctggcagatttttatcgaatggtgctgaacaagggacgggaattaatcactttagaaaaggaagctcagattactgatgattacctgacgattctgcaaatccgttatcccgatgtgtttcgctatgaagtggatatccctccagagcttgcaggtacaccgatcccgaagctctcgcttcagccgcttgtcgaaaattcgatttatcatggtcttaagaagaaagaaacaaaaggttttatccgtatttttgcctttaaacagggagataaggtggtcgttcgagtgcaggacaacggtgtggggatggatgaattccaagttcagactatcatgtccagacatttaccgaaagaaggaatacgatcaatcggtacctacagtgttcagcaacgactgagcctctattttggcgaagagtatgggatatccgtgcaaagtgtgctcacggagggaacaactgttgacctgttgctgccgatgctgccaaaggggagtgaacaccaagatgtataaagtgatgattgtcgatgatgaaccgctgttccgagactttctgcgtattaagatagattgggaaagtcatggctttcgggtttgctgcgaagcaaggaacggccaggaagcacttcaggaagccgagcggcatcagccgcatctcgctctcgtagatatcaatatgccttttattgacggaattgaattagccgagaggttgaaagtcaagttcgaacgcatcgttattgtattcatatccggacataacgaatttgaatacctacagaaggcggttcgaaccggagtacaggattatttgttgaagccgttcaatgcagaagaaatgctctcgatgttggaacgtattaagccgaaactaccagtgtttccacaagagagcgaaagtaccgagtggggtaagcatggtagcgaagcgttgcacggcagagcaggtatgcctgatttgggccatctgcgtgatgcggtcgtgctagacctccgaatgaaagacagtgaaacgttagaggaggtccgtaaggcaatccggcagcttagtatatacaagtggggggatgaatacgcggatgcgatgcttatgggaatcgtatctctagcactttcctttgcaagtgaacgcggtattccttatgatcggctatgggatgaaggagggaacaaatctccttacgaccggctgcgggagttggattcctgggaggctgctgaaggttggatgctcgccctataccgcaagctgatccagctgatggagaatatgcgtcctacgaaggcttccaatttgtttgcggcggcgatcaattatattgaggaacattatgcagacacagagttgtctgctgagcaggtttcgtgcggagttttcgtcgatccaagctatctccggcgcgtttttcgcaaggagtctggcttctccatagtagatcatattacacacatccggatgaagaaggccaaggagcttttgctgtatggaaatcggaagctgtcagaaatcgctgaaagtgttggatacagtgaccccaattatttcggcaaatgcttcaagaaacgctttggcatgacaccgactgaatatgagcaacttaaaaaaaggtagcgactttcctaagaggcaggacaaatcgatttaagcctggcggttttcctatatatggagaaccgctactctatttgtcccgttttttactgattaagcccgttttattccttaatcaaaaaaagaagcggcagtatactgtagtcatgcaaatgaaagcgtaatcataaaacacactgcatgagggggattaaacacatgaaaaaaacttacagaagttggagtgcagctttgctagtgctcaccatgtctattggattggtcgcttgtggcgaagataactcgacctcttccaagagcgaggcaggggacggtacgatcaaattgaaggtgtatgcgcagcattttgatgacgataccataaagccgttcgattatgcggtggaagagctcaaaaagaagatgccaaacgtagagattgaactggatcctgccgtgcaggatggaggccagaagctgaaaacctatgcggcaacgggaaacatgccggacatctatttagcggattggtctgttctgcaaactttcgcaaaatcgaaaaatgttgaggtgctggacaactatgacacaacggccgaattcaagaagaatcttaacccgggtgttgaatcgcgtttggtagctccagacaatcatgtatatgcttatcccgaaaccggtatagaattccaaatgatctattataacaagtcaatttttgagaaggtcggaatcaaaacaccgcttaagacgattgaccagatggccgatgcagcgaaaaagttgaaagccgcaggttatgtacctatgtcaatctttgccaaggaaaaatggataacgaccgctttttataatggactggttacaagggagcagccacatggattcggagcacttgatcagaaaggtgtaatagcattgccgaaagcatttgtaacagcggctcagcagatgaagcaattgcagagagccggattgttcgatgccaacgccacgaataccaattatgatcaggcatcgtccttattttatcaagggaaggctgctatgttcgtgaacggacaatgggaaatttacagttcacaagaaaagctgggtgaccaggttgactggatgtactggcctgcaaaggatgaagcaacctacgagaattccaaatatttcatagacggctcgggttcaccacaaggttacgcagtatcaccgagtagcaagaacaaggaaacagctgtaaaggtagcggccttccttgccaccaagtcagccgagtacagatacacccaacttggaagtccaattgtttcgcagaaagtggataagccaatggcctctaatgtcccagcaatgatgcagcgagtcgtcaaagagttgctgccaaacgcgcaggaatatgctcaacttctgagcaatacaaaaattcagaacactattaatgacaatacacaaaatttaatggtagacaatttctctgaacaggattttgtgaacaatctgaatagcacattggaaaaagaaaactgagaattcagggattcggcaacccttggcggataagtcgctgggggatgctgttccaaagataaggggtggaagcaagacatgaataaatatttggggaacaaatcggcgctcgcactgtttctcctccctgctttgatactgtacagtgtgatactgatatatcctgttctgcaaactgttcttcgcagcttttatgattgggatggcctgagtacgctgaccttttcgggactgagtaattatcgggaactgttctccgatcctctacttgctacttcgcttaagaacggattaatctttgccattgtgctggcggtctttcagatcggactgggaacactattagcgctaatctgcgcggacccgcgcacacgcgggcgaaaaatactgaaaacgtcttattttatcccagttgtcttatcggtaaccgtggtgtgccagctgtggatcgcaatctatgacccaactaacggattgatcaaccggctgtttgatctcttgaacatcccttatcagcaaaattggctaagctccccgacagcatcgattattgccatcgccttcgttaatgcctggcagtttatggggtatcaattcgcgctgctatatgcaggagttaagtcagtacccgaagactactttgaagccgccacgattgacggctgcagcaaatggagagcgcactggcatgtcacacttcctctgatgagggaaacttacaaattctgctttattattgcgattacctctggaattggggcctttgtgcagatgctgattatgacaaatggtggccccggcactacaaactatacaatgacattcatgatttaccgctatgctttcatggaaagcaactatgggtatgcatgtgctgtatccgtgctgcttgtattaatctcactattggcaactgtagtcatcaataagctgttcgaccgcggacaaaccgcctgataaggcgtgtatcgaaaaggagaacgaaatgagtaaaaccgctttgagcaagttcagacaagctgttctgcagataccgctgtggttgtattttattgtttcggtctacccgttgttctggatggtttcctactcgttcaagaacaacgatgagatctttgtctctaatccatttggactgccgacgcattttcgttacgagaattacattaatgcctggacgcagtttaatattccccgttactttctgaacagtctggtcgtatcaacgatttcgactctgttcatccttttactggctctgatgtttgccttcgcagtggctcgtatgagatggaggtttcgttctgccgttcggacttatatgatcataggaatgtttatgccactgcaggttatcatgataccgctggcgattctggttcgcgattttcatcttaccaatacgtatggagctcttattcttccttatatcgcaattggtcttcctttctcgtccatgattttttacggatttcttataggaattcctaaggagattgaagaggcggcatgcatggatggagctaatatttatagactgttcctgaaaatcattgtgccacttgcattgcccgcaattgcgacggtggccatttttcaattcttgaacaactggaatgagttcactttggcctatattttaatttctgatgaaaatatgaagacattgccactcggcttgcttttcttccaaggctcttacagcacagattggggagccatgggggctgttatgactatggcttccttaccgatggtactcgtctacctgttcttgagtgaacaagtggagcgggcgatgacggtaggttcggctgtaaaaggatagaaaggataaactgctcggggttgagaatcagaaaaagattctcaaccccgggcagttttgttatgtacatacgttagttcaatccgacgatggtctgtaggtaatcagaaaccttacagcaaagaaatgtttttgtaagattcaactgttgttcgttatgtagaaactaattatgctggtaaatagctaggcaaggaaagaagtgagcagacttgaaagatccaaagcaaagtttcaatgaaatattaaaaaatcgtaaaaaaaccattttaacagtaatagttgtcgttactataattatattgttaatcactctggtatttggcaccatgcatattatccggggttctatatacaccaccacgaaaacctcctaaatctacaaccaaaggggattagattgttgttattgcttgaatgatcaaataaaggcattatagagaaatcagttgttaaaaattcaagcactaagaaggtagaaaacataatgcaaaagatattaatagtagaggatgaccctcaaatcagctccttgctccaatcctatcttgaaaagtatggttatcaaggagttattgtttcaaattttgatcaagttttagttgcctttcaaaaggtggagcctgatttggtactacttgatgtgaatcttcctcgtttcgatggattttattggtgtagacaaatacggactcaatctacatgtcccatcctttttgtgtctgcacgcgatgataaaatggatcaggtcattgctttgcaaaatggagcagatgattacattacgaaaccattttatcccgaagtactgttagccaaagtagaaagtaatctgcgacgtgcctatggttcttatgccgttgctccaaaatcacgttccttaaaagtgtcagctttgacgctatatcccgatattatggaacttgtgtaccatgacaagcaggtcgaaattagccagaaagaagcagcactgctagagctattaatgacgtatcctaaacaggttgtgggtagagttcatctcttagaggctttatgggatgatcaccaatatgtgggcgagaacacattgaatgtttatgtcactcgtgtccgtaaaaagctgagcgagctaggactgggggatatcatagagacggttagaggggctggctatcggcttcacttgactgaggaggatggacggtgaagcttttttggcgtgaccatttttcgctggtgatttttaatatcatccaactttttcttgtgttaagtatctattggttggatggttaccgtaactggtcgacggccctgtattccgtcttttttggggcttccatattgctggtttatttgctcttccgatatgtcatgtactctggtttatatcgaatattatccactgcaaacctaagagatttagatgagcttattcagatgaaggtacttaatccgttagcctcttctttgcaacacttgcttttacaatattaccgattgtatcagtctcgaattcatcagttagagcatcagcagcgtgatcatattacatttatcaatcagtgggttcaccagatgaaaactcctcttgctgttattcatttaatcctcaaaggaaaaatagatcctgaatctgatcagatttacgatgaaattgatcgaatgggaaaaggactagacatgattttatatatgtcacggttggaatcctttgaacctgattttcatgtggagcctgttgtattacgaaaactggttagtgatgtgatctatgataacaaaagactattgattcgtaacgaaatttatccttccaatgaagtggacgagcagttgtgtgtgataaccgatgccaagtggctaagattcataattaaccaattgatgaccaatgcggtgaagtattcttcaggtcatgcccacagtctgaaactgatgtctcacgtaagagatcatgtcattgtgttggaagtacaggatgaggggattggtatccctaaaaaagacgtagaacgggtatttgaggcttattacacaggtgaaaatgggcggaagtatcgtgaatcaaccgggatgggactctatttggtgtctgaaatctgcaaaagactgaatcataacattcagttaaaatcgacggttggtgaagggacgacggttcaaattctgtttccaattcgcaaatgagaaaccttacaacagatttaaggtttttgtaatgttaatcgatcgcttcacttgtctggatggattatgatcatgacataggaaaaagaaaggaatgaattatggagattgtacgaatggatcaagtcaccaaaatatactatggcaaggttccctaccgagcccttaacaacatccatttaacgatcaaacaaggcgagtttgttggcattatggggccgtctggtagtgggaagactacgttattaaacatgatctcaaccattgatatgccgacttctggcgaggtttgcattaaaggggaaaatccacatcagctcaagaaggataagctggctttatttcgtcgcaaagagctgggatttgtatttcaggactataatttgctggaaactctcactttgggagagaacatactgtttcctctgatgctgaataaaaaaggattaaaggaaatggagcacaaactggaagaggtagcgaagaaactggatattattgatattttggataaacggccttatgaggtgtcagggggacaaaagcaaagggcagctataggcagggctattattcactctccttcactcttgctcgcagatgaacccactggaaatctcgattccatgtcttcacgtgttgtgatggaaatgctggggcttatcagtcgtgtggatcattccacaatcgtgctggtaacacacggagccgtggaagccagttattgcgatcgggttatttttataaaagatggtgagttatataatgaaatccatcgtagtcatagtcagcaattattttttcaagaaattatagatatactctcctttttggggggaagtagacatgcgcatgagctttcgtctgttagcatggaataatctcaagcacaatgtgcgtgcttatgtaccttactatgtaagcagctcattgatgatttcgatttttttcgtatatgcgatatttatttttcacccggatgtctcagatgcaatcacagcagctaatgtaaaaaagggattacaagttgctgatctgttgatttttgtgttttccttcttcttcgtattatacacaaaccatatttttgttgctgcacgaaaaaaagaatttggtatactgaccattttagggacacatcacagacaaatttattttttggtcgcatatgaaaatctaattataggctttttatccttaattaccgggattatcggaggatttgtttcagcgaaattctttctacttttgggatccaatgtcataagaatgtatttaacgttttattttccttggaaagcactggctttcaccgtggtgggctttatgtttttgtttatattgatctcatttgtgtctgttttcttcatacgctattttaaattgcagcagccttttagcaaggtttcacagctgaagaaggatttaaaagcttcatggagcctgtcctttcttgccatagtattaataggagcggctgtatatttgatgaggattgattttcccccctacatttatctggcaccgtatcgtttggggactctttctttttatatattacactattcagttggagacacatttaaatatacaattgtaatgggatttattggtatttacttattttacactcaattatgtgtactattcattcaattgcttagagctaacaggaaatggtcttggagcggaatacgcttattatggttatctgagatcacatacaaaatcaggaataatgccgggctgttttcattaattaccctaatttctatcatttcttgtgtaggagcagcgtcaacgtttgactccatgcagcagcaaaaaagatttcttaaggagcaatcctattcatttgcacttacttctgatgttgtaagttctatagagcttgaaaaagggattgaccaaaatcttcatacggctggggtagattattcgaaaggtgaagtattgatctttccctttcatgaacagctcgcgccagtgatgaaacaatccaattatgaggctcttgcttccaggtttaaggagctaaaacaggcagtagcgcttcgggatcatcaaggctttttcatttttgattcaaacgggatgtctttagaagaacagaaaaccttttttgaaaaaaagctaacttacaatcaaggaaaatctcagattatgaatattcagattatggatactcggaagttggaccataacttaaagtctgatgaaaacatcatctctgaactaggacggttacttgttgttccagatcgaacttacgaccatttaattgaacaacggtatttcaatgatccattggcatacaaatctgtttactactttgtgccaaaatggaagaatggtcaactttctttagatacttcagaaactcaacaggagatatggttgtattccgtgttggcccacaaggtgaataaaggggtgcttaactctagagcagtggattatttgacatcggagatggatctgaatattagcgaatttattggcggatttatcgccattattatgttggcaagcactgtaagtctattgtatttcagattgtatgtagatcttcaacgggatgaggaaatataccgagctttatcgaaaatcggactaaactcaagagaaatgagacgagctgcatccagacaaattgctttcttatttcttctgccattagtcgtatcatccataggaatagtgctttgtttagttatgtcagaaccatctggagtatatgtagtaccctttcgcattacgcttattcagattatgctgtgcttttgggcaatccaattcttttcctttcttattgtacggttcctgtaccttcgtcaattggatttgaagatgttataaggaacgataagctgtgtgtaaaaaagttgcagaaggggaggagcggttcctcctttctggaatctccacggattatagacgatgcagctctcaatcacgatttccttgatggggagtcatacaaagaaattgtagtgtagaggaagaattgaaattcatataacaacgtatttattagacttaataaacttagaaagagggggatatctatgaaaaaaagtgtggttattttattgttgttggccttatcaaccagttctttttcagggtcctttgttcaagcagaggggcagcaattggcttccaatgcaagtgtgaaactaacattgagtcaagcccagctatgggcacggtctaatagctttagtttgaaagaagcccagcaaacgatagagcgtaaccggattaacctaaaaaatgcaggtaagaatctggatttcattccagcaggtgcaggcaacggtgaagaagacgcggctagtagctcagcttggaaggggtatgcttcatcgacggtttcttatttggaatccaagaagcaaatcgaacttgctcaagatcagacagactacaccacaatgaaggactattacgacgtacttttggctgacaacaaagtgaagagtagtgaggatgcactttcgcttgcgttattggaggaaaaagctgctgaggcgaaagcgaaccgtggaaaaatatctccaggtgaacaaagcaccattattcagactcgtttagaagcagaaaagaatgtagagattgcaaaatctgcgctgcaaaaagcgttagaggtgctaaacacccaaatggggcaaccgcaaggtacggtatatgaactggttgatcgacccgcttaccggaaaatggataacacgaatttggatacgcttgtgacgcgtgcaatctcgtcgagtccttcggtatggagacaggaggaggctgtcaagctggcaaaaatggaagttaaatattacacatggaactcgggaacggacgattatgaaattaaacagattgatgtagactcggcggaaggtggactcaaaaataccaaggaccaattggcagaatcactaaagagtatctactttaacttacagcaaaatgatgaacaatacgaacaaatgcaaagtaatttacagaacgctattaaagtgttggacatatctcgtaaaaaaagggaacgtggatttgccacaggtgcggaggtcgccacgaatcagttaaaagtgaagcaaattgaacggaataaggatgaactcattattcaaatgacaatgctgcaacatgctttaaacaaaccgtggagcgtataggtttagaaaaaatacattttaaggggatataacattgtcggaaacagaaaagaaagatgcattgcaagtgttaagaaggaaaaaaagattgaaagggatcataggtattcttgtcttgattattatagcgggaattggcagtactgtttatatgaatagaagtcaggaaaagcccgtggagggtcctgcgaaccagatcgtacaggtacagaaaacaaacatgaccgaatcgcttaaagtaactggaaccgttcaggcttctaaggaagtcaatatcaattttacaaatgttgagggtgccaagctcattgccgtcaatgttaaagcaggagatagtgtcaaagcgggtcaggtgttggctcgtttggatgattcggattccaagttacaaattaaaaatgctgaatccaatgtagcgattgcccgagccaaggtggaggaagccaagcgcggaccaaagtctagtgatattgagctccagaaggcaaatgtcctaaaggcgcagatggcgattaaaacagccaaggattccatggagctggaagaagtcgctgcacaaaaagtggcggccaagatgattttggataaagcccagaaggattatgatgaccagaattatctagtccagaatgatgcagctgcagaaagtgacctggcgacggccaagcaaaacctggataaggcaaaattggatatgaataatgtcgaacttcaatacaagaaggcaaagaatcgacaagttcaggcgattgaggatgcggaaatgggctataaaacagctttaatacaattaaaggcagcacagtccccgcctgatgcttccaatattcaatccgcacaggcttctttacaacaggctgaaacggaattggaacagaagaaaagtgttctgaacaaattacaggttacggcaccgtgggatggaattattttgaaggttaatggcgatgtgggtaccagtcctacagcacctttcattgttatgaacaactccaatacaggcgttatgaaggttagtgccaaggttaacgaaagtgacattgctaaaatgaggactgggctccaggctacgttacacacgaattcattccctgacaaagaatttaaaggcgaagtcctctttgtttctccagagccggttacggattccaatgtgactacatacaaaattgaattgtctttggatagtcaaaagataagactacaaccagggatgaacatggatgtatcactcctcttggctgaacataaagatgcgttgtctgttccattgttcgcattgagatccgaaggtggagtggatggagtatatgtagcgaggaacccggctaaccctgcagattatgaattcagaccagtgaagctgggggtctatacagcggatcaggccgaaatcaagtctggtgtcaaggaaggcgaaaccattgttattccgccccagggtggtagtgctggtccgaatggcagtcaagagggtcaggaccctgatggaggtcaggcacaatgaacgaagttcgtttgaataaaagcgttattgaaattaaagaacttaaaaaattatatgaggtgggcggtcaggagattcaggctctgcgtggtgttgatttatctattagcgaaggtgagtttgttgccataatgggcccctctggttcgggtaagtccactatgatgaatgtcattggttgcctcgatcatcctgatacggggaagtattatttggatgggtattccattttggatgctcgtgagaacgagctttccgagattcgaaatcagaaactgggttttgtgtttcagaaattttatctacttccccgaactacagcattagctaatgtagagctacctatgatgtatgcaggtatacctgccaaggaacgccgggaacgagctgtggaggcgcttcgaagtgtagggcttgcagaacggatgtacaacaagcctaatgagctatctggtggtcagcagcaacgtgtctccattgcgcgtgcgttggtgaataatcctgttattctgctggcggatgagccaacgggggcactagatacaaagacgagtgtcgagattatggagctatttcaaggtttgaatgaacaggggaaaaccattgtcttggttactcatgagctggaaattgccgaatatgccaagcgcctgatcagctttcgtgatgggaatattgagcgggatgagagcattatgaatagaagaatttcatcaaggatggcaagcctatgaatttaatggaaacgatccgtgtatcaattaacagtttaacaaccaataagctacgctcctttttaacaatactcggtattattatcggcgtggcagcggttattgccattatggcgattggaaacggctctacaacccgcataaaggcggaaattaataaattagggaataacgtattgatggttgcgccagctatgacaatggtcgatggtgaaatagattatgacaacactccatcgtttacttgggctgatgtcgaggcgttggaacaaaagaattccatagatgcattgatgccaaatataacgagcaattcaaaagctacgtgggggcgatataactataacgccactattgtagggacttccgcttcattctataaagtcaaaaagttttcctttgccgagggcagaacatttaccaacgatgagatggataaacgcatgaatgtcgccattcttgaaagtcaggcggttcaacgtctttttggtggagatacccaaaatgtattgggacgaacgtttcaaattaaacagatccctttcaaggtaattggagtattaaatactcagccagtaacgaaattaagctacagcactaatgaacaaatttacatccctgctacaactataatgaaccgtctgggtgagaagaacattacaggattggacgtatccgccaagtcaccagctttgatggatcaggctcgttcagacatattggaaagcttgcgtttaacgcaccagctaaaaccctcggaaccggatcaatttcaaattatgagtctgtcagaagcagcaggtgctacttcaggtgtagataatatcatgaccagcttgctaggaggtgtagccgcgatatcgctcgtggtagggggaatcggaattatgaatattatgatggtgtcggttatagagcgtacaagagaaatcggtattcgaaaagctattggcgccaagccgagagatattatgattcaattcctatctgaagcggtcatctttggtctattaggaggtacaatcggggttgtaacaggcataggggcatccaaaatacttgaagcaactgcacatatgaccattgaatttacgatctcgcctattatatattcgtttcttagctctgcaggcacaggcatcctatttggagtatacccggcttataaagcagcaagtttgaagcctatagatgcattgagatacgaataattgtattggcacatggtcacaaaatgaaagccgtcaatagcttctagattttggaggaacataaactatggagaaaagctatacgcataatagaacgagagctcatcggataaagagaaatagaagaaggcttctgtttattattatcatatgtattgttttaattattataaaactctttgacatattcagtagtaaaccacagccagtaagaacaattgaatttgcagaaaaaatagagtcagtgtcaaccgacaaactaaataacgaatccaaagggagcaaatcccctctaaaaaatgtttcgggtgttgaagatgcagcatttattgagaagtacttgaatcagcaaatgcaagggcatcggcctcaggggatagacggtaaaaaagtagtctatttatcttttgatgatggtccatcggttaccgtagcgcctaaaatattagatattcttaaagaagaaaatgtgaaagcaacgttttttgtggtaggaaaagcagtggaagaaaatgaagtgactaaaaaaataaccaaaagattggttaaggaaggacatgctatcggaaatcacacctactcacatgactacagttatttgtatcctaatcagactgtgaattcgagtatttttatgaatgatattgaaaaaacaaatcaagttttaaaacaaatattgggacggaatttttccacgagagtgattcgatttccaggcggtcatatgacatggcagagaaatgatcccgatggtatggaagtactggacaatgctctacaagataaggattatcatcagattgactggaatgtgttacctaaagatgcagaaggtgcacctaagaacgctgaacaattaattcgcgaattcataaggaacatgggtactagagaaaaagcagtggtactcatgcatgacacttatgggaaggaagaaacagccaaagccttgcctgaaatcataagatatttaaaaaagcagggatatgaatttaagacaataaagtgacttgccgattccaaacaaaacagaagggacaagcaataatatggatattaaaggtgtggaggatctatatttatcttgcaaatcagatctcttgggatatctattgaggatattgcataacaaacaggatgccgaagatttgttgcatgagtgctttattcggtttataagagcttcacctgacttgcctcaagatcgtattcgattttatcttctgagaattgccaaaaatttagctatagatttaataagaaaacgaaaaaagatggatgaatacaacttacgtaaggagctgctctactatcactgggataccgtcgattttgaaattcaggaggaggtcaatcgaattcttttgatggcaagtaataccgagcaaaggacggtacttgaattgcgtgtagtccgaggatactccataaaagaaacggctagaatcttaaacaagagtgaaaattcggtaaagtcttcgctgcacagagcttcaaaacgcattaaattaagatatatttcctgaactgatttggatgaaaagcggagtagacatagagtctgctcttttttgcttgatacagagatataacaataagatcgatattttccaccataatagataataaatatcccctttttttggattgtttctatttataatgaaagcgcacccataacaatcaaaggagctgatttgttttgacacgtaacaaacgcttaagaagattgtccaccgccatgttaacggtgcctatgctcacgatgttcgcttcaggtgcaatggcagagcaggaattgaacagacataagcctccggtttctactggaagcagcgtattttatgaaatttatatcaattctttttatgattcgaatggagacggacacggtgatttgaaaggaatcacacaaaaacttgattacttaaacgatggcaaaccccattcgggtaaggatttgcaggtcagcggcctctggcttatgcccctaaatccatctccaagctaccataaatatgatgtaactgattactatcaggtggacccgcagtatgggagtctaaatgatttccgcaccttgatgaaagaagcggaccgaaagggcgtcaaggtgatcatggaccttgttatcaatcattcgagcagcgagcacccatggtttaaggaggccagtgccaacccacagagcaaataccacaactattacgtatgggcggatgagaacacagatctggaagaaaagggatcgtggggtcagcaggtatggcataagaatccgaacggcgaaggatatttctacggtacattctggtcgggcatgccggatctgaactttgacaatcccgaagtccgcaaagaaatgatcaaagtaggcaagtattggctgcagcagggtgcagacgggttccggcttgacgcggcgatgcatatttttagaggacagacgaaggatggtgcggataagaacatcgcctggtggaatgaattccgttccgagatggagaaggtgaatccaaatgtatatctggcaggagaggtatgggacaaaccggagaccatagctccttatttcggaccactccactccctatttaattttgacctgggtggaacgattttgaactccgtgaaaaacggccgagatcagggtatcgcgacattcgccgagaaaacgctgcaactgtacaaatcgtataataaggcagcactcgatgctccgttcttgagcaaccatgaccagacccgtgtcatgagcgaactgggcggggatgtgcgaaaagccaagctggccgcttccattcttttgacgcttccgggtcagcctttcctgtattacggggaagaaatcggcatgaagggagagaagcctgatgagtatcttcgtgagcctatgcgctggtacaagggagatggccctggtcaaacgacgtgggagaaacccaaatacaacacaggcaaggtatcggtggaagcgcagctgagggacgatgattccttactggaaagctatcgcacactcatccgtctgagggaagaacatgaagctttacgtagcgacagtctgcaacctatagaagcaggttctgccagcgtgaccgcgtttaaacgtacttcaggcaaagaaacaatgtatgtatatcataacctgtctggagagtcggttaccttgcagataaaagatttcgataagggtaaatggaaagtgatcttttccacctcaaaggatgtaaaggtgaagaaaggaacagttacaattccggcttacagttctctaattaccgaagaagacagaaagagctgaatatagggcaaaattaccgttcagatgaagcaggatatatatcgatgaatccagtttggggtgttaacagcaccccatttttctatataagttttgctgcacacgaatagaggatttaaaaccgtcaggagatcagttatatgtcaaaaagacagttttacgacagttgtgtgttgaaccgggaaattactcgtttcaactagaccacttggatgcaaagcacgccccttagagtacacacagggaaggataaatgacattctcccgtgtatattccaaggggcattatttaataccctcaatcatagtaaagatcggacgattccatataattataaagggggtataccttccggtacctttcagctcttgctcttagcaagcaactgctcatcgaacggtagattctctttgatcgcccacaggtcgtcatagctgagaatccagcgatcggctctggacagatcctgccggccggagccggggttgtgaaagccgatgcagtacattcctgcacttttggctgcctggaccccgttctgtgaatcctcaataacgatgcaatgggccggtgcaatgcctagctgctcggcggcatataagaagatgtccggtgcaggcttaccctgcaatacctcttcaccggtgattcgaatgtcgaagtaacggccaagtcctgtcttttccataatgagatcaatcagcgcccgtggagaggaagaggccaccgcgaccggaatccctttctctttcagccagtccagccaccgctccagtccgtcaatcgccacaaggccctcgcgcgcaatcatcgtctgcatcacattttttcggtgataggacagggcctcttccaccgtattggtgagctgatgcctgttcagcacttgacgccacatggattcgagtgtcactccgacataggtgtgatgctcttcttccgtcatgggcgcaccgaaatgggcaaaggagctgcgttcgacctcaaagtaaatcggttcgctgtctactaacaccccgtccatgtcgaaaatgaccgctttgaccggaacggacgctgataggtctcctgtgcattcattattggtcggtgtaacatgatggatgctcgtcatgtccattctctcccttgttagtagctaaatttagttgccggagccattagattgcagtacaatcttgatcgcctgagacgaaggctgaagtgtccgctcgctgatattgcatccaagcgtcttaaaggcttcatggtagtcatcaagcggatacgagtgggttatgatttttttggcgggaatgatttgttgctcaatcaggtaatgcgccgtggagaacgtgcccagagaatcaatcgagccgatgattttaaggctacggtcaactacctctttcggattaaacgaacttaccccatctctcagccccaccagcatcaaatacccgccgctcgcaagctggcttagtacctcagtgccgaccactcctgtggtatccacaatcatgtccacctgattttttaacggagccagctcatgaatggccgactccagtgtggcgtgcgcggaccaccgttcgggagcaatagaatccgctatagcgagccgttcctccgagatgtcaacaaggcaaccagttatgcctttcgaagcaagagcataactgtacagaatcccgatcggacctgcgcctaaaataacggttgtgaagttcggcagcaggtgaatctggttgattccggtcagcatacagctcagcggttcggtcagcgtcgcttcttcgtagctgatatggtccttcagcttgtacaaaaaacggtcctcagtcacataataatcggtgaacgtaccgtcggcgctaactccggtctcggttacggatttgtgtgtgcaatgattctgtcttcctgtccggcacatttcgcattggccgcagtagtatgttggatcaatcaccacccggtccccaggctgtagtgaactgacggctgatcctacagcgatcacatcccccgctgattcgtggcccaagatagtggacggaacggcatgatatttgccactaatgatacctaggtccgtaccgcatacgcctgtcgcccgaattcggacgagtacatcgttatctttttttatctccgggataggtctttcctcaagtgcgacatcccaagccgatttgtataccaatgcaagcataaataattcctccttttgcctgttaggcagatcgttagtgaagggtggtcagaacagtgtcaagccgcttggcaatttcgacaatctcatcttccgtagccgtgagggaaggtctcactttgaccacattgccgtaaccgtaacgggagcctctgagaatcagctgctgttcggcaaaagcgcggtcgataatcgcattgctcttaactgcgtctggggcattatcctcgtcgacaatttccagtccccacatcaagccgacgccgcgagcctcaccaatgatacaatcgtgcttgtcggccatctccgtcagcagggttccgagcaggcttcctttggaccgaacggcttccagaaaaccgggttcagatacaacctctagcgtggctttagctgccgtaaccgagattagattactacctgaggtgaaggagtgctcgtgcttctcgaggacattaagacgagactgcatcaatactgctgctaccggtacaccaatgccgccgagacccttggcgagagtaatgatatctggctggatatcaaacagttcacttgcaaacatatagcctgtccgcccaatcccggtctgcacctcatcagcgattaggatcagcccgtactcgttgcacagctgacggagacgcttaaaatatcctgcaggtgggatgatattgcctccgttgcccaggatgggttcaataatcatacaggccacagaacctgagcttgcatactcaatagcatccgatatggcttcgacgcattgatagccacacttgtcaggcgaagaattaaacgggcagcgatagcagtagggagcaggtacatgaagggaatttgctgcagccgagttgggaaacttcctccgccggaaggcgttgccggatatgcctgttgcgaattgggtctgcccatgatgggatagatacaggctgattatatcgagcgctcccgtatatttctgggctagcttcacagcgcattcgttcgctgtagagccggtaatatctctcatccatcccgcgtcaatgccgttcggcgtatactggatcaaatgatccaggacttcctcgacatagggctcggtaaaggatgaggacatgtgggcaagattggcgacttgttcctgtactttggtgacgacatgagggtgattgtaaccgagtgagagattgaaggtgccagatacgccatctaaatattccttacctgaatcgtcaatcagagtaatgccttttccgtatctgaagcgttctttggttaaggtatgcacgatgttcccctccatatcagaatatacattctcattaagtacatccttaaaaaatgtactgccctgctactacataaagcggtgggcctcacctcccccaagaataaagaatctcatccttccttgccctgatggacaagggagtcaactacccgtctgctcctgctattccacagatacgagaaaatgactgccagcagcaaaattaggctgaaagccgccaaaatccaaagggtagccgtcaccgaccattcgctcatgctccagcctgttacatattgaagcactgctccgccaattccgcctgacgcaattagaatgctggtcgttctctcggtcattcccggaatcagcacgttcgcatagacgagggcaatacagaagagaccggacatgaataaccctgcaccaaaaatcagaaggtatgtagcccactgactggagacaaacgccattgcgaccagaaagcagaaagttccgattccgctccacagcaggaaaggaatatatcctgcggactctgcaatcttccctgagaacatgcggccgatgatcatcgcaatccatagtatactaacacccaacgaagctacggattcccgaatctgcagggtctcgatcagaatagagggcaggaagttcatgagccccagttcaagccccatgtaaacaaagaagaatacaatgaatattcccagtaacacacggtgctgtacagagtaccgggcttgttcgaccgatcgctcagaggtttggagatctgcttggataaggtgggaagaggaggaagtaggcatggtaatccagaacagccccagaataaacgtcagaagggagatggtgtagaaggtcaaataccacactccaagccagatatacaggcttaccactgcgggaatgagcagtgcgccaagtgcaaaatagacatccagcttggacatggctacggctttctgctcttcggtgaactcaatcgtgaacgctccgatggacgactcaatgatgcctgagccgaagccaacccatatggtcatcacgataacccaggtccatgagggaagtacccccaagatggcatatcctgctacgatactaaccagggcaatggacagcatagacttgcgaccgatgtgtagagccatgaagggggagaacagaacaccgacaagaaatccgaaaaactgaaggaacaataataatccgccatcgctgtaccccagtccatagtaaggcagtaggaccggcagtaatgctccaagcaccacactagtaatgccgattaacagatagaaagcacaacttaaagcgaatagtctcttcaaggtccgtccctccataagtctatattttttatatggattctgttgctttactagattatacctttttcttggaaatgtacacatgtatttatataaaaaatgtaaaaatgatcgctcgacaattttacacgtatttacttaatccagttaaggtgaaacctgtttatccggagaaaccgcatggggaagggagaaataagatcagcccaaattgttttcgggcgccaaaccgctcataattaaggcataactttgtgtttgcaaaattaggttagtaaggatacctaacagttgttttacttaatacaactatgattgatagggtaggaaaaagaatgttaaccgcttacaatttaaaagggagagggaatttattcgaaagtcgagaaggagaaaaatgaagaagagaagaaggaatgcagtgcagcataattatcaatagtcatgtgtacggcttttttgaactttacaacaaaaggagtctaccaaaatgaatttttatttagaaatcccggagcttgaccgacattttcctttccggagttttattaataaaggcgacgtgctttgctatcctcattggcataaagaaattgaaattatttatgtgacccagggaaccttggatctgggaattaacgatatttcgatacgcatgaaacaaggtgaagttcagtttataaatgggggtgatgttcattatttcttggcttctcccgacagcgaacgggtggttattcaatttgatctgagcttttttcaagagatttccacattaagtgatcagaaacgccctcttagatatatatttacggagatggagcaatcaagctggaactggccagaagaaacagcagctaaaatgcttcctctgattcaaagcatttatgatgagaacgtcaaccaccacgaaggtcatgcctatatgatcaaagcgaagttgtttgagatgttgactcttattatgcgtgaagtgccgagaagcatgacgccaaggcttcctgacatctctgaaagacccttaacacaatcaaaggacaccctttataaactggaacgtatttttgaatatgtggaatgccattatcatgaaaccatttcgctaaagaatgtcgctgattatatggggttcagtccgtattatttcgccaggctatttaagaagaatacggggatgacctttgtagcatttttgaatgattacagactgaataaggcaaaatggattttgttgaatgaaaacaatccgatcactgaggtcgcagaggcagcagggttcagtagtgtaaagacgtttcatcatctctttaaagaagcaacaggaacatcaccattgaaataccgcaggacaatattcgggaataaaacagcaagaaatgaggaggaaagcttttcatgagatttgtatgatagagctatccgatgaagtgaagggagagttacgaggacattaaaatttattgatctatgagcaaccacttgatatgcggtgggcttaaatcaggagtggaggaagatgaaaatgggcaatcgtatatacaatgtagtcattatcggttatggaggcatgggaagctaccatgttcaattgatcgaatctaatcagcaacttgccgttggcggtgtatatgatattgtcgattaccgaatggaactggctgcggctgccggctataaaacctatgccagcctggatgccgtccttgccgatcaggcagtggatattgttttgatagcaacacctaatgatgttcataaggaaatcgcgatccaggcactgcaagccggaaaacatgtcatttgtgaaaagccggttacgataacgagcgcggatttattggacattgttgaggtggcgaagaaagaaaatcgtgtgtttacagtacatcagaaccgtagatgggatgaagacttccgaattatcaaagatataattggcaataagaccgtgggtgatcttttccacttggaatcgcgagttcagggggctaatggcatcccaggtgactggcggcaactaaaggcgtatggaggaggaatgctactggattggggagtacatctgttggaccagctgcttcagattacggatagcaaaatagaaagcgtagctgctacccttagctatattttggggactgaagtggatgacggctttaccagctttattgagttcaaggacggtctgaccgcagtcattgaagtgggtacaaccaattacgtaaagctgccgcgctggtatattaaaggaactgaaggaaccgcaatgattagagattgggatttgagtggagagatcgtcacccgaaatccagatgtcgctcacgtggaacccaagccgattcaagcaggtcaaggattgacgaaaacgatggcgccgccgtctgaggaatccacccttaggttcccgattgagaaaatacctgctgctgcagaaagcttttatgagaattttgtctccaccatcgaaggaaaagcggagattgcgatcaaaaatgaagaagtacaccgtgtattggtgctgattgagacgatttttgaggcggcagcaaccaaaagcgtgattcgaagaactatttaaatccgctctatttttcgatctatcataagagagagatataggatcctggagagaaccaaacagtattgacctaatgaaattttgggatgcatttgagtaatcagtaaacctttgaaatggtgagcaaaataattttgcccaccataaaaccaagcgggtatcgctccacaaccgaattctattgcttgatcatttttaagttgctgagatttcgaataggtttaatttacacgtaaagagaaaagaagtttttacataaaatccgctatttcctcttataaatcaatatattccactctgaattcttccataaaaatataaaataatccatgagagtgatagaataatcatttgtacgagaaaagaggaagggagagatcatcacggggatacttgtattaacatctgtaatgttgtaacgccgatcaatgctgatcaatgcaaaaaacgttgatgcggccccttcgaacaaccgaggtggtgcgaatcatgtttcaagcggcaatgcatcccacagtgatccaatgagagtcgccaggtgcaacctaccaggatttgattaatgctgcacacgacaaagatattaaaatcatacaggatgttgtgtataactactctagctgctggggtgcaaaaggtatattgtacttgatctcccggataatcctgcccccggtaagatcggtgaaaacgggcctttcttgaagccttaatttttaaatataagaagcatgaaggaatgacattcctaggagtgtcgtgatttgaggttttaaaaacacactcataaacatatgggtgtgttttttggtgttgaggatagtcgttcatgccattaacagaattttattatgattaagtaattcgccatattcctcttcattgattgaaagtatcacagataacaagaagatgtaacatttttcgcagcttattacgttaatgtagacaccttaacatacttaagagtattcttatgtgtacttaagagggaccccatcgcaaccaaaactaatgaatatgaagtatataaaggaggcccatatatatgaagtctcatacctatgaccgtattaaaatcccgctaggattgtgggcaggattatgtcagttagggtttggcgcccacgacgtagctcgcaaagcacgattgccgatcaccattagtactgaaacagtagtcactaccgctcaatatttcgcgatctggcaggcatattctgatctcattggtgacactgcacaaggaatcatcaagcttgcgaccgtctttgatacagcgaagtacccaccgactgtcttagcgacttaccacgctcgggactaccgcgacgctctaaaccgaatggctcggtacaaacaactgtgtcccccggaaaacctacatatcactgagaagggcgagcactgtacaattgatctggaatggctgtctcccgagcaatctggtctgccgatactggtgggtattacgctggcttgtcttctggagattggacgccgggggacaggtcaacctttgacagcgcagcttattgaattttcgcactccatgggcgatgcacaagcccttgaagcatacttcggctgtcgcatccgaattggtgcaaaatgtaaccgattgacgctacatcgaagagatctggaccgtccctttgtctcgtacaacaaagagttgctggaaatcctgactcctgctctggaccgatcgttggatgagcagcagcgcagccgctcaattactgagatggtcaaatggatcatgaaacgtagccttacaggagggcgtcctgacattcaggctgtggcgaaggagctcagtatgagcgatcgtaccttgcagcgccggcttactgacgaaaatacgagcttcaagtttctattgacacaagctaggcatgagcaggcacgagagtacttggcagacccctcgctcgatattaaagaggtggcatttttgattggatatgaagaccagaattcgttttaccgcgccttccgccaatgggagggtgatacaccttcaaattggcggactgaacacttaggtacaaactcgatatcaggagcacgttaggactgcctaatgagttttatcatttggcgtgttaaacaagaactttggcgcaatatgctagttactggacaatccagacaagataatataatcactatccagagctcaagactgttttaaaaaaggagaagtgtattatggatatgggattaaaatataaaacagctttagttacaggatcaacgaaaggcataggtaaagcaactgccattgaactagccaaagaaggtgttaatgtactaattaatggacggaattatgaagaggtagaacgaactgtaaatgaaattaagtcaaatttcccagctacctcccctcaaaatgcgacagccgatattgtggatattggacaaagagaagctttatttgaaaaataccctagtattgatattttggttaacaatacgggcatttatgaaattatgcaatatgaggacgtagacgatgaagtatgggaaaaatacttccatactaacgttcttgctgcaaatggattatcaaagttttatttacctaaaatgttgaaaaatgattatggccgcattatttttattgcgagtgaagaagcaattatgccttcaggacaaatgccgcagtattgtatgacaaaatctatgttgttatcattgtcaaaaagcttatctaaattaacaatagggacagaagttacagtcaatacgatcatgccaggaccaacactctctgagaatgtgcaccaaatcattgagagtatgtatcctcatgaagatatgactttttcagaaaaagagaaagattttatggttacaaacctgcctcaatctgaaatacagcgatttatcaagcctattgaaataggtagactagctacatttgtatgtagtccttatgcatctgcatttaaaggttcgccaatccgtatggatggaggaatggtaccgactatttattaacgcttgtggagaagcttgctgaaattagcgctgacattgtggaacattataataagatgaagtcaaatattattcgagggtaggatgaggatcatgaaccattttgctatgtatggaaagttgacggcacgtccagggcaaagggacgctcttgcagacatcttgctagaagcggccgatctgttgaagtcgaataatgactgctatttgtatatagtcaatgtgtcagacgacgacccgaatgcggtgtatgtgaccgaactgtggaaagatgcagatgcccatgcagccagccttaagaacgaagaggtactggcgtcgatacaacgcggccgaccgttgattattggagcgaagcccattaagctacgtgctctagggggaaaaggcctgtagggccatgatgcaagtgctgctaccactgcagccgatcattcggttgtttttaagctaaccagcaggatagtcctaatgaaacgcttttgtaacatgtgaaaggttggcagataaaattggccctgatataataagggtaattcactaaggagagatttttttgtctggagctgttctttactaatccaattccataaaaagaggttttcatgcacctactattcgtctgcccaatttttgtattacgggtggggatttgaaagcttcggaattagttaagaacaacggatactatcagatccttagggatacctgttataatgagtccaatccgtgctggttcagcgcggatttttttgtggctaaatagcaggtgatatgagggtaggaatgacgtatgttcattcctgcccttttctaattttagcaaagggggatagaagggaattactccaatttggtcaaatagaaccagacttcttgaatgaaagattcaatctaagtaagtagaaaggtggacatttcatgatacttcaaacgaatcggctcctattaaaaacacttgatcttaatttaatcgaagcagcagcccaacgtgatataggtgctattgaagctttgggttataaaaccagtgatgaatggccgggtcctgatttctttgaagctttaccttattttcgagaacttttgataaaaaataatggcactagaggttttgattcttggatcattgtggagaaggatacccaagaaattgttggagggattggttttttaggagatcctgatcagaacggtatgattgagatcggttttgcaacgaatgaaagtcatcgccgcaaaggctattgctatgaagccgctcaaaaattaatagagtggtccttaaatcatgaagaagtccaaatcgtaacggcaagatgcgtacctgacaataacagctctaagaatttgttattgaagttaggatttcaaattaatcacaaagatgaagaattgctttattggaaatatcaaatgaagaaagtaggagggggtcaggagaaatgatccggcgagatctagatgacgtagatttcataagagcaaatttaatggggcctagttcgattatcatgctcgaggagctatcgaaaaatttgactttgtagaaaggaatgcgagtgctggatttgggctgtgggaccggactttcttctatctatctggcgcaaaagtttgacataaccatagttgctgtcgatttatggattagtgcaactgaaaactatagaagattcagagagtttggtttggaaagccaaattatccccattcatgcagatgcctgccacttgccttttgcagagcaatacttcgatgcagttataagcgtagatgcgtatcaatattttggagcgaatgagcttcccagtcctatggggtggaattcgctaaactaactaaaaacgatagttcaacgctaccaaaaacagccgagcactcggctgttttttaactaacgggcagattacactaatgcagattcctcatcgcatgaagcggttaatcgatgctagggtcgaacgtacaggcttaggtcaaagagtaaaaagcgagaacggcccatgaaggcctccacaagttttctcaattcccgacgggtctacccgaatacggagaggctttagaacttgtatccataacattttttaaacacagattgtcgatattccaaaaaactgtttaacagtgcttttttctctctaatatcatcattttcttttgaaatgccgatatacataaattttacctaaaggaagtggaaagagatgtttaaaaagaaatggcttatcaccccgttggttgcgacgacactatttttcggtcaatctgcattcgcggcaaacacgtttcctgatgtggaaggaacaaaatatgaatgggctgccgaatcgattcgttccatggttgacaagggcgttgtcaagggctatggagatgggaccttcaagccaagcaaaaccataacgaaagcggaatttgtacatatgtttcacaagctttttccagaaatcgatcattcttcgggcgaaccttccgactttgtagatgcgcgtaaacactgggcgaataaagattttgcagcaatattcaacggggactacgtttggccgtatgctgaaagtgttggcgggaaatatccaaactatcaattctatgtcaagcctgacaaaccattgacccgctgggatgtgatgatgattgcctctcttcggacggattataccaatcagacgcttcatcctgagattgaggaagtgatttccgcagctgcgcagtacaaggatatgaaagttcgtcaggcgaattacaatgacaatttctcggcctactatccggtgttgtacatcgacaagactggagaagagtacaactatgatggagattcccaggatcaaaaggcagaagcattctacaccctaaccaagatgggggtccttaccgctaatgaaggataccttctcccaaaagcgctagtcacacgggctgaagctgttaccattttacagcgtttgaatgaagccacaaccaagtcagtggatgatcgacactagccgcttgcgcattgtagccatcaaggaaacttcataaggagataaagcgctttggagttttctacttatttagtaacgtatctatgacgacgcctaaccgtcgattactgtcgaaggacaacaactatgtataaaaagtcgccgaattggtattatccccttcta

SEQ ID NO: 2617 - DNA, 173994 bp, Unknown
  Kingdom: Bacteria, Phylum: Firmicutes, Class: Bacilli, Order: Bacillales, Family: Paenibacillaceae, Genus: Paenibacillus
cacaaacgggggtcagttcctaaggtcggcagagctttttagttgaaaaattgcttacagacggacatttaaggcggaactgatatgaatcaactttaaatgtatgttgaaaataaagttttgataaccacaataaaaaaacaacggtaggcgaggacgggggaataaaatcctttcctgtcgctatttcattaactaatgtttcccgttagttcagcgactttacattctttataatgcggttcaccatcatttgtagagcgaaatgatggaaaccccagtcgggcatacttcacaatttaaaagaatgtttgaagcggcgaactgtgaggattcaaaaccacaattcgtcgtagcgttttgtttaaattggttaaatcacctagtaaaacaaaagcgtaactactagtattaatacaacaaacgtcttctaattttagctgatctatcctcttgaattgcatcggattgataagagctcgccattttccggtggatttcagcaactctagggtagttaaactccaataaatctgcccacttgttgtatctctcagaaagttccctctcttgatctccaccttccccgcgccaatgaacccctcgtgcattgtaaaggcccgttcgcactccaattaaaaacttttctgttgcaatatcttcaattgcttcacgcacaggctcacatggccaaataccgtctttaccatgcggagacttagaaaacaatgttccaagtaaactgtcacatatatctccgcgcgaaagttcctctgataactcacgaacttctcgtacccagttttttatctttgttgaatcaagttgtccttgattatcatgtcctggtattgatgaaaggttttctaaaagatgatatgccgcttctgctcttcgtccctcaatttctgtattttgaatatgccatctttctggatcttctttatcgtcagctctcctataagctaatgctagagcttggacaaaaaactctggattagattcaacatatttctcaagattggggatgccgattccttcattagttaaaattttgataaaaggaaactccagtcctaccatttggtcaacagaaaactctccactttccgtaagcaatttaaaagcctctccaatacgatgttggtctaattgatgtgattcgctagaatttttgtcatttgaaactatagcttctatgattttaaacaaagtttccgcgggaatcatctccaggtcatattgaacatgcgtaaaagctgctacaggacgctttactgcgagcaattgattaatggcatatcgatagtcttccagatttccttcacttaaaattgtaggggaaacattcttccagtatttattttgcacgtaagcattcatgccttgaagtatattccaaacggtcttgttaaacggagcttttaatagtagttcaattatctccgtaagttcacggccttcaattaattctacaattaatttttctttgccttcgtataccgctctatgcattagccccgaaagtattgattgacgtatttgtgaatctgctagtaatcctaactccaaagtccctttcgcaaattcaagcagctttttgtcatgcagtatatctagaatcaaatttcctatgagaaaagcacattctcctcttgatgctaactcatacactccttcaatccctctttcaaaaagcacctctgtaagcgcctcctgccgcatcttttcaattttgactgaacgttctctatagtctagcaaatcatcttctaattcctcgtatgattcttcaatccattgttttttgaacaaccattcatttctaattataatgtcttttggctctaacaaagcatatacctttcgtgcatgggaatctgaagcaagcgctcttccagcgttctttctgacacgacgagaaaaagcattgacgcgtatcttctctcgcaaaatagacttttcttcatcttttgctgtgtaactccaactttcaataagactccatattcgatctgcaaattcgactggaatgcattcaatgcaactgacaagatctccaagtgtagaagtggtgtgaggattccatgataatactagttcaagagtttttaaaagaaactttctgcgttcttcgtgttgaactggttcgccagcaccgtgagcgccagtgcgccaacgtggtttataattatacgtaccgatcattgatcttgtattaatttgttcaatacaaagcgcccatgcaacgtcaggataatgtttaattaaatattcaagcaccaagacccttgattccagtgaagctgtagtttgaggcatccaggagcgaaaaattgattgtagacttgctatcggcttatttgtcaaattatcttctatttttgtttgagccaattttgcaaggattcgagctacctccatgagatattgaggagaccaagcaataccttctaaggcccacagtaatccagttcttgagctgcgtccaaacaagccagattgaacaggcttcattaagccaattaattctgaagaatccgaaaataagtcttctgcaagtattcgaagaaacacatctggcgcggcctcagcatatactggcaattcactggactgagcctctaactttcttaatgttaaaggagtcaacacatttttaattacttttccaatttcaatttctatgttgtgcccatgtcgctcttcaaataaggaattaccatgtactgcaagcaagagcaatgtttcggctacactctttcgaagtactgaagaacattctctagttttaccatataagttcgcagcccattgctgatcttctggaagatccaatgcaggatcatcttcagaaagaatatactctgccaattccaaaaatcgttgaatactttgccaggtaagtcttttgttaattgcataaagagtatcaatcttggagactagtccacgtaaataaccaatagaccaaactgggctatcgcttagcaataacaatttactaaactcttcttcaatttgattgtattccatgttatctgtaagaagtgaaagaaggaccttgtctgcatcgctattagcattccatgtcccagcaaaaagaaaacttgaaaggacgggagagacattggggtctgcagtccattcgggtatgcgaattgcttctaaattagacaatctgcgtctcaaaactgttaaagaacgccctgattctcgacctaatttttctatttcgtctccattgtaacccatgctttcaagggcctttcgaaaagaagcatagcttaaaggctctaatactacatccgcttcagcgtttgtagaattctttggatagataataatagaatttaaattattcttataagaagcgtattcgcgttctacttctctatccgttattatagcgataaaattcgaaggttttatagctaattttgataatacttctttttgagtaaacactgctattcgatctcgaaaggaaaaatactcagagttactaggagagaataaacaactcaaaaaagctagcgcctcctctgtagagtcgctatgaataattatcggctccattgtaacaagcttattctggattgatgtactcgctttagcgttttcaatagcttcatcgaaaagagcttctgaaagttctggattgctatcagcaacccacgtattccaacactgatctaatgactttacaccctgtgctggcattgacaattcatttgctaaccatgcttgtgcagaaatagattgctctaaccattgttcaagatcgctagaatcaaacaccagcacattcttccactcattttctgctaaacgtttatttttccaggcggttttgcctggccaacgatttggagtaacaaagacgaaagtaatttcggacctttcttcggccgaagactggcccaggcttttagtgtaatccttatctgctttcctttttggatcgttgttaacaccaaactcccaacctgatttccctttaggtacccatggggtaccttcttgggcttctaaatatccatcccatcccggacgctcagcgtcatcatttccgggaaaatcaattttttctattcccaatcctgtagagttaactaatgttcttaaaaatacagcaaggcgagtgcgcgctttaatcgtagatgcccattgttcaatgtcattagcttttatttgtagaaaaggcgggatatatgttttcgccactgaagctacgcctttatttcgaacatgtttcgtatcataagtagattgcatttccattaattctttagcatcagcgccaaaagtacgctcaattttagcagccatatcaccagaaagtgcagaatgcccgttaagaagattagaaagagtcgacctgttaacagatagcaatttggctgcctctgtgaccgacataccttttggaataacattacttttgataaaacgccctaattcctttttttggatatcagcctcgctgctcaatctaatctcctcctaaatttttaaaaatcaaaaaaacatgtgtattgtagtcattgtaatgtattgtgttaagtcacacaatacaaacatacgttttattgagctgtccttttttaatgatcaagctaccttactttatggtggcggataattctaaactacgagatattgtcatcttgaggactgggatacaatcataagatcatcatgctcgcagaagacgaagagagttattttagagaatattaaaatttcagaaatatcattgctacttcctatgcctcaatatataatagaaggaattgttgatgagaccgatatatgtggtgaatatttcgttatttgaatcacaaaaaaatcacataaaaaatcacaatctcggcgaatgtggatgaatataggcaaatgaaattttctgaatagggaaaaaaacgtgttataaaataagagttaagttcggaaacgtttatcggcgagaataaatcaaagatgggcggcatgatgtaataggttgaaaaaaccttatgcatcaagggcttctatgattagacgccctgtttgaccacatagtgtaaaacaaaaggctgattatggacactctcataatcagccttttttaatgatccaaattgcagtgatatatatagacttacacatgatctataaggttttttcgtttcattacgtttaaattgaaagcgttgacatgattttcaacccgctatatacttagcttaattaaatgaatagcactaggattgttactgttacgcaggcaaaacctaaggaacaaaatgttaagatctaaggatcttatgtattttgttatacttaggtttttttgtttatagagagaggaaggttaaatacaagtggtttcggcactttgctgaagccattttcttctatttatgagttcacatctgagaggagcgacaaacttggaatacaaatatgagctggtccaggcagacaatcattttccgttaaaaattatagttcattcctccaatgaaccagcgtacatacctaggcattggcacgatagcatcgaaatatcctatgtgctttcgggaaaaatcgataatatctatattgatggcgcgagttacagctccaaagaaggagatattgtgctcattaattcgaatgctattcattccttctctgtggctaagggaaaagggagagaggctataacggttctgattccttctgaatttattagagcaaatgttaacggcagtaatcccatctcatttgactgtatttccattttcgaaactaacgagcagagattacagcattttgcggagttgcgtgatttgttaaacaccttatttgtggcttatctcaaccggcataatgactctttagcacatatccatttaacatcactatcttataaactggtgtatctgttattaatgcattttacaatggatcatgaatctatccgcggctttaactccgataaatatttggagcggctgacgttgataaccgattatatcaaaaagaattacgatcaaagtttatccttggattcgatagctcaggtttttgggttgtctcccgaatatttgtcccgtttttttatgaagcatgtagggatgaccctatttcaatatatcaatgccatccgtctggagagatcttttcgagttctcatgaatacggatcattccatcatacaaattgcgctggagcatggatttccgaacgagaagtcttttgctagggtatttaaaaaggtttatcaggcaacaccgcatcaatatcgaaaagagaacaagaggtattctggagcaaggagtcagtaattgacctgaaataggctaataaaagacaggatacaaataaaaaaatcattaaaataaataatgtaagcgttttattaatggacccgggaggtaagacatcatgtttaaacggtttcaaaaggctgctaaaacaactatgttattcactttagctatcggtacgacccttgctttcaattccggtgcatgggccaaggatgtaaagatacagtccacctcgtaccggacggttgcggaggttaaggattggggagcagccattacgaagatcattgttaacctgggtaagccagtacctaaagatgcgataacaaaggatacatttaaggtgcatgtgggaagaagcgacaatagactggtaaatccctttattgagagtggcaaccggaaagtcaccaaggcctatgtatcggacaaaagtggcaaccctgtaaataaaaccggaagctacgttgtattagaaatggaagtcggcccagccttaacactaagctcagctattcattatgatgcggcaggttccgggtttaacgcatggaatgataacaaatacacaatcacgcagcataaagccattaaaaccacatccggaacgatttccgacttgaaaattgatacttccgcaggtcagatacggaagctagttgatcaatttgcaaccggcaaagctacttttgacgggattactttaacctatgcggactatgcaccgccaaaagacaaagtgaaaaaccccttggtgatctggctgcatggtatgggtgagggaggtacagatccgacgattccgatttccggaaataatgcagcgaattttgcatctaaagatattcaatcctattttgaaggggcttatgtgctggcacctcagactccaacctactggatggatggttttacaggcttcggagacggcacctccaaatacgagcaagcattgatgtccttaattaaggagtacgtgtccaagaacaaagacattgatacagatcgaatctacattggcggagactccaacggcggttacatgactatgctgatgatccgtgattataaagactattttgcagccgctgtggttgcctgtgaagccttgaaggatagccttataaccgatgaacagattaacgaaatgagggaccttccgatctggtttgtggctgccaaaaccgacaccgtagtaccgccgaacgattatacggttccgacctacaaccgtttagtgaatgctggagcaaaggatgttcatatgtcgttatttgatagcgtagtagatacctctggtctgtacaaaaagagcgaccaaacaccgtatgaatacaatggccactggtcttggatttacatttataacaacgaagtatcgaaggtgattaacggaaagaaaataacgatgatgcaatggctagcctccaaaacattggactgaaaggtacagctagcaaatgaaatagcaatatgatgtaataggcttctttaaagttcaagccagctataccatacattctctgagccattcgttaataacacattatcgctcggagaattatcagttccttattaggttttcgcaaaaccctcatgtataaaactccgtcaccaaataattgacggagttttattgctctcttttacttattcacttcaatgagcccatccggtttttcccgattagagagcaattcggataccgtgacgaaggtaaaccctttcttcttgagctctggtaaaatgattttcagagcttcgacggtttgtgtactttgatgtacataatcgtgcatcaggacaatgtcgccattacgggcgttgcgaagcaccctatgagcgatacggtgtacacctggttttcgccagtccagggtgtcctgatgccaggaccataaaataattttgaaccccttttccttggaaagcttgacgagcgaatcggtgtaggagccgccggggggtctaaaaagatgggttcctgcaccagttgcttgaacgatgctcgcttggccttgatccaattctgacagagctttgttacgggaaatatactgaaaagatgaatgataaaaggtatgattgcccacttcatgcccttctgctcgttctcgtttcacaatatcaggaagcttttctacacggctgccgacgacaaaaaaggttgctttagcattgtactctttaagcaaatccaaaatggcaggcgtattgcttttgtccggtccgtcatcgaatgtgagagcgataagcttacgatgggtaggaacttcccacacaatgtcgccccgttcttcgtaataggcccttccctttgtaggagtgggggaggcgtatgatgaggcttgtgcattggtagatggagtgggacaagagctgatacacagtaaagaaacagcaattccagcgcacagcaaacggttatatttcataaggcttcttctccgttctaacgtattctcacattagcttgccaagaagaagcgtataccattcctcgtttctgaaattcatccattccaatcacttaaaattagatataattgcttcttcagcaatgcgcagattgcggagttatactgaaaaagagtgatagcttgcttgttgataacatcccgtacccatgttaagttgtaacatatccatccttggtttcaatgtgcagttgaggtaggtcattgtccagttcgcgagagtcttaatctgacgaaaaatgaagaggtcggcgggacaagccgtaaaagctgatctgaagtcaaggagctgtgactcgttcctgaacttcgaacaggagatgagacgggatgcaaacaaatgaaaaagagttgcgagctattagtctgacgttagaagcgggcgaacacatccgatcatgtatggggtgtatgtatgatttgcaacagagctcccagaagatatcgcatcatggaatgctggcagtgacatcccgacgaatcatcttttattcctgcactatgggtactccttgggtcaagttcatcaattatcatcatatttcactggctaagctggataagaatttgtcggattttagggggaacatcacgctgatcaatcagggtgtgaacgaggtgttcacccacctgccgagtggagattgtatagaaaggtttatagctgtactagagcaagaagcaggtatctcttgtgagaactaatgattatgaaaaacaaataactaaaacctccaacttcgtaatgtgccaggaaggccccttacagaatttggaggtttttttgtcttttaattagagagatgtggatcgagcatcagctcaacagggtgataaccaataaattatacaacaccagcggcagaatgacattattgtaggcataggagcgatcaggcgtggtggtgcctgggaagggggagtgatattgctgagggactctcagatacaaatgatccgcatcgatgtgtacaatcgttccttcatatacttgatgatccatcgtttgcaccctaaccgtgtgattcatgtaggggcttaattgataatgcaaatgatcgcggatatttttgagttccgcctgtaattccggtctagcttgatataaagtttgcggattgacggtgttgtatggcattcgcctctaacctccataccctgtaatgatgcattatatgcaggagtctatgtccttgtgcttatacctatagagagttgcttttacaaaatgaaaaaacattaacattttactccagtccacttgacgttccctttacatcaaaacgatacacttactgaggttggtttgaaaagaaaggggcgctccgttttgggtgagcttaataaatctatgggactagggacgaggagtcagcaacagacttcgtctaaagcccgcatacgcacgggttcgctaaaaattcaaagattgcgcgaaaacgcgctggcgtatacctttttggctccatcgcttattttgtttgctgtatttatgttttacccgatgatcaagtccgtatatctcagcttgcattctacagatcccgcaggaaacgttgcagcttatgtggggttagataattttactacacttttcagctcgggactgtttctacaaggaattaaggtcacactcctgtttgcactgttaacagtaccagtaggtattttattggcgctggtactggctgcacttacacacagtaaattgcggggaatgcgtatcttccagtttgccttttcgctgccgatggtgttgtcggtcggttcatctgcggtcatttggaaatttctttttcatccgacactggggatgttcaactatgcgctttccctgctacatattaatccggttccgtggctgaccagcccggattgggcgctgttctcagtagccatgatgaccatctggatgaatcttggcttcaattacattatcttatcgagcggacttcaagggattccagatgacatgtatgaaagtgccaaaatggacggagctggcccgctcgtcacgttctggcgtatctctctgccactgttatcaccgacgatcttttttgtaacagtagtctccatcattggagccttccagtcttttgctcaaattaacattttgaccaagggcggtccggtgaacagtacgaatgtattcgtgtattccatctatcaggaagctttcgttaatttccggtttggaacggggagcgcgcaggccattgtcttgtttgccgtcattctactgctcacgatgattcagttcaaatgggtggaaagaaaggtgcattaccaatgaaacgacacctgaattcaacattgctgtatgtactgcttacgattgcagctgctctcattttgtatccggttatatatacgttttttatggcagtcatgtcgccggaggaagcaagcgcttatccaccaagctttcttccgcattcctttcatatggagaatttcactgaagtgtttgaaattgttccgattgcagcctttattggaaatacatttctcatttcgggtctgacgatgattgggcagttgattacagcgagcttggcggcctacgcctttgccaagatggaatttaagggaaaaaacttcatcttcagcatgtttgtagcgacgatgatgatcccttgggaagtgaccattattccaaactacctgacggtacgaagctggaactggcttgatacgtatcaagggttgacggttccttttctggcgacggcattcggaacattcctgttaaggcaattttttctccagcttcccaaggaactgtttgaggcggctcgtatggatgggtgcggacatatccgttactttgtgttccatgtgcttccattatcgcgccctgcgcttggaacattggctgtgtattcgttcctgaatatgtacaattcatacctctggcctttactgatcaccaatagtgagaatatgcgtacggtacagatcggaatatccatgctcgaatttcaggaatcgacttcatggaatttggtatttgcgggtacggcccttgtcattttaccgtctctgctcctgctgatctttggactaaagcagttggtacgtggaatggcagcgggtgcgcttaaaggctgatcacatatttcaaatgaaaagcaacacctgcgcaagcagcccatatacagagcttcaacacacaagaatatcgcaagagaatgccaattcaagatcatttaatcaaagggagagaagagagattatgagattttttcgtctgaaaagtacattgaccctgcttattctgactgccatggtggttgcagcaggttgtagcaataatactgctgcagagaagccgagtaatggtagtgatggggcagcagcgacttctccagtgaagctgacttggtggcattcgatgtccggtaacggtgaaaaagcaatcaagcagatcgctgctgactttaacgccagtcataaggacattcaggtagagccagtatatcaaggcaaatatgatgacagcttgaacaagctgaaggcatcacttggttccaacagcggcccggacatcattcaagtatacgaaatcggtagtaaattcatgatcgactccaaaatgatcacacctgtacaacaatttattgatgcagacaagttcgatctgtcgcagttagagccaaatattacgcgttactacacgattgatggtaaattaaacgctatgccgttcaatacgtcaaacccgatactatactataacaaggatgcattcaaagccgcaggacttgacccagctaatcctccgaaaacgtatgatgagttcgaaaaggctgcaaaagccttgagcaaggatggtaaatccggtgcttccattgccctctacggctggtttatggagcaactgtttgccaatcagaacgcggattatgtgaataatggcaatggtcgtgaccaagcggcaacggaatccatgctgaattcggatgccggtgtaaaaacgctgacgtggtggaagaaaatgatcgatgaaaaggttgtatccaatctgggacgtaactcagacgatacggcaaaggctttttccgcaggacaaattgcgatgacgctggattccaccgcttcgctgcgtaatattgtggagcaggttggcgataaatttgaagtaggcacaggattcctgccaagagccaatgaagctaaagaaggcggcgtggttgtaggcggcgcgagtttgtacattatgaacaacaagcctgaagcccaacagaaggcagcatgggagttcattaaattcgtcgcttccccagctgtacaggcacaatggagtgtaaataccgggtacttcccgatcacgaaagcagcctatgacgagaaggtactcaaagacaatatggtaaaatatccgcaattccagacggcggttgaccaattgcacgcatcggcacaatccaccgctacacagggcgcagtgatgggcgtattcccagaagcgcgccaaatcgtcgaaggtgcaatcgaggccgttctgagtggccagcaacagccaaaacaggcattggatcaagctacacaagaaattacaggcaaaattgcgcaatacaatcaaacggtgaaaaaatagtcggccttcccttaaaatcggttggtaatctgtagaatggcccccttatcatccgattttatgacatagcggatcgaaatgagtgaccccctcacttattcgatccgtttttgcattttcttttttagaataagcgtttagacgaattgtctaaaatgaattattttcatttttcctattgctgggtaactaaagatgggcttataataaatacataatttttgtactggacggtcagttcaaaaaaggaggaagcatgaaacagcaaacgaaggaaattatttttaacggcgcacttaaagctttttccgaacgaggatttaacgaaacaaacatggaagaaattgctaaggtttgtggcatagccaaaggaaccctgtactacaattttaaaaacaagcaagaattgtacatttacattttgaagatggggatggagcgatttgtgcaggatatccatgaagcgatggctcaggttcctatggatcaggtagaactgagggttcacaagctgatccaagtacatattgagttcattgggagagagccggatttctgccgtttactggttagcaagggatgggtctcacaggaacagcattttaatattaggcaggtgctggcagactattttgattttatggaggcggagatcgattccggtaagttatatgggaaaatttcaagtaagctggatgccaaaacaacagccaattgcttatttgggatttacattttcgctccgatgcgttccatggtttggggtgaaacgatgaatctgcaagaggttcgagaaagtattgaagtatttgtgtgtaatgcattgggcatgcaacattaatagacagatggagtgatgaaaacatgaaagctaaaaaatatacgatttacgtcgtacttattattttaatcgcggtaggaatttatgccttgactgctttcccacggggtggaagcagcttgtctgcggatcagtcttcttccatacctacggcttatgtggagtcggataccctcaatgccagctttaaaatggcaggacggattgaccagatgctcgtcaaagaaggcgatcaggttaaaaaggggcaggtgttagcccatctggaaagtcgcgagttggaagataaggtgaagcaggcacaggcggcgttgctggcagctaagagtaatgtatccaaagcaaaagccagtgtgttgcaggctcaagcaggcgtaggtcaggcacaggctactgtgagcgccgctcaggccaagaagagccaaggtacgacatcggtcagtgtgaccgctgaggcatcctccagccagatcgaacaggccaaagcggctgcgaacgccgccaaggcaaaactggatgcgctcaagagcggggcaagaccgcaggagcttgagcaattgcaagtatctgtgaagatagccaaggaaacgctggacctgaccgttaaaaacctggagcgtgccaaaaagcttcaagaagccggagcagcaacccaggcatctttggatcaagcgacattggaacatcaacaagcagtggccaagtataatgcagagtcgcaaaaattggatatggcacgggaggggagccgcaaggaggaaattacggcggctgaagctcaataccgtcaagccttggctgcggtgaaggaagcacaggcaggagcgggcaaagttgctgtgcaacaggaagatgtcaaagctgctcaggcttcggtagaacaagcgcaatctgctgtgaaggcggcgcaatccacagttgagcaggctcaatctgcggttgcaggtgccaatgctcaggtagcccaagcagaagccgcacttcaagaggctcagacctatttgagttacacgactctatatgcggccgaagatggaatcgtaaaatccaagtcgcttagcttaggtgaaatggctagcgcaggattcccagtctataccattgaaacttcgacacaacgttgggctaaattctatgtacctgaaacgtctctgaatggccttcaagcaggggatactgtccaaattaaattgctgtctggcggtaaggagctgaagggtaaagtcattctgttagaatcggctgctgactttgccattcaaaaaccgagccaaagctccggtgacaaggatgtccgttccttcggtgttaaagtagcattgccggaccttgctgcttcggttccaacaggctccacggtcctgtttacaggcaaaggggcgcagtaatatgcaggattcacaggaaagacttcgtatccgtgatgtgtttcgcgaggaatggctgagcatcttccgggaccgccgctttatggctattctgctgattacgccgattgtgtatacgatactattcggtttcctatattcacaccagcggattaccgagatgcctgtcacagtgtacgatggagataattcacagctcagtcgccagattattcaggcgttcgattcgaccgactcatttgccgttacacggcaagcgaccaatcaggaagatgctgtccgtcaggtagagaccggggaagctaaggtcggaatcgtcattcccgacaactttacgactcggcttaagcatggggagaatccacccgtgctcacgctgattgacggcagtaatatgatgtattccaatagtgccagtcggattgcgaatcaggtcattagcagcgtgagcgctggagtatcggtcaattccatgaaacaaaagggaatgaacgccgatcaggctgcgtcgacgctgactaccatcccgttccgatccagagtgctatttaacccggtatatgattataagcttttcatgccactaggggttatctctgcggctctccagcagtgtttgctgcttggtatcgcgttgtcctgcacgcgtgataaggaagcagggacttggggaagatttggtgcatggagaaataccccttggcggttggctattgccaaactggcaccgtattatgcagcgggagctttcaatgtgctgactgtatttagtatcagtgctttatgctttgatattccgtttaggggacaggtactgccgttaattttggtgtcgctggtctttaactttgccttgtgcggattaggcttcctgttcagtctcttttccaagaccagagtggatgcgacccaaacgctgatgctgattgctgttccttcctttatgttgtcaggttatacgtggccattagaggctatgcccggtttcttgcgggggcttgctgaaatattgccactgacgtattacctggacgctgtacggaacatcacgctcaaaggactggatatcacctacatcttcaaagatatgattgctctaggcgtcattggttgtgtgagtctgctggtgtcctttgtgatctatccgttattctttagacagcagcagacgacagggcagtatgccgatgtgcccgctcaagaaggattcacgctaaaaggctgagagcaactttaaatatggatatcataaaaaggcagatcaggagtaaaccctgatctgccttttacttattcgtatggtttaaaaacggaaaaaatattattgcggcgccttaagatcctcgatagaatcaatcggcacataggatggaacgacaagcccggacataacgccagtcatgctggttccgatgtcatccactttatccttgtattgagcccaataatcagcatgcgtcaatggaagccaagccgcagcagtagcatctacacttccgcctgccacaccagtccacatcgggccgatttccacttgcagggctgttactttatagcccaatttttgttccaatacatatttcaatacgttcgtactggcaatttcagaatcccaagcagcgtagctcagcttcaaaggatcaccgttgacgggctgtaggcccttgatccatgcctgtaccttgtcaggatgtttatcagcccagttcttggcagcctgctgtggggcaataccgtcctgaatcgcgatcatcacttcacccatatcttcagcagtccacttaaagcggcttagaaattcataagccacaggagcatcctgctttaaacctttgcgggcgattgtatgaatttcttccttatcaccgtacgcttttttaggatctttcaagtatttcaaatcatatttgttaaacatccagtgaggagtccaacctgttacgacgataggctgcttggctttgatagctttatccagtgtagcggtcatagcagctccagagctttcaagcagcttccagtcggataagccatagtcattaatagctttagcggtcagcttcattagtccggcgccagggtcggtaccgacaatgcggtaaccgacctctttgccaaagtcctcggttgtggcggaagccggagccgcttcggctccgttatcctgcaaatcagtaatcgatttaacatccatgtaagctggaacgaccaatccggttttaacaccgctcatattagccccaagatcgtcgagcttatccttgtatttagcccagtaatccgcatgtgttaacggcagccatgcagccggtgaagcatctacatcaccactagcgacacccgtccacataggacctgcttccacttgaagtgcggttactttgtaacctagtttgttctccaaaatataacttagcaaattcgtactggcaatttcggaatcccaagcgacataactcagcttgaacgtgtcgccattgacaggttgcagtcctttagtccattcctgaaccttatcggcatgtttctccgcccaatcctgggcagcttgttcaggactggttccggcttgaatggcaaccatcatttcacccatatcttccggtgtccatttgaaacgttttagaaactcataagcgataggagcatcctgttgcaagcctttacgggcaatcgtatgaatcccctcggcttcaccataagacttcttagggtcttccaaatatttgagatcatacttgttgaacatccagtgaggagtccaacctgtaataatgatcggttttttcgctttaatggctttgtccagtgtggccgtcatagctgcaccggaaccttcaaccagcttccaatcagacaaattgtagtcttgaattgctttggcagtcgatttcataatgcctgccccggcatcaataccgataattttgtaaccgacttcttcgccaaccgggttggcagcagcgttacctttgccagatgcggaatgatctgtaccaataaaatattgggaagcaccagcgatcaaaatgacagctgtaactgcagaagtaatccatactttttgcttgctggatacgcggcttttgcctttttgcgtaggtttaaacaggttttgcgtaaaacggtcaagcacaatagccagaacgacaacagctaagccggcttcaaaacctttaccgatttgcagctgtgtcacagcacggtatacaacagcaccgatgccttctgcaccgatcatggaagcaataacaaccatggatagtgacagcataatcgtctggttaataccagccattaaggtaggcaatgccagtggaagctgaactttgaacagcttttgcgcagaggttgaaccgaaagcatctgaggcttcgatcagctcacctgatacttgcataatccccaagttagtcatgcgaatggttggggggatagcaaagataacagatgcgataacaccaggtacaacacccaggctgaaaaaggtaaccgctgggagcaagtacacgaacgcaggcatcgtctgcataaaatcaagtaaaggcgtgataatgcgggatgcggatttactgtatgcacaccagatcccgatgggaatcccgataacaatggatacgagcgcagacgtgatgaccagtccgagcgtattcattgtttcactccaatagccgagattatcaatcagcaggaagccgatgacagtaaacagcgtaagctgaacccgcccgatcataaaggcgataatcccgatgatcacgatgaacaccagagggtgcggaagcatgaacaggcctgagaaaaagcctactacagcttctataatagaagaaataacattaaacaatccagccagatgaatacccatccagtcgacaatggattgaatccactcagcgattggcagtttcggtatcatgggcattcacctcctttgtagtggtaacatctccaccaagtgcgccaagcaatgctccacggacgataacgcccagcagcttttgcttgtcatcgaccacagccagcggcaccttggacgagcttgtaatttcaaacaaatcattaatgacagtctcggcagcaacctgcggtccgtcagtaatcaaaatatcttcaattttcaaattattgcgcagtgcatgaacagcatcctcggcgttaataacacccagtagctttttagtacggtcaatgacgaacaaattggaaatcccacgctcccgcatcaattccagagccacacgcggaccacgatccatggtgatggtttctggacgaagcatgacatgagcagccgtcaataccttggacagatccacatcctcgacgaagcgggctacataagagttagccggttggatcataatttcttccggtgtaccgatttgtacgaccgcaccgtctcgcatcaaggcaatccggtcaccaatccgcaacgcttcatccagatcatgggtgataaacacaattgttttcttcattttatcttgaagttccaacagctcatcctgcatgtcacggcgaatgagagggtccaatgcactgaacgcttcatccatcaggagcacttcagggtcattagccagcgcccgtgccaggccgacacgctgctgcataccgccactcaattcatcgggcattttatcgccccagtttttaagaccaaccagttccaacgcttgttgcgccttttcctgacgctgtgctttttctaccttttgaatttcaagaccatattctacattttctaatacagtccgatgtgggaacagggcgaatttttgaaaaaccatgctgatggttttacgacgaacttcgcgaagttgttctttgttcatcttacggagatctttgccgtggaccagaatttcaccggaggtaggctcaatcaagcgatttagcattcgcaccaaagtggacttgccactgcccgatagccccataattacgaaaatttcaccttgcttaatttccatgttggccttattgacaccaacagtaatctgtttttctttggccaacttttccttgccccagccttgctccaggagcggaacaccttgctctgcgtgaggaccaaagagtttgctgacatttttgacttccaaaatcgtcatacatacacctcttctttctatactttgcttggtattaaccccttgttgcattaaggattgagtataaaaatcataattctgaacatcctgaacggttaatgacaaaattaattgtaacagaagcactacttacatttcaaacaaaaaaactgttcataaagtacgtacagaaaaaactgtacaaagtttcctttgatatgctccttcgttctatagaatgctcaaacattcggaactttacaaccgatagtgctttttttaaaatagacaatgaaatataaccataagaaaaagatttatgtatatccataattttaaaagtttactatcattagcaattttgcgaattatgattttgaacgatccatgctgttgtaatatagacagaagctttgtttttgaaacatttcatttattattgaaagatttcatacattgcgtcaaagctaatcttttacgggtaaatcgttcatactaggttgtgcaaaatgctctaaaattaggaggttgcaagcatgagcttgtaccagttaggtgatgagcagcaggcttcgctgcaaaaaattcgcaaacgtgttatagaagctataggtaaaaacatggacctgtatgggatcactttgtctgcggggcatttatacggtttgcttttctttgcggataaaccgatgacgctggacgagatgggccgtgaaatggaaatgagcaaaacgagcatgagtacaggagttcgaacattactggatctgaaaatggtaaataaggtttggagcaagggctcacgcaaagacttgtatgaagtcgaatatgactggcatcaaaccttcactgatttcttcgctattaaatggagaaaagcggtagaaacaaatttactggtgttgcgcaaagccattgatgagctggacagattgatgaatcagggtgaagagtacgaggaatttaaggcgattcttcaacaagatcgtatgaaaatgaagcaggccgtcgcttattacaagtggctagaccgactaattgactctatggaaagcgaagaaatttacaagttgattcccaaagaagaagttcgggattaatcgctatttccctatcttgtttataaaaatgccggagcgcaaaagtgcttccggtattttttggtttggccgtgtgcaaagggtataatagagatatgtaaagattgatattataccgttgtgttgaagatacgaaataaaggaggcttcatgatggagagtattacggtacatactcgtttaggtcaattacgtggggaaacggggaatggatatcatgtatggagaggtatcccatatgcacagcctcctgttggaaaactacgttttcatgcgccccagcctttggagtcttgggaggatgtacgggctgcgacgagttttgggccaatctgtccgcaacctatgccatccgctgaaagtatgactggaaatctggtggaaccgcctgagcagtcagaggattgcttatacctgaacatttggatacctgcttcgaaggctcctgagaagggacgtccggtgatggtgtggattcatggcggtgcctttgtcacggggtccgggattatacctttatatgacggggaacgcatggcgaagaatggcgatgttgtggttgttacgatcaattatcgattggggccgttaggatttttgcatctgactccaaagggagatggcctgacctctaatgcgggactgctggatcagatcgctgcgctggaatgggttagggatcacatctctgcctttggcggtaacccggacgaagtaacggtgttcggtgaatcggcaggcgcgatgagtattgccgctttattggcgatgccatccgctgagggactgttccagcgtgcgattttgcagagcggtgcgtcgcaggtattgccaacctcacaggccgaacaagtgacggctgtgtatctgcagcagctgggtgtggacactcagcatccagaacggttgtttacgctgccgacagatgcgctgatgctagctatggcgaagacgcatgaagtcatcggaccagggatggcgatgatctatcaacccgtcgtggacggtgtgaccttgccagatgaaccgctgtctgcaatcgcgcaaggttcagcaaagcaggtatccgttttgattggaacgaacctgcatgagggggcctatttcatccgaaaagaatcccatctaatgaacaagtcaacagcgagtcaggcattggaaatgatgacgggcatgtcagacatcagcgacctgatagaaccatttcctgttacgattgagggacaggcacaaatgttgactgatctatttttttggcgtcctgcattggctcttgctgttgcgcagtcggcgcatgcgcctgtatggatgtatcgttttgattggacattgccggggcatcctacctttggacaagcggttcacggtgccgaaattgcgtttgttttcgataatctggagcttctaggtaagcttggattagagattcaaccgtcgatgcagaagctcgctcaagctatgcagcaggcatgggttgcttttgcacgtgacgggaagcctgtgctgtccgaggaggcttggccgatgtacaacagggaagagcggactacagctattttccatcaggatattaaaatggagcacgaccccgaaggagatagacgccgtcagttaactggtcagatgaccctataagtaagcaagagagaaatcaccccaagtactcacatggaaaaagccttcgcccgtaactagcatacggacgaaggcttttgttagtcattagatatactgctgctcattcttaatttcatgaaattgcaacgatacgatgtgtaacttaaatcttaaatcgcttaaccagctgttgcaaatcctgggccatgttggacaactcctgagacgaagatgcgatttcctccatggccgccatttgctcctgagcggcagcagaggttgtctgcgaactgtccgccgaattgcgagacagacttgccaaatgggtgacagtagccgaaacttcctctgtactggctgagatttgttcagccgcagcggacacactttgaatttgttccacaatatgagatgtagagcgttcaatattcgtaaatgcaccttctgcatcttggctaatacgtaatccttcacctacctggttacgaacattaccgttcatggtagcggtggagcgttgaatcaaatcgagcatctgagtaatgatctgactgatggaatctgcactttccttggattgctcagacagcttgcgtacctctatagcgactacggcaaatccacgcccggcttcgccagctctggaagcttcaatagacgcgttcagagacaacaaattggtttgcttggcaatggcggcaatagctgtattcatctgcttcgcatcgtctgagagctgggatagctcatccatcaggctagccgtttggcttacagcttccagaatacggtccatttgtgtccgcacatggctgatcatttgactgccttgagctacatcatgctcggtttgtcctgctgaatctacgatggagcttgctgattcggcaatggtgctgacacccttggccatttcttcaacggcattagcggtttgctcggatgcctcggcgctggtggctgcattttctgcggattccataaccgtttccgctacgtgttgtacggactccgtcgtttgttctgtgctttccttgatcatcagagaagaggaagcaagtcgggaggacgtttgattgacctcggaaaccatcgtatgcaaggaatgcgtcatctggtcaaaattctgtgccagttcgccgaactcatccttgctggataggttaacacgttcggtcagatttccgtcacggacgatgcgtgttcctgcttgcagcttgcgcagcggaattaagaacgagcggaccataagcacaatgatgatcgcagcggcaagtatggaaatgacaatcacaatcaggctttgcttcagaatcggttgggctgcatcactgtaatcctccagatccgacagtgcgacaatgctccatccggtgagagggtccttaagtgtaaaggccagcatatctcgattcataaattgaatttgcgacatggaaggagtatcattttcgacggttgtcgccacttcgggaagtccctctatggcgtcagccggttttttgcctgtcttgttaaaggctgttccagtcccagatacaactttatattcagaatcaacaataatgagtcctccgcgttcaccaatcttaacagactgcagactttcacccatcttgtccagattcaaagccaatgcaacagctccttcaccgtcctccagcgttcccgatatattaacgactaaattccctgtcgtgacgctggcaactggaacaccgacgaatactttgcccttttccagcatcgcatttttgtaccattttctctcccgggggtcataatcggcctcctgttttttcggcgaacgtatgtattgccctttcgcattaccgagaagcgcggcatctagctcgggatgagccttgacgatgacatccaacttcttctgaagggcctcttggttggtaccaatggaatcagaattgatttcagtggtaagcacgtccaggtctttcataataggtgctacatactgattgacattgctccggatcaaatacagattcgtgtatacggaaccgcccatttgctgactgagttgtgttgtagccccctgataggaaaagtacccgataagtgcgctcggaatcaataacacagccaaaaaagatattattaatcttgtcctcattaaataaaactgtttgagaaacctgttccaccacggaactgtttgttttgttttagtcatagctcttgctcctctgtgtctgatgatcactacattgttttattcgacagaaaccgactaattttatagatgtaatctttgagaaacgaagaataattacatgttttagacactttttctgaaagataggtctaaagaactgtattttatataaatacgaatatataaaaaagccaaatcggagatgcaaaagcatcttcacgatttggcttgggtgagtcatgaaagggacgttaaactgttaatttttttgctgacgtgaaatcataaagagcgtaatccagatgagcataaaaccagtcaattgcgctacagtgacaatttgctgaaatgcgatccagttaatcacgacaccaaccatgggaaagctcagttctgccatcgtagcataagacgctttggtcgtacttaagcctttgtaatacagcagcaagctgagaaggcccggaagcaatgcctgcaatagcagattgataatcacagctgcgcccgcccatgtaccggcaggcatattccatggcgcatgctctacagaggtgaggacaatcagcagagggagcgccaccatgaagcggagggaggttactgtttcatatttcattgaacgaagcaagtaacttcccatgactgtcgaaccgccccacagcactgctgcaccgagtgcaagcagactaccaacctgaacaaaatcacgaacatgtccgaaggggagcgaccaaccgaaggtcagaagatacgtcccgaacagagcgactacaattaatactccaaaatgacgcggcaacatttcctttaaaataatacgggctagaacaatagcgaccaagggttgaagcttctggagtaagagtacagcattcaaatcaccattgctgagtgccatagtgaaaatcacgctggccagagccgagccgccccacgagacgaataaaatagcgaaaacttgacgaagccgtaccgctttgagttcctcacgatgcttccacagcatcggtgtcagagcgaggaagagcagcacatgctccataagtacaatttgtgttgaagtaaatgactttagcaaaataatacgaaaaagcgggtctgcgccccacaaggctgctccaattgcgaccagccaaaaaccgcttttcatgtgggagctacgatcaaaacctttggatgttagtacagtagaagattgactcatactcaattagctccttgcgaatacaggaccggtggcacaaaaacccccgtccatggcgagccatgcaagacgggggttgatcaaataaacttgccgctttatgcaagttaaatgaagttgctgcaaaactaataacgcagtattcatccacttcgcggcatgttgatatttcgatcttcttccatccggactttaccgtcggctttggcatctcaccaaatcagtccgtatcctgttgccagatacagagtcgcgggcttagctccatgagccataccgccggttgggaatctcaccctaccccgaagatccttattccgtttttaatttctcctataggatatacctgttttagaatgaagtccagtgaaaaatgtgtgtatatctaacaatgattttcatcttttttttgaaggcgctctaggagattacatattacgaggtaatatccttatactcaatacgtcgaatcgccgcataagccacaagcattcctagtagagagaagccaatttgcacgggggctatggaactaagtggagcaccgttattattggagaaaagcaatgctacaatcaggattgaggtcacaatggtggtgggtacagagtatcttcgcatccccatatacagcggaaccaatcccataaagctggcagcaacggcattgatcagcgttcgtgctgattgttggcccagtatggaaagagtaaggttatccggtacaatcaagacaaactggttgagcagatgaatagcagccgtaatgattatttccgaaataataatagacaagaacgtaaacagcagcacaaccaagagcttggcgatcatcagcttttgacggtgaatcgggtacatgaacaagatcgtaatcgatttggatttaaattctccgacgataaagcggcatagcaaaacggaggaaaatacaataaatgttgctctcacaaaattgtctattagatccaagagttgagtgtactgtgtgaattcgggtattccttcactttgactgtccagcgcgataatacagagcagcccaagaatgcatgcattggcaatcagtgctgatcggatataacccgcgagatgaaattttttcagctccaactgcatcaatttaagcatggagatcacctccgtttaacaggcgcaaaaagtagtcttccagcgtgctgcttttctgatgaatggaatccacctctatatcatttaaaatgagcgttttcgtaatttgtttctgcggtacatttgaatcgtaaatacgtatactctgttcatttagtacccttatattattcagattcagatgatgggagaggacgtaggtcgcttttttacaatcgttggtcgtaaattcgatatattccgtattggtttcccgcacctgctccatcgatacttcctcaatcagtcgtccgtgattaatcacgcctaccgtatctgcaatctgctctatttccgctaaaatatgactggacacgagcagagtcatcccatattccttgcatagcatgtggaatagttggcggatttccttgatacccacggggtccagaccattaatgggttcatccaaaatgagtagctctggcttagttgcaatagcgcgggcaatcccaagacgttgcttcattcccagcgaaaaatcctttactggcttgtcatccgcatttcgcaaattcactaattctagggcatcccgaaccgcctgcttattatagtagcccatgtattcacaatgaagttcgagattttgctgtgccgtcagcctgtcataaaaaatcgggtattcaataatcgaacccatccgtccgagcagatgatacgattttggcgttaatttctcaccgaataattcaatttcacccgaagtcggcttgagtaaattcgtaatcattttcatcatcgttgtcttgcctgccccgttagggccgagaaagccataggtttctcccttgcgcacattcatactgactcccgctacaatttcattgcccttcagggccttggtcaactgatgtgtacgtattacgtaagtcatgggtgttctcccttcgtatactgctgataattcaaggataaagggcgaaatgttcatttttctttcgagattcttacaaatttattaagttgagcacaaatcgaattatgcaaaatgctgagttcgattaatagttgattttcttcaatgtaaaagagaagactgtccgctcataaggtctactagtcaattgaatttctccgttcatcgtttcaaccaggcgtttggcaatcgtaaggcccagtccgctgccttgtaccgccttattacgggagtcctccagtgtgtacatgcgttcaaaaactttatcttgctcagattcctgtatgcctttgccacgatcccatacctctatacgcactgtatcctgctgttccaatagagccagacccagcgtccgtccatctgccccataacgaatggcattcgagatcagattgttcagcacccgcccaatcgctccttcgttccccaaggcatgaatggggtgctccgggatctcaatatgcacggtaaatccctgtgcggtcagcaggtcataaaactccaaaatgctgcgtctgcacagttctcccacttccagtcgagtcaacggaatatccgtatcattagcctccagcttcgccaagctaaaaaagctgccgatcagctcaatcgcttcacttgtcttttgatgaattttggatagcagttttatacgttcttctggcaaaatagttggatcgccatccagcatctcggcatatccaagcacaaccgtaagcggggtcttgagatcgtgggaaatgttcgaaatcattttgcgcatggcgatttggctacggttgtaatctgcagacactctgagattcaagtccagcagtcggttaatttccgtcatgagtcgttgcagttcaacgtcacctgtgacatatagcagcttttccgcatgattcaccgtcacaatccgttctagtagggttcggatatcctttattttgcgcttataggccatacgctcccgccaaagccatactataacgactgacaggatgaggccgacaatccattcagaaatgttctcgatgttcatatcagccattctcccatttgtagccaatgccccatagcgttttaatgtggacaggatgagagggatcttcttcgattttctcacgcagacggcgaatatggacgttaatcacgttctcgtcgcccatataatcgtctttccaaataaatccgtataattgtgcttttgtaaatacccggttcggattggctacaaatagcttcaaaatatcggactctttggctgttagctgaatttcattttcattgcgtatgactgtaaaatgatcaaaatcaatgcgcagactgccgtaggtcaaaacttgtgcttgcggctgttcctcctgttgttgctgacgggcatatgtagtagatctgcggatcgcggactgaatacgagctgtcatttccagcattgaaaaaggtttggcaacataatcgtctgccccaaagcccagtccaagcgctttatccacgtcgctgtccttggctgacataatcagaatcgggacagcgctatgggtacggatccggcggatcacctccataccgtccaccttcggcatcatcaaatccaccagtaccagatcataggtatgacgttcaaaggcgagaagcccttcttccccgtcataggcggtagttaaattgtagccttccttgctgagtgctttgagtagcatttcggcaatggatagatcgtcttcaattagtaaaatatgttgtgacataggtgtggaacacccctaatttttagattaagctcgcgtgacgaactgtacctgaattatatagagcagtggaggggatttccataaaaaatatccaacgaatttgaataggggaattttcgaaggagggttaaagggctgtttttcctaacctctcaaacatgatgaaaagttgaaagacataagagaagcaaggcatacagccatttttgtatatgacaggtggtgagaagttgactgcgggtgggcaaaaaattcgaaaccctggtggctgtaataaaaattgctaaaactgaaaagttgattctaataacctttaactgcaatatggaatgtattggtttgtctgaaaagtgcttggtgtgagtaatactttataaatttcgtaatgaatgtcttcgactactactcttctgggcgaactaatgatttgataaactttttagtttcttatatctatagttcctatagctggttcaataccgccttcacccaaaattattcttctcagaaggcacaatcggtggctgcccatgagctaggacatgtcttaggactagatgaggactttagtaaatgcttgatgtatccaactacaccacaacgctatgataattggggaatttacactccacagcctagcgaagatgtgtttggtattaatgatctttattaataagggaggtaagttaaatgaagaaatatattattacaacaatagttgccgtggccattgtgggggtggttgggtatttagtaaaaagtgatgttctccaatcaacaacaaataatgcaccaatcgttgcagactcaaaacaagcgacaccgaataaatctgagcctgaaaaaagcggaaaaaccaaagttattacaagcctaagcctaagtaaatcttatgatacacttgatgctttgactaatgctgtagatttagttgcacaggtaaaaataacaggtatccaggggactttaccagaggaggattctacacggtataatgcagaattgactgatgtgattaaaggaacagaatcagaaaaaaatattgttattacccaattaggaataaaaacagacgatattgttgaaaaaacagacaatccctaccttaagcaaggcgatgaactcgttttatttttgaaaaagggccaagatcctaaaattaatccaatttactttgtggctggtgaatatcaaggtaagtttgacattaaaaacggaaacgtttatgcggtcaatcaggcgttaaaagagcaagctagtcttaatagtattgacgcagaaaacaatcaatatattgatgggcaaaaactaagtacatttaaagaaaatattaaaagtatagttagtagacaagaataaaaaactctatttaaaccgcaatccatttgtgaataatcagaaaaggtcttggcctaaatcgtaaaaagctgacttcttatcccgagaagtcagctttttaatacagattttcttatgattttggcttagagcagttaatctgatgatatgcgacttaactctactatattctttactcagttagaattaactattcttttttagataaaagagaaaaccttgtagaggcaaggctttctcaaaaataactattaatattctctaacatgtgccgttaaaagtaatgaaatcagtctcaaatataatcgattattcacacttaggtaattgctttaaccacctcatgaaatgatctaaatattcttaacctgaaggcactgtagtaatttcatctccactcctaacagaagatgtgatcaaattactggcaactgctagcccctatattatactgaaagagtttataatccgatgtttggaatacggtgttatgatatccgggacatgcctcatatgagatattaggtatgtcgaatcacgctgcggtacaggaccgtcaataaaggagagcaatgatgtttgtcatacgaggaacacaaaaactgctgaaggaatgggagactgaaccacttcaagttgatatttatccgcttttgaatagttggcatgccagcttgtttttactgaatcgaagaaaaaatatagtatttatgcatgatatatcccgcttaagcatcacgctttttgggattaaaaaatcgcagtacaaaaacttgccagctctttttatgcaagccttgaaggaatttatgatcagcgaaggctttgatgaacagatcgtaaaggcctacacacaggaaggcgagcagatgctggctactacgacgaatagtcatagtgtaatgggaaccttggaggagattatttttatcatgaaggaactggatatggagcatgggtgcgagctggaaaaaaaccagtggaataaccggattgttttcaaaacagtcgaatacaagtaccctgttgatgtttttaaagaaatgctagaaaagcattataaactagagagtatttgagaattttatgattttacgaaatgagttccatttattccctctgtcctatataattaatatagttctaaaagactatataaagagaggtaaggggtaaatgaagattaaattgagaaataaaactggaatgatcaaggaacgcaaagtaggtttttcatggactacgctctttttcggttttttccctgcgttgtttagaggggattggaagtgggctgttattatttttctggtatcgatccttacgagtggggcgtccaactttgtattttgcttcatatataaccgcttacatattaatgacctgctgacccaaggctatggtcctgctactaagaaatcccaagctatcctgatttctaagggatttattgctgaaaattacgctgctaactttgcaggttaatttgagagctgcttgttaaaacgagacgtgtcaaaagagcattcaccgaagtccatgcggccggggaatgctctttttttataactcacatgatagcaacgcttgcgatgaaatgaatcatagcgcaataagcggcacactttggtaaaataaaacgatacagggtttgacaccatcggtcagacttataaaacggggggtacataacgaaagatgaagaggattattgatatagccaaggaagcaggcattgaagaagaacatctggagacgtatggaaaatataaagcgaagctgaatccgtccttgtgggagcagttaagggatcgcccgaatggaaagctggtgctggttacggcgatgaatcccacgccggcgggagaaggaaaaacgctgacaaccatcgggctctcacaggcgctgaatgcgctgggacataaaaccgttgctgcattgcgtgagccgtccctcggcccttgcttcggcatgaaaggaggagcaaccgggggaggacaagcccagattgttccggcagaagacattaacctgcattttacaggtgatattcacgcgatttcggcagcgcataatttgctggcagcgatgatcgataaccatttatttcatggaaatgctttgcggttgaaaccggagcggatcgtgtggaaacgcgctgttgatatgaacgaccggagtttacgaaatattgtgaccggattggggtcaggtaatggagcagtgagagaaggtggcttcctcattacctcggcttcagaagtgatggcggtattatgtttaagtgaagatatggacgatcttaaagtgcgattgggtcggatggtgattggttataacgaagatggcgaaacggtaacagctgaggaactacatgcggtggaaggtatggctgtgctgcttcgggaagcattgaaacccaatctggtgcaaacgttggagggaactccagttattgtgcatggcggaccttttgcgaatattgcgcatggatgcagtagtttgatcggtacgaagctggccctgaagctgggagaggtggtcgtcacggaggctggattcggggccgagctgggagcggaaaagttttttgacatcaagtgccgtcaatccggtttgcagccagatgcggccctgttggtcgtaaccgccaaagcgctgaaatataacggcggtgtagctaaaaatgagctggacgcagaaaatctggagcaattgcaacttggattagtcaacatgaatcggcatgtacggaatttgcaaaagtttggcgtgccagtactagtagcagtcaaccattttgtaacagatagcgatgccgagctggaactgattttctcggaatgccgcaagctgggtgtacccgtagaactgtcacaggtgtgggcacagggaagccaaggtggagagaagctggcccaaagcctgctcaacctgcttcaggagaacaaagcccattttgcaccattgtatgagcatacacttgatttgcaagcgaaaattagtgttattgcgaaggagctttacggtgcggcagaggtagcttacactcctgcggccaaacgggcgttggccggtatggagcagcttggttttggacaactgcctgtatgcatggccaaaacaccgtattctttctcagatcaaccttctcagctaggtgcaccggaaggctttaccattcacgtagccagcgtttctttgtccgcaggggcaggctttgtggtcgtggaaacaggcaataccatgacgatgccaggattgcccaaatccccagcagctgagcatatgtcgctggaggcagatgggagtattcaaggtctaatgtagtatctttagaaaatggcagcttatcaggatgaagtgacgagcagtttgggcagtgcagtaagcagtttttgccgggtcatggcatcgctccagttgaagacggaggccgtttctccggctgtgatttgcgtaccgagctgctgccacattgccagattacgggctgtgaaggtagacaaccagcgttcggcctcccgctccttaccgagccaggtgccaagtgtacgcatccgttcctccagcgtggcgaaggagttgaaggtgacggtgggagcgatactggcaatgcgctcatattcctgttcatctgaattagcgatgataattagatcaggatcgagagcactggtcaagcgggtatccagtggaaggcccacatcggcgacatttcacaagacgatgtttataaacgctgtattcactgagtcgcagacttccgccgctggctttggcccctaatgccaatagatcgcccatcgtttctccatgatagatgatgcggcttgctcggcgcggaatatgaatatggtgacccgtccaatccttgacgcgcacagaaccggagacagaaagcgcgtacttgcccgggggaatcccggtcaattgcctaaaccgccgattaaaataatattcgtcagagaaaccaacctgacgggcaatttcacgtaaaggccgtttgcaatccagcagcagccgcttggcatgattcaagcgcagctcagtgaggtaatgcagcggctttttgcctgtcattttacgaaacaattgtgagtattgccatatggaaacgttcgcctgctcggcaagctgcttgacggtaatgggcttttcatagttgctttccatatatgagagagtgccttctaccgatgctggcaatgccggattagaggtagcattttgatcaatatgggtgtggtcttcctgccacagcaagagcaactcttgaaacatgatttgctgccgtaatacagatatctggttatgcggctgtatcgtttgttgggtactatgaaatagctcttcagtcaactgaataagtttggaggaagaagaggagacgatgcattcgcgcggtctcggcaggacaggtccatgatatagggatggcatacgcgatgcgtgttcacctaaggccatgtccgcttgtggttctgacggcaaagcgatgacctcaaacgtgattttgtagtattcgggcacagttccattcaggggagcgatttgataggattcacctggagctagccaatatccatgacctgtatggaatagatactgctctgagccaatgtctaccatacctgtcccaccgatgaacataagcagacagtggtataaattgggacgtgataataattcatcggtaggctcaccaatcaacgcaatttctttaaaatgaaaaagcagtgaactgaacgggggaggttctttttatttcctgtatgaatttattatcagtcttcaaaagattctatagtattacacaaggatacgttcaagcttgtcatgccagtctgcataaatcgaacaagtccttcatagacatgtactaattcatttaaaacatgtgctgaaggggttgatgacatgcgccggatttcatggatgcttgccatggtcatgtgtgtaacgctgctgctggccgggtgcggcaagaagagcgcggacgatgtggttaaagatttgagtgacgtggtgagcgacctgaacagctaccacggtacagctttgatgacgctgcataccggcgacacgccgcaggaatacaaggtggatatttcctaccgcaagccgtcctattaccgaattgccatgacgaacgagaaaaaggatgttacgcaaattgtgcttcgtaatgatgagggtgtatttgtactgacacccagcctgaacaaaagcttccgtttcaaaagcgactggccaaacaatcagggtcaagtatatttatatgaaacgttggttcgcagcattatcggcgatgcctcccgtcagttggctaccgacgataaatcctatgtgtttgatgtggcagcgaattacaacagccatgcgctggtgagacaaaagatatggctgtccaaaaatgactatgcaccgactcaggtacaggtgtctgatgcgaatgccaaggtagttgttgatctgaaattcgatcaatttgcttttgatacgaagtttgacaaagactcttttgatatggagcggaacatggcttcaggtaagacgagtacgggtagcgaaggggcgccatcttctggagcagtggagcccagcggtcagcttgatccttccggtgcgatggatgggacgactggcgtgacgtctggcgaacccggacaagaacagggaacagcaggggatgcagtccagcagccgtcaggggaagcgaaggtggacggtactgccacaaacgatacgtccaaaccggatgcagcagccaacgcagaggcacagcaacaaaccccgggcacatcggatcccgcaaacggaacgtcagcgggaacagatgcggcagaagctgtgatgggtgaattcggcttgatcgaaccgtcctacacgccagccggagtacagatcaaggatacgccggagctggaagataatgatacacatgccgtgatgctgcggtatagtggaacgtataattataccattgtggaggcgcgtccaaaagatcgggcggttgcactggccgcaggtgaactggttgatattggaggaagcttcgccgttctgaccggaagcgaacagcagacgatgacctggatgaatgacggaatcgagttcagaatcaccagtgctgacctgcctgtgagcgaaatgatacaaattgccgcttctatacaggatcaatcgggtaaataaaactttatagacggatgcagacggtctagagtgtaaattactctgctgccgcccgtatccgtcttttgttcattcgcgatctaggatgtgcatcgcttgtaagtcgtgttcattgtagaggatgctggcaaacgccccctgccattgacagccacgtttctgaacattaccattaacctttggaagtaaggtatgtgccacactccgaatggtaaaggttatgttacaggctaacaattgaagaaggtgactggattttgcaagcacaatacagatcgacccgggccgaaataaacctggatctccttggcgccaactatgaagcttttcgcaaggcattgccagcggataagctgatgctggtctgtgtcaaggcaaatgcctacggacacggtgccgtggaaatttcaaaggaattggaacgccttggtgcggattatttgagcgtcgcttttctggatgaagcgttggagcttcgtcatgcgggggttcagctaccaattctagtactcggttatacctcaccggaagctgtacaaacggcttgggagcatgatatctcattgacagtgttcagtgaggaagtgctggagggtatccgcagagtggaccgccaaggaaacgaacgcaagctgaaggtgcacatcaaaatagacagcggcatgggaagactgggtttgttgcctggagaagaggctatggcttttgtccggcaggctaacgaattagagcaagtgctgctggaaggcatgtacacccattttgcccgcgcggatgaagaagacaaaagctatacactgctacaatatgatcggtttcggggcgtggcggaagcgctaagggaacaaggtatcaccattcccattatacatacgggcaacagcgccgccaccattgataccccttctctttcccccaatatggtgcggattggtatcagtatatacggtctgtacccgtctgatgaggttaaccggcaagccattgaactgttgcctgtgttgtcattaaagacggcagtggtttataccaagacgcttcctcccggctggggagttagctatggcacccggtacgtgacctccagtgaagaacggatcggtacactgccaatcggctatgcggatggatactcccgcatgctgagtgggaagatcgaagtgttgatacgcggtcgccgcgtcccggtactcggtacgatttgcatggaccagtgtatggtatccttacaatctttcgcagaagatgcggaagaaatccaaactggcgaagaggttgttctcatcggccagcagtccggcgaaactatcgcggcggatgagctggcatccaagcttggtacgatccactatgaggtaatctgcatgatcgcagacagggtaccgcgtgtatacacacgaggtcatgttcctgttgttcgagtgaactcgcttcttccaacccgctggaattaatttcataacgcaaattaccgaataaaagcaggagttttcgcagaacgtcccgaaatatgtacaaaggaaagaaaagagcgctataactgtcaaaagacgcattaggctccgctgacacttgtatttcggggatcaaacgcctgtacgaaaacgaactgcgtagtttataatggaatgcagcatagatgatatacgaatgtcatatacattctcttgtattccgtttgaataaattaccgggaataacgttataatggtacaatggcgacaaggttttgggggtggaagagaagttggccaatttgcagaacaccaaaagaataatgatcagtttgccagatcatctcttgcaggaagtggacgggatcgtagctatggaaaattccaaccgcagtgaatttatcaggcaggccatgaagctgtatgtaggtgaacgaaaaaaacgttacattcgtgaagctatgcagcgtggatacatggaaatggctaaaattaacttaaccatggcatccgaagcctttcacgcggaggaagatgcaaacagcaccttgggccgtacagttagcggggtgtaatccatattgatcgtaaagcgcggcgacgttttttttgcagacctttcacccgtagtcggttccgagcaaggtggcgtcagacctgtgctgatcattcaaaatgatatcggcaaccggtttagtcctactgtgatcgtagcagccatcaccgcccagattcagaaggcaaagctgcctacacacgtggaaatcgacgcggcgacgcatggctttgatcgtgattccgttgttcttctggagcaaattcggacgatcgacaagcagaggcttaccgacaaaatcacccatttagacgaagaaaccatgcgcaaagtgagcgattcgctacaaatcagtctcggtttgattgatttttagcgtgatggaacgacgagtgaaacgggaaaagggcagcgcttgggcgctgtccttttgcgtgtccaatgaaaaatgcaggtagggcttgctttaacgtcacctgctggcgctttgaatcattttttgtgataatgaaagacatggtgtaaaacaagagctgtgaggaagaagggataggtttgtctaacgaggaaacgaagacggaaatccggcaggagccgaacgaagcagaacgccaagagcggattgtcaaacaagtggcgagagagctgtcgctggcactcaagcaaatccggacaacgatcagtttgttggatgaagggaatacaattccttttatcgcgcgttatcgtaaggaaatgacaggagagctggatgaaaatcagctacgtgaaattgaagatcgtgtggtgtatttgcgtaatctggaggatcgtaaggtagaggtcatccgcattattgatgagcagggcaagctgacggaagacctgcaggctgctatcacctctgcggttaaacttcaggaagtggaggatctgtaccgtccgtatcggcaaaagcgtaaaacccgcgccagtgtagcaaaggaacggggactggagccgctctccatctggatctggagccagccgaagcagggcgatgctttgaaagaagcggaatcctatgtgaatgctgagctgggagttgaaaatcccgaggcggccatccaaggagccttagatattttagctgaaaatatagcggatgatgcggctattcgccaatgggtacgccgatatacgctggaccatggtatgttgacctccgaagcgaaggatgcggagcaagaatccgtgtatgagaactactatagctatcgtgaacttgctaagaaaatgccacctcaccgtattctggcgattaatcgcggagagcgggagggcattcttaaggttggtctggaggtagtgccagattccatttacaattacgtggcaggtcaagtgattaaaggatcatcagtcgtgcaagatctgctccgcagtgtcattgaggatgcgtacaaaagacttattgcgccgtctatcgagcgtgaagtgcgcgctgaaatgacggagaagggcgagcagcaggccatctccatctttgcaggcaacttgcgcagtctgttgctacaggctccgatcaagggccgacgtgtgctcggtgtcgatccggcctatcggacaggctgtaagctggcggttgtcgatgacacaggcaagctgctggaagtggcagtgacgtatccgacaccgccgaacaacaagaagcgcgaggctgctgaaaagttcaagcagctgattgcccaatacgggatcgaattgattgtcattggtaacggaaccgcttcgcgcgagacagagcaattcgtagcggaagtcatcgctgacattggtgacagcagtctagcgtatctgatcgtcaatgaggcgggcgcgagcgtatattctgcctccaagctggcacaggaggaatttcctgatttggacgtggccgagcgcagtgcggcttccatcgcacgtcgtgtgcaggacccgctggctgagttggtcaagattgagccgaaggctattggtgtaggccaataccagcatgatgtgtcgcagaaacatctggatgaaagcttaaaggacgttgtcgaatcagccgttaaccatgtcggtgtggatgtgaacacggcttcctctgcgctgttatcctatgtagcagggatcaatgcgacgattgccaaaaacatcgttaagtaccgtgaggaaaacggaaaattcagcaaccgtcgtcaattgcagaaggtgccgcgtcttggtgcaaaaacctacgagcaatctgtaggctttatccgtataccgggtggagaaaatccgctggaccgtacaccgattcaccctgaatcgtatgctgtcgtagaccgcctgttggcggaactgaacatcagcgctcacgatctgggtactaagactgcaatggaagcactgagggtgtccaacattgacgaactggccgccaagctggaagtcggcgtgccgacactgaaggatattctggacagcctccagcgtccgggccgtgacccacgtgacgagctgccgttgccggtattccgcaaggatgtgctgaagatcgaggatttggcaccgggtatggaacttcagggaaccgtccgcaatgtcattgatttcggcgcgtttgtcgatatcggtattaaaagtgacgggttggttcatatttcacagctgcgcagtggctttgtaaagcatccgatggatgtcgtatctgtcggtgataacgtaacggtgtgggtgttgaatgttgatttgaaaaaaggcagggttggtctgacgatgaaacctcctgcagaggcgcaatcgcaggcataatactttaaataatgctgtacaaccttcttgtgaaggtataacaaaagccggaatctccgaactgtatcggagattccggctttcatttttggatgcctttagcttttacccgttgttggcatcgaactccacgccaggtgctttatgataaaaaaaccaacaatcgttcaacagtttaatttgacgccggtcctttttgtaaaaggcccgcatgagctggttgctgagccattgaggcaagccgatctcctcctctgcgttacatctgtatgtttagcatatggggtgggtacctaaagtgtgcttatgaattgggggttagacttcggtcgttattttataatatgcttgtcagtaaggagcaaaggaggagagaccgttaggatggagtccaagtccctgagcaattcaatgaaccattcaatgagccgttctatgagtaatgaagagcttcaagaatgggtagagcgcatttcgctggagagcttcggcgtgccgtttcgacatcaagccacctttaatgcgcgcttgtcttccacaggtggtaggtattttatgaaaagtcatcatattgaaattaatccacatcaactcgcagcttacggacgttctgaggtggagaaaattattaagcatgagctgtgccattatcatttgcatttgcgcgggatgggctatcagcatcgagatgctgacttcaaagcatggctggcccgtgtaggaggaagcaggcattgtcagactctgccgggaagaacggaacgtaagcctcagccttatcgttacaagctagtatgcgtttcctgtcagcaggagtatatgcgcaagcgtaagatgaatcctcagcggtatcgctgtgggaaatgtggagggaagcttcgcctgttggcacttgacggcaccccctgaatcatggtaaattaaccatactgtaagataatttacagtaatgttccctgatagctcagttggtagagcactcgactgttaatcgagttgtcacaggttcgagtcctgttcggggagccatggagaggtacccaagtggctataaggggaccctctgctaaggggttaggctgcgaaagcggtgcgagggttcgaatccctctctctccgttggtattttaagtagaaaaaggacgctcgtatgcattgtaatgatgcttgcgagcgtccttttcgtctatatctgctttgagaataacggtggactgaaatcgtttaaatggagaggggacgtgctgcgtacagcttgaagcggcgttagcctgtcttgtacgcagccaatgacgtctatttcacggtgtcagcctcgactgtcttgagtatgttcaacagagcatgagcgacgccatcttccgcattagtcagagtcacttgggagcagacggccttgatgtcgtcttttgcattgcccatggcaatgcctgttcctgccattgttagcatggagatatcattgtagctgtccccaatcgctacggcttcctgcatgggaatgttcagatgattcgccaaataacgcaatgcattgcctttagacgcatccctatgctcgacttcaaagttacggtctgaagagatgaccatgttcaggccctgaaaacctcggtaacgctcacgaccccgctccaatttggcttgatcaaaggagaaacagagcacgttataaatctctacatccagtggaatgtcctcatatgaagcgatgcgggtatgtccggtctgttcatattgtttttcagctgcatgtaataaagtatccagcgagatatccgggttggagctcagcaagcggtccatttcaacagcaagcagctgatgtccgttttgtggagaataaatagcgcggtctgtcatgacctcatagtaaaagtcgttgtcatgcagccagctcagcacttcaaacgtttcactgcggcccataggagtagaggttaactgacgacgatgcacatcgtgtacggttgcgccgtttgctccaatgacgggagttacaagctctgcttcctctagcttcgtccaggcgtcataagcggctctaccagtggcgattgtcacctgaacgccttgctgctgtgcttggcgtatagcctccgcgtttactttgcttatttttccttcctcgttcagcagtgttccatccatatcaatcgcaaacagtttcatttctctccaactcctgtctttcgatatctctgtgataaatcttgagttctagctaagcagtttcatattttatgagggtacaacaacttcaacatcataatgttgcaaaatttccagcatcgctggttctggcaatctgtcggtaatcacgatattaacttcagacagatcggcaaaacgatatggaaaattgattccgaatttcgaatggtccgcaaggatgatcacctgatctgcctgcttcatcatctgatgcttcagcataccgtcttcttcatgaattaggcttagtccgtgggcagatataccaccaatcccgataaaggctttgtctacaaaatagtgagacaaagtggcgatcacggaggagccatatacatatcggtgttctttttgcaggcggcctcccaacagatgtatggagacaccgtcttttcgagatagcacgtcagcctgattgattgaattggtgatgaccgaacattcctgcacattcagtctttctgcacacgcctgtacggtggtagaggaatccaatataatacgatccttatctcgtaccatgctggcagccagctgtccgatcacttgtttctcctcggatacagtaagcagtctttcgttataatttccaattggatcgtgatgaagtgtagggagaagagcgccaccgcgggtgcgaataattttttgatgttcttcaagttttacgaggtctcgacgggccgtatctcgtgaaacattaaaaaattcacaaatatcatccaccgaaatacgtttatgaagctgtaagtaatcaacgatttttaacattcgttcttcctgatacatagaaagctcctctgatatataattatttcggtatcttgtaagtgattataagtaaatacaagtgatattgcaatcatttatcgctattttcaggattttaatgatttgatataagggattgtaagttaatatgcattttgtacttataaaaactgctttttttaaaattttagaaataagtattgccattcgttattctatttgatatactctttcttgtcgccaagttggcgcataataataaggcccgttggtcaaggggttaagacacctccctttcacggaggtaacaggggttcgaatcccctacgggtcattgttgtctttatagactacatgttgcatgcttaagggaaattcctgaggtctggtctaatggcggacagcttggatgaacagcatgagccattagctcagttggtagagcacctgacttttaatcagggtgtcgaaggttcgagtccttcatggctcaccatttatattttgttatgcggtcgtggtggaatggcagacacgctatcttgagggggtagtgagcgtacgctcgtggaggttcgagtcctctcgaccgcatcaatggaataaacggaaaagtctctcgcggtagaggcttttttttatttgtgtagtgatgtaataaagtaatgattatgatgaaataatgattccatagtataatataatgccataatgttatagaatgataagtataaacttgtgaagtgacggtgaaaaatatggacactcaactgttaggaaatatatcagaaaatattttgggcttgtttccgattgtgaagaagaaatttttcacctacggtccgctcgatttcccattacatttgtcgcctaataactttcaggtattactgcttctgcgtgaggtgcgcttgtctacggtatctgatttatccaaacagctcaatgtctcacgtccgaacatgactcctcttctggacaaactggtggagcatgggttggctgaccgccagtcgtgtgattcggatcgcagagtcgtgaatgtggcgattacacaagaaggcgatgctttttgtgaacaggtatttcataccttctccaataaaattcaagaaagactggtgtatctgccagaagaagatttattgcatctgagtgaaactttgaatgaattgaagcatatcttacttaaaatcgacaacgctgctacgtgattggcgtaagtgaactggcttaaagaccgccctttcttcggaaaacaggcggtttttgttgcgtgttgtggtataatggaaaccaacatacataattcggtaattttagcatacgtgatctttgaaatgggaacagagaacatgatatcgttatttgagagcctgctagggaggaaggaacttctatgcaatctatttaccatcgcattgaggaactcatcaaggaacggggaatgacgaaaaaggcgttctgccagcagttaggcattagtacagggaacttcggggattggaaaagaggaaaaacgacgccgggcacgaataaactcattgaaatcgcttctttttttgatgccagtctggattggattatgctgggtcgagatgtacagggtgaggtgctgaaggagtcgcaagacccttatttttttgacgcttcagggcaactgaattgccagggggaaccgcttagtgagacggaaagaaattttttacttgagtatattgaatttacccgctttcgtaaagagaaaaaccagcgcaattctactatggggtaatggttgcttaggatttgatgaggattactaatgagtaaggctgaaaaatgaaaattaattcagaaaaagttactgtgtcggaggggaaacattttgggagatcaaactatttatcagcggattgaagctttgattaaggatcgcggaatgaccaagaaggcattttgtgaaaaacttaaaatcagttcagggaatctcggtgattggagaagaggtaaaacaacgccgggtaccgcccatttgattcagatttcggacttttttaatgtatcgcttgattggttaatgaaaggaattaagccaggggaaggcgtacttcaggagcagaaggctgcttatttttttggagtgatggggccactgaattgccaggcagaagatcttgagacggaagaacagaattttattttagaatatgttgaatttgcgaaataccgtaagcaaaaaagtgacaaggataaaacaaagccggaataattttttggctaaagatcgtctgggttgaaaacccgtaaacgaactggaggggttcgctttacgggtttatttggttttttggtgatatggaatgacctatatgtaactggaatgcttgttggatttagagtggcggtgcctccttataatcgttatcgtcgatgttcagaattgcagcaacttgttttctgtacctttgtgctttgcgggtgccgtgaatcagattggacaagcgtgaaggcggaatgttgtgtgtctcacaaaatgttttctgatccagtcgaagttcgacaagccgttgtttgatggcccacccgaaggaggtgacaggcattttgttgttcaagagaaatcgccccttacggattcttgcggaataattggtgtgttataataatcatcagtaaacatgttagaattaaccatctaaaactatgatacacttttatacgtgtttttacaatcgtaaatacgttattttgttgaattaattacttaattaagtgctaggtggttctgataacccgtctagagtctactaatagtgtgaatttcgattatatgtggataaaaaacactctgccacctgaggaaagggacagagtgtttttggtgttgctgccacattagcgaaacgacgcatcagggggatgctggaaggcgtttgaatagacctgagggggaaaacagtctaggctcatccaattggctattatggctcatataaagcggtagagtgatgtaggagttgtaccaatgtctgtgaagaaggcgacgctgaaatgcagttggctcaggtttgttaagcttcttccatgcggagagcagctcgctggtcatacgctccataaaagggttcttttcctcataaggaggattgagtagtttgaaggcatcttccacgcagaaggacaccgctgcgccaagatagccgtgaacggtctgttctacatcgtttccgaggaggaagttaatccaggtgtgaacggtagcgagtgtgccaattgcattgtattgaatgagtatggattccaactggtcaaattcaagccaaggataaagagccttagcgagcttaagtagacgctgaccggatagacgcaactccttcacatgctgcaaggagggacgttgggtatgcagcatcttatcaataagagcgattcgccaactgtcattctgctggatggcgacatacagactgttgatagccatgccgtcaacggttgtaaattgaggatacaaatcatccagcatgtaatgttccaggtcttgtagactgttcaaatgtccgttgcggaatagtttctccagtccgttaaaacgggtgaagccaccaacaggtagggaagggtccaacaataatgcatagttcagcaagcggttgcctttatgcagggcggttcgcctcctcgaagtgaatcattatgttatattattttactctttacttagggataacgaaaaaattcgaaatatatgtaatatatatttacattttagcggcatttgtgtcaaattaaatattattatcgctcatatatgttatataaaataacatataaaataattattatatttgtgtttacaaatagtcgatgagagagtataataaatctgttgcctcaatacattatgatttgcggtcgtggtggaatggcagacacgctatcttgagggggtagtgggcgtacgcccgtggaggttcgagtcctctcgaccgcattatatgcaaaacctagttaaaaaagcatcctgacacggtttacgtgaagggatgctttttttgttttaataactgtgataaagaagaatatcagttttgctgcaaaagcttctctatatctcccgccaacttatctggagtggtttgcggtgcatagcgcttaaatacgttaccttctcgtgtaattaagaatttagtaaaattccatttgatcgctttggaccctagtacccccggagctgtttgggtcaggaagcgaaataaggggtgcgcttgatcgccattgacatctgtcttggcgaacatcggaaaggtaacaccataattgatctggcaaaactcggaaatctcctcgctggaacctggctcttgtttggcgaattggttgctgggaaatcccaaaatttcgagccccagttcatggtactggtcatatagctcttgtaacgctttgtattggggggttaacccgcatttactggctgtgttcacaataagcagaacattccctttatatgtggataacggaattggtttcccttgcagggtttgcgcatcatattcataaacggtcatagtatctctccttattcaatattcagcaattaaattgtaagcaattcaaagtaaggttgcaagtctggaaaagctgtattaagccttctgccgctgtaaaatcgtattttgttcaaaacagtaaatcgcaccgcaaatggagcgaattaaggtgtttcttcttataaaagcgggttcaatcggtgcttagctggtacatatagcgtattttcttctctttttacaaaaaaaggccaaaaacgctctaccctacgccaatattgacatgcttgtcattttcaaaaagggatgaaaaacagagattgaatgagctgtgagaagcatagttgcattgtaagcgttattattaatcttctatgctataaaggccgatttataaccccgcagttgagctttacagtcttccatgcgcgggtgtatgattcaagacgtaatttcaaattaacttgaatgaagcaacaacgaaatgtctatagcgctgaattttgcagttgcaaaagcgggggaaccaatcgagactgtacggcttgccgtgtgtctcatggggtgaattttccggtcaagtgccagaaatagggcgactctcacgtccgaatccgacagctaacctcgtaagcgtacagggagaggcaacaaaccgccgtgtgcagccatggtttattttatcatggatatgtcagaagccggaggaaagcctttttccttcggcttctttttgttgtctttttataccgggagaggagctactgatggaaggtcggttaattattgtcactgcaccgaatgaagcgggcagaagttttgtgaaattgcttatttacaaaaaattggcgtttgcagttctgacgaatagcgcccaggaggaacgacagctcaaaaaaatgggtgtggagcacattgtccgcatcaataccatgcaagcgggaaaatggaattttccaaaaaaagaaattggtagtgtgtatttgtttgagaacagcttgaatctgacttgccgtttcctgcaaatatgtcggccgctaacatcggaatcgatctatgttattacgcacggctgtaatccacaaggaatttatcgaggattgggagcggaccatgtgatctacacattgaacggagaggtgggttttctgctgaacggataagcacttataacatagttgttttatgattttatgatgaaataggaatggcgatctgaggaccgatacggagggtataaacatgatggatatatacatgctgctcgtcatggctgtgagttatggagtgatactgctgtttgtacgctggtgtgatgcgcagacctctaaaggaggacgaagaggatgatcgttatacttgggcttacggctattgtgtttatgtatttaatctacgcacttctgaaccctgaaaagttctagtcagctataggggatagagcgggcgggaacaacagatcatgaatattaagcatcataggtagcaggttttcgcaaacgtgtgcacacgtttggtgctctgaagcaggtctgttgttccaaacgtaggagcattttggaggaggaatagaggatggagctgcttcaaattggaattgtgatcgtcatattgttgctcttggtaaagccagtgggcacctatatgtatcatgtattctcgaatgaacccaatcggacggatcggatttttggcggaacagaaaagctgatttataagatagtaggattgaagaagctggagagcatgcgttggactacgtatgttatgagtttcattgcaacgaatgtcgtgcttgtggcgatcagctacttgctgttgcgattacagggaatgcttcccggtaatccggcgggaaacagtaatatggaagcatcactagcttttaatacggtaatcagctttatgacgaatacgaatctccaacattatagtggagaaagcgggcttacgtatctgacacagatggcgttcgtcacgatgatgatgttcacttcggctgcttccggttttgcggttgctgcggcttttatgagaggattgacgcggcgcggtgaaggaatgggcaatttctttcaagattttattaaagccatcataagaattttcctgccgctggcctttgtgcttacgctggtgctggttggattgaaggtaccccagacgctacagcctacggcggatcttacgacgctgagcggaacacagcagcagatttctatgggacccattgcttctctggagtccatcaagcatttggggacaaatgggggcggttatgcgggagctaactctgcgcatccttttgaaaatccaagtccttggacgaacgtgctggaaattttggcaatgtgggtaatgccggcttcgttgccgtatacctttggattgtttgcccgtaatcgtaagcagggctggattatttttagctccatgatggtattgtttcttatttttctatccattacgtacgtgtctgaaaagacaggtaatccgttaatccagacactgggtgtggatgcttctcagggaagcatggaagggaaagaggttcgtttcggcattggacaatcggctttattcactgcggtcacaacagcggcaacgacaggttcggtcaataatatgcacgatacactaaccccactgggtggcatggctgctttgggagaaatgatgctaaacgtcatttttggcggcaagggtgtcggactgatgaatatgctgatgtatgcgattctgggtgtgtttatatgcggactgatggtcgggagaactccggaatttatgggaaggaaaattgaaggtaaggaaatgaagctgatcgcgattgccattttggtacatccgtttctcattctcgccccaactgcacttgcatttatgagtcattggggatacgatgcggtcactaaccctggctatcacgggttgactcaggtgctctatgaatatgcgtcatctgccgcaaataacggttcgggatttgaaggtctttcggataacaacgtattttggaacatgacaacggggatggttatgttcttcggacgatatgtatctatgattgcattgttggctgtggcggcttcgttgaatgccaaagcaccgactccggtgacgacggggacactgcgcacggacaacaagttatttggagccattctgatcggggtcgtgctgctgattggtgcgttgacctttttacccgtcatcgtattgggacctgttgctgaatttttgaccatgtgaagaagaaaatgagaatggatgaacggggtgtttgatcatgaaggaacaacgcaaacacatgctggacagaggcatcttgaagcatgcgatcaaggatagctttataaagttaaatccgatgattatgatgaaaaatcctgtcatgttcgtcgtggagatcggtacattggtcgtgctgctcatgttactgtttcccggttattttggaactggcaaggaaatgggctttaacctggccgtgtttgttattctgttgtttacgttgctttttgctaattttgccgaagcactcgcggaggggcggggtaaggcacaagctgcctctttaaaaaaatccaagcaggatacacaagctaacaagctcatcggaaatgacattcaggtggttagctcaaccgaattgcgtaagggggacgtggttattgtctcccagggcgaaatgattccaagcgatggtgaggtcattgaaggtctggcttcggtggatgaatctgcaattacgggagaatcggctccggtcatcaaggaatcgggtggtgatttttgctcggtaaccggcgggacgcgagtagtcagtgaccggattaaggtgcgaattacgacagagccaggcgagacatttattgataaaatgatttcgctcgtggaaggcgcacagcggcaaaagacgccgaatgagattgcactgaacactttgctgattagcttgacgattatttttctaattgtggtggttacgctagcgccgattgcccgtcattttaacattgatttgcctgttcctgtgctgatttcgttgctagtctgtctgattccaaccacgattggaggactgctgtcagctatcgggattgctggtatggaccgggtcacccagtttaacgtactggccatgtcaggcaaggcggtagaagcttctggggatatcaacacgatgattctggataaaacaggtacaatcaccttcggtaaccgaatggcgagtgaattcgtgcctgtggagggcgtggagaaggcagagttagtgaagtgggcagcgattagctctatgaaggatgagacgccagagggccgctcggttctcgaattgatgcgcaaacaggagcatacgttggatgcatccttggcagcaggtggaacctttatcgaattcaaggcggagacacggatgagtggtctggatctgaccgatggacgaaaggtacgcaagggcgcggtggattctgttcggcaatggattgtatcgcaaaacggcagtattccagccgatctggaggaaaaagccaatcaggtagcctctgaaggaggtacaccgctggcagtcgcgctggatgatcagatatacggcattatttatttgaaggatacagtgaagccaggtatgaaggaacggtttgatcagctccgggaaatgggtatccgtacgatcatgtgtaccggagataatccgctgacagcagctacaattgcacgagaagcgggtgtggacgactttgtagctgagagcaagccggaggacaaaatcgcggttatccgacgtgagcaggaacagggaaagctggttgccatgaccggagacggcacgaatgatgcacctgcactggcgcaagcggatgtcggtctggccatgaatagcggcacagtcgcggccaaagaagcagctaatatggtggacctggattccgatccgtccaaaattattgaggtggttgcgatcggcaagcagctgcttatgacgcgcggagcattgacaacgttcagcattgcgaacgatgttgccaaatattttgccatcatcccggcgatgttcatgctggccattccacaaatgggcgctttgaacgtcatggggcttggctccccgctgtccgctattttgtcggcgctgatctttaacgcggttattattccgcttctgattccgctggccatgaagggcgtgaagtataagccgctgagctcggatcgcctgctgggacggaatttgctgatttacggtctgggcggtatggtcgtaccgtttgtcggtattaaggccattgatttgctggtgcatttgtggatttagtgcagaaagggtgaacgacatgagtggtttttatcggatgatgtctggacgcagatttgctgcgcacgaaaaagccgaatctggcgggcaaggtcataacaaacatacagggaccgggacagtgtcggaaggacaaccggagagacaagagatgcgaggaagtacagttattggagtagctttgcgaacttcagtgctgatgattctcttgtgcggtttggcatatccgctagtcagtacaggagtagcgcaggttctgtttccgcagcaagcaaacggaagtatgctccgtgacgcagagggacgggtggtcggctccgaactgattgggcagtcctttgccgattcggcatttttccaaggtcgggtatcgagcgttgattacaatggggctggttcaggctcaagcaactacgcgccgtcgaatccggccttgatacaacgagtcaaggactcaattgcggattggcagaagcataacccggatgtacccgtcagtcaggttccggtggacctgattacaaactccggctccggtctggacccgcacatctcgccacaggcggcacgggtgcaaattccgcgcattagcggcttgacgggtatcccgcaggatcaactgagagcactggtgcaggagcagacagaaggccgcagcgccggggtattcggcgagccgcgtgtgaacgtgctcaagctgaatctcgcgcttgaggcgcaaataaaggtggagcctgccaagcgttgagtattctttatgtatacaggataaataaaataggatgaacaaaaaaaggtatctcgctgccatggggctagtgagatacctatttaatatattcatattttggctaccgattaacctgaaatcgtttggatgatgagcactacattcaagatgataatgacagcggtcacgatccaggttaatactttttgccacattttatttgcgaattcacccataatctttttgtcgctggtaaagagcagtaatggaatgatggcaaagggaagctggatggacaggatgacctggctcagcacaagtagttcctccgcacctttttcacctgcgatagcagtgacgatgaccgctggaatgatcgcgatgaggcgggtcaccagacgacgcaaccaaggtgaaagacgaagattcaaaaagccctccatcacgatttgtccagctaaagtgcctgtaacggttgaattttgacctgaggcgagtaacgcaaccccaaatagtatgcttgccagcgtggttcccagtagtggcgaaagcagataataggcatcactaatttcggctacatctgttcttcctgccgtatggaatacagcagctgccacgatcaagatggccgcattaataaataaagcgaacatcagcgctatactggaatcccaagttgcaaatgtaatagcttcccgtttacctgctgaagtctgctcaaatttgcgagtttgtacaatagaagaatgcagatacaggttatgcggcattacagtagcacccataataccgatggcaatatacagcatgcttggattcgtcaaaatttgcgagtctggtacaaagccgcccaatacgccgccccattccggttgtgccaaaatgagattaatcccaaaacagccggcaatcgtcgccatcagtacaatgacaagtgtttccaatgcccgaaaacctttgttttgcagcagtaaaataagcatgacgtcaaatgcggtaatgatgactccgtatagtaacggtagaccaaacagcaacttcagcgcaatggctgaaccgatgacctcggccaaatccatggctgcaatagcaatttcgcacaagagccataagccgatggcgacaggacgactgtaagcatcacggcacatttgagccaagtctttacctgtggcaatgccaagcttgccagataaggcttgtagcaggatggccatcaggttggagattagaatgacactaagtaacgtgtagccgaatttcgatccgccagcgatgtctgtggcccagttgccggggtccatatagccgactgcgaccatatagccgggtccagcaaaggcaagaaacttccgaaaccaggttccgtctttcgggacgctcaaggaacgattcacttccgacagtgaagcgatttccgcgaagttaccctttgtatttttcatacgcttcaccttctttattgatgttgaaatatattattagtgacataacgattgtgttatccctattgtacacttacaatagtttttgtctagtgcaacttttgtgtggtcaagcaagttaatcgtatttttgaagcaatatgggtatcgtataaagccgaacactagaaaaaaccaagctatatcgctctgaggggagcagcttggtcgttttggatttttttaaattgttgtccatcttccgggtgaacgctgctccatattttatcaatttccttgtagttatccggactgaaacgataaatagcccggtgaatcggaagcattttggtcatttctacgcctgtaagcttttccaacgctttggcataggccatcacatggactccaccccgcaccaacaagtagcctacgatctcgcgtacgacagggttgtcagtcatggaagtctgagcagatacaataaaatgatgcgagtgagccttcaagacatatgttgacggcccatcaagctaggggcttataacatatagtgtaaacaaggtgaggtggaactaaacggtaaatgtacaggttaacaaccttatttcaaatgattcattttgtgtagttcgtttaaagtacatacgagaaggaaatcatgtattaacatgacgatagattcctgcggaaaacatatgatatagagaaggagagatgaaatcatggaagcattatacacagcatcagcaacggtacatggtggaagagacggttcagtcgcttcatccgatggagttttgaagcataagctcagcacgccgaaggaactgggtggcgcaggcggagaagctacgaatccggagcaattgtttgcggcaggctatggtgcctgctatgagagcgcattggctaatgtggcccggaaggctaaggtgaaggtagacaatgttgaggtcaccagccacgtatctatcggcaaggacccaagcgatggcggcttccagctggcggtacgtctggatgtgaaaatacccggtattgaacgcgcccaggccgaagatctggcacgccaagcgcatgatttttgtccgtattccaaagcaacacgcggtaacattgatgtcgagcttaatgtcatttgactgcatttctataacttttacactctggccgccgatttatcggtggcttttgcacatagatcttgattcgttgagatttgcgaccatttgacatcatcgccaaaattcattaagatggcttaggtgattctggtcatcaggtacgaaacaaatttgaaaaatacgggtgatatgatgtcttacagaccgaatattgttaatttcacgctggctggcagcaacgaaaaagaagggctttatgagtttaaaatgagtttggccgatggaacggagtgccgcgttttttctcaacgtaatccggagtggaccttgacgaatattagtcgactgctaacgacgccttgcccggtatgccataaggattttatctgcaagtgtatggataagttccatgaggagtttttagagcaaattaatacgaaacagctgtttgagaaagcattgagctagtttttcgaacaggtaaagactatacatttctaaacaagcgtcggatactttcggcgtttttttgtttatattcatatggttgcgttgctggtattcatgccgttgattttcttggaggtgaaatgcatttatgaaccagactgatcatgctcattcagatcattccattgtgttggtagatggggtatgccacttttgtcagggagcggcccgctttattatcaagcgtgaccccaagggaacattttattttggttccctgcaatcggaggcaggacaagaactattacgtgcaggaggactatctacagatcagctggatacgttcgtgctgattgaagacggtacgtattatacaaggtccaccgcggctttgcgaattgccaaacgtcttcgttttccatacccgctggcctatgtgttcatcctggttccccgctttgtgcgcaacgctgtctataactgggtggcgcataaccgatatcgttggtttggcaaggatgaagaggatcaatgtcagatccccccaccagaaatcagacaacgatttttttagttgcttttttaagtttcttttttggagcgatgtctacgaattagtaagatcacagcgatcacgattagtatcaggctcgtaacagctacatacacgatatgtcgtacattgggtacgttaacagacaattttagctcgttagattccaaaggagcaatgtcccaatacagtgtttttccgtcttccgacacacggtccgcattattggtagcaggttggatgggtaaggataggctgaagttaagatccagctgccgctccagtaatttgcgcgcaaacacattcatttgctcaaatttatcactcagtccttgagcttcttcaggaagcatccgtggtagatcgagcttcatggtaagatcaatattcgttgtgaaaaaatgttggctcacagcgcgctttatttctaatccctcaggtagatttaatccctgactgggattttttttgtttgtgctccaatctccttgataatgccccttgatttgatatccctttcttccctgttcagctagcggctgtacatctacattgttgctttgaatacgcttgactaatcgatctagcagcccgggattgtccaacatcatcagtgtctggttgtttacactgaacgttgcatccagatctacactttgatcgagatgaacatctacatggatgtcacctcgagcacaggaagttagggcaagcagacagcacaccagcataaaaataagcagtatttttcgtatccgaacttgccgacgtttgttccgataagggctgtatcctgttggctccatgacctgcacctctttatatgtattctttggtttaacgattggatatcttctatatattacacattgggagaacgaaaatcgaacggtataacgaaatacataagaattatattttttaaaaatgtttccctaggtaaaaactttagtgtatactctaaaatatagtattgataaaaaataattgaatcaaggaaatagtttgtcccaaaacgaagttcaaaggaggattttaaaacatgaacaagcagtttaagaaggctttgccgcgatgggtaacgacagttggagtattgtctctagctctggttttagcgactgcatgtaccgatgctaagaagaaggagcagggaactgcgagagaatcaggacaaaaaataaaggctacggctaccatcggtatgatctctgacattgtcggcaaggtcggcggtaatcatgtagaggtcacgggaattatgaagtcaggcgttgacccgcatttgtacaaggcttctcagggagatatgcgcaagctggatcaggccgacgttattttttataacgggttgcatctggaaggaaaaatgcaggacattctggagaagatcagcaagcaaaaaaccgtcatacccgtgtccaaaaacatcgcacaggatcagttgcgtgcaggtagcccggaaatgggatctgagcatgatccgcatatctggtttaacgtacagaattggatgtctgcggtagaaaccgtcagagatgaattgtcggcgctagacgctgttcatgcggaggaatataaggccaacgcagaagcctatcttactgagctgcgagagctggatgattacacgagagagcagattgccagtataccggaagcccagcgcgtgcttgtcacggcacatgatgctttcggctatttcggagatgcctaccacattcaagtgagaggacttcaaggtatgagcacagaatcagaagcgggttctcaagatgtgaccaagctgcgagattatctggtcgaacataaaatcaaggctatattcgtagaatctagtgttccgagaaaggccatagatgcggttattcagggggccgctcagcaaggtcataccattaaggttggtggcgagctgtattcggatgccatgggtgaagaaggcacagaagatggcacatatattggaatggtcaagcataacgttaatacgattgttaaagctcttaaataaggaggcaaagatacatggggcattcaccacttgtcgttcgtgatttatcggtagcttatcaaaaaaagcccgttttgttcgatgtttcctttgaggtgccggaaggcaagctgattggtattatcggcccgaacggggctgggaaatctacgttgatcaaggcagcgcttggactgattccaaagcttaggggcgaggtgctggtctacggcaagccctataagcaacagctgctcaaggttggctatgtaccacagcgggagtcggtggattgggattttccgacgaacgcattggatgtggttatgatgggacggtatggcagattgggctggtttaaacgtccgggtgcagcagatcgtcaggctgcgatggagagtttggacaaggttggaatgagcaaatatgcagacaggcagattagtcaattgtctggcggtcagcaacaacgtgtttttttagccagagcactcgcgcaggatgctcagctttattttatggatgaaccgtttgtcggtgtggacgctgcaacagaaaaagccattatttcgctgctcaacgatctgaaacagcagggtaaaaccgtgcttgtcgttcatcatgatttatctacagtcacggattattttgatcaggttatactgttgaacgggcatcttatggcgtttggagagacgacagatatttttaccgaggaaaatctgcagcgtacgtatggcgggcgtctgagtatactcaaaacaagcccggattccggtacgatactcggagtgaggtgaacagtatgacaagcttggcaacgcttttgactgacccgaatatgcagtggattttgctgggctgcattttgctcggtttaagtagcggagtgattggaagttttatgtatttgcgcaagcagtcgctcatgggagatgctttggcacatgcagctttgccgggggtatgtgtggcttttatgatcacaggtacaaaatccgtgtttggatttatgattggggccgccattgcagggattgttgcgacctttgccatcagtgcattaacccggtattcacgaattaaaagcgattccgcgattgcagcggtgctgtcggtattttttggcttcggcattatgttgttgaccgaaattcagcatagtggcgcaggcaaccaaagcggattggataaatttctatttggtcaagctgcggcaatggtattgtctgatgtctatacgatggcggtaatttcggtggtactcatcggaatatgtatattatttttcaaggaatttaagttgctcagctttgatcccggctttgcccgcggacttggttatccggcagggttgctggataagttgttgatgctaatgattgtcattgcggtggttgctggcattcaggccgtgggagtcattatgatggctgccctgctgattaccccggccgtgtcggcaagatactggacagagaagctgggtgtcatggtgtgcctatcaggcttgtttggtgctatagcgggccttggtggaacgctcattagctctctggggcaaaatctgcctacaggaccgttatgtgtgttgtgtgcgactgtggtgtttggaatgagcttgatttttgctccgcagcgcgggatgatctccaaggctatcgttcggttgaacgccagaaaaaatctggagcagacagtcagaacacagccaagggaggagcgtgccctatgagttcattttatgtaattttgacgggaatgttagtggcagggggatgtagtatcgttgggtgctttctcgtgcttcgaaaaatggctatgatcggtgatgcaatcagtcatgcggtattgccggggattgtcattgcctttctcatcagcggatcgagggattcggtgtggatgatgtttggtgcggctgtgctgggtcttctaacggtgtacctaattcagctattccaacaaagcggtttgcaaagtgatgctgccattggcgtggtgtttacgacattgtttgctatcggtgttttgctggtcagcgtgtttgcttccaatgtccatctggatatggatcacgttttatatggggaaattgcttatgtgccgtggaatacgttcgagattgccggcttcgatgtcggtccgagggctgtgtggattacgggcgcgatgtttttgatcaatttgctcgtaataggaggcttttttaagcaatttaaaattacttcctttgatcccgcgttagcagcttcgttgggcattccagttgttttttttcattatctgctgatgagcctcgtctcgctaacgacggtggcgtcatttgagagcgtgggcgcaattctggtggttggcatgctcgttgtgccgccgcttaccgcttatttgctgacggagaagttgtcccgtatgattgtatacagcgtcggatttggagccatcagttcggtcgcaggcttttacacagcaagtgtattggatgcttctattgctgcatgtatgctatgtgtatcgggtgtgttgctgcttttggcttttctcttttccccgtctcacggtgtgatatggcaaaagttatttcaacaacgggggatcgttggcgaagatagcaagtgattgtaggaagtgatcccatatgagttacccaaaatagcgtgtattcaggcataagagacctgaatgcacgtttttttgcgcttatactgccctgcgcggctttttttggagcaagcttgattgatcatcttgaattgattgggacacgggagtacattcattacaaccatataagaatgaacggttacgctgggggaggaacgaaagtggagagcttcaaacgtaaatcaccagaggaaatactggattcgattaacaaactgcatcgaggcagactcaaaatttacatgggggcggtcagtggctcgggcaagacgtatcatatgttgcaggagggacaatcgttgcagcatgaaggtattgatgttgtgatttgtgcggtctcaaccatgcagcggcctgtgaccgtcgaacaggtcggcacgctggagcgcgtgcctagtattcattggataaaagatggtgaggagcaaaaggatctgaatgtggaagctttggtggcacgaaatcccgaggtggtactggtggatcatttggcacatcataaccggaaagatgcttcatttccaacacggctggaggatattcggtatttgctggagcagggaattagcgtcattacgacggttaatgtttatgaactcgaaggaattacggagtgggtatatcagctaacaggctttgaagcggaatatacggttccagttgatacactggaactggcggatgaaattcgtctgattgatgccaccccggagatgattttggaacggctagcgaaaggctacatgcatacgcccaatcctgagatgtttcaccggggaaatctcggtaaattgcgtgagcttgctctgcgattggtagcagaggatgtgaatgattcgctggaacgacaccgggaggagttaggcttgcacggggcgtcaggagcggcagagcgtattttggtacctgttcaatatcattggaatgggtctatttatgtacgtaggggagaacaggtcgccaagcggttgggtggagatatgctagtggtctcctttgtcagctcgaagcgcaggctgtccaaggaatcagcagccttcaagcgttcgattgagcagttggctgacaagatcggatcaacatttgaagaaatcccgcttttttcccgcagaaggttgcctcgtcaactgattcattatgcggtgacgcacaatgttacccgaattgttatggggcattctcggcagactccgtggcaggagttgatgaaaggatcgctggtgaacgggattttaaaacgaatgaaaaatatggacttgctgctgattgcggaccgagccgagcaggagggtgagcggatcttgccaacgatgagacaggaagagggagataatgatccgtatcatcgtttgagtgttgaggaagcacaggctgaggcagccaaaatcctgcggggcaagctcaaggtatacattggcgctgctccgggggtcggcaaaacatacacgatgctgagagaggggaatgatctgctggaaagcgggatcgatgtagttatcggactgctggaaacacatggaagagcagaaacattggcacaagtaggctctctggagatgattccccgtcagtccattgagcgtcatggcgcacatttggaagaaatggacaccgaagccattctcaggcgtaatcccgaggtggtgcttattgatgagctggcacataccaacgtgcccggaagtatgagatctaagcgctatgaggatgtgcttaccattttggaacaaggtatttctgtgatatccacaatgaatgtacagcatctggagagcttgaatgatgcggtggaacagattactggtatacgagtgagggagactgttcccgaccatatgatgcgtctggccgatgaggtacagcttgtggatgtggctcctaaatcgttgcagcagcgtatgcgtgaaggcaaaatatacgatcatgcgaaggtggaacaggcacttagccacttttttaaactgggcaatctgattgcgctgcgtgaacttgctttgcgggaattggcagatgacgtagatgagcggctggaatcctgggatcgacacgaatcacttcggggaccgtggcgcagggaggaagtgatcttcgtaggcgtgacgctaagtgaaaatgctgaaaggttgattcgccgcggttttcgtatcgcctttcgtctgaaggctgtgtggattgtgacttatgctcatgtcggtgagcgtatacctgagagactgaaccctcgtctggaacaactaaagttgctgacccaccgactaggggggacctttgagatacggcttgtttccagccgacgcgagattgccgacattctgattgctccggtggaaggatattcaggtacacagctcatcgtggggcagtcttcccgaagtagccgttggggtaagtctgcggttgtgccaaggattctccgtcaagcacgtcatatggatgttctcattgtggcggattatgatccggatattaagctggaggtagatcattaattagcccagtaaattcataaatagtcatatgctggttaccgatggttcgctgcttccatagtatattctatctcaaagaaatggaggcgaatttgaatgtataaacatcgtaagcatgattgtcattttccaaagccaaaaaaacgtgtctttaagaagatcattaaggtgactgtcattaagtttaaacctaaatttaaacgtgatcactggaaacatgaagattttgataagaaatgtcattgccggaaacgtcgccatcatcgccatcatgactgtcatcgtcgtcaccacaaattctactaagatgaagatagtaggaggcggggctagactgcccgccttctcctagtacgaggattttggaagatacctgcacaaaaaatacttgctctaatataagcgctatgctattctaccagtaaatagattgcacgtgacggaagcaccgttcaccaaccgtatgtacttacggatggatgaacggtgcttttttgcgttgttgtgttagggaaagggatgagcgttatggttccagtgaaagtggtattggctgtagaaggccgggattatattgagccgctgctgaattatgttcacggaagcgagtacgccagaaggctgagaataacggctttttcgcaaccggaggcatttcatcaatacatgatggaaaccagcggaatgaaaagaccggacgtggtggttggtgaagcggcttttttgaatctatggacagatagggaagctgctgatattccttgtttggtattgcatgagggagaacaagtgagcgaatatggacagcctttattaaaatatcagcccttatctgagctggtcggttttattttggaaacggcgagacagaagtcgaacggtcggaaatgtgtaaacagccgggaaggtggactgattatcggcatggtagcagcttccggcggactgggcaagacaacggccgcactcaatatgtccaaacagctggggaatgagggatattcggtattctatctgaatctggagacggtggattcaagctcgttgttcactggttcaggcagtgctagcggagcagaaggagaagggctgtccaggctgctctatgatctcaaggcggaggggaatgagggcattccattatccgtggcagcctattgtgttcgccgccctgaaattcaggcggatacttttcagcctgtctataatcgtaaggaactgacggatatgacttgtgatgaagcgaaagaactgattcgaacggttgccgaaagcggacagtatgatgtagtgatcgtagatggcgattctgaaaaaggtgaccgggctcaagccgtgcttgaagctagtcataagctgatctggctgctggcagacgatttaatgagcatgcacaagtgcggattatggctggatgttttagaaaccacgcagcctgaagggcttgaagatatgatatgcaaaaccagctttgtggtgaaccgctatatgggaactatgatcaactcgttacctcgtgacttcatggagctaaacggagcgttaccctatataccttcatggaagcagatgcagcaccgtgagctactgcttagttcaccgatttatcagcgggaaattcgtcatctgtgccacgagctgctgaatgtggacagtgtaacacatccgccggccgtttggtcttaaaaggtgctgatgaacatgaatgaggaacggtttaaggcattgcgagcagatatccgaaacgggctggacgtaacgtcttcggtaaaggataccgatctggtacggcatattgaaaatcgaattttacacgatgtagagctggcgggcttaacttcccgtgagaagcacgcacttgtccgcaagatttttaactctttccgtgggctagatgtactccagccattgattgacgacccgaccgttacggaaattatgatcaacagtcaccgggaaatctttgtggagcgggctggtgaggtgatgcaggtacccgatcaatttgagtcccgcgagcgactggaggatttaatccagacgattgtagccggggtgaaccgaattgtgaatgaggcttctcccattgtggatgcccggttaaaggatgggtcacgcgtaaatattgtgctgcctccagttgctctcaagggtccgacgatgacaatacggaagtttcccgagcgtcctatgacgatggatgacttgatacgaatgggtgcgctggatgcagaaaccgctgctatgctcaaggatttggtacgtagcaagtacaacatttttataagcggaggaacgggttctggtaaaacaacttttttgaatgcattatcccagtttatcccgtcgtctgaacggattattaccattgaagactcagcagagctacaaattgtgacggtccctaatctggtttccatggaaacaaggaatgcgaacaccgagggaaagggagaaatcacgattcgtgatctgattcgttcctccctacgtatgcggcccaaccgcattgtggtgggtgaggtccggggaagtgaggcgttggatatgctgcaagcgatgaatactggccatgatggttcgttgtcaactggccacgcaaataatatccgcgatatggtcagccggctggaaacgatggtgctcggaggggcagagcttccgcttggagtagtacggcagcagatcagctcagctattgatatattcgttcatctgtcacggatgcgcgacaaatccagacgagtgctggaaattagcgaagtgattggttttgaaaatggtgaggttacgcttaatcccctttatcgttttcaggaacgaggagaaagtaaggggcgaatcgtaggaggtctggaacgttgtggcgagggtctgcaacatactttgaagctgcaaatggccgggatcaatccggaaagctggcacaggggaggagtatcagcgtgaagtcaggaaaaacgactgccaagcaagtatcacgtgaggtcccttctctgccagattatacggtatatacattatcgacagtacaaaaaagtctgtgcatattgtttagtggcgtgctgtttgcgatgatcggctatctattttatcaccaatggatattatcattgttgtgcgctgccggggctgtggtgacgcctcgttattttaggcaaattttgctgcaacgacgcaggtctgctctaagcatccaattcaagcaggctttatattcactctcatcttctctttcagcgggaaggtcggtggagaatggttttcgtgaggttgtagaggatttgagattgcttagtccagatggagatcacgacctgatttttgaatttaatatcattacagcctgtcttgaaatcggacagcctgtagaggctgctttgcaggatttggcccgtcgggcgcagatggaggatattacgaattttgcggacgtatttgcggcttgcaaacgaaccggaggtgatctggtggaagtcgtacgacgagcttcaaatgtcattggtgagaagttggaaattcagcaggagatcggtgtaatgattgcgcagaaacgttttgaatcgagggttatgtttgcggctccttttttgtttgtattgtttatgacgatgacggcgggtgattacatgatgcccttatacagcggtacaggtatgattttatcaaccttttgtttattggtgcttggtgggtgtcttgtgtggatcaaccacattatgaagattgaagtgtaaggagagatgggtgtggtgatgttggtttgtctggtcatgttggttctgcaagtgggaggttgggtggtgctgaaccagatgcatagtgctaagtatgcgcattttcgccatatgaagctggagggactgcggctgcaaagactttcagtcccatttgtacacatgattcatgcttcacgtgctactcaccggctgcctttgctgatgttcaagctccagcgttcggtgcagaagctgtatggtatgcgcaacagcggagaaaaaacgatgctttttctggcagaaatgttgggttacggatatatgatggctgctggtggagctttaatatcgcttatgctgggcggggatgcgactgggctggtgctcggattgggacttggtattctggtacccatcgcgttgatcaaggatttgcatgggaaagtacagaagagggatcagcaaattttaatggaactgcctgaactgttgagtaaaatgatgcttttagtaggtgcaggtgagacggtacaacgggcattgctacattgcgtggaacgtaaaggggcggatacggaacatccgttgtatcgagaactgaggcagacggtggcggaatgggaaagtggtttttcctttcaacaggcatttgagcacctgagcaaacgttgtggtattcaggaaatgacggtatttacgacgacagttttgttgaatatgaggcgcggcgggagagatttcgtgatggctttacgtgagttatcccagacgttatggggcaagcggacttcaattagccgcacaaggggggagcaggcttcatctaagctagtattcccgatggcgctgattttgctaacggtaattgtgctggtgggcgctccggctttaatgatgatgaatatgtaggaggaatacaacgatgatgacattagtaacaggcagtattcgtaaattgtacaaggatgaggatggcctgggtacgttagaaatgatcctgatcattgccattctgattgcggtggcaattattttcaaggatcagatcaagaaaattgtagaagggcttttgaaaaaggcggataaaaaaagtaacgattttatggattcataatgctgcgcaaattggcacaaaaagaggacgggagcttctccttggaagcttccctcgtctttcccattctactgctggtcatttttgtgatgttatttttttgcctgtacatatatcaaaaatctatattggtgcaggtcgctgctactgcttcggaaagggccgcttacagttgggataacagcttcaaggacccgcgtacgggagcatttacacaagggcaacgggattctctctattggcgcttgaaggatgatgttatgctgggagccctgtttggctggaccggagccaacaatcaggaaagtgtacaggtgccgggcggaaatgggggaggctcgttacctgctcaaaagctgtccaatgcagaaaataatatgcctgcgggcatgcaggggcagatgacatatgagaacagtatgattcaccgtaaggtgaccacaaagttaaataagatagtgaaggtacctttgctgaatcagtttttagatcagacagatttgcaaggggaaatgagttctggcgtggtcgaacctgtagaatggattcgtacggtggagttggtccgttattatggtgcgaagtttatgggcagaggatcaggtgaaaaggtagattcggcagttgtagggaaagtattgatgcaatatggtcaaaacggtcagtgagaagtaagtaatgggaatgtaactagaaaggaggaagcgggtgtttgataagggacacaatacaaaggacggggaatcaggtgctgtcacggtctttttaattctgattttggcggtcatgttcggttttattgctgtatttattgattacgcgagaattgctgcactgcatgtgcagaccgaacggctgacccatgcggcggttcgttcagtgatgtctgcttatgatccgacattacaacaagagtacggtttgtttgcttatggcgaaggcggcggagaacaaattatggtcaaagtgctcaatgacagcgcgcggcgtacggcacgcgcagaaacgctaccgcttatgaatatgaagctggattctagttccctgcaaatggaaagggagcttggtaaatatgccatatttaacgagcagatccgtgaagagatgaagtataaagcacctgtcgattttacgtttgaagtgctcgaaaagctaaagccgctctctcaaaatatgaaagaggcttctcatacggtagatttgctgaaacggctgcaaaagctgtacgacagacgagaggccaaactagatgacatgctggagaagcagcgtaaggcaggagcttatatggaagaggtacgtaagcggattattaaacagaggggcacctatatgcccaatcagtatatatgggacccgcttgaggttgtagccgatattgccgctcaatataagcattacgtacatgtatatgaagacaataagaagagtgtggatgacgttaaaatcatgcagatggaaaaatatgcacgtagagcgagggcagcgcttgatcgcctgcgtcagatcatggctcaggctggagaagaacatgataagctgcttctggaagccaaggaaccgttaaatgaggcccggcagattaatgaagagatgcgcaaagtcattgcccagtataagcagagggcggccaatgcaggctacgatgaggtttcagcagcgcctactccaagcggagcaggctccagcgcagatccgtcggtaggaagcgcacggcaaaaagcagaggatttgttgattccagacaaggaatttgagcaatgggaagcagaaattgaaaagcaacggacttctataaatactgctaacaatagaataacgagtatgatgcgcacattatctttttatacagatccatttttgaatgcagacatgctcaagcaagaagtcgcttcaacgctcaaagagatagataaatacttgagtgcgtatgcttggacgggacctgcgaatgtactcgacggtgaagccaaaatgatggatacgcgacgtggaccggacaaagaacgcaagaaaatggaaaaagaggcgaaaaacaagctcaaacaagcctatcggatcattgaggttctttccaaaggtaaacaaagtgcagaacaattccaaaatctggaacggtattacaatgaaagtatttcgtttaaccagtctacatccagtccagctgtatccgctgatttgtcctatgacacctatgatgcagcgggagcttccatggatagtatggatggtctatacaggtcggcatccaatttactgactcaactgggagacgagttttaccagaatgaatacgcgctttcttacttccatcatgtggattttagccgttttggcagtttggccggatcgggtggaaatgtggggaatgctgcacagattttgggagatcagctggaggtgaataatcaggaagttgagtacatcctgtatgggttccataatccgacgggtaatctggcatccgcctatggagaaatttttgctatgagacttgccattcgaacaatggagggattggttaaaaacagctcaaaaggtaatccgctggtcgttttggcggcagctttgttatatggagtagaaaaagcgatagaagatatgattatgctggcacaaaagggggacgtgccattgtctgattttctgaaatttcgaatgacatacaaagatcatttgcgattgttcctgatgctccatagcaataatgaacgaaaaatgtcccgtatgcttgctctgatccgcctgaatacagatgtcaatcctgctgagcggcaaacgtatgcaacgggtgaggtcaaaaatgggatgaggctgtggtttctacctggggtaatgaagatgctcgggaccgcctcaaaagaaggagagagcattaagggtagtgtgtactatgtcacgaaaacagcgcatttttcctattaatcagtatctacggcaggttagtgggcaggagcggcgtgaacaaggaagtattgttttagaagcgtcactcgtgttgccaatgtttctgttttttattatttttctcatttatatggttcagatgacgctggtatccacagccttgcagaccaccgcttcagaagtggttaagcaggtttcgactaaaatctacccagtttctctagccgtggaggcggcgtccgcgaaaatagatgcagtccgtgaaccgctggatgaattgcccaagttatctgtgagtgaatatgcaagccaattcgctgcccagttgccacctccaatgggtgattgggtagagagcgctgttcagggcggtcaaaagccgatggaggagctgcgggggcgatttacggaagctgcacttgaccctgttctgaagccgatgctaaagccttttatggaggaaaacattctggagtatgaccgtattcatataacgagcgtacatgtacctgctcttacaggaactaaggacccttattttagagtagagctgtcgtatgaactgccgatgaaggtcccctttctgtatcgtagcattgtgcttcaggcggcggcagaggaacgtctttggattggcgacacaggggaaggagcaggtacaggaaatgcgacaggagataaggatgcgcagcattccatacagttgctcgtcaagcctgaacctgctgtgaaaggtgtgtacaatttgatcaaggccaaggttgagcctgggacgactgctaacctttctgtactttataagtcgggtgagagcacagctcagcacttgggctgggcctctgccaatgcggacgggattattgaatggaactggtttgtgggaacgaatacaacacccggtcaatggagctttgtgattgaaacggaggacggtcaacgtatagaagttccgtttaccgtggaaaagccagctgatggatagataggatcgactcgacatagacggacaggaataactacgatggagaatgatttggtagtctgctagttctattttttaaagggggaagatcgcattgacgtggatgtatattgtatgcggagtactactcgcgattgcgttagttacggatttacgtagcatgaaaatccctaataagcttacattgcccggtatagtggtaggcttggtgttcaatactctgtttggagggtggcacggttttttatttgctgttgctggactgggtaccggatttgggttcatgctgattttgtactggatgggagctgttggtgcaggagatgtaaagctgttcggcttgattggagcatggacaggtgccgcttttgcatggcagtcagctttatattcgattttttttgcaggtattattggcataggaattttgctatggaagagggaaacgatcatgagactgcggcgcgtggcttttaatttaggaggattttttctatttcgcagcggcaaagtgctgaccagtggaaatgaagcgcacctcaggtttccttttatgacggcagtcattccgggagcgatcagtgcttatctttacttcttgccatgacatgtccgctgggggagatcatgctacctcacggagataggaaattgttaaggaggtcatgaattgttgggtttaagcagggattttgcccggaacggcgggacatttatgattctaaacaaggaagacgggctcaagaccgatgatttaaattccgtacagaccggaatgatgactggtaatcggattcccggtctgctggaacttagaataaaggaagtcgattttcagattgagttacattacgacatttcggggcaacgcatgctttcccagttatggaaaggtgggggcgtgtcgacttctgatttctatcgcattctttatgaagtggcagatgccctccatcgcagcccgcaatatatgttagatatccgccagtttattttgcatgaggattatatttttctaagtggttcaggtactagggaaaccgctagtttaacctatgttcctttacgcagtgtacagtatgcagggcaaacaggcagtcaatttaagcagatggttattcgtttaatgactcgtgtggcccactttcagggagaatatatacaacgtatactggatctgtgtgatagaaatgaatttgaattgggattgctaaaggaactgttattacaaggaatgaaggccggtacagagagtgctagcgtgcagggagaaagtatggaggggcgagctttttcatcagccgaccctatcatatctgctcatatctctcatgtctctcatacctctcatacctcacaggggaactatactgatcgtggcggaacatacgggcaagagcatcgggagactttgcaggagattcaggagcttaaacggatcaatcggctcaaaccgtccatgaaaccagaggagaattctgagctagtaacagaaaacgaggtagaagatgtggagcttggattgcaaaaatataaaacgtacattgctcttggatgtctgctcgcttcggccatcgtatggcgttatatttatctggatcatccagagacggtaccgttgatcatttccgtggtgctgaccttggtacttgccgccgttgcttatataagctggacggggaaatgggagcggaatagaacttcgtctcatatgtacagcgattcagtacctgtattggattcggaatggttaggaactacttcttccccagcgcagcggaaaaatgatcgttatcaggtagataagctgaccggatttgtagcgggacagcatcatcaagacaagcgatcttccgatttgagtgatcaagggcaggagagctggagatggacttttccaaactcagaatctaaaagcgtgggagaccgagttacggaagacagggagaaaacttcagcaaattatgacttacacgagccatcgtggaaaggtgcggagcggggaaatgaattggaagccaatgataccagtgaggcttattataagtctctctccggggtaacggagctgctaaatgctgcatctaagcaggaaacgatgctgcttcgtccagatcaagagatacagatttcacctgttcagcaatcaccgattgcttgcctggatcgcaagccaccaggtagtggagggaccgagcgcatccggttacagccagaccatttcgttgcaggcagctttatcatcggaagagacccgcaactggtccagtttgtagagcatacggatggagcctcccgttctcatattgagctttgtatagttacaggagaacatagccacattgttaaggatttatcctcgacgaacggaactgttctgaatggagagcctatggtgccttataaggagtacacaatgaaggatggagacacttttaaaatcgccggggtatcttatacttatcggttggactcttttaaatcctccaatgcatcataaataaaggttatatggatatatgtcaagaagaggcctgttatgttcagggcttctttctttgtaatagggggctattgataggaataaaatgagcatcttaaaaacttgcagtctgcttgagagattgtgtcggactaaaaaagaactctaagctggcagtgacactacctaccagcctggagttcctctttttagattcaatgctgtttttgggaagaatggagttcctccagagcgtccttaagtgaaggatagttaaacttaaatccgtgctccagcgctttgcgcggtagtaccttttgaccatccaatataagcgtgctcatctcaccaactagctttgaaacgagaatgctgggcacgggaaaccagtgcggacggtgatataccgtagctactgtcctcccaaactggtcgttcgtcaagggatgtggtgatgaagcattcactgccccgacgatttccgtcgtatggatgcagtacgtgatcagacgaacgatatcttcaatatgaatccagctcatccattgatgaccactgcctattttgccgccgaatccgaagctataaggcatcttcatgagggggaatgcccctttttttttgtccagcacaaggctaatgcgtaacttgattaaacgggcatcagaagggtaggcattagcggcttcctcccattgctctaccacctgagacagaaaatcttccgaacagcgagggctcgtttcatcgaatttttcggtcagggaagtaccataggcggcaacagccgaagcctgaatgataactttcggctttttttgtagagcatttaatgcttgagccaaccgggcaacagatagcagtcgagattgaagaattctttgtttggatttatccgtccagcgctgattcagcgtttcgcctgctaaattaacgaccgcatcggtgccttccagtacttcaggcttttgttttaattcgttccaactcatatattgcaaacgggggctcgcttcgtgtcctaccagtggcttgcgggtaacgactttcacagtgtatccgtcgtctagtaagcttttgaccagtgcactccccaccaatccagttcctccacatacgatgatgttcatggagccagctctccttccgattcacaaaaaaaatacatctgttatagaatataacccttttcgagaaaaaaacttcatatgaatgtacctttatacggttaaggatgtcaatccatgattttatttaccctcgtttgactaacatatattcggatgtgtactttatctacgtgttcccttaatagagtcatttaagaaagcagccataaaagctatgttgtttgatttcaataatcacgttaaaatgattaaattaaaataagacaagcataacaggataaggggatgaatcagaatcatgctgaaaattggttctcatgtgtccttctcggacaagggtctgctcagcgctacaaaagaagcgtcttcttacgggtccagctcctttatgatatacacgggggcaccgcaaaacacgcgccgtaagccgatggagtccatgtatttggaggaaggcaagcagttaatggctgagaagggaatggaagatatcgtggtgcatgccccgtatatcatcaaccttggctcttacaaagaaaatacctatgagcttgcggtcagctttcttcaggaggaaattcgacgcacacacgcgattggtgtgaaaaatatcgtgctacatccaggcgcttttaccgataaggatgcagaatacggaattgggcgtattgctgatggtttgaacgaggtactaaacggcgtgaaggagacagatgttaacattgcgcttgaaacgatggcaggcaaaggaacggaaatgggtcgtggctttgaggagattgcctccattatagataaagtagagcataacgagcgtcttacagtttgtatggacacctgtcacattcacgatgcgggttatgatatcgtaaatgatctggatggtgtattagagcaattcgaccgtattgtcggcttgaatcgcatcgcagttgttcacattaatgacagtaaaaatccagttggcgctcataaagaccgacatactccgatcggatcaggctggattggctatcagacgattcataatgtggtgcatcatgaagcacttcaaggacgtccgtttattttggagacgccatggattgggaaggaagccaaaactcagcgtccgatgtatgaggttgaaattgccctgcttcgcggaaatgtaaaggagcgctttggggatgagtttttgggtcaggtagagcaattgcattcgtttttcaaaaaacaggatgtggatgtccgtaaatttgtgctggacacctggactctgctgaaaaatgatgccaaagcaagaaaagccgatccacgtgagccgttggagcgtctgtatgacatgataacggaagcagcactatttccagatttgagcgaagaacacattaatcaacggttgattgcctggtttgccggcagtcatttgccagtgacggtataagctaagggggattaatagccacatggaaattcacgtaaaacatcagccaaatagcactctatcagcccatgaaaaccgcgcgcgtatgcttgtatcttgtccagacggaccaggtattgtagcggccgtgtcccgttttttgtatgagcatggggccaatatcgttcaatctgaccaatatacaatggacccgtccggcggtatgttttttatgcggattgaatttgatctgccgaatttgagtgcaacccagccacagttggagcaggattttgccgctgttgccgagcaattccgtatggagtggacgatttctgcggtcagccgcaagaaaaaactggctattttcgtttccaaagaagatcactgtttggtagaactgctgtggcaatggcaggcaggagatctggacgcggatatttcattggtggttagtaatcatccggatatgaaggagtatgtggaatcatttggcatcccgtatcaccatattccggtaacagccgatactaaaccggaggcggagcgtcgtcaactagaggtcattggcgaagacattgacgttatcattttggcccgttacatgcagattatttcgcccaagtttattgagcattatcgcaaccggattatcaatatccatcattcctttctgcccgcattcgtgggtgggaagccatatgcccaagcctataatcgcggtgtgaaaattattggtgctactgcgcattatgtaactgaagaattggacggcggcccgatcattgagcaggacgtgcagcgggtaagtcacggagatgatgtaaatgagctaaagcggatcggtcgcaccatagagcgggtcgttttggcaagagccgtgaagtggcatgcagaggatcgtattctggttcatgagaacaaaacggtcgtttttaactaatcttaattttagaagaaatttgtgagtatatattttttgttaacaaagcccgtcgcataacgggctttgtttttttatgtgagttatttgccttataaacggtcagtacataatattttttgtgattttataattttttaaatgaggttaatacattacgggtatatttatatgaggactcggtacaacatttccacaatcatctttataaacgatctggcaaactttcacggcaaatggtacaatacttaagaatgtataagtcatattgaaacattcaagcagattcactcacttcaacagacatcgtttctttatcggacggtgatgttgaagagtatgaccgaatgcaattgacatactttttacaatatgaggaggctaaccatgactgaccagaaccaagcgatccaaaaggatgaaaactccacgatcgacaatttgtccatcacaactattcgtacgttggcaattgacgccatcgagaaagcaaactcgggacatcctggtatgccgatgggctccgcgccaatgggataccaactttttgctaaaacgatgaatcataatcccgatcaacctacatgggttaaccgtgaccgttttgtattgtccgcaggacacggttccatgttgctatacagccttctgcacctaagcggctatgatcttcctatggaagaactgaaacaattccgtcaatggggaagccttacaccgggacaccctgagtttggccacactgctggtgtagatgctacaaccggacctctgggacaaggtctcgcaatgtccgtaggtatggcaatggctgaagctcaactgggtgcaacatataataaagacgaatttaaagttgtagatcacttcacgtatgcaatctgcggcgatggcgatctgatggagggtatttctcacgaggctgcttcgttggctggtcgcttacaactgggcaagctgattgtattgtttgattccaatgatattacactggacggcaagcttaatctgtcctcttccgagagtgttgccaaacgttttgaagcttacaactggcaagtactgcgcgtagaagatggtaacgatcttccagccatccaaaaagccattgaagaagcgcaaggcgactcgacacgccctacgctgattgaagtgaaaacagttatcggctacggaagcccgaacaaacaaggtaaaggcggacacggtggtactcatggttccccgctgggatcagaagaagctaagctgactaaagaattctacaaatgggtatacgaagaggacttccacgtaccacaagaggttcgcgagcattttgctaaagtaaaagagcgcggtatcgcggcgaacaaagcatgggatgaacagtttgcgaaatacaaagcagctcaccctgatttggcagctcagttcgaaacagctgtaaacggcgatcttccagaaggatgggatcgtgatcttccgaaatacacgactggagacaaagccgtttcgactcgtgtagcttctggtaatgctctgaacggattggctccaaacgtacctttcctgacaggcggatctgccgatctggagagctccacgatgacacatttgaacaacctgacgaactttacgccagaagactacgccggccgtaacatctatttcggtatccgtgaatttggtatggctgctgcgatgaacggtatggcgttgcaccaaggtgtaaaggtattcggcggtacattcttcgtatttacagactatctgcgtccagccgttcgtctggcagctctgatgggattgcctgtaacctacgttctgactcacgacagtattgctgtaggtgaagatggtccgactcatgagccgatcgaacaattggcttccctgcgtattatcccgaacctgacagtaattcgtccggcggacggtaatgaaacttctgctgcttgggcttatacattggaaaacaagaaaaacccggttgctctggtattgactcgtcaaaacctgccaatcctggctgctagtgctgagcatgcacgcgaaggtatcaaacgtggtgcttatgtggttgcagatgcaacagacggcaaaccggttgctcaaattctggctacaggctccgaagtgcaattggctgttaaagctcaggaagcactggcagaacaaggtattcaagtacgtgttatcagcttcccaagctgggatctgttcgaaaaacaagacaaagcatacaaagattccgttctgctgccagaagtgaaagctcgtttggctgtcgaaatggcgtatccactgggctgggaaaaatatgttggcgatcaaggcgacattctcggtatcagcacgttcggtgcatccgcacctggcgaccgcgtaattaaggaatacggctttacagtagagaatgttgttagccgtgtgaaagctttgttgaaataaaacactgagcatctaaaacagacagtcgtaacctgagaaaggcttacggctgtttgtttcatacagttgatgctttgcaatgaaatcactattgaattccaatgtataggatacggtgatacagtgtgtattttcatactgaagctggaatcaaatctatgttatgatgcaccaatattcattcaaccattgagagcagatgaggggataacgaatgacacagttcgatggagtaagcgtagttaaaaaagcaaacgtttattacgatggtcaggttacaagccgtacagtcatcctgagtgacggcagtaaggttacactgggtattatgctgccaggaacgtatgagttcggcacggattcccgtgagatcatggagattttggcaggggatttgagagtgttgcttccaggtactgaggaatggctagaaatacaagggatggcaacctttcacgtacctgcaaagtcttcattcaagctggaagtacgaagtgtaactgattattgctgttcttatcccgaataataagctaaaaagggtaagcacactcagccttcaagccaagtgtgcttaccctaaagctatgccatatgtacacaagcacagccgtatggttacaaagaaaggtgcagcttattcgagaggttgaccaccaatggtgtggccaatccatgcttcgtatgtcttcacgacagcggataggtcttcttcgccgtagccttgtgtttgcccggcttgaaacaggcttttggcaatggataacataggtgcagggatggacaggctgtctgttagtgaggaagcaagcttcaagtccttaagcatcaaggcaagtgagaactggttgctaaaatcatgttcaatgattttgcgccctttcaggtcagcggccttgctgcctgccgatccgagttgtaccaattcaaggaagctgtctgccgggatgccggatttagccgcgatagcaaagccttcagccagagcgaggttatgaatacccaccatcgtattatgagcgagcttggctacggccccgctgccattaggtcccatatgaagtacctttttgcccagggtatcaaaaacatctgattgtgccgcaatggcttctgcattaccgccaaccatgaacacaagtgtaccgtctacagcagcaggcttactgcctgttacgggtgcatcaatgaaagagcagcccagcttgtccgcttcggcggccagttgcttgaccagttcaggtgaaatcgtactgttgtccatcacggtcatgccagccgtaagtccggcaaacacgccgtcatcgccgtaatagatgtcacgaatggagtgatcatcgctgaccatggtaatgaccaagtgctgaccttcagctgcttcacgaggagttgaagctgtacgtgcaccttgctctgccagtggttcgcagcgcgaagcggtacgattataaactgtgactccgaatccctgctttagcagattggatgccatcggggcgcccatggtgcccagtccgataaatccgatatttttcattgctaatcacctttcttgttggaagttgccgtccgatgcagattgcgagttcggctcgaaatgaatataaaacaggttgatctcagttaattgtagcatgggcatactaccctatctacaggaggggctgtcaagcacaggatacacaggtaacgcaagcttgtcaggccccgcaaattaaagtatcctattcctaagtccttatgttcgtattcatggtcttagtaataccaaacaggaggttccaaacatgtctaaaaaagttaattttgattacactaaagcgctctcctttataggtcggcacgaaattgattattttgcagagcccatcaagctggctcatgagcaactgcacaaccaaaccggtgtagggtccgatttcttgggttggattgacctgcctaccaattatgataaagaagagtttgcgcgcatccaaaaggctgctgctaaaattcaaagcgattccgaagtattgatcgtaatcggtatcggtggttcttaccttggagcacgtgctgcgatcgaaatgctgtcgcattctttctacaatgcgctgcctaaagatcaacgcaagggtccagctatctattttgctggtaataacatcagctctacatatgtgaatcatctgttggaactgattgaaggtaaagacttctctgtgaacgtcatttccaaatcaggtacgacaacagagccggcgatcgcattccgcgtattccgtgcagctctggagaaaaaatacggtaaagaagaagcacgcaagcgtatttatgcaacgacggataaagaacgtggcgctttgaaaaaattggctaacgaagaaggctacgaatccttcattattcctgatgacgtgggtggtcgttactccgtgctgacagcagtaggcttgttgccgattgctactgcaggcattaacatcgaggaaatgatgcagggggcggcagacgcttccaaagagtacagcaacccgaatgtagctgagaacgaagcttatcaatatgcagccgttcgtaacgctttgtaccgcaaaggtaaagcaattgaaattctcgtaaactatgagccgtctcttcattttgtatccgagtggtggaaacagttgtacggagaaagcgaaggcaaggattacaaaggcatttatcctgcttctgttgatttctcgacagatctgcattccatgggacaattcattcaggaaggcagccgcaacatttttgaaacggtaatccaagtagaaaatgtaccaagtcacatcaccatcgaagcagatgaggatgatctggacggactgaatttcctggcaggcaaaactgtggattttgtaaacaaaaaagcattccaaggtacattgctggctcacacagacggacaagtaccgaacttgattgtaaatattcctgacttaagcccttactctttcggctatcttgcttatttcttcgaaaaagcttgcggcatcagcggctacctgttgggtgtaaatccgttcgatcaaccgggcgtagaagcttacaagaagaacatgtttgcgctgctcggcaaaccaggcttcgaaaaagaaaaagctgagcttgaagcgagattgtctgaataagagtgctgtaatctctgattcgaaacaggatttcggtcagaagtgttatagtgtatagcatcaattaaagtacaggaaagcagttcaccagctgccagaagcgggggactgctttcttgtaaaatgaagtaaggaaggttatacgtgtatgttggaacaataccgaaccgtacgcggtgccggcaacaaggaaattgtgatccgaaaatcccgttttatcggccatattcagcctgttcaaactgaggaagaagcagttgctttcatagagcgcatcaaaaaagagcattggaacgctacccataattgttctgcttacatgattggcgaaagagacgaaatccaaaagcaatcggatgacggagaaccgagtggtacggctggaaagcctattttggaagtgatccgcaaccagaagctgaaaaatgtcgctattgttgttacccgttactttggtgggattttattgggagcaggcggtctgattcgcgcgtattcagatggtgctgttgcagcaatcgaggcaggagatgcaattacacgtgtgctgcatcgtgaagtttttgtagaattggattatacctggttgggcaaagtggaaaatgaattacgcaatcgcagcatccgcactggagaaacaatgtttacggataaagttactttaacctgtctgccgctggctggtgatgcggaatccttcagcaactggataacagacttgacgcaggggcaatcgcttgtgtcggagggagagcagctttactttattgaaggggaataaataatatggctagaagagcagtagaacaggagttgtcaagagggcggattctggaagcggccaggcacttgtttattaccaagggctaccgtgcgatttcaatgcgcagcattggccagcatctgggttacagtcatggttcgttatattatcattttaaagagaaggctgaactgttctatgccattgtaattgaagattttaatacattgcgtgggattctactgcaagcagcaacaggtacgcctgatgatggcttgagcaggttggagtacttgatgctggaatttatccgttttggtttggaaaatccatatcagtacgaaattatgttcatgatgcacgatgaagaactatttgcatactgtcgcacagagcaaaaccgttgtgtggaactatttgcgtccatgatccgtcaagaattgagtggtcaggggcattcggaggaagattgctctagggtaccgaaaagtctgtttttatccatgcatggctttgtatcattttatattcaggacggtttaacatttgaagaaattaggcccgctgctttagcacatgtaaagctgctgtgcagacacctatgagcgtacctgcattcacacacttcagccatgaacatgtagggcgcttttttgggtgtatacacttcatgacggtgacttatcattacgttactttgcgaaagcgactaagaatttaacagacgatgatgcatccagtaggaaaacatcatggtctgtttttttacccggtccgtcagcctttcatgatctttacatggtattggcgtctgcgtggtccgtcgaattcacaaaaataaagtccctgccatcgtccgagcaacagctttccatcatggatgatgatcgtttgtgaggggcctgtcgtaatggattttaggtgggaagctgtatttccctccatatggcgatattggggatgctcccacggataaacttcatctagtcttaatatcacatcatgtttgacgtctgggtctgcattttcattaatggcgatgccggctgtcgtgtgtggacaataaacaagtgcggttccttgttggaccccgcttttttcgatcaatgaagcaacctctcgtgtaatatcgcgcatttcatctcgccgtgtagtggataattctaaagtatgcaacaataactccatctcctttcttcctaatactttacccttttaattcctaatataatatatagttgacgaaaattactttcctttgataaagtatcacataagaaaaaacatagtatatacattggaataattaaatgatttcaaatgaggtacgtgctttgcgagaagcaaggctgctgctgttcctgaacaggtccagaagcggaaaggaagtgtacggatatgcatgtggaagtaagaggattaaacaagcatttcggtaattttcatgcagtaaaggacgtatcctttgatattcaggcgggccatcttattggcttgctcggtccaagtggtgggggaaaaacctccattcttcgcattttggcgggtctggagcaaccggatgcgggagaaattcattttcatggaaaaagggtaaacgagctgtccccgcaggaacgtggaatcggatttgtatttcaaaactatgctttgttcaagcacatgagcgtctacgacaatattgcctttggcctgaaagtgaaaaaaagctccaaaacccgcatcaaggaacgggtcacagagttggtcgaactaacggggctcaaaggatttgagcatcgttatccgcatcagttgtcaggtggacagcgacagcgggttgcctttgcgcgtgctttggcaccagagcctcaattgctgctgttggatgagccttttgcagctattgatgccaagattcgtcaggagctgcgcacctggctgcgagagttgattgagcgggtgggtattacttcaatttttgtcacccatgatcaggatgaggcgattgaagtagcggatgaaattatggtgattaatcagggacgactggagcagaagggaacaccttgggatatttataaaaaaccgggtactccgttcgtggcttcctttattggggaatctacggtgattgaacaggcaggcagtctccgaggcttcgaagaagctgctggactgggagcacgtgccttgatccgtccagagtatattgatgtcgggccaagcgaggaatttacgcttctgtcggcgaccgaggaaggtacagtgaagcatttgcattttcgtggaagtgagtggatggttgaagtacaggtcggggatcatcgtctcatgacataccgctcgctggagaagtctacgctggaacctggtcagcaggtgcgagtgttggtgcatcgagcctatctctataatgaccagtccagctggatggtggaaaaccgcctgaaggaagatccaatgcctatcatcatttaaaaataaatacgatcacgcatgaggggatgtctagccggatttcacggctttgggcatgctccttttggtgttggatgctggaaggatttacgcagatgatttacgtagaatcggtctgttcgttataatagtagtaaaaagacccaggtagataggagttaaaccatgaatcggcttatttttcttggcacgggggatgcaatgggggttccgcgtgtatattgtgattgtctcgtatgcacagaagctcgcacgacaggggcgaatgtaagattgagatcgtctgtgctgatcgaaagtgcgacggaggactttatgattgattgtggcccggactggcgcagacagctagaattgcgcggtctgcgttttatccctacgatccttgtgacacatgcacattttgaccatattggaggattaccagaatgggcagatgcctgtcgctggactgggaacagaggtcgcttgtacgcgccacaggaagtgatcgacacgatcttgcgtcaattttcctggctctctggaaacttggatcttattccagtagacgagggagcccaacttggcggatggaatatccggggatggcgtgtgaatcacgggaagaacggatatgcctacgcttatcgtctggaaaaggacggtttctcgtgggtttactgttcggattcgattggattgaatgaggcggaaattctgcccttgcacaatctgaatttgctcgtcctgggaacgagtttttatcatgaggaggccaagtatgccacccgttccgtatatgacatgctggaggctcaggagcttataggaaggcttaaacccgaaaacacagtgtttacacatatgtcccatgatgtagatgtcacacgcaactatgggcttctggaagggattagcttggcacacaccggcatgagtttgccgttagaataaaggtgacctttacctttacatcgtttgactgatacgtagaagtgtggagattccttctttgatttgtagctcgttggcgtatgaataggacagccgtacatgcgttttaccctctgcgccgatgggatcaaatacattgccggggacaaaggatacagactcttgtaaacttttggaaagtaattcattaggtttcaacgtagaaggcagctggagccacaggttgagtccccctgccgggctggtccacgtccaaccggagtcgcggagactgtcttccatcgtttccttacgaatctggagcgcgatacatagctttttaatatgctgctgcatacgtggagattgaaagtattctaaaaacagcttttgattcagcagtggcgatccattgtccactaacgctttgacgttcagcaggctgttcatgagctgtggtcggcaggtcacggctgcgattcgtagaccgggtgcgacatatttactgtaacttcgaatgtagacgacgcttcccgaaacatcataggcgaaaatcggagaagggggcttttgcccaaagctaatgtcataggtgctgtcatcctcaacaatgaggcagccatagcgctcggctagttcaggcagtcgtttgcgctgctcatcggggaccgtaaagcccgtcgggttgtggaatgttggattcatataaaagaggcgtggtttttccgttttcatgcaccactcaatctggtccagatcataaccttctggtcgaatatcagtcatagtcagacgtgcgccttgtctacggaatatttccatagcggggccataggcagggcgttcgatcaatacacggtctcctgtacggagcagagatcggccaattaaatcaatggcttgctgtgctccggaggtaatcagcacttcatccggtgataaagcaaaatgcttatccacgctaaaatgctgcgccatggcctcccgaagctcggcatcaccctgcacagcggaataggtggccgctactttcggatgcttttcaaatacctgcatcattagctctccccaaaatcggttgggcaggagagaggggtcaatcagcgctttggaaaactggaaattcgtatttacggattgaacgcggctaagtccatccattcctctccaggctgaaactgacggatcatctgccgcatgggcagattcggagtgaatcgtgaggtcaatggacgaatgtcccgagtagccagcatattttgcatgcccagtcgcttgggaagcatgaacgtaatatcctgatttgtcctttacatagaccagtccccgttgcttcaactcctgatatgcccggaaaacagttagccgatgtacacccagctcctgagccaagcttcgtacggacggcagcttcatgtctgtttgccaatccccgcgatcaatccgcacagttacataatggataacctgctcatacagctttaaggcatgatcggctgcaaagagtagttcgctgttgttcttacccatgctatccacgctcctttctgtgtattgtactatatagcacttcaaaaacgtatacaactgttctgtagttatacatctgttctgttcgtctccctgtatgcttaaaagcaactgaagggagagggacgtatcatgataggtatcgcgtttacagtaatgtgtcttatttttggcacaacgtttttggccataaaagtgggagtggaagccggacttccgccattcctatcggcaggtgtacgttttttcgcggcaggggcgatattgttcattgctatgaagctgaccggaaaagtacgatggtcgttattatggcggaaggaaatgttgctaattggagcaggaacgaccttcggtacattttcagccttgtattgggcagagcaatatgtcagctccgggatcggagctattttgtcagctaccgggccgatgatgatcgtcattttgcaatctgtactgctacggcaaaaaacgtcacggattacggtcgttggctgcatgatcagctttcttggtgtggtgctggttgtgctgcccggattggcggttcagatcagtggtctgtggctggcgggatgccttgtcattttgctgggggagctgtgttattccgggggagctctgtattccaagcgagtgatggatgtatttcgtgaaacgaacccgattgccctgaatgcggcgcaaatgatccatgggggatggatgctgctgttactgtctgcgatcacggaaccgtggagttctgaggggtggcagtaccttcctgccatggggtctttactttatctgatcctgtttggttcgatgattgcacatacactgttctactggctcatggagcgtacaaatcccctgtttccgacgacgtggctgtatatatcaccgccgattgcggtgggcttgggagcgttgttgtatggagagcatgtaagctggtggatgctggctggggtgctgctcattgtgaccggattaatccttatgaacaatggaatcatccgtctggtgaacaggcgtaaggtacgttctgctgcctgatattttaaagggggcaggttattatatgatctgacagaaaaggcctccaaactgtcgtatgttactgaacatgcgacgtttggaggctttgttgttgtactacttcatttaagtattatgggaacagtcactttttactttattcaacgttgagtacgaatttgtcgatggcgtgcttaacaccgtcttcgttattgctgcgagtgatgtaatcagccagctttttcaaatcgggaatggcattctccatcgctatgccgagaccagcgcattcaagcatctcgtggtcgttccaagagtcaccgatagcaatcgtttccgacagttcacagccaaaatggtttgcaaggaaggtaagcgcatggcccttagtgccttcatgatgcataatttccagaaaatgaggcttggatttggtaatgtgaacttcattgccaagcagttcgcgaagttcaggaattaattcatccaacacttcaggctcgtcgataatcagcaatttaggagccggctgctctataactttactgaatacaggctctacaaaatattccgtgttgttcagctccgtgtaatctttgattttctgattatcttcacgtgtgtacaatttgtcatcaatatacgtttgcagatgcagattgcgttccacgcagaattcaaacagacgacgtgcagccacaagtggaacataacgctcatacagcacgttttcgtccagcaggtttttaaccaaagctccttggtacgtaatgatcggcacgttcaaacccgtctggcgagcaattttgtgtgcagaggcataagctcgtccagtagcgagggtaaccaccacaccttttgctacagcagcttctagtgcctgttgtgtcgctggtgtgacttctttctggtcgttaatgagtgtatcatcaatatcaatggcaattaatttatacatatcggtattctctcctttatctctatcatggggcaatgctaaaattgtatcttataatattcaaaatgacaatatcgcaatgaaaaggggacagctcccataagagcctgtccccatataaccactgaagtattggcttgaaacgatgggaaaaagtaacggttagtcttccaaaaatacaagtccaacaaaatcgtccagctcaatattaccaaaatagtgcttcaaatcgagagaggataaggcttgacgtacctcaccttcatcatagcgcttgccgcgcaggatattttcaatatcagcaacgtcacccacaccgaagaaatccccatagattttaatatcacggatgtagccttccttaagatccatgcggatatcaataataccgaccggaaatttacgtgtgtgcttgatattgctctcgggcgatagaccgtagttccaatcccacgattggtagcgttctttggaaatttcatggattttggcccagtcggcatcggtgagcttatattgaggcacctgatccaattctgctccgaatacgaaacgcagcagttcctcacgaaattgctctatggtcatctcacggtccatcagttcgctgatgttagccacgcgactgcggacggatttagtgcttttggacttgaatttttcgggattagcatgcaacgatgcagccacattatccagattcaggttaaacatcaatgtaccgtggctgaacatacgtccgcgtgtggcaaattgggcgtttcctgaaattttacgttctccgacctgtagatcgttgcggcctgtcatttcagcttctactcccatttggcgcagggcgtcaatcacaggttgcgtaaatttgaggaaattatgaaaggactccccgttatccttggtaataaagctgaaatttaaattaccgagatcatgatatacagccccaccgccggacaggcgacgaacgacttgaatattgttatctctgacaaactcggcgttgatttcttcaatggtattttgatgcttgcctataataatagaaggctgattaatgtaaaacagcaaatagctgtcgtccagcggtagatgcttgagcgcgtattcctcaatagcaagattaatggctggatcgtgtatcccctggttgtcgatgaacagcatgtccattcctccgtatataaactgtgtaatttatgtgtgcctccttctattgtaacccaagtgagccatgtacaaaagctcatttgcattgacgggacgcaaaaagcagcctcataatggagctaaatgattggaaacgggcggaaaggatgagaggcaatgatagaggtttacggtcatggcggagacagggaaacagctgccgcgacttttggcggagctgctgcggattttgtagattttagtgcaaatattaatccgcttggtccaccgccagaggtgcttgaggcgctgcaacactcagttgacactgtgattcgctatccagaccctgggcatcggaattttaaaaatatgctcgcacggcgactgcatgttccaccggagtcgctaagtatcggaaacggagcggctgaaagcatggcgctcctactattgggactagctcctaagcgtgtgggtacagtggagccgtgtttttcggaatatgccgagctggctggcaaattcggagccgaggtcaaccgggtgtatgggaaggcctcgcttcaatggaaggcggacgtggaggacatccttcagctcatggagcaggtagatgttttgttcctcggacagccgaataatccaaatggcgtacaatatagtgagcaggagctgtgcgagctggcagaggcggctggcacaacgggtaccgtgctggtggtggatgaagcattcattgattttattccgctggaacggcgaatctcactgctgcctgtgctggatcgctatcctcatgtgattttgatccggtcaatgaccaaattttatgccattcctggcttgcgattgggctatgcgattgctcatccggactatatccggcgaatgacggccaaacaggtgacctggagtgtgaatggattggcgttgctggctggggaggcgtgtttgagaagtgggcaagcatatgagcgccaaacacaggagctgattgctgcggagcgcaaccgcctgttgaccgccttggcggaatggggctgcggtgtcgttcccggtgaagccaattacgtgctggcaagggcgccgggtacgtggagcgcatcggctattcagcaggcgcttggacaacgcggaattcttatacgtagctgtgctatgtatccgggactgacgacgagccattttcgcattgcggtcaaggatgcagaagccaacgacaggctgctgtctgtattgggtgaagtgctggaggaggagcagcggcgtgacagttagcttgattatcctggcagcctaccttttggacaggctgatcggtgatccgaggtggttgccgcatccagtcatcgggatgggacatgccatttcagcattggaaaaagcgattcgtcgccaggtccgcagtgatcgggggctgaaacgtgcgggtatactgcttccgctcattgtggcgggaggctcctttgcgctcgcctgggcgctgttgcacttgcttgcctggattcatccgtggttgtctgtcggcgcagaaatggtgctgattgcgaccacgattgcttccaaaggactaaaggatgcaggaatggccgtataccgagcgttgcaggcggatgatctggcagcggcacggcgggagctgggcatgattgtcgggcgggatacgcaacagcttgatgagcctgagattgtacgtggtacggttgaaacggtcgctgaaaatatcgtggacgcgattatttccccgcttttttatgccctgatcggaggagcacccttggcgctggcttatcgtgctgtgaatacgctcgattccatggttggctataaaaatgaaaagtatctgcatttaggctgggcttcagcacgtctagatgatgtggctaactacattccggcacgcctgacagcggcaatgcttgtcgtagcggcgtggatgtacaagcgagatgctgctagaagctggcgcacagtcaagcgagacgctcgtctgcacccaagcccgaacagtggcttcccggaatcagctgttgctggagcactggggattcgtcttggaggctataatgtgtatcatggcgtacgctcttttcgtgcatacatgggcgattggatacgaccgctagagtcgaaagatatacggcatacaatccagctgatgttcgccgtgtccagtatgttcgtaggattgtgtttgttaggagccgcaggttgttttgccttgggatgggtgcggtgagggtgaggcgtgacacactgaataatgatcgagcaggaagtgacatgatcttgaagcaagatatagcagcaaaaaggacggtagaatacgtacaaagtccgaactcacaggaggataaggtgccatatgatgctaaagaagatctgcattgggacatggaactcgtgttagttcgtcacggcacaaccttatggaataaggaacgtcgatatatgggacactccgacttaggtttgctaccaggagcagaacaggaattaaagcctttgcaagaagaattgcaggggcagtcctttgctcgaatctattgcagcgatttaatgcgatgtcgccagaccttgcagatcattgtgccggagtcagaattgacgtctggaggttccctatctactatgtctcctatgatggaaccacgtctgcgagagcttcattttggcgagtgggatggaaaaacgtatgacatgctcaaggatgtgtcgttgtatcgcgcttggattgatgagccgcaacggataacccctcctggaggagagtcttggacagattttgtgaatcgtttgcggaaatttcttgactctctgtatgaatggcgtgttgctatggaagttcaacccatggatttgactgctgcgccgccctctgttttggtcgttacgcatggtggcgtaattcgtcagttagcttgcatgctgataccgggccatgatttttggagtctgaatccgaagccgggagaagcatttaggattcaattgaggctggcaggaccgcacaattacatagcggaaatgctccctcattaggttagacaccagcggataaagaggctgtttgggttgtaagccgcctcattttaacctataatcatcaagtaaaagaacggcttgactaccactacatcaaatatccagcagacgaggtcggcgcagtgtgatgaaactatggtttcccttgcctgcgctgttaaaagggaagtcggtgtaagtccggcgcggtcccgccactgtaaatggaaacatgccggttagtcctgctttatgtgctactaagcatatgaaggaatttcaggacatgcatcttaccataagtcaggatacctgcccgtccgcctgtcaccataatccttcgaggaaaggatgacgtgttcgcagtgactgtccgtgcggaaagaagctgccgcctgcgcacaatctgcgctaacgtgacccctgtgtcctaatatgaggatgcggggtttttttgataggaaaagaaggctggatttagaagatatctgatgatgctcaagtaacgctcttaacgatttttttatgaaggggtgcaaatcatggcaggaaaaaaaataaaggtttggacaacaggtctattggttctgattttggcagttgtgctgagtgcatgtggctctaatggaaaaaatgctgaaaataaagagaatcagacttctgcacagcagccaggaaagaccgtaaccgcacaagagcctccgggcaaaacagtttacccactcaccgttaaggatgcaacaggacaggaatttacattcaaaaaagcgccggataaaatcgtttccgtctccccggcagaaaccgaggcgctgttcgccatcgggctggataaggaaatagttggcgtatccgactactctgattacccggaagcagctacgaaaaagcctaaagtgggcggtattatgaaaccgaacgaagaggcgatcattgctgctaacccggaagtcgtttttgcagggatatcacttagtgaacaggctacgaccaagctgcgagacatgggaattatgatttttaaaacggaaccaaagacagttgaagatgtcatagctaacatcgaattgtatgggaaaatcaccgatcatcagaaagaagcgagagcggtgactgacaagatgagggcagatgtagcggaagtgaaagaaggagttaaaaatatcggtaaagggcagaagctgcgggtatacgtcgagttttcaccaggctggacagttggtaaaggcgagtttatggacgagctgattacgttggcgggcggcgaaaatgtaggtgccacgcagaaggggtggtaccaaattagtgaagaaaatattattgctgcgaaccctgacgtgattttgtacagcaaaagtgtcaaggacgacaaaactggccagacgctcggcgaaatcattaaagctcgcagtggatgggatcaaatatcggctgttcgccacaaccgggtgtttgccgtggatgataatttgatcagtcgtccgggtccacgcgtaacggaaggtctcaaggaagtggccaagggcgtgtatcctgaaattttcaaatgaaccgtaaactgatcggctttggagggacaggtcttgtcctgctgttgctgacgctgctgctctgtcttggcatcggctcggccaagcttccggtcagccagatcacgggcattctggttaaccaccttccgtggttaggcgatacgtttacaccggattggaatacatcctcagagcagattattttgaaggtcagattgccacgagtgttactgggaatgttggtaggagcagcgctggcgctggcgggagccggatttcagggtgtgctgcgtaatcctttggctgatccgtatacactgggggtatcctcgggggcttcggtaggagcggcagtactgatctattggggccttcaattttcatttgttggcatatggacgctgccgctagtggcatttacgaccggaatgctgacgctgtggatggtgctgacgttggcacgggaaggtggaaaaattccgacacaaagtctcattttgtcgggtgtggtgatgcaatcctttctgggagcggttgtttcttttctgacagccatgtcgaaggagacggtcaatgaaatattgtactggacgatgggaagtcttagtctgcgcggttggtcatatacaggaatccttttaccttatgtggtcataggactggtatttctatggaatcgggcacgtgtgctgaatattttggctttgggtgaacgtcaggcggctcacatgggagttcatgtagatgcgacgaagctatctgtcctgatcatttccacgctgctgacagctgcggctgtctcggtatgtggagtgattggctttgtgggacttgttgtaccgcatatcattcgtctggtgacaggccctgattaccggatgattgttccattatctgcgctcggtggagctatttttatggcttgggcagatacggcggctcgcacgttgttatcccccacggaaattcccctgggcgtgatgacggcctttgttggggcaccgttcttcgcatatctcctgtaccggaacaagaagctgcgcaggggggaactgctgtgacagaacaaagtgaatcacagaaagtgcgtgatcgggcattagaggtagcgggtctgacacgtgcctatggagagttccatgcgttaaagaatataagctggagcgtcgacgaaggaacttggtgggggattattggtccgaacggcagtggaaaatcgaccttgctgcatctgctttcgggtgtagatcagccaacttcgggaaacgttcatatctatggcaaaaaggtcggtagctacagcagaaaagagctttcccgactcatagccgtactccaacaggaagggcttcctccagtgggatacactgtcagggaagtcgtagaaatgggacgttttcctcatcaggactggttaggcagggaaaagggtgttgatgtggaggcgatcacggatcgcgtgctggagcgattgggtcttaccacgttggcggacagagcattggaccgcttgagtgggggacagcgacagcgtgtagctttggcaaaagtaatggtacaggagccacgaatattgctgctggacgagcctacgacctatctggacttgcgctatcagcttgaatttatggaactgctggcagattggcgccaagaaacgggtgtgacgatcattgcggtcttgcatgatcttaacttgacagcccaattttgcgaagatttgcttgtactcaaggatggaatggttgaaggattgggagcttcatcgaagttattaaccgaggatcggattcgacgagtatacggtgttgagcctgtgatgcttccgcatcctgatagcggtgtgccgcagctcttgctgcgcagaagtgcttcggatacagcagattaaataaacgatgaaacacacttaaaaagagcagggagtggaaggtatgaacaacaagctgcgtcagctgatcgatagcattgcccagccggatggagtggcggcctcggcagcttcagcccatttggaccaattaacaaagccaccgggaagtcttggaaagttggaaagtgtggccatcaagctagcaggaattacaggagtggacaagcctgaatttgatcgtaaaacggttatggtcatggctgcggatcacggggtgtgtgaagagggagtcagtgcctttccggctgaggttacacagcaaatgctgtataacatgctgtcaggtggcgcggcaattaatgtgctggcacgccatgcgggcgcagatgtcaaggtggtggatgttggcgtgaatgcggatgtcactcacgagaatctgttggatcgtaaggtacgcctgggtacttcgaatatagctaaagggccagcaatgctgcgtacggaagcggaacaggcggttttggccggagctgaagccgtagcagaagcggtcaaaggtggcacacggctattcgttaccggagagctgggcatcgggaatacgacagccagcgctgcggtcgtatgtgctcttaccgggctagagccggaagttatcgtaggccgggggacgggtgtagatatggctgggcttacccgtaaaatatcggttgtctgccgcgcattggaggtgaaccagccagatgcaaatgatgcgctcgacgtgctcactaaggtcggcggtctggagattgccgccttggcaggagtcatcctcggcgcagccgcacatcgctgtccagttgtgctggacggctttatttcaggcgcagccgcccttgcagcgcgtgcgcttgcgcctgctagcgctgcgtacatgctcgcatcgcacgcctcggacgagcgcgggcacgcggcggtgctccgcgagctcaagctggagcccatgctttatttggacatgcggctcggggagggcacaggcggtgcgcttagcttgcacctgattgatgcggcgtgccgcatcatgcgcggaatggcgacctttgccgatgcaggcgtatcggacggtcagggagccgcgcagcgatgaaagcgctggtgaccggcggggcacgcagcgggaaaagcggctttgccgagcgattatgcatgtcgcgcgcttcgcgcgcctgctacattgcaacggcgcaagcctatgacatggagatgaaggagcgcatcgcccttcatcgggtccagcgcgagtctgctgggtacgactggcagacgctggaggaagcgcaggcgctgccggagctgctgcagcggcttggtggcgatcgagcgtcgcagcccgcgcctatgttgctggtcgactgcctgaccctgtggctgtcgaacgtactgctggccgcaggcgaggacggcgaagctgcgtccagagctgccattaatgaactggcggcagctgtggagcagtatccagggcagctcgtcatcgtaaccaacgaggttggtgacggtattgtgcccgaatatccgctgggtcggctgtatcgggatttgagtggggttatgaatcagcggattgcccgtctttgtgatgaagtatttttggtgacggcggggattcccgtagaactcaaacagttggaatataagctatgagccgcgaacgtcaggctgttgcggcggcttttcaatttttaacgcgtcttccggtgaaggcggaaatagatttttccccggatttgcttaaacgcagtgcaagttattatccgctggtgggagtggttattggcatcattgtctggggctttgcggcgcttacttctatggtgttgccgccgttgccgtgtgcgattcttacgcttgttgtctgggtttggttgacgggcgggttgcatttggacgggtggatggatgcggctgatgccttattcagctaccgatcccgtgagcggatgctggagattatgaaggatagccgtgtaggagcaatgggcgttattgcttgtgtgctgctacttatgctcaaggcttctttgctgtatacggtgctggttgaacggaatgtgtctggcttgctgctgcttccgatggtttggagccgctggtttatggtacatgcaatgaaacgctggcctaaagcccgtaatgatgatgggctggctgcgcgttttgctgatatgagtggtggccgagtagggttggccgtattctgggcagtattagtgaccctgagtgctgccgtaggacaatatcttctggcaggtttggctacagcaacaagggggactgggaatctgtcattggcaggatcctacttacagacgttcctttcatattctgagagccttccaatctggctaggttttgtgttgcttccggtcttggcttacggtgttggaaccttcacggcaaaccgtattaaccgccgcttgggtggacttacaggagatatatacggaactttaaacgaattgctggagactgttttattgttgtttattgtcattttgtacggggtgtgactagatttgaaatgaattcgttaaaggggaagaggcaattgtcaactttcgaaccgtcctgcacgaacccggcagccgtattgatgcttcaaggaacagcgtcggatgtgggcaaaagcgtggtgacaactgcgctttgccgtatttttacgcaggacggatatcgtcccgcaccgtttaagtcgcaaaatatggcgttaaactcttatgttaccgaggacggcaaggaaattggacgcgctcagggggtgcaggctgaggcctgcggtattgaggccacaactgacatgaatccgattctgattaagccggtcaaagatatgcactcacagattgttgtacacggtgtaccttatgcctatatgagcgcctccgattaccggaaggattttttgccaaaagccaaacagaccgttatggatgctctgaatcggttgcgtgatacctatgatattgtccttatggaaggggcaggcagcccagcagagattaatttgaaggaccgcgatatcgtaaatatgaatctggcaggttgggcggatgctccagtgttgcttatttcagatatcgacaggggcggtgtttttgcctctctcgtaggaactatcgaattactggaaccccatgaagtacagcgtatccgcggatttatcattaacaaattcagaggtgatctttctctgcttcagccgggactagactggctggaagaacggacaggcattcctgtactcggtgtattgccctatctgccagacattcgcattgaagcagaggattcggtagtactgaataagaagcccaaacaatctgcaaaggataaagaactggatattgcggtgatacgatatccgcgaatttccaattttacagacacggatgctctggccgcagagccggatgtgagtgttcgttatgtcacagaagccggacagttgggcgtaccggacgccattatcttaccggggaccaaagacaccattggagatctactggaattgcgtgaaagaggtctggaggaggacattcagcaggccatgaatacggaacgcacgcagctcattggcatttgtggaggttatcagatgctgggtaccgcactatttgatcccgaagccgtcgaatctgggttgccgcagcaggcagaagggttaggttggcttgctctatccacgacctttttaaaggaaaagcaaaccgtacgcgtacagggaaccctgtctaatcattgcccgcttttgcttagcaccgcgactgattcaggttctgcctgcaagccaagcattgaaggttatgaaatacatatgggcgttacggagtatgttacggaaccatgcgcacctacagataaaactttaaacctaagcgaaatgaaaaggttattctatatccggcgtggcgaaggaacagcttttgaggaaggctggggtacaacagacggtaaagtatggggaacctatttgcacggtgtgtttgataatgaccgttttcgccggtgctggctggatggattgcgacaagccaagggcttggcacctttagagagcacttttactgtacgtgaagccaaggaacgagagtttgaccgtgtcgcagaggtggtccgggctcatttagatatggagcgaatttatcgtattatgggaatggattcataaacttcatggatgattattaaaatcgcttttaaaaaataaagaggtatctctacagccattttcaagactgagagatacctctttgtattgtatcggcttacgtaattttaaatttttggacagccttttgcagttcggttgcttgtttgcttaattggcgaacaacctcgctgtggctttccatttcattcagttgctcatcggcatttaaaccgatttcttgaatcatatgctgtgcattggctgcgatgagagctgtctcttccacggaagcagatacttcctccgagctggcggatacctgctccgttgctgcagagaccgtttgaatcgtagcattgatcttttgcataagctcacttagctggttaaaggctgagctcgcttgttgaaccatttccgttcccgaatgaatttcacggctcacctgggtcacagagtccacagattgttgcgatacttcttgaatggtaaccaaatagtcggaaatttcttgtgtggcttctttagattgctcggcaagcttgcgtacttctccggctactacggcaaatccccgtccatgttcgcccgcacgggcagcttcaatggaggcattcagggacaacatttgaatttgcttcgtaatatcgaaaatagccgaaacgatactgccaatggcttctgagcgctcattcatactatggatgtatcgaagcgattcatcggcagcatgtcctacctgtgacatttgagctacagccttttgagcgagcgtattaccgttaactgtttcttttgtcgcttcactgatttgatcggatacatcattggcagaggaggcgatgtgctgaacaccttgagcgatttcctccatagcctgtgcattttcagcagcagctgtagctatgctggtactgccctttgctacttcctctgcggcaactgtagagtcctgcacttttacactcatagcctcagtccgacgaagtagctcgtccgatccttcaacaaccgcaccggatgtagaaagcacatggccgatcatttctttcaagttatgagacatggattggaagctgcgggcaagttgggcaatttcattaactccatgaaccttcgcttcttgtgaaagatcaccttgagcaattttttcgctatgacgaaccaattcagcaatgggttctacaactttacgtatcacgagggtagaaataattccgcccagcaggagcgttgccactgtaatacctatgcaaatccatagaatttgttgggatttttcctgtacaaatccgacgtcttcgttcacacccagaactagattactacctgatatagcaaagaaggcggttttgtgtactccgtatgaatcgctgtaaatttcactgatattcatctcgccttgttttgcttttttaatatcctcaacaggaatgagtgcatccttgaccttgtatactgattttacattccgtgcgacgacttcggctttatcatccttcactaccgcgatatatgccgattctaatttgagggtatcgaccttgtcctgaagataggattccatctgtatagcggagccggaatcagaaccgcttccttgcccagcctgaacagctaaggaaatattgagatcctgatacacatttttagctccaatttctagcaattggtctacctgaggcatgacactgttattaatgatactcatggatattgcatagaaactgatgctgaacaaaagggacgcaaagagctgaatcagcaaaaacataattcgtaatttcgcgccaatggaacgattaaaactcttcatgaaaaatctcctctcacatgatggtaataaaatcagacgaattccctgcttgaagtaggccgcttgtccaatagatacttgacacgccatgatctacttgtgttcctttccttgcttgaagaaaagactgaaaatgttcggattctatgtatatttcagctgaattcaagggacaagaatgtgaaagggaagtaatccatgatttactaaaaagtaggttagacctattttacataattaacagacggttgaatagtcatatttgcccaaaaacaaacaaaaaatatataactatggtcttaggtgtttagatgtaagttaggtgtgaattatcagatgcataaaaacgaatagattactccttctttaaaactattgtaaaaaagaagtaatataagtagcataaggaataccgcttttttacaatattcttctaagcttggtttgtaagttcgaaagtggtcttcaatatacatataaaaggggaaacggttgttatgaatcgggatttactttccaaagaagtgatttcgcaggtcagaggagaagatacacaggagctgacttccggcagttatagagctgcgacagggagaaatccgataagtcgactattagattatgtatcaggcgtatttactccgatcttgccggcaatgattggtgcgggaatgatcaaagtaattatattagttttaatgtccttcggtttattgttgtctgatccgcaggtatatactattttaatggctatcagcgatgggatattttattttttacctatttttgttgcggcaagtgcggcaagaaggctgagcagcaatgtgtttgttgcggcagccatcgcagcatccgtattccatcctcaattaacaagtttactccagtctggtgaggaggtacgttttgccggtctgccagttatagacccacaagctgcttcatctatagtactcatacttgttgttgtctggatagcatcgtatgtcgaaaaatggttaaacaggtatatcccttattcacttaaattaatggttgtcccgactttgacactgatgatcactatacctttaatggtgttcgctttcgggccactgtggagttatctcggccaacatgtatccgatggactaggctggttgtttgacaatgcagaagtatttacagggttgttgctcggaggcacgatgtctttgcttattattgcaggtatgcaatatataatgctgccgattatgatcagctcgcttacaacattgggttatgatcacctttttcccgtggtcattgcagcggctttcgctcaggctggcgcaacatttggcgtatgtgttaaatccaaaaatgccaaagtcaaaacgctggctgcgtccacaggtttgttggccatgctgggaatcattgaaccggccatgtatggtgtcaatatccgtttcaaaaaaccgttaatagcagttatgatcggtggagccgttggtggggcttgtatgtgtctgtttgaaacggagcttactagtattggtgtctctgctgggctgttcagtttgcctttattttctgaacccacgcttgtgtacggtattgtgggtatgctgatttcgtttgttacggctggcgtaattacgtattttgtgggctttgtggatgaaaaagacgagcattcgcaaggagtatctacatctggcatgaatgcttctccgaactcggttgtggaaaagagccccggcagctaagttgaatacatgtcgttctgttcaggacaaaaaaacagcaagccctcgaaagatgaaggcttgctgtttggcgttttcgataaaatccaaatttgaagctgcttaactattttattgttagaaaacctacaaaaatagttggttttgtgatatagtattcttcggattgaaggatcaccttataaaacatattaagtataagtttggaggaaataatacatggataccttctttattattttaaatgtaatcgtgctgcttttgctgctaggcgtattggtctggatgcagaaaaagcacatctcctttacaaaaagggtatttgccggacttggcttcggactgatctacggggctattctacaatatgcttatggcgcaggatcagaggtcattacaaaatcggttgattggttcaacctcgcaggtaacggttatgtccgtttgctgcaaatggtcgttattccgcttatcatggtgtcgattatttcggctattatgaatttaaagggaagacagaaccttggcaaaatcagcgtgtccattattgcagtactactgattacaacggcaattgctgcttcagttagtattgtaaccagcctgtcgtttgacctaaaggcaattgagattcaaggtggggaaaaggaacaagcacagggcttgaagatggaagagcgccttggaacagttcaggacatgaccattccacagcaggtgctggaatttattccttcaaatccttttgaggatatgacgggagcacgtcgtacgtcgacgctggcggtggttattttctcggcttttatcggggtggctgtactcggattggatcgtaaaaaaccggaacaggcgcaaaccttccgtaaagtgattgatgcagtgtacgctgtagtgatgcgaattgtaactctggtgctgagattgactccttacggtattttagcactgatcactaaagtagtagctacgaccaatccagatgaaattttgaagctaatcaagtttgtgctcgcttcttatgtggctctgttggtcatgtttatcattcatcttattttgctggccttgttcggctacaatccggtgacgtatgtgaaaaaggtattgcctacactggtttttgcttttacttctcgttccagtgcggcgaccattccgttaaatgttgaaacacaaacgaaaaagcttggtgtgtccgacggcatcgcgaatctgtctgcgaccttgggagcgactattgggcaaaacggctgtgctggtatttatccggcaatgctggcggttatgattgctccaaccgtgggtattgatccaacgagctgggattttatcctcacgctgattctggtcgttacggtcagctcgttcggcgtggcgggtgtaggcggtggtgccactttcgcttccctgatcgtgctttccaccatgaatcttccagtggcattggcaggattgctcatctcagtcgaaccgttgattgatatgggacgcacagcgttaaatgtcaatgattctattactgcaggtctcatttcaggcaaggtgctcaaggagaacgatcaagacgtattcaataatcatggtatggatttggatgcaacggcacactcttaagtaatgataaatgaagggtgtacgatcagtctcatatcacatctgtagcctatataacacacgtactgtatgtacgctgtacaaagagccggccataaggtcggctctttgtattgagtttagggcagtgtaaattatggctgttcacaaatcctaatctatgatacattaaaataatgtttttccggcttgcttcggatgaaccgcggttcgcaaccatcccgcgctatcaaaactaggaggatttcatgtttaatctgttatggggggcagcttttgtcctcgtcaattttatgttctttttgttatgttttcggttgttcggtaaaaaagggctgtacgcctggattggtgttgctactgtactagccaacattcaggtaaccaaaacgattgatctggtcggcattaccacgacattgggaaatacgatgtatgtttctatgtatatggccagcgacttactgaatgaaaaatatgggcctaaagaagcgcgtaaagctgtgtggttcggctttttcactctgattatgacgacgataacgatgcagatggtgctgcagttccagcctactgcaacggattttgcccagacaccgatgcaacagctgttcggattgttgccaagacttgcgcttgccagcttgacagcctatgcggtcagtcaattgctggacgtgcgtctgtacgcctggattcgcaagttcttcccggaacgtcatcagctctggattcgcggcaatggcagcacgatgatcagctcgtttatagatacgctcattttctgtactattgccttttacggttatgcgtgggggatatggctcgagatattattcaccacctacatcttaaaatttgtactgaccgcggcgggtacacccattttgtacatcgcacgcaatttccgctttatagaagaggaggggcaaaccctcaagccatgatggcttggggttgcccctcctttttttcatccttttttacataccaatataatgaatagcgatggatttatccgagcactgtcagttcttttggaaaagaggtaagcacttcaacaccattagaggtgaccaaaacgtcatcttcaatccgcacaccgccgaggcctggcacatagatgccgggttcgatggtgaacacgaagccttcatgaagcagatcgctattgcctccgtgtacagatggatattcgtgaacactcataccaaggccgtgtccaactcgatggttaaaggcagggccgtatccagcggcttcaacaacagcccgtgctgcctgatctacggatgcgcaggaaactcccgggcgaatggcggcaattcccgcttcgttggagcgaagaaccgtattataaatcgtttccagctcagccgtcagctttccaaaagcaaaagtacgcgtaatatccgaagcatagccatcggaatatacgcccatatcaaacatgagcagatcaccaggctgtagcttgcgggtgcccggaacaccatgaggcaaggctgttttgggtccagacagcactgtcgtgtcaaaggacgggccatctgcgccgatttttttcatctgatattcgatttcggccaccagctcgacttccgtcactccttcgcgcacatgggtgaggccgtggcgaagagcatcttccaccaaacgagctgcatgtttcagacgttgtacttcctcaggagtttttctcacacgcatttcttgaagcacaggacccagatccacatattgaaccgcgccaatagcagtatgtaactgttcataacggaggacggagacgtgctccttttccagcgcgaatgttttcactccggtgcctgtacgttgacgcaacagatcatatggattgtccgtatcggtgtgggtggatatacgagtcacagaagaagcagcttgggcggcttctgcatccagggcgggtacgatcagttctggttcttggtctcgaagcagcacgaggccaagaaaacgctcatgcggatcactggcaaagcccgtcaagtagtaaatatgtttgggatcggtcacaagcaggccatcccaagattgtgatttcagttcatcatataatcttgtgattttatcattcatagagtctcattcctttctgtccatgtattcattatagctcttattacatcataatttatagctttgaatggcttactctcttgcctgacttaatgtttgcagacgtgcttgtacgttctgatcatagtagccgccatggtagcagattaccttttcaacatccaataccgtcagcttttcgaggctcttcagagccaatggcatatccggcgtagccgactcagcgggaccgaccagttcaccttcgactaccagcagttcatctgctgccaataatagcttttgtgcgggcacatacaagctgatatgcccgggcgtgtgaccgggtgtatgaataatctgtatgcccccaccataaggcagatgctcaccgtcctcaagaatatgagcaaagcgcaaatctggcaggcggcgaatcatatcctctgcttgctgcttgagcacagtatccatttgtttaatccgttccgacgtcagcttcacaaacggtcgctctcctgtcatgtaaggaacgtcatccttatgggctaacagggcagtattcggcagcagatccagcagtgcatgaacatttccgatatggtcaatatcctgatgtgttaaaataattcttttcacgcggctgatatcctcacccacatctgagatagccttgcgtaatggctccaattggccgagcattcccgtgtcaatcagtgtaagtccatcctcgtccttgagcagtacaggataaatagtcgtttttccaaaaaaagattccataggtatttccaaaatcaagagttgagttccaatattcatattaagctgcttcagaatccttgactccgaaacatacctcccgtctcatcgtgttaaatcgctttccccgtttttatttttccttatcttcaagctctattataaaaccctttgggactaatccgcaaaacaactcgatatggctgatcgggcgcttgtcttgtacaataaataaatcacaccataggaggcggatacgaataatgaatcaggaccaatctttttccattgaatttgcgtgtagagaggatcttcccgatattgtggatatttataattctacgattgcaggacgaatggtcaccgcagatctggaaccggtgacagtggagagccgcattccatggtttgaggctcatcaggagaaccaccgccctttgtgggttttaaagcaaaagggaaccattgccggttgggccagccttcagtccttttatgggcgtccagcttataacggtacagcagaaattagcatttacgtccatgaggattctcgtggaaccggaacaggaagtcgactggtacagcacttgctaaatgaatgtccgagactggggattacaacgttgttgggatttgtttttggtcataatgagccaagtattgggctgctgcggaagtttggttttgagcaatggggatactatccgcgtgtagctgtgctggacagcatagagcgagatttggcgatattgggcaagcgagtggatgaataatagtttatgacagttaaatatttttttgtaatgtgtacagaaaaaggctgtttccaaaatcgtctctacactgcggatgattttgggagcagcctcttttattttgctattttcatcgcttttaacgctgaggtctaaaacgtatgttgtgaaaaatttgattaagcacctcagagagcaccaaaccgacagcaatagctcctgcgatcatcagcgtgctcagggccagctccagtgcctgaggataatgttgttgtacgaactggcgcatggcattataggccattccccctggaacgagcggaatcatgcctgctacgctgaaaataatcacaggcattttgtacagccgcgcaaagccttgactgacgatgccgatgaggatcgttgctaaaaggctggcgctcacaggtcccatgctgtccgtggttgaataatagaccagccaacctagcataccaacaaaaccacattgcagcagcgagcgccggggggcgtggaaaagtatgccgaaaccagcggtggcaataaagcttgtgaataattgtgcaagcatagacttgaatctcctccgaatcacatataagaaatgataaccgcaacgccagctccaatgccgaaagacgtcaggcaagcatcggctcccttggaaagacccgaaacaaggtgtccggacattaaatcacgaatggcatttgtaattaacaagcctggaaccagtggcatgacggagccaattataattttatccatcatctgtccccagcctactatcgttaacagagccgctagcaagccgattagaaaagatgcagaaaactctgagaaaaacttgaccttaacgagcctgtgaaaatactgtacggctgcaaatccgataccgccgcataacacagctgcggggaagtctcgccagacaccaccaaacataatcataaagcaaccgctggccaacgcagcagccatcagctgtacacggttggaatagcggagggggccacgctcaatctccgcaagctccttgacggcagcgcggggagacaaatcacctgtgctgattttacgtgaaatggaattgacctctgtcaccttgtgcaaatcggtggtccgctctacgatgcggatgagcttggcaggctccgaatcattaatggcaaaaaaaatcccagttggtgttacatagctatgggactgagatatgccataggctgaagcaatgcgggacatcgtgtcttcaacacgataggtttcggctccattttgcatcatcagtttgcccgccaacagacaaacttcaatgatttcaggagtaggataggaatgattattcatactcgctctctttcattcgtaccgggccgttcgaccctattattttcatttattgtagcacaaaaagccgccttttcagaggcggttatgttagggggaatcgaagttttcgtcaagattctatcatatcgggaataacggtatagtaggactcttccagatatgttgcggcctcagataggcccatcaacttaagctgtccagctacaaaagcacgaagggcagaatgggtgaacagatgccgtgtctgggcatcccgaataaaggccagtctggcttcacgcgaaccgttatagaacaattcacgcacagcttcgccttgttgttcccaaaggaaaggctccgttacggtcaagagggtactttccatagaagagctatgcttcgcggaagaagatacctgaatgcccaagccgttcagcgtaggagctgcttcattgtgcttccgttctgctcgcaagctgtcgatataggcagccatatcctgaatcggttcgataccaaatcgttcccgaaagcattcgcgtacaaacgcggtacgttcatctacaagctgaggcagtcgctgacctgcatgtccagaatagtcgtctccgctggcgtagtatcgttttaatgaactgttctctgtataaacaacgcttaaaaaatcctgcaaatgacgggcaaccacccatacacccgtccaatcgacgggagatacgcatacgataggggcctgtgaaaggtccttttcaagaccaaaatccgttaaaaagccataatgtattccgtccactcctgcgtgggcaaaaggaataacatctggtggtgtagccatatatcgtggcgcgcggccctgctccataatcaatcccaaatcaaaactcagagaatgccggttcgcttcgagctccttttcaaattctataagtgcctcaatcaaaggtgtagctgatccataggctaggttagaaccggaatccatcgtgtatgcctcccttatccaatacatccattaaagcgttcatccctaaaaggtacgtgattttacacgaaatgtaaacctgtatgacgaatattttcaaaaatgtgaccttttacccgtgtgttgtcaaataaaacgctttcgagcaaagcaggacaagatacctatgttagctcggtagagaagtaaagtgggtttgcgaaaatacggtcttttcagtgtatgttagcaaccgtgaagtgtgattgcaggatgcgcggtgtgaaggacagggtgcaacgtaacaggccaacgggtataatatcaggacaaggtgaaaaggagcgtcatccgaagatttaacagaaagaagtgggcatatgaacttgcaaaagaaggctgttttttttgatgtagatgatacgatgtacgatcatttgcaccctacacgcgatgcattgcgtacagtattaggattgagtgagcgttttccttatgagaaagcctaccatcgtattcgctattacagcgatgtactgtcggctaaaggaggactattggaggggaaggcagggccggatgaactggatgagatgagggaaggccgtttcattctggctttacaagaattcggggtagaaattacccgtgagcaggcagtacatgttcaggaagaatacttggatcgtcagtaccgaattgagccttttgagggggctacctcgttaataaatgatttgagctcggctggctttttagttggattaattacaaacggtcttgaagaacaccagatgagcaagatcaaggcgatggcgttggaaaatcatgttgcggcagagcatatctttgtatctgggaccgttggctatgccaagcctgatccgcgcatcttcgaagtagtgaatgagcggacaggaacgttagcagagcattgctgctacattggggattcctggcgtaatgacgtggcgggagctatagctgcaaattggcaggtgatctggttcaatcacaggaatgctcccccggaaactgatgtgctgggggactataaaacagcagcaagctatgcagagttaagaaggttgctgctgccggacgctcgttagacacggtacataccgtattttttaaaagaatcaacctattttgaagccattccaaaagataacccgtaatactatttatctgttatagaactaacttcattggtaaaggtttagaacagagaaggaggggatcgcgcatggtagaacaatggagacaggcagaagacatcataagtcaagtgaccgtatacagtacggaggataatgatccggttaccattaaaacagccactcaagacgtccgctgtattggcatcgggacagatgcggccgtatttacgctcgatacgttgccaggctacgcgttcaaggtgtactcagacatggcgatcgagaaaaaagatgcggaggccgacgtatatgagcgtttgcgagggtctgacttttttcctcattattacggaaaaggcgacaagtatattgtcataagttatgaatccggtattacgctgctggattgtttgctgcaaggaattcctgtgccagagcaggtcattctggatgtggaaaaggcgagggaatttgtccggtccaaggggctgaatccccgtgatattcacctcaagaatgtacttatgcaagacgggcgtgccaaggtattggacgtgtcggaatacgtgaaggaaggcgatgacaagcgctgggagcatttggtgtgggcatatcatacgttttattccggtatctcggaggttaaggttccctcatggattttggatacgattaaaaaatggtactacaagctggataactccaactttaatctggaggagtttgctcagcgtgccagtcaattgttctctaaatggaggtcataaccgctgtaaagataacggatatgaagcttgatctctcgatagcaaaaaggattgcacccgcatttaggggagcaatccttttcttttatctgaaatcccgaggcactcttctggctgtaccgctcgcaattgcggcttgaattaccttttcacgtacccgttgaaccgcactctcgttaaatacacctgggataatatacaacttgtttagttcttcaggacggatcgtgcctgcgatggcctctgcggccgccagcttcatctcttcgttgatttcacgagcacggcagtcgagcgccgctcgaaagatgccagggaaacaaagcacattgttaatttggttaggataatccgaacgtccggtggcgatgacacctgcaatgtcctcgacgtcctctggcgcaatttcaggaaccgggttagccatagtgaacagcaccggggcttctttcatatgtttcacgtcttctcgttgcagtattccacctgccgacagaccgataaacacgtcagcgtccttcagaacctcggacagcgtgccagacagccgttcagggttggtatgctgcgcataccagttccacatcggatgctcgtatgtttcatcagctgtaagagccccatggcggtctacgccaatgatgttgacagcccctgcagatagcaaaattttggtgcaagccacacccgcagccccgataccacagacgacaattttgacgtcagacagggctttgccgacaactttgagcgcattgatcagccctgcgtataaaacgacagctgtgccgtgctgatcgtcatgaaaaacaggtatgtccagctctttacgtaaccgctgttcaatctcaaagcatcgtggcgatgaaatatcctccagattaataccgccaaaagctggggccatttgcttaatggccttaatgatctcttcggtgtcctgcgtatccagacagattggaaaggcatcgacggagccgagctgcttgaacagcatagctttgccttccataaccggcatggctgcatagggaccgatgttacctagcccgaggacagcgcttccgtcagagacgacagcgaccgtgttgcgcttgatcgtcaaacggaaagctttgtcgggttcctcgtgaatcgccatgcatacgcgtgccacatcgggggtatatacccgggataagtcatcgcggttttgaattgggactttgggctgcatttcaattttgcccccgaggtgtaataggaaggtacgatcagagatggataatactttaacaccttgtgcttttttaattcgggcaatcatacggtcgatttctgctggatcggcaatggtcaccgtaatatccctcacggtgaccttctcagaggtgctaatgacgtcaatggcaatcacatctccgccatgttcgtttaccagcgtaatcaattgaccaaattggatgtgcccggtggaaatttccaatcgtaaaatgatgtttttaccgccaataccgccttgcatacaaattcctcctttgttttccataacaaaatcatacgtaggatcaattgattgcgcttacaataagaagcggatgtaaaatccatgctgttattttaaattagtggtttcttcccctatcatagtgaacaatctctcgcttgtacagatcaagttgagtaatatctattattttgtatttaacaaaggacgaaagcccggctatattccagtccaagcgatcatccttttttcaatgaaatgatctattttatttttacgcattcgatctgttacgtcatatttttaccgtagtaaatttcgtccatttcgattttgagacgtgttgatatattttgttgctctttttcactcaggctttccttggtgtagccgaacaggtaattgtccagatcgaattgttttagcttacatttggtatggaaaatattttcctgatacacattcacgtcgatcatgtcatactgactgcgcacttcgtccggaatatagttttgaatggaggcgatatcatggtcgatgaaaagcttatgtccattcgtatcacgtgtgaagccgcgcacccgataatcaatcgtcataatgtcggtgtcgaaagaatgagtcaaatagtggagtgccttgagcggggagatttccccacaggtagagacatcaatatctgctcgaaacgtactgatcccctcgtctggatgatattctgggtaggtgtgaaccgtaatgtggcttttatccagctgtatcacgacagattcaggtagggggccgggtgactcggcataagattcagtcggtacctccacaatgggtccttcggatataagtacggtcacgctggctccttgaggtacataatcctgctgggctacgttgagcacgtgggcgccgataatgtcagatacattttttaaaatagctgtcagtcgatctgagttgtattgttcatcaatatattcaatatacgcctcgcgttcttctttggttttggtgtaacaaatatcgtacatgttgaagctcaatgatttggtcaggttgttaaatccgtgcagggtaatccgctgttccggtgttatggtcataggctatttccccttatagtcgcagtattcgtacataatattcccaacacgccttttcatataccgattcataaaatcagttttgtaactgttagattaaaggcttaaacaagtatgtcttacccgtttggcataattaaaaacaggtaggggaggggctttgtttttacatgtatggaaattttaatgtatatatattttatttcttactcagcaatttttaagtaacaggacttataatgtggactatgcatacgaagaaggaactgaatggacagaggagtcgtagtaagacataagaaccgggtagtaattcattaattcattaatttaatgtgtttcaccttcacaatgccgaaagcttaaccgaatatgattatagacccaaaaaaatagtgattttgtatattgcgaaaatcgagaaaagcaacttcagctaataatatgcgtataatgaaataaacgtaagaagctgagaattatgaagttaaaatgaattttgatagcaaaattcattttataaaccgatcgcatgttactatcaggattttacaaaattcgattccagtcgctccgaatttgtaagttatagacgaactaaaccatttcgatctatatcttgttcattggagtttgcttattggatttttgcaaaatcctctactgtaagaaaaacggtggaaggagtatcaagatgctggctttgtccgatccggcctggactctgctccaaggcccctacggttcctctcaatacgtcccaaaaatgttgaaacagctccaagccggatatgacggcgaaatggctgacaccttgtattgggaggaactgtatcaccaaaatacattgtatacttgtacatttgcggctgttccttaccttgtagacattgcgttaaaaagttctgatatagggattcgtgcagatatctataacatttgcggaatattcgaagcgaagaataacaatcccttacataccaaaattccattggaatttacaagggatcaggtgaaagtggattctaatgtggctgaatatatttatgcgcaatatcggtgtgccattgtccgacttgcagaattgactgaagaaatggtgctctatgcgaaagaacacgaaggagatgtaggtaaacgctatgttctggctgcgggtgccgcttttcagggatatcgctgtatagcttatatgctacaaagcttcgatacaggtgacgaatatacgctggattgtccgcattgcggtaccccgctctatatttggcctgatgaacagaatgacaccctggttgtctatgataaggaccctgtaaattcagacaatctggttccccatccgatccgcccccgttcattggaccataaaggtgctaatatacagtggttacacgaatatgcccagaaaattgaagagaacaagcttcttgctcaattaccctatttaatcggttggctagattgtccagtgtgtaatacgcccatatatatatgggatgagttgatgaaaatggctgatggtattcgaaggtataccgcttaatcaatcaaaaaaagggtgctgttttctacagccccctcatttcctcttctatttttccacttaatctccgtatgctttgctcaattctactcccgaaacggattcaaaaaagttttaggaatatcggattcaaaacgcagcaatactccggtgacgggatgaataaatgacaataccctcgcatgtaggccaaggcgcccaatcgacttggatttggaaccgtattttttatctccaacaattggatgaccgatatcctccatatgtacgcggatttgatttttgcgtccggtttccaaacgtacttccagcaaagaaaaatgacgattggcttgaagcagcttgtaatgagtgactgcgtgctgtccgtcattcggataaggactggaatacatttttagcgtcttgctttctttcagccatgaggtgattgtaccctcagcttttttaacctgtccttctacaagagcaatgtatgttcgttcatacacaacttccttccacgctttttgcatttcctgctgtatggcttcgctttttgcaaacatcatcactcctgatgtatcacgatccaaacgatgcagtacaaaaatacgattgtacggatgttcgcgcctcacatgggccgtaagctggcgataggctgttacttcctgctcctgcgctgaagccacggacagcaacccggcatccttatggataacgataatggcttcatcctcatgcaagatacgtagcccagtcagtggtacgacgggagttactttttccttggaaagcgcgacagtctgaccttgctccagtggaaaattgtgcacggtacgcggaatgccgttgacggacacctgcccacgagccagtgctgatttaatggagttacgacccatgccagtcacatgctctactaaaaagcttaacagctcggcaggctcctggacgatgtatgttttggcaggggctttatcaaaagcattcgttctccgttgagcttccggtctatgggagccagatcttccggcaggtttatgactgcgtttggaatggcttgcgtttgacgtagattttgtatgatttttccgttggggtttccgattgttcatgggttctttctccttcttggaaccgtgtctcttcataattatggacaaatttgcggcaccgtgttcactatatcatgagaaaacagcgaacgccataagggactaaaccagattggcagtcttctagcggttgaacattaccctgaaccccggtaaactaaaggtaacgaaagaaaagccgatatgcgtcaaggacgctagaaatatgaggagttttgaaactatgagtgtacaagcaccaacattggaacgggcgcaggacttgctgcaaaaattttatggctatcccgatttccgggagggacaaaagaaaattgtggccagtatgctggagggcaacgatacgttgggcatcatgccgacagggggcggaaaatcgatatgctaccagatccccgcgttgttgcatgaggggctgaccattgtcgtgtcaccgctcatctcgctgatgaaggaccaggtggatgcgctgaccaccatggggattgctgctgcctacatcaatagtacgttgagtggtcgagaagtgaatgatcgcatacgagccgcacggaatggtgacttgaagttactatatgtcgcaccggaacgactggaactggactggtttcgcgatgaaatggctcagttgccaatttcctgcgttgcggtagatgaggctcactgcgtatcccagtggggccatgatttccgtaccagctacctggctgtggctccattcgtggacgggctgtatgaacgcccaatcgtggcggcgtttacggcaacggcgacaccgcaggtcatggatgatatcgtgcgcctgcttcgtctgcgctcaccggagacgttcgttacaggccttggacggcccaatttggcgttcagtgtgctgcgtggggaagacaaacgcagctttttactgaattatacccgtgagcatgagggtgaatcgggcattatttatgcggcgacacgtaaggacgtggacgatttgtaccaacggctacgtgacgcaggcatggcggctggacgctatcatgccgggatgacagatcaggaacgtgcagatagccaggaagggtttctgtacgacgatatccgtgtcattgtagcaaccaatgcctttggcatggggatagataaatcgaacgtacgctatgtcattcactacaacatgcctaaaaatatggaggcttacgtacaagaggcggggcgcgcaggacgtgatggcgacccaagtcaatgtattttactgttcggaccgcaagatattgtgacgcagaagtttctgattgagcaaaatccacaggatgaagaccgcaagcgcaacgactaccgcaaactccagcagatggttgattattgctacacgactcgttgtctacgtacggcacagcttgagtattttggagaagcgaaggagcatgaagcttgcggcatatgcagttcatgtacagatgaacgggaattggttgatatgaccatagatgcgcaaaagattttttcgtgcattcatcgcatgcgggaacgttatggggtctcgatggtcgcttcggtgttgaaaggatcgcgtaacaaaaaagtgctgcaatatggttttgacagcctgccaacctatggcgtgatgggcaaccggacggaaaaagaaattgccgaaattatcaatgtccttgtttcggaaggctatctaatgttgtccgagggacaatatccggtcgtacgcttgcagcagcttgcggctgaggtgctgaaaggccagcgagaagtcatgcagcgtgtggtgcgacatgccacggcttttgcaggtggagcaggttcacgcggacgacagggacgcgatgcatacccggctgcagtcaacgaaaccgtgttcgagcaattgcgcctgattcgccgtgatctggccgctcaggagcatgtaccgtcttatatcattttcaatgatgcaacgctgcgtgagatgagcgtagcgagcccgcaatccgaggcagacatgttgcggatcaagggtgtcggcgaagtaaagttccgcaagtacggcaagccgtttcttgattttttccaaaatcaggggagtatcgggggaacggtaagcgaggaagagatttatgcagacgatgtgtacgaggattttgaatagctatactaaggtaaggggatataacagttcatgcaaactatagaaggttgtgacctatgaaagtcattttatcaacgttaaatgcaaaatatattcatacctcgctggccattcgatgcctcaaagcctacagtgaaaaggactttgatatcgagttggcggagtacacgattaaggacccggtgatgaacatcgtatccgatttgtttcaacgcggggcagatgtcatcggcttttcttgttatatttggaacattgaagagacgatcaaagtcattgatgtgttgaaaaagattatgcccgaggtcaaaattgttctgggtggtccagaggtatcctacgatacggatcactggatgaagcgcttggcgaatgtggattttatcgtggttggtgaaggagaggaaaccttccatcaactgctgcaggagttggaaggggatggcaagttccattttgtgtatggactggcttaccgtaagggagaagaggttattcagatgcccggtcgcccgaaagcggacttgaacgagctaccgtcgccctatcgttttgcagaggatataccggaacttgggaaacgggttgtttattttgaaacgagccgaggctgtccgttcagttgccagttttgtctgtcgagcatcgaagttggggtgcgctattacgatatcgagcgtacaaagtcggatattctgtatctgatcgacaatggagccaacctaattaagttcgtggatcggacgtttaatattaaacgcgattatgcgctggaaatgttcaaatttttgattgaaaatcaccgtggttgtgtcttccagtttgagattacggcagatattatgcgtcccgaggtgttggattatttggcggaaaacgcgccaccgggcgtatttcgttttgaaatcggcgtccaatcaacgaatgatcctaccaatgagttggttaagcgtcgccaaaactttaccaaactttcccgtactgttaccaaggtcaaacaaagtggtaaaatcgaccagcatttggatttgattgccggattgcctttggaggactacaacacattccgtaaaacgtttaatgacgtttttgcgctcggcccggaagagcttcaacttggcttcctcaaaatgctgcgtggcaccggactgcgtatcgacgcagacaagtataactatacgtatatggatgttgcgccgtatgaaatgttgagcaatgacgtcctttcctttgccgatatcgtccggctcaagcgcttggaagatgtattggaaaaatactggaactctcatcgtatggatcatacagttaactatctgatcgagcgcgaattctcgtccgcctttgatttctttcaggaattcggagactactgggaaggacagggctggcaaaaaatcgggcatcagctcgaagacttgttcacgcgtctccagtcctttctagaatcgcgtggaacaaagcgaatggatatggtgcttggactgatgaagcttgattatttccttaaccataaatacaagccgcgtaaaatttggtgggagcataccttggagaagaatgattggtccagctatatgaaaatggttctccagcatccggatgcgctgttgtcacctgcggttacagattttgtggcagatgcgagcaaggagagtgcaggtgggatggatgtaggcagtcaacagccgcagccataccgcgagattattccagcctttgcttccttgaagctgagtgaaaaggaactgcaaaagcatgctgtgctggatgttctgccgttcagtttggatcatatcctaagtgggggtagcccattgacagccgaaggccgcaccctgctgcttgtagtctatcagcaaaatggacagcaaaaaccgctctactacgccatgccgatcggcaaaaatatcgccgccatttaaataaaaacgccagagggcatcgactttgatataccaagagtcggtgtctttttttgttttataaataaataggcgctcattccaaattttacattcgcataatctattgctttacgatgctttacaaaacaaatatatgattactttatcatatatgaatatcaaatttattggagtgtgaccttgtgaaaaagcgttcgatgaaaaagagtatccttgctttaggtgccattaccgttttgagtgcgccattgttatctgctaatatccctaacgcttttgcagcctcatctaataccaagtctactaccgcacaggtatccaaaggactgaaaacttcgtcagcgaaagtcgatgctcctaagaatgtcattctttttatcggcgatggtatgggagaagcaagtcgcaacgcgattcgcttggcgacggtagggaaatcgggattacttgaaatggacaacatgcctgtaaccggcctggttagtacaagttcaggggataacctggttacggattctgccgcggctgcaactgccattgcaacaggtgtgaaaacgtataacggcgcaatcggaatggatttgaataaaaaaccagtggcaacgattatggagctggctaaaaaagcaggcatgtctacaggtgtcgtgacgacaagccaagtgacagacgcaacgggggccgcctttggtgcgcatgtcgaaaaacgctccgctcaaagcgagattgccaagcagtatctggagaaaagcaaggtggatgttattctgggcggtggtgaggatttctggtaccctgccggaacagtaggcaaacatccagatgctccggcagaagatcctgaggaagctagtaagggaactcaagggaatttggtagaacaagcgaagaagctgggttatagctatgtgacggatcaggcaggaatgaaagcagccaaaggttctaagttgctagggctgttcgccaatgaagagatgtttcaagctcacaacaagctgggtaactcttacaacccaaccgtttctctaccggatatgacggctaaagcgattgatgttctttccaaaaaccaaaaaggttttttcctgatggtagaagaagaaggaacggatgagatggcgcatgacaatgaaggggagttaacgattaaggctgggcaacaacttgataaggccgttaaagtggctaaagagtatgccaaagcgcatccagatacattagtgttggtgacggcagatcatgaaacgggcggtttggcgattgaaggcgaagatgcggaggatgaatccggtgaaggcatttccaaagaggatggtccttttactgtaaaaggctccgatgagaagttttatatcgattggaccacgggtggacatacatctgttgatgtggcgttaaccgcgatgggacctgggtcttctcagtttagcgggaattatccgaatactgccattcatgacaagttagtaaagttgcttcaattaaagaagtaacatggtgtgaaaggaaagccgcccttaaaaagattttccatattggcaatatggtttttcctgtgataaactaaagctaataagtatatactgaaaaagagtaaggatgctgccaacatcctcactcttttacaacagccgcttataagggcggtggctgtagggttggattagaaaaatagaccgctaaccttttccagagggcggtctatttctttttgttgaaggaaagaatcaagatcaccaatgtcgcaaattgaatcatcaacatcaatgtatctttaacctccacaggcatcacctcctttgcaggagactagccgaccgcccatctaagccattctgttgttagtttatagtatatcatatggatagtattgctaaaaaggacaaaaatgaaaacgcctgtttctaggcgttttttgttttttcaaaagatatatttttaaagttgaaaattattatgtagttcttacccagtataggtgttacgtaactcatctaaaatttgcatagcatctttgaatccctgtaaatatatttggttctctagaatagattgtagagagatttgggcatcttcatataaaaacagggtatgttcgagatgctcgggaacggattcacggatttgttgaaaatactggttgctttccgtggaaaattggttgtattccgggatggttttagaaagattgctatacaatgtttctaatcggtttctgattatgggttcaactaatatttctaaagaattagacatgatttgcaaacctccggagggaaaatattttaatgtgtaatgacaaaatatcatgtaaatattgtatcattgcatagcgatttggtataccgaaaggtgacatcatagtgacgtcaaatcaataggaaatttcaataaatatcgaatatttcgtgaacattcttgattttacttaaaatgataagcaaaaaagaaagtgattgagtttacacaattgtttctttcgttttcttctatttctataaaatgatcttggatgttgatgatttatgcgtggatgagaataccgaaaacgagggatctcccaactattattgaccgcagctcagcaacatgtacactgacaggattcaagggaattgggtatcgataggaaagaataatatttcagtacaagagagtatgaaggaaatcaaaatatcaatgatgggggattttaccgttatgagctgatcctatagctctgtcctgtcatgtgaggaataaagtctatatgagctgaactgaaaaaatgtacatgcaaaacgtagtagacgaaagggtgctgtacaagcgaagcggtcgctttaaaagctttccgtaggaaagctcacttcggaagcatcacctccccggatttctactgttgaagactttatttcagatatccgggggcagtggcgatgggaagcaccatccgtctacgtatgttcataatataagcaaatttaaaagttatcttagtgccactcgtattctacctttactcctctgttgttttcttcccccatacaaatttcattataagaaatataattgtcagcatgatgagaagcaataccatctgcaagccataacgatggattagttctcctactgcttgtacatgatcgccaaagatacgtccgagtagaaagaagattagcgtccagatcaaacctgttgaataagagaagagggcatagcgtttgaaactcattttattgattccgacaatataagggataatgtgacggacgatcggcagcaaataactgatgcaaatagtgaaatttccatacttatgtatcaatttttccgaaaacgtaatgtacctgtccatttttttcttccgacgcaaacgttctagaatcggtgtgcccacggttctccccaatacataacctaaggacaagcctgatacaaccccaagatatacaattaaaaaagcgggtaacgggtgaagtatgcccatgcctgttacagccccgccagtcatcacgatgacttcatccgggatgggtagacccacaatccccagccatagagaaaagaataatgcggcatagccgtattgttcgatgatggaaattaaatattccacgtccatacccgtactcctttcttaggttttctttcgacatacatacacgaatgcgggtggaacattcattggcacaaacttgatttcttcaatatcaaaccattcacctaactgttgtttcatctgtttagagtattgaaaggccacaaacattcctccatccctgagcgatagatgaatttgttctacaatttgattccgcatcgcttgtggaaaattgaaaaatggcagcccgctgattatgcagtcaagctgttctatttgggcatttttcatagcaagctgaagctcacgcgagtcggaatagcacagataattcgggaatcttctttttaaactctgctgcatggtttggtctttctcaaagagtaaaaccttggggtgaaattcagcagcagacgggatgtattgggtaattgcccctgttccagcaccaagctcggcaacagcatgaacttcactccatggaatggattctatcatatttttagctaaaaatctggaacttggtgttacactacccacgtatgcaggcgagtacaaaaatttgactaggaacataagtctctcgtgaaccaaatggctaatacggatcatacgtcatttccctactttcaatttttaaaatacgttcatttattctttgctaagagtaacaaattatccctttacttactcctgtctcaagtagggttgatccccccgtcttgcggagggaatcttccttgactatggtctaggaaataataaaagggttacggtattaatgagtttgtatttattcagttatcattcagcataccctcaggttgcattcagatttgttaccgatgaaaggtaggtgggcagctaaaaacattatgtacactgagaggggatctactttgtcactatccattaacaggcatctcatcacgacttcctatgatcaatcgaatacggtgaagtcaaatgagaatggactaaataccgcgggtcataccacacacaagaaatctaacgattcactcgaattgagcaaggaattcatggaatacacgggaggaatgcaggctccgcttcctacggaaaactacagtaatgattacaagtacgatgaccaggataccattgcactaactacagacgaacagaaaacgctgttgtctgatctgcaaagttacctgatgtcttccagtgcttcctctgatacagatgaactcattaatagcaggaagaattcgttggcttcggttagagacttattagctgatgtggatatttcgacggcaacagatgaggaagtatcggatctattcgataagatagcagaaacgatccaaaataatcgtcctgcaccgacgcctgaaggtgacccgtcccatcctgaaatggatagcagtggtctgcctcctatgatgcaggcaatgggtggaattatgcctccattcgcatggaatatccaagagacttccaatcaagaggataacagcactacatctgaaaaagagcttacagtagatggaaaaaggtccttgctgagtgatttgcagagcattctgagttctagtcttatatccgggtcaacagcttcggacaaagatcaggaaacagatctgctttccgcattaaaagatgcatggggaaatacagatgaatcgaatgccatagcttagaaccggttagcccacacgtgtaaaactcatacttttataaaggggaaatctcgtatgaacatttcatccacatccagcagttcaatatctattgcaagcacatcatcatccagtaccaacgatacagctagtctggaaaagcaaaaagctcaacttgaagcggagtacaacaaggtacagcaaagtaaggataataaagatacaaaagaaacaaaaatgaagcagcttcagcaacaaattaaacagattgaagctcaaattgcacagcaaagttcgcaatccagcagtacgtcaactccaaaaatggaaaagcccgctccaagtaacacagaaacaactcgtatcaacagcgctaacagcagcgatattacgggagttgggaaatcactggatatttcaatttaatcattccatctcttctcctgtatgacagacgatgtataaacgatagcaggttctccgtttcataggggcctgcttttttcgtttactaaatattttgcatgaatccagggagcgactttaatcagcgatatttcgattagaataattctgtccatctaaattgaatcatgtgactaaacatagaaaagtatatacaatatataacagtaggaagatgaaagtattttaaccctattattttctatatttaaatcagtaagtgctagtaatcatttcaaattggaggatttatgccatgacgctggaacctcagatgaatcgaagtagtagagaggaagcgcgtttagtcaggaacaagttgattgagtttaatgcgaaacacgtcccagcagatattcgaacccgatacgaagagattaatcttacgctcaaagatgaagacggtcaggtcatgggcggtctcctaagtgtactatgttggaactgggtggaggttgatattttgtgggtagatcagcgttacagaggaaagggctacggttcacaactgcttggtgaaattgaacagattgctagagataaagagtgtaattttatacaacttaatacgtttacttttcaagcgcctaaattctatgaaaagcatgggtatgaagtcgttggtgtcattgacgatgctccgagaggctttaaacactattattataagaaaagtatctactgaggactctatatatgcgtgtacagatcaaggaaataaataaagatcagcatatcatcattcgtagtatgggcgaggaaaaagtatacggctactggacatatttttggcatgaactgacttccggatatgcgtatgttgtcccgtatgaacaaagcttgaataagatgattcccggttgtgtaatttcggtcgagacttctcaatccagtatagaggggttcagaaggctgaagtctactgaagagacagggatttttcgacctcaaccaaagctaggcgactattggattcaaggaacgatacatcaagtgatacagggcgaagcaggcgagatagaatgtctggagattgtagtaggagacactacgtttattgtggattctaaagaaataaatggtgatgtcaacgttaaagtgggtgaaggtgtcgcctttgaaatcataggtctgcagttgtttgacgagggactgtgatcgttctatggcgattgattggaaaagaggtgacacatgtctaatgattatagtaaatcgaaaacgttgggagcttttctgaaatcacgtagaaatcgacttcaaccagagcaggcaggccatagactttcacagggtcagcgaagaacaccggggcttcgccgagaagaagttgctatgctggcaggtgtcagtgcgacgtattacacatggctggaacaaggtagagaagtaacagcatctaaggaagttatcgaaagtataggagaagctctacaattaactcatgatgagagagcacatctaattcaattgtggaatcccaatgagacggttgctatttcgcccatccatacaacgctgaatccacagtggcaacatattattgatcagttgtcctatccttccttcatcagcaatgagaaagcggaagtgcttgcttggaatagcgcggcgaatgaggtcattaccgatttttcttccctgtctatttctgaacgtgtcatgattcgtttattgttcgtggattccgaattacgtcgtcgaatggttaactgggaagaatttgcgtcctattcggtagctgtttttagaacctattatgacaagtatttaggagatccttggtttgaggagacggtagaacggctacgtgtggaaagtatggagtttgacaccatgtggaagctgcatcatatccagctcaaaaaagtgaatcgggtttcctttcaaatccctggcgctgtggaggcagtttcctatgatattaattctttagcaagcattacggaccaaccgggtctgcacttttgtatctacacgccagtaagccaatcctctgcctggtaatcttgttactagtataaacgtactgtggttgcctccatatgggtccattagaatgagtacatgttcattccatccatttacccaaagaaaagagggaaccatgatatgctgaaaaggaaattgggacatgaagggctggaggtatcagctctgggccttggcacgatgatgatgccgaacaacgaggagtcggtgcgtacacttcagggagcgctggaccttggtgtaacgctgtttgatacagcagatctttatggtgaggaatacgcacagcagaagttcggcggcaatgagaagctggttggacgtgcgctcaagggtcgtcgggaggaggccgtgattgccactaaattcggaatcacgcacactcaggggcccaaaggagatccggcatatattaaaaaatccgtggacgccagtctatttcatctggggattgattatatcgacctgtattatcagcatcgagtcgatcccaatactccgattgaagagaccgtcggaacgatggccgatttggttaaggaagggaaaatccgttatatcggcttgtcggaagcgtcggctgaacagatccgccgcgcgcatgcggtgcatccaattagcgcggtagaaaccgaatattccttgtggagcagagaagtggaagatgatgttcttccgctactgaacgaattgggaatcggcttcgtaccctacagtccactgggtcgaggtttcctcacgggacagatcaagaaatttgacgatctaccagaggatgattaccgccgtcattttccacgcttccaaggagagaatttcaacaaaaatctagaagttgtcctcctgatcgaaaaactggctgcccaaaaaggctgtacttctgctcagttggggctggcatggctgctggcgcaaggcgaccatatcgttccgattccgggaacgaagagactggaaagagtgcgtgaaaatcttggtgctctacagatctccttgtcggaagcagagcttcaagagattgagcgcatttcgcctaaaggcttcgcagcaggttctcgttatccggggcgtgtctagaaaactgattattggcatgatggataagaccgttcctttctggagtcgcttggtagtaccaacggctttgcagaaaggcggtcttttttttactgattttgaccgacttaggcatgagttttctaatctagtctatggttagagttattgcgctctacaaaataacgagttaaagtatgagaaatgccatatttaaccacagtttgtcggtgtgaaagtaaagctagattatagcagatcgtgaataaagaaaggtatgatcggattgacaacagaagtgacccacaaaatatataccatgtgtatgattcaagacggaagcaaggtattgcttatgaatagacccaatcgaaaggggtttccgggttatattgctccaggaggaaaagtagagtttccagaaagcattgtgaatggggccattcgtgaagtaaaggaagaaacaggcttaaccgtgacggaaattgtatttaaaggaatcgacgaatattgtgatccaagtcaagggctgaggtatatggtctttaactatttggctacagccactgaaggtgaactattaaaaaatccccctgagggagaattgctgtgggtcgatatgaaggaggcgctaaatctgccgatgcaggattggtttaagcggagatttccattgtttttcgagccgggaacgtttgaggttagtttcgtttggctggcagatacggatgaaaccctggaagcaacgattaagagctatggtgtgtagagatgacgacgaccatttatttttcatctaatcggctaggcgaggtaacaaatgaccaaatgcaaaggatgctgaatcgttttgatttgggacgtttgctgtcttacgaaaaaacggcagaaggtgtcctagggcaaaccctctatgtttcctcaacggctgggaagtttgtgctgaaggggaacccgctttttctagggcaatggatagaagaaaagtttatggtggagcaaatacagacacggacttcaattcccgtgccaacaccgtatcttgtggatcatacggaggacatttttggctggagctatgcagttatgccccgtctatacggtcagcatatacatacacctgagttgcaagcaaagctgacctcgctggataaacagcaaatggctgaaatgcttgctaatgttctgttggagcttcatagctggaaggttaagaacagtggagagctggatacaacaactctagccattcgtccttttgaagtttcttatcgagtatggttgtatgggcgaattcgatattggctagaggatgccaaaaaatactcgaacatttctgtacaggatatcgaatgggtagaggaaatattggaaggctcccgtcaagcattcgatcagctggaagctgccacctttgtgatgggggattttaaaccgcaaaattttcttgtacagaatggggataagggttggagagtcagtggtctttttgattttacgacagcctattttggggatgggattgccgaccttccgaaaataaccaccatgtatctggagaatggtgaagaagagttggcaaaagggttctttactgcttacgcacaagggatggaagccaaagaaggatttactgagcgtttccgggtgcatatgctgcatcagcaggttctaaactggggatgtgccaaagcgatgaagcaagtcacttgggatgataagctcacttttgcagattgggcgcaaaagttcatagatattgaggtatatgagaaatagcagatgaattgggtgcttaatgagaggacagtgagtggaatgcagaccgtcagattggtaaagccggatcggggctggaaggatgcttatctttcattttatgaggaatggaaaaagagtcaggagcatatggtaccttgggtgatctctgtagagccgtacgattttgaaggtatgatgacggttttaagtaatcaggaaaatggaatgaacctgtctgaaggctgggtcaaaagctcaacatactggcttgtgaatgcgaatgaacaggttgtgggagcagtgaatatcagacatgaccttaacgaacacctaatgaatgccggaggtcatatcggttacggtatccgtccttctgcacgagggaacaggtacgctgtaactatgttggccttggcattggaaaaagcaaaagaactggggatttcccgagctctggtcgtatgtgactctgataatatcagctccaaaagaacgatcctgcgaacggcggaacgccggacaaggattacatagaggaagacggaaaccgtgtaaaccggttttggatcgaactgtgagtgagaaagaggggaacgcgagaagctcatgaaattatggcctgaatatgcacaaaacatcattgttggtgttatttttgaagggaaatggaattggtatgtgacggaaagagagtattggtttttgaataccgagatggaggaacggtttggcatcgctattttggatgaaaccacagcgggagcatttttggatcacatctgtgaatataaggtggctacaggggaactaacttcaatgcttcagttgctggatgaggctattcagcatcaggatgaattgttggagttctgtcctgctctgtatgttaactttgacgagaaagttctctattcgctatttcctgagccagcttcatttgaacactatgtcccagcggggtggaaaggggaatatcaaaactttttgaacgaggtaccttcacctgaacggtattggattataaatggaaaccatttttttgaatgattcatatgagaggagcgggtatttggacgagtatcaatggcgaagcttggcatatctgtcgacaggtaccccaacgcaaggaatatatcgcatatttatattgcaatggctccatccatatgatccagtattggtagggccggttccaattggcatccatgtagaaaggtagcgacttggatattatttgtgaagcacatgatattcagggattccaaaatgacgtacagatatggctcggaacatatccgggttttgaatcacgaacaaagtttgtgaatcaggtggagcgggtaaccgtcaactttaggtgtgatggatggcctgttgaggtttttggacaatcgatttccgtgacaagacaaaattgatttcgtcatatggttatcgaggaacaattgttaactctcggtgggaaacgtttaatggaaagtatcattcagttgaaaatcttgggatttaagacggaaccggcatttgctaagctactgggtttggatggcgatgcttacgaagcgctattgaaattagaagattggacagatgcagaactaaggaggctgttaagaatatggattcactaacagtagaggttttagataaaaaagtcaccttttcaggtaatggaatggaaagttccattaaagtattccgaaaaaggcgactctcctaaattggtttttaacaattaatccagtttccacattgaatttgctttttcataaagagctgtaatctctggttttaattcttgaatgagtatgttggtttgtttatcgttttgatcgacagattgcatctgttcatccagagataattcatatatgattccgtctttttgcaaccgtacaccaaattcatagcttccgtctattaaaggccaaatgattagagtttctctagcttcaggattattaatccccaagtttcctgtaaaacttagataatctgggcgcttaacgttgtatacgtacccatcttttttgataatgtgatttccaaatttactttttgggacagctttcaggaaatcatcgtatcgattattcgtcaatataaaccaaactacattccaaaccccgaataaaagcacaatgattaatcctataatcatccaagtttttgcatttaatttccgcataaatttatcaccctgttaccttgttttttgatttcttcatcgtgtgttaccaagataatggttttgccggcctgattaaacgtttttaaaatgtggagtacaacttctgcattttttttatcaagtgaacccgttggttcgtctgccaaaatgatatcacattttttcagcattaagcgtgccaaagcaatgcgttgttgctctccaccggagagggtgtatacttttttatttaatttatcttcaagacctacacttttaagcgcctctgatatggttaaatcggttttacaatctttccgaatcaattgtaaattttcttgtactgttttattgtcgaccaaagcgaagttttgaaataaaaatcctacttttgttcggaaatattgcaaatgattttttttgtttttaatgtctagaccgtcgataataatgttaccctctttgatattttcaatggctccaatcatattaagcaacgttgttttcccgcaaccactgggaccagagaaaatgacaaaatctcctgagtcaatctccagattcaaattggaaaatataagtttatctccaaatgatttgctaaggttctggatggagatcattacgtattgcctcctttcaaaattttttgaattttcagattttcaattcgacgaatataaaagaggatgactgtgagttccgagactaaaatcacaatccctccccaaattaaatagctggcagagtttagtccaaatccaaatgcagcgattattgctacgccgatactaattattgttgtaatcagtgtcatgccaataattttgcgatttttctcccaaacactgtaacctagcactttttttatagaaagttctattgcgtttacttcatattccaatttagtaatggatgaaataatcataaactctaaaagaagaactaatagactaaaaacactatttatatataatacctgtttggcaatattccaactatcgttatatttttgtagaacatttgttttggttaagcttgcattagtatccgttaactgattttcttgcacgaatcgtttaaattcctcatctgtgatgtcatacattatttctgtcaggtaaacggctctatttggttcgtatttaagtgattgtgtttccggggacacattgttaaagattatgattggatttttaattaattcgcttccataggcattatttgcattgatcgcaacaagattaacattattttcatagtaaataactttaaaattatcttgaacttcacgaccttcaaaaaatttgaattcttctcttaagtctgtcacaacttgagcattgttcgataataccgaaggtaagataaaataaacttctttttttaggtcaagttctgataattctttaatgtttttttctagatagggaaatgcattgtgattcgccatgattgttggagtagattctgctaatggcatgtggatcatggataacaaagtagctttggattcacggaaataccgggtgtaaaactccgtttgcaaaagctcgctttcctcccatttaggatctccaataccatctttgcccattacaggtctatattgaactgtaatataggagtagttggcgtgatccttaaaaaatggtttttgcttatataaaagatacgattcaaaaatgagtgctaggttgcttgagatgaccaaaatggttagtacgaccgaaaccagctttagcccataattcaccgacaacagttttttagtgctgctttttgcattggaaaaagcttcttttacatgataagaacgtaagtttagatagaccaaagcattaaaaataagcagtaagatgaggctaattaaggatatctcaagattcatcgaaacggtggtaacggattttagtactgtaaagatgattagcaacatggtcacgtacaggaaagaatctttgagtatatttttccagatgatagcagctattcgttcacccatggaaatccgaattaaattttcttttttctgataaatgacatcataatacgttaaaagaagcgtaacagcaatcattaatatccaaatagcaatcattgtatttctggtatcgttgtatatatatcctggctgaggaaaattcccagcatatttgttaattagctctgctttaaactgatcagctttgttgtagtcagcgataatataaaaatcatgaatatctttgattccttgaatctgttccaatggataaaagccaaattggatgtctcctaaaaacaaacttttatacttttctgagtaaatatctaaattgttgtttatatgtttttccacacctggagaaccataaattctaatatttgtaaggctgttgttatttttagtttttgtgaaagtaaaaacgtcaacgtcgttttttttagcggcttccagcgtatcgttaatcatgtcacgctcttcttgaccgtattgtaaatatagagaagtataacgatatggagtgtaaaaattatctaaatgaaaaatttggctttctccaacaatgagtactccaataaagaaaatacaaaaactaatcatatattttatcgttttcaataaagaaacctccgtatgtattagagttaccgttcaactctgattagaaaccgaacggtaacaaataaattcggaaatcgatagttttgtatgaaaactataacgatttttattattttttcttgagagaattagaagttaaaattgtagtatacagaatttccggaatgagttacatctactctagaccaacttccagcgttgtcactatctgaaaaagtactattaccgtttgtaagcttgactgcgtgacctttggaattatgataaccgtgaatatagtcttcatctatggcaaatttgttgaacccgtactcaacttcccatgtattaaagccgcttccaccgctatcactcgcttcccatgaacgagcaaatccacgaccgccactatcataagatttagattcaaaaagtgtaataggagcactagctggagcgttagcagaatcatagacggaatctgaaacagaatcagaaggtgaggcagaggcagcaccaacaatagagaatagacttaaagcagcaacacttgaaactaaccattttttcattggattaggactcctttattcaactaagttagagtcactgatagctggccagcaaatcaaagctcgtaaagaattatatcctaaaaaagtgtcataaagtgttaaattatgtgaaaagaacataaaagaatgtgaataacagtctttatagaaaaaaaacaaaaaaataaatgtttttattattttttatccaatatttatgatatgattacattgtattttaaaaattttactaaaatgtaaacaaaatgagtagacggagtggtgtagtaccggtataacggtggcaaggggaggcatcatctgactaaacagtggcttagtagtaaattttaagttcattctaaatggattttggtgtacaagggggcttaatcattgtttaaggtagctatttgcgatgatgaattagagattcatagcttagtcaaaagtttttttgagaaaattgcagagaactcttccctttcttttgacattcaatcttttttttctggtgaagagttactacagcactatagagatcacgaccgttatacattccatatgcttattttggatatagagatgaatggtatatcaggaatagaagcagctaaccaaattcgtgctctgccggatcgtgatgtacaaattatatttttaaccagttatcccgaatatatgttggaaagcttcgatgttcagacgttccaatatctattaaaacccgtttcttataagttgtttcaggaaaaaattttaaagctatgtagatacattacttcatctacacatcgcttttttacaattaaaacagaggatgagcaagtggtattgcgtaattcagacattattgctattgagaaagtgaagcactatttgactcaaaacaaacttacgatcatcactgaccatcaaatgtatgtggttacaggcactttgatggagtattcgagcaaacttaatcattcttttgtacagattcatcgctctgttattgtaaatttagaacatatccgcaagtttaactttacttcagttaccacatccaatcagcaggtgtttccagtcggacggtcacaagtaaaaaaacttaaagatgcctatgctcgttatatgtttgtgcaggttggtgagggagggtaattttattgtactatgtaatattcgttgggattacgataacccaactcatcttgttaaatcgttattatgatatcatatttcgtgtttcgccaaggagcagaaaaagtaattttatcatttatcttttggctggaggcatactttacgtatcgttaacttcgctttctttcactactattatgggaaatttatctttcataagcacactcatcatagcgtttatataccctgttcgtatcgaaaggaagattattttttctatattatatttaattttagagcttatcgcagagtctctttcctactactacatagccgtatttcatcagaagcaaacagatatagagctctccagtgacgtctttaatttttttattatattatgctccacgtttattcagcttctttttattaaagtcatcggatttatcaaaaaggtgtataactacagaataggtatatcataccatttaaatattgtattcgttttcataataagtctatttattttaaataccttatttcaccatgtagaaaacgatatactatatgttctatcaggctgtggtattctaacaattgatattattatcgtctttttatacgacaaaatgatcgaaaaggttagattagttaatgaaaaacaccagttacaaaagcaaatagaattgcgggataacagttatgtaagaacgaaacactcatttaagagaattaaaagaatcatacatgatacaaaaaaacaactggtgtacatccgtgcctgcataatggagcagcagtttgaggaagccataacaaatattaatacaactttggaagatataaattcagcttatttgcggattgctacgggaaatcttgtaattgatgccttggttagtcacgcgctcaatattgctaacgataaaggaatggattttaaacatgacatccgtattaacagtgaagatattcgcttggatcgttatgatttgtgtgtagtgatcggcaatattttagacaatgctattgaagcagttgatctggtttctgaaaaggaagagaggtctattcatttgcaaaaatggtctgatgcccattcgctatttattcatgtaacgaatacttgtttgaagcctacggtgataactaagaagctccatttagaagacgattttgattttcatggcatagggctagttaatattcaacgtatagttgaaaagtatgaaggattttttcaaagttcacggtctaatcatcattttgaaactatggttatgcttccttttaacgaaaataatagtaaaacgatgcatgttgattaatctgaaacataagagaacaatctaaatgacggtagaatgacgtatgtgttttattgaaattagaagattggacagatgaagaactaagggggctgttaagaatatggattcttccatgcatgagtttataatgatatccaagcacagaatgtacgatcaatatttggtaaagttgcgggcatgcattgtgcttttggatgaacaggtgctatggcgcgtcggtgaggcggaaacgaacagtattggtgggatcatcaaccatatcatggtgcatgtgcgcagaaacgcagtcaagcttatggacccgacgattacatacaagcaaggaatggaggatagctttataccttccatgcaaaacaaggaacaactgatggatgaggtagaagaagctttttcatccttctgtgcagcaatcctcgcaaaatttacgagaataacggaagtagtagttatataaacctataaaatatagttctaaggtcacgaaaaactctgtaatggtcatgtttctatttcttaattgatattgataattattatcacttataataggagcagacatattacgctatgatagggagagttgcagagtgacagtatccttggaattatatgatgtaacgatcatcggcggtggtcctgccggtatgtataccgcattttacagtggaatgagagatatgaagaccaagctgatcgaagccaagcatgagctgggcgggcggatgcgcatatacccagagaagatgatatgggatgtcgggggggttaccccggttttatgtgaaaagctgattgatcagctggagcagcaggcgcggacgttcgagcctaccattgtgttgggacagcagatcactggtttggatcggcaagaggatggcacgttcctgctaacttctgccacaggggaacagcattggacacgcacgatcgttctggcagtaggctatggtattctcaaaatggctaagctggagattgagggggcggaccgctatgaggttacgaacctgcattatacggtacaagagctggagccattccggggcaagcacgtcctgatttccggtgggggcgactcagcagtggattgggcgaatgagctggagtctattgcggcgagtgtgaccgtcgtacatcgtcgggatcactttggcggacatgagaaaaatgtagctcgtatgaaatcatcttcggtccgtgttctcacaccatacgcggtgagtcagctacatagcaacaatggagagacgattgaacaggtgacgattagtcatgtagatacggacgaaatacaggtgttgaatgtcgatgcagtcatcgtaaatcatggactaaaatccgatttcggcccgcttcgggattgggggctggatatgggtgagtggcatgcccgagtgagcgaaaagctggaaacgaacctaccagggattttcgcggcaggcgattttgttgagtacggaagtaagctgtatctgattgccggtgcgttcacagatgccgcccttgcactgaacagcgcgaagctgcacattgatccagcagctgacaaagcggcatatgtatcttctcataacagccgttttaaggagaagaaccgcgagcttggtgtcgtggagtagaataagatacggaattaagttaaataggatcggacctaccatagaaagtatggacgggattgaaaggtgacatatgaagagacgaacggagcaacaggaagcgatgatggcagatattattcaaaaggcggagccctttgtacagcaacagctggagcatgatcatagtggtcacgattggtggcatatagaccgggtgagaaagctgtcccttaaaattgctgccaaagaaggcgcagattcgtttatttgtgagctggcagcactgctgcatgatgtagcggatgaaaaattaaatgattccaaacaagccggactagataaagtagagcagtggctgcgtctgcatatcagcgatccgaatgtaatcacgcacgtgatgaccattattgctacgatgtcctacaatggtggacaaaacccgcctatggagacgctggaaggtcaagtagtgcaggatgcggatcggttggatgctcttggagcgattgggattgcaagaacctttatgtatgcaggctcaaaaggcagtatgatgcatcacccggataaagacttttcacagcatgagtatcgtgccgcaggtaaaagtgccatataccatttttacgaaaagctactcaagctcaaagatttaatgaataccacttatgcccgagagctggcggaggttcggcatcaatggatggagatgtacttggagcaattttatagagaatggaatgtggataataaataaagtgtttcaataaggctgtttcctctaaccgagtatatcggaggggaaacagcctttatttttttataaatgtcatattgatattattgaaaatgtgtgttattttaatgttaataacaagatgataataacataataatataaactataaagaaagcggggaagcggctatgtttggatttaattttgttaaatttcagcccagtgaatatgtgatgaaggtgaaaaacgggaaggtggttcgggagggtgttggattatctttttattattatgccccgaccacctcggtcgtcgtggtgcccgtctcttccattgatgtaccgttcatgtttgaagatatgacgaatgattttcaggcggtgacggtgcagggacaactgacttatcgaattgtagattatcggagaacgacgcagattttaaactatacgtatgacttgaaggaacgacgctacatttcggatgatccgggtaagctggcccaacgggtgattaacatcgccaaagtgcttaccaaaaagtatttggagcgtgtcccgctcaaagaagctgttcagtccagtgaacgtctggcccaaaacatgacgaaggatattgctcagcatacggaaatggaaaagctcggcattgaggttatggggttgtcgattttggcgattctacccaataaggagacgatgagagcgctggaggctcaagcgagggaagagattcttcgcaacgcggatcacgctttgtatgagcgtcgtaatgcatctattgagcaagagcggcgtgtgaaggaaaacgagctgaacaccgagattgcagtggagacgaaaaagaaacaaatccgcgaaactcaactcgatgccgagcgttctgtgaagcaaaagcaaagcgagatgaaagaggagcagctacgatttgacacggccttggaggagaaaaagcgtgagctgattgagctgaccgtaacgaataaaaaggcagaagccgatgccaaggcctatgagctgacagcagtcatgaaatcgttgcaggatgttgagccgaacgtacttcaagctatggccaacatggatatgagccccgataagctaattgcgatagcatttcaggagcttgcagaaaatgcagggaaaatcggtcagctgaatattacaccggatctgctgcaaggtctcatgtcagatacgggagcaaacggatcagcaggatcgagagggtctggaggaagaacacgatgagcagccgaatgacagagcaaaagatcattttagtgaagcgtaaaacgcgactggaggaactgattgttcgatacaatacggtgcagcaggctcgcttctttatggaacggctgggtgctgatttcagtgattatgtgctggaggacgaaaattaccgcagggcggtggcaacggctacgtcggagttaacggctttgggtcgagttcagattgtggagcgggagcatgtgccgaactttatttttggtgagcaggatacagtggtggtgctgggtcaggatgggctggtagccaacacgttaaaatatttgaacgagcagccgcttatcggtgtgaatccagatccattgcgctgggacggggtattgttgccgtttactgtatccgatctgcgctgggtggtgccggatgtgttcgtgcacagacggccaattaaggaagttacgctggctaaggcccaattaaatgatggccaatccttgtatgctgtaaatgatttgttcattgggcgcaaaactcatgtctccgcgagatatgagttaagactggaggatcaggtagagcagcaatcctccagtggtattatcgtttcaaccggattgggagcgacaggctggctgaccagcgtgcttgctggagcggccgggattgtcggcagtgctacacggcatcccatctcgctgactccaggccagctgatgccaggtgcagccttcagtcaggaaggggcagtagacggaacgagtcaggatcatcgtgcaacctggagtttgccatcgctttattttacagtgagagaacccttccccagtcgaacgactgctgcggatcttgtgtttggtcaggtagcagccgaaaagccgttacggattgcatcgcagatgccggaaaatggagttattttcagcgatggagtggaaagcgactttctggagtttaatgctggcattgaggcaaccattgaaccagcggagaaaaaagggcatctggtcgtgtagaggtttgtacaggacggcaatgggtaattatgagtaaggtacaaccatcagatgaaattaaaaaaggaggaatcaacatgagcgatcacactcaagacgaagcgaaaatccgcaacaagaaggacgaggacggagattccttgatggagaaaacgaagctggaaaatggcgtggatatcgagcctgaggctgatgaatggattgcgaagccctcaccagtgtcatacgatgatacgaactcctcttcgaagaaataaggctcttgtgtccaaatagagcagtgaagcaaagacagatgacccctaattgggtcatctgtcttttttacataggttagttgaatctggaatataccttccatacgagctcacgacggctgcttacatctgttttcaagaaaatcgctttcagatgatcctgcaccgtgtaggcagtaatatgaagtgcgctggccagctccttggtcgaaaagccttgaacaatgagctggacaatttgtctctctcgttcggaccatgagtacacctcggtcataagcggcagcatgtcagttgctttagcagcctcaaaccatacggctagctgtttctggcccgtatgctcctgtccgccttgcaaaagggtggccctgatggttacccatggggttcctgcgtctgcggaagggatacatagtcgggctggtgcagtggcagtggatagcgctcgcaagcataccgcccggacaggagccagaaggctgtcttcatggattccctcctgctgccgaagcagctgtagccactgctctgctactgtattggatgagatcggttctagcttatcggaaagtatgaggactcctggttcaagttcattttccgtaatcatggcaggggctggagatagaccgacactggcctgacgcagatggtaggctatggacggcgctaacgcttcaagcagttgttgctcttcctcgctgaatacaggttttccatgatgacggaacaacgtaagaaatccccaacagctccctttgtacataaacggaacacgtagctcgtccccgaatccagcgggttgcaaaacatctctatatcgtgtgctccgatccggttggccttgtgtagacccatgtagcgtcgctacagactgtcctcctcgcaccaactgatcatacttcatcatatcgtcgtgcagatattcgtattctagcagtttgttatgaatgtcctccacacccgactctgtaaatgctcccgtggaaagcaacgtacgcggatctactgaggtacagcacgccgcatcgaaagcaacctgagtacgcaaacggtcgattagggtgtgcttgtacgttagggatgagggggcttttttccccggatccatgatctgctgtcgagcgtccttaagctgtgcaaatagcgtgtaatgtgcgttcatcatttactcctatcgtgaaagctggaggttctcaagcgcgattattaaatcccacatttatgggatggtggatattcgtattgtctttataattgagaatgattcttaattaaatcaacaataaacgaatggtctgagaagatcaaggctaaatgtttggaggaaagcacatatgaaacatacccctattggaaatacggactcaaatcaaccgatgagctggaatcatccgaatgtgcataagtacgcggatacgattgctttaaaaatacctggatatgctcatttgtacgagatgacagactgtttgatagccgcacaacttgaggcacaagctcatattcgaaatatagatccaaatgtgctaattgtcggagctggaggcggccaggaattgattacgctcggagagcgccatgaagcatggtcctttacggcagttgatccctccgagcatatgctggatttggcacgtaagcgtgtgacacatgcgggcatcagttcaacaatatcgtttgttgcaggtacgttggaagagtcatccagaggaccgatctatgacgctgcaacctgcctgctggtgcttcattttcttcagagcttggaaagtaaacaggcattgctacgccagatatctgctcgactcaagccgggcgcacctttttgtctagcttctattaatgggaattcgcaggagccttctttttccatccaaatgcaggcgtggaaggatcatatgctgagtcagggcatttcacaggaggattgggaacgattcgctgcttccatcggtcgtgagtcaaacccggtgtccaatgcggcaatacaggaactgttgatagatgcaggctttacccacatcacccggtattatggcgcttttttagtaaatgcatggtttgcggttaaagagggagagacgacttatgacaaaggataacatcatcatcattggcgggtatggccatgttggaaaaattgtatgcacggagttaagtgaaatgtttcccggcaaggtatttgccgcaggtcgtagtctggagcgggccactgaatttagtagacaatcgaatggtaagatacggcccttgcagctaaatattcatgagccgatggacccgtcgatattagagcaagctaaattggttatcatgtgtctggatcaggacaatacggccttggtacgtgcctgtcttcgacatggggtgcattacatggatattacagcgaatgcggcctttttgagtcaagtggagcagtgtcatcaagaggcccgagcttatcaggccacagccctgttaagtgtaggattagctccggggctgaccaatctgttggcactgcaagcgacacagctcatggatcagacggatgagttgaatatatctttgatgctaggcttgggagatcaacacggtcaggctgccattgagtggacagtagatcagattcatgccgatttggaggttatagaacagggacgcctggtgactcgaaaaagctttaccgacggcatagtggcagactttggtgcaggagtggggcgccatcgggcgtatcgatttcctttttcggatcagcagacacttcctcgtacgctcaaagttcctaccgttagcacacgcctttgctttgattcgcgcttgaccacccggcttctggcagggcttcggacgataggagtatcaggtttactccgacagcaaaccgtgcgtgatgcagtggttcgcagctttggcaaggtacatataggagggaatgctgtagcggtcaaggtagatgctcgaggaactctcaatggcaaagagacgaaggttgaatgccggctaaggggccaccatcagtctgatttaaccgctaaggcagccgtctttgcagcgctcgccctgtaccgttcagaacttccatacggtgtatttcacatggagcaggttttttcgtggaatcgcatgcaggcttggttggggcagcaagtatccgcagatattcaggtgaacggacagcaagcatagaaatcatatattttaataaaggactctcatataatccaagcttattcagcaacgcattgcggataggtcttggatttcttttcctgttagattacactagaatgaagtacatatttttggaaaagacctaaggggatgatatgaaatgtggaacccctatgaaaatagcagacagcatacgcaggaacgaggggatattttatggaaggcccgcgccgtgttggtgaagttgaagttacaagcctggtaggcctcttgaccaatccggtcaactagctagctgctgaggagtcgataagagatggatatcgcttatatcatagatttattacgtaaacacgatgtgaccttagctccaggcttatccatgcaagaggttaccgatgtcgaaggcaggtatgatattcatttcccgcccgatttgagggagcttctgatgagtgttcttcccatcggtaaaagctttatcccttggagagatacgtcaccacagcggatgggtgtaattcggcaaaggttgaattggccgctggaaggtatgatttttgatgtggagcaacatatattctggcctcccgaatggggcgaaaaaccgacagattcggcggaagccgttgatatatgtaaacgtgagattttacgtgtgcccaagctaatcccgatcaacggacatcgatatatcccagagcagccatctgaagaaggaaatccggtattttcagtgtatcaaacggatattatcgtgtatggggaatgtttgcaggagtatttcaagctggagtttggggagaagccttatgaacaaattgattttaatgccgtaaaaaaggtgcgtttttggagcaacttttgtgagtgagtgtcaggaagatgaataagtcgaaacgaagaaaggggagcatgatgtgaaggtggagcaggatttggaagaaatcaaagaaaggttgacccagatcgagaccaaactggaacaaaagtcgacctccaagagaatcttgaagtacatgatcatcattttcttgtctattttttttcttttatttctaataggaattattcaatttgtttcaacctaatcggtgcaagaggatgagggaagggagctatttatgtccatagaagcgattatttttgatctggataatactcttattcatcgcaaacaggcgtttgcggcatatacagagcgctttatagaacgatttattgtggcagaagaacctgcgagccgcgcggctgtcgttgaacagatacgtttggcggatcaggacggatatcgggataagagggaactgtataccgagctgcatgcagacttggaactgaaaaatcccgatacgtcagtacaagagatgttgggcttttggtatggtgaatttcataagtttacggtgttgatggacggggccaaggaagtgctgtccgaactgcggtcgcgtggcttgaagcttggtattattaccaacggctcactccgtacgcagcaagcgaaaatcgaccgagttatgctgagggattatgtggattctattatcgtatcgggcggcgtcaacatccagaagcctaatcctcgaattttcgagttggctctgaatgagctgggcattgtcgatcccggccatgcctgctatgtaggcgatcacccgacaaatgatattcgtggtgcacaaagtgcaggattgcataccatctggctggaaggctttatgacgtggcaggaaacgggcattgtaccggactatcagattgggagtttgcgtgaaatcacaggttggctggatcgtcgcagttattcaacgaataaggaggagggtgcatcatgagtatggagcagcaaccgaatcccattctcttatcgttccctgaccaattccagacggaacgattgaccatacgcgccccgcagtggggggatggggcggcagtcaatgaggcgatgcgagagagtgcgaatgaactgcggccttggcttccgtttgcaagaaatcttcctacggcagaggaatctgaaatccgttcgcgccaagccagacttaaatttctggatcggtctgatatgatgttgtatatatttgatacggtttcgggagaatttgtagccagcagcggtctgcatcgtattgattgggatgcacgaagatttgaaattgggtactggctcagaacatcatggaccggaaaaggcattatcacagaggccgtgcacggtattacgaattttgccatacagcatttgaatgccaatcgggtggagattcgttgtgattccagaaacacacgcagcgccaaggtagcggaacgtgcaggttttacactggaggggattttaagaaacgtcgagtatgatgaagagggaagcatggcacacgaaatggtttttgccaaggtgcgtggtattgaattctagtatcctcacatgaacagtttggaagttgctgatggtttgtacgatattacggaggctcattatgattaattatattatgaaaaatacagacaagttagtgtgcatacaatatgtcatcagcaaaaggttcagtaatcttgcaagcgctatccaagagaggatgctttacgaatttccagcagcttggcgaagatgtcccagcattaggacaggtgatttagcatgaggagcgttcgtaagagcgtcattagaaaggccaatcgggaaataaaggcgaaattccgctggaaggcccgcgctgcgtacctaattgctgtgctggtcacgattttgttgggtttgggaagccgggttttctcctcccagttgcctgaattcgttgctaatcactttggggatgctttgtgggcgtgcatgatttattttgggctgagaatgttgtgggtgaatcgtcaattgtctgtagccctgtggggcagcttgctgttttgtttcgccattgagttcagccagatgtaccaggctccctggattaaccacattcgggcaacgacgctgggcggcttggtgcttgggaaagggtttctgaccgcggatctgatcaggtatacagttggcattgtggtatcctgggcgctggatcaaggctgtcaaaagctggcggggagcaatacacgtagagacaatgacaaactactcaaataacctgaaaagcgagggttacgcttgaaacaaaagggaaagcgtcacaggttgttcggtaagatgattggattatgcgcaggattcagcttgttgtttgcaaccatgcttatcccagggcaggcactggctgaaagacagcttgcggcgcctcttcgattcgactttggtccagggaacgtagctgacggctacacccaagtcactgccaaggatgtttacacgcctgagcgaggctatggatttaccgatctttccaaggtggatgaagaggatcgtggtggaagtgatgctatatgctcagattttgttcgtgttcaaggatcatcatttgttgtcaatttaccacctgcggattacacgctttcccttattgccggagatactgccggaaacacagacattacggttaaagccgagtccattgtcaaggtagaacctactaccaaaacagcaggacaatttgtcgaggctggatttgaacttgcactcatcgatggtcagctcgaattgtatttctcaggtaatgaagcgaagattaacgctttggttattactccaaaggatgctcgaacggctggagaacgcccttcggtatatcttgcgggagattctacggttcaaacctataaatccgcgatgaagcctcaagcgggctgggggcaaatgattgctccgttcttcacagatgagcctatttttgtgaaccgttctattggtggacgaagcacgaaaacctttctggtacaagggcggttagatgatattttacgcaatatccgtccaggagattatctgctcattcagtttggacataatgatgccgcgatcaacaaccaagagcgttatgtttcacccgcggattacaaagtttacttaaaaacctacatccaaggagccatccaacgcggtgcaacacctgtgctaattactcctgttggccgccgggattatgatgcggcaagtgcctcgtttcggattagtttcccggaatatgtgcaggccatgaaggaaacagcatcggagacaaatgttgcactggtcgatcttagccgcttgagtgtagcgtactatgatacacttggcctcgaaggaacacttccgttatttttacatgtggagccaggggtgtatcctgcatttcctgatggagtgaaggatgatacacattttcaggaatacggtgcggagcaaatagcttggctggtagctcagggaatacgtgagctgaacattcctttatcctcttatgtacaggcggaagattcgcaataaaacattatttccatagtcatggtatacttagagaataagctggccctacccaaagatagcattgcttaggcttgggtagggctttaatgttctggatcttaaggaggaagcgagaatgacagtcgcccaacttcataatcttattaacggtcaactcctgtacaatcagcatcggagtttattttatatgcgcgagggttctgttctgttaggaccttcaacagaaatgacgtactggctgacgcagagaagctcggagctgatcctcatgcttcaaagcttgaagcgccagcatacgtataacgcttttgtgacggatgtagcggctaaaatactgtcccagtttgtaaataccaatcagtatctacattttcacacagatcatgcgagggagcttacggagctgtatgatcgactcttcactcggattgaaaagttgttccagaagaaatttatagatagagcaatcctggacctgctgcttcagcagcattacggacatttgagagattttttaactcgtaccaatggacgtgaaatgtttgctaagtatgcagagtgtgagtataccttttggataccttgtgaggaatatacgccggagttgcaagctaatctactaggattggatattgctcgtttgcaagagcctgttctagatgttggttgcggatctgaggcacggttaattacttatttacgtgcctgtggaattgaggcttacggaacagatcggctggctgaaacagaaggttgtgtcactcgaggagattggttagagaccacctttggagaaagtgcatgggggacgatcatttcacatatggcattctccaatcattttatacatcatcatctgaaggcagatggtaatattcatgagtacgctcgcaaatatatggaattgcttagagccattcggccaggagggagttttatttacagtccgtgccttccgtttatggaagagcttttggatgcccgaatgggttatcaagtagagtatatccagtcatctgaaggttacagggccacgaaaataacgcgtgtacattcataagcgcgagtagtagtccattcatttgtcagattcattcttggaatggtagtataaggatagatattactctatttgggattctgttaatgataaagattctcatgacgctaattagacaccattagaggatgattattagctgtatggctgcactgaataataatgattagcttacggataacggaattttcaggaaagattaaatcatattttcctaaaagccgatatatgggaatgaggcgagaacatactgttattatacccgcccgaaaatggaagtatataatttgggttaggagagtagaagaagtgtcagatctgtatacgaaaaaagaagtagaagattatgtaacgaacgtggttttcgaacgacctttaggtgtaagcatttcagccattttattgatctttaatggggcacttctgttggtgacccagctattgacgcttaatgcattaaatgaggcttctacgttagtaggcatttgtaggggcatgtttcaaggatttatcgcgttactcggtttggcagggacgactgccggtgtcggtatgttgtttggtaagaagtgggcttggtggctggcagtattttattttacatatgagaccatgcgttatacgtgtgcaattctgtttattccggatgtccctccaacgttgggcggtgtacagctaaaccctgctctatactacgtaaaatatggtatgcgtattatttggaatttgttgtttacgttgttcatgtgtcgtagtaaagtcacaggtttttttcaaacaagtggaatcagcaagtggagagcatgtattgtattattcttcataaatggagtgatggttgggattggctggtggctgataagataggttattcgatgtaaaggaggagatggataatgtcaatggaaacgtttccgattttagaaaccgataggcttcgtttaagacagcttacagtaggggatgcggcggatgtgttcggctatttttccaaggatgaggtcacacaatattatgacttggaaagctttacagaggtagagcaagccgaaaaatttattcgttcgatgctaaccagatatgagaagcaagagggctttcgttgggggattacgttaaaagaagctcctgagcggatcgtgggtacaattggattccataactggcacaaggagcactcccgtattgaaattgggtatgagctggcaccggaatattggcggcaaggtctgatgacagaagcgatgaaggtggtcgtgaattatggctttcaattgccgcaggttcaccgtatagaagccttcattgatccagataacgaaggctccagacggctactgctcaaaagtggctttactaaagagggtcacctgagagactatttttatgaaaaaggtcaatttgtcgacgctgttatttttggataccttcggaaggagttttccgtggatcggtaagtttataaatatcccttgtctccgtatggctggagtcgatcaagccaggtctgctccagctttgtcagtgcatctttgacatcaaagaacgctgagtcctttttcttcaaaacgtccagcacttcaaattcaaacgaatcttcgccatactcattccattcctgttgcagttgtttattcttaaatccacccatgttcagctcaaaacgccgtccattcagcgactttaaattcggcgtggaagagacgaaaattttcccattacgtgtatttcgaatgcaatagattcctgcctctgtcttcatctccatgtactgctgcaccaattcttttcttcgattcattgtcgaatcctcctattgtataaacgttaagattcaagattccttcaaccaatattcactgccatccggcttacgatccaatagattgtattcaatcatatatcttcgcaccgtgacataatcgtcatatacttcctgtaaaatcgcattgatatccttctcgtgatatatttgtccctttacaaaacggctcgcaatttcacgcagcacaatcagcttgtgcttttcttgcattttaaaggtctttaggcgtccgtctgtcccattcggaaaatacttcgtgagtaccttttgccgctcgttttccgtaatgttgtagcgttcgtccaccatccgtgcttgtactggtacttctacaatggcaggagcgtgccgatctttctcctttaacagctccattaatgtgagaaaaaccttggcctgtcgttctttttctttgagaccaaagcgatgattacgtatggtggatgcgctaccgattccggtttccttttgaatatccgcatcgcccatgccttgataaaataactgaagcaaccgattctgatgatccgtcagtccagtcagctttttatccagaccgatcaaatagtcaaacaccgatccgtacgtccgctcaatatgaagtcgcatgtacctctccgcgtcataaaataccccttgatcctgatatatgatgccttgctcgtatcgctgtccgtccagcaggcaaattacttgttcttcttggcgaatatatcctcgcttcagttcttcgattccagcattccagaatagttcggaatgatccattttagcaaacacctcaattaaatgatgattattttatagacaatataacattttgtttactttaaatcaatgaatggatatttatttagggtctcgacaatgttcgctatatacaaaagagacatcggattgttatcatatgtaaattattgaattgcattaagactgaatagttgctatatattgtaataaggtgggttggtaaactatgaacaaaatgcgattagaagaagtcatagaaagtggagatttaaaggaagcggtaaagattatagaggagataggtgaaaagctggaccatacattcactccaatattattgagatatttagcaacgacggatagtgtattgctaagaaatgtaatcgccattacgttagctgatctaggagaccgtgaagtggtgttgcctcttatcgacttgttaagaaatccaaagaccaaggggaatagaggaacactgttatatgctttagaattttttgacgtatctactcatgttgtggcgctggtagatttactggatggtacctttgaagcgagtagacaatcttatcaactgataagtaccgtacaagataaaattactaaggcacaaaaggacatgtgtagacaaaagataagaagaaagctagccgattataaaaacaaatataagcgtgactttttgctggaatctttagagctttttacatgattcttttaatagagaggtttggttggagtgttaaaaaaagctgttttattcgtgatcatcattctaattgcatatacagttgtatccattacaacaggaagtccgatagaaagagtccaatttcggagtaacgtcactgactacctacataaaacgtacactatgaactggaaaattgattcaatagattatgattttaagaatgataaatttatagcaaatgtgatctctgactcagggatttcttttttggtggatgaagactattatgggcaaatgatggataactacgcctcttctgtgtggagggatgagctaaaaaaagctgtaacacaaaaaacaaagcaagttacaggatcagatgcagaagtcatcataaatgtttctcatatggggcgggatgctttaacctaccatgacgaggttccaagctattctaaggttagtcaaaaactctcctcagaagcttcaatttgtattaaaggtaacttttcagccactcattatcttcaagagatgttggaaataaagcagtggattgttgaaaagaagtatgatgcttcgttaacgtttaagcccaaagataaggatgtttacttctatttacctactgaagatctgaaaaaaattaaaaagctagaggatctcaatccttatcgccttcaaattaattaattattctacccaagaacttgaaacagagccctcccctgtggaattaagattatgggagtttttaaagggtgctcagtcgcttgaaaataatatatggcaaggcttttctaaagaagaacggtccgggtggctaaacgtgactagaatacattctgcatctaatcattttgccagactggataaacgaggagaagtctacaccttggacggtgaatacatatctgattttacaacatttttcatagcacttggtgaagcgattaatgggcccggagggtactatggatttagcttggacagtatatcggactgtctctgtagaggttttgggacagtaggaccgttcacgatccattggaaaaacgtacattatttcttggaaagattcgaggaagaatgggatcaagaagagagatgttatagattttcaccacagcaatattttacggatcttctaacgatcttagtatcaggtggtgttaccgtgaatttttcttcgaattaagatagcaaagcaagaagggaatttttaaaatggaatataaattaatgcaaccaccttttgtcatgaaagaatactctgaaatgagtaaaaacgaagcaaaagaacattttaattggtttaaacgacaaataccttcacgtttagagcaacttggcgcattttcacagatacatctggattatagtgatcgttcgctcatagatatttgggaatggtatctaaggaatgtgcagattcaaagtaaaagtgcttcagaattagaagaggagcattcagagactgaagaatggttgaagagctatatatatgagaataaactcgccacaaaatcccaagcttttacactggatattgccatttatctaggagaggttgtaaaaagtaatcacagtgggttggattggggagttgtttttaaacctaagtcgtatgttagcgttaatcgccctgttatcactggtttgactaaggaaacagatatggatgtgatcatgatcgtaacgaataaaatgtttgcagtattaaagggacaacgtaaccttaatgcattatttgatatttatcatacatgtaaagagtttatttgaaatcgtcgataggaagggattacgatgatcgaaatcatttgaatgggaagatcggtaaaaaagtattttggagattatacaaagaacagagggccgtaagcatgttaacggctctcttcgttgtcttctggcaagtattcgatcagttcaccagggagtacgccaagggttctacaaagtgtgttcaaggttggaaagtcaattcgggcgtttgcgttggaggccaaagctttaaccgtattcctattaattcccgtaatagaaacaatatctttctgttcgagtccacggtctttcataattttatcaagagaaaatctaatcacaacaattcctccaaaaagtaattaagtaaactagttgacatgtatgaaacataagtgtatatttgtaatcaagtaatctagttaacaagattataagtaaactaagttgatgccttcataatatcaaaatgctttaaatttagcaacagttactattttgataatcctaaaacaattaatgcgtgaggaggcttaaaaatcgtatagaagtttccttataaaattcatataacaacgttatgcaataattttaagcggtttttaaaatggataaattgtaatacaggttaatatttcatcgaactaagctgtgataaatgaacaaaggaatggagcgaggatgtatgacagaatgggtaatgggattggaacgggtatccatggttcaggggccgtatgattcacctcatgcatatgagatatgcgaaggggttctttatgaccatcaatacttcttttacctcgaaaacggcatactgtgtctgcgccatgtgaagaaggtggagcaatcatatcatacgcatctttacctagatggagagagcggaggcttgcaactggcagagggtgtacaaggggaagttatgcaagttgtcacggagatcatcgaacgcttacgcgctaaggatggactaacatttttattcgatgaactgctgtggctacatgggaggggccccattgaattaaaccttttcaataagaaggatgaagtgaccccgagtggcagacaacttgctacgaaataatgctctatatcatggaacttgtagagtaaaaattatgatttcagtgaatgtaccagttgttgactgataaaaatgagcggataccgaatcaatatggtcaattccaccacaacagcatcaccagagggagtaaatccaaaatcacctcccaataatatgttttgctgctgctttgatgaaggaaattccggttcatccaagccatattgttctttgattctctctttcgtttcatgatctatgacaaggttatcctgtgcaaaggtatagaagataggaacacttaactgtattaaaagaagtaatgcaacgggtataagcacttttttgctccgcatggttagctcctatgatctctgtttttgacctcttaacttttgtatctaccataatgaaaacaacttaaaaatgcaacggaaggatgaaaaaataatccctttacaggattttatgaccagaatataatggtaaataacagcatctatctacatacacttggttatcggggtatagcgcagctaggtagcgcgcacccttggggtgggtgaggtcgtgggttcgaatcccgctactccgatttcaatcaaaatgtcctgctgatgcagctaatgcgtctgccgggcgtttttttttgaatattatataccctatcggtctatgcatctactgggttgtgacgagctagtcgtatgcaaccaacgtatgtacttgtggagtatttgaggggagatatgatgaagccacctctgcactggattcggaggcagaagtggcaactcaacaatcgctggcggaatggtctgttgtttgacttttttaatttgcctataaagattcctgaagggtcttggaagaagtgctgtaatcagcataacggggaagcacaatagtgtagtatattcctacaataacggtacagaccccaactaataaaaacaagagctcaattgaaataaatgaaggaaagcttatagcaatgaaacctaatgtaagagattgggacagcatcattaacggattaatcaaaccttgcacacgtcccatcatttgaggatctacaatacgaggaagccatcctcctatgccaatgttaatgaacggaagtatcagtgcaatgacaaagttgataatcagaaaagcgtagatgtggttaacaaatcctagtatgcacatacctattccggctaccagaactcccgctgcaatcatttggtgtagctttagcttggcggagatgagagaagcgattagggtaccaagcaacacaccagctccaaaaataatacctgtccaaaccatatactgctcatagttgcctggagctagcttatatttaagaataaacatcggtaaaacgctaaaaccaccatttaaaataccgaacataaaaaagcctgaaaccaaccaaagcaatagtctgttgcgtagtatgtaaagaaacccttgtttaaaatcgatcatgacaagtttgaattttaattgtttgaattgatgtgccccgttcggaaggcgtacttcctttggaattttgcaggaacgaataagcagtgcagacacaataaaagaaatagcatcaattaggatggctccagtaattccaaagtgccagtagacgacggcccccagagttcctccaaataacatgaaaagactccccatcatttgattgaggcctgcggcaatggtgtaatcatcttcgcttaatatcccctgtataatggcactttcggctgggaagaagaatttggaggcagcactacgaatgaagaggagggcaaatatcaaaggaatcgaatcgacccaaataaaaataagcaaacataaggataaaaaagcgctgatccagtcacaattaacagcaatcttttgtctgtccatccgatctgccagcactccaaccacgagaaacactaccagcatcgggagcgaatacattaactcggcaagcgttgcatagtatggctgatttgtaaaccgtttcaacaaataaaacatgaatgcagtaaccccgataattcctcccatttgtgaggcgaaggttgccagaaaaaacctgacataattcttgtttctgagtacttgttttaatccagtcacagttccatccctttcgctttcaaagcggtttttagatgcctaattaaaataatagtgaaaagtaggaatattgtacagaaaagtgactttaatgtcactttaagtttgaatttgcatcgtatcggaccctctgccttttaaattctgctgttaacgataatcatagtggggtggactgggaagttgttttcaaaatggtttggcgtagtatgaggagcaatataaacttaaataaccagccgacggttgatatccaacggctggttatttaagttgccaggtgtttgattacagattagcccgattcatctcatttacgcatggatatgttgagaaaaaggaaatgctcctagctagaaaactttatacaatggaagaggaataagaattgtgaaattcgacttttgatgaaggatttcatataatgtgagcatattgtgaacaacttaaattgaagacttaataaaaaatgaaaatgatttccgtccagctatgaatttcaaaatttgacggagggaacgagatgacaatggaagagagcagcagacaggtaccttggcaggcgtattatggacctaatctaggttatgtgcaggaccagtatgaaaagtatgtagcggaccccggaacggttgatccggcttaccgcgagctgtttgatcaatggggtgagccgccacaatccgaatattcggctgcttccatgatagacaacaaattgcaaggcccccccacaagtgctttggggcaccttgattcaaacacattacagaaagcggttacagcggggaaaatggtgtggaatatccgtgagtacggacatttagccgcccaaatcgatccgctggaactggatgcagagcaggatacacgcttgcttaatccagcatcttacggtttaactgaacaagacttgaaggcttttccagcctctttaatatgggataacgctcctgcgggaacacttaacggatgggaagccattcaacggttacgtgtagcatacacaggaccgattgcctatgaatttagtcatattcacaacgaggaggaacgccgctggctgaacagctatgcagaatctggctggtcctccaagccacttacaacacaggaacgcaagtcgttgctaggcagattggtagaagtagaacagttcgaagagtttttgcataaaacattcgtcggacagaaacgtttttccatcgagggtaatgatgtgcttgtccctgttctcgacgagattattcgtctaacgacaaatgcaggagcaagtcatgtcctgatgggtatggcgcatcgcggccgtttgaatgtactggctcatgtgctgggcaagccttacagtaaaattttctctgaatttcatcattcgccgaataaggatttgatcccatcggaaggttccacgggaattaactacggctggactggagatgtgaaatatcatctgggtgctgatcgttttgtaaaagatgggggagcagtgcaagcccgtctgacattggcgaataacccgagtcacctggaatatgtaaatccggtagtacaaggattttcacgagctgcacaggaagaccgcagtgaggctggttatccgaagctggatgtgagcaaggcagctacaattattatgcatggtgatgcggctttcccaggtgaaggtatcgtggcagaatcacttaatttcacaaatttgcgtggcttccgtaatggcggcacggtccatattattgtgaataatcgtctgggttttacaacggaaagtgtcgattcccgttcgacccgttatgccagtgatctggctaaaggctatgaaattccaattgtacatgtgaacgcggataatcctgaagcctgtattgcagcagctcgtatggctggcgaataccgcaatcgtttcaagaaggattttctgattgatctgattggttaccgtcgttatggtcacaatgaatccgatgacccggaaacaacacaaccgctggtataccgtaaggtgaagaatcatccgacggtgagcaaattatatgctcaaaagctgatgaagcagggtatagtggatgaagcgtttagtgccggtctcattgaaaaggtccaaaacagactgaaggaagcgcatgagcatgtgaagaatcaaccggaacaagagccggaaatgagtcctgtgaaggcgaaaaagaatcagaattctatggtacgtactgcagtggaattgaaaaagctgcgccaaatcaatgaaaacttactcaaatggccacaggcttttcatgtatatccgaagctggatcgaattttacagcgtagaaaaaccgctctgaacgaaggggaaaaggtagattggagcttggcggagacgctggctttggccaccattctcgcagacggcaagcctattcgtatgacaggtcaggatgcggagcgagctacatttgctcaccgtaaccttgtgctgcatgagcctgaaacaggccgtacacattgcccgttgcatacattgccggaagcacgtgcttcattcagtattcataacagtccattgtctgaggcatctgtcctcggctttgaatatggctataacgtgtattctcctgaaacgttagtgatttgggaagcacaattcggcgattttgctaactgtgcacaggttatttttgaccaattcatctccgcaggccgtgccaaatggagacagaaatcgagtctagtgatgctgttaccgcatggtagcgaaggacaaggaccagagcatacaagcgcacgtctggagcgttttctccagttgtccgcacaaaataactggactgtcgctaatttgagcagtgcctcacagtatttccatctgctacgccgtcaggctgcattaagcgaaagtgaggaagcccgcccgcttgtgatgatgtcgccgaagagcctgattcgtaataatcgtgtcgcttcgcctgcttctgaattcagcgaaggagcattccgtcctgtgttggaacagcctggtctgggtgcacgtccggatcgtgtagagcgcattgtactgtgcagtggcaagattgccatcgatctcgaagaagcattggaaaaggataagaatgaggcagaagagcgtctgcatattattcgtgtggagcagctataccctttcccggaagaggaaattcggaatattttcggccgcttcccgcatgttaaggagttcgtatgggctcaggaagaacctaaaaatatgggggcgtggagttacattgaacctcgtctgcggaatgtagtgccacagggagcggaaattcgttacgcaggcagaccagatcgttcaagcccggccagcggttatcagcaagtacacagcctagaacaacagcgaattattcaatcggcgttgaagcaggattccaaaaacaatattacacttgggaggtagcggctgtgagcgatattatagtgccagcaatgggagaatccatcacggaaggaacaatctccaaatggcttgtgaaggaaggggattccgtaggacagggagatgttctactggagctggaaaccgataaggtcaatctggaaattagtgcggaagaagcaggtgtggtccagaaaatccttcgtcaggagggagatactgtggtcatcggtgaagctgttggcttgatcggaagcggcagtggtggtgcggaatcaaccggtgctggagaagttgcagcgactcaagcgcctgaagtaccgtccgtagcgacttcaccgtcttccgtaggaggcggcgttaaagcagaagaaaagtctgcaccgcctatttcatcgaatggcgaagggaatggccagacggcatcaccatccgcccggaagttggcgcgtgagcgcgggattgatcttgagcaggtacagggaaaggacccgctcggacgtgttttccaggaggacgtaaaaacgcataacagctctgaagtgtcacgtgcagcatctgtacctgcgtctcccgctactagcaagcctgcgcctccgtctccagcacaaacggagtacagcaagcctgtggaacgccagcggatgtctcggcgcagagcgacgatcgctaagcgtcttgttgaagcacagcaaacagctgccatgctcaccacttttaatgaagtggatatgaccgccattctcgatgtgcgtaaacgccgtaaagataagtttaaggaaaaacatgatgtaggcttgggttttatgtccttctttacaaaggcagtggttggtgcactcaagcgcttccctaccgtgaatgcagagattaatggcgatgatatcgtactgaaaaaatactatgatatcgggatcgctgtatctgccaaggaaggtttggtcgtgccagttgtgagggatgccgatcgtcttggctttgctgagatcgagaaaagtattgcagatttggctggcaaagcacgctccaattcgctttctctggccgacttgcaaggaggaacgtttactataaccaatggaggtattttcggctccctgctgtctacgccaattctcaatacaccgcaagtgggtattttgggaatgcataagatccaacttcgcccgattgccatcgacgaggaacgcatggaaaatcgtccgatgatgtatatcgcgttgtcctacgatcaccggattattgatggtagcgaggcggttcgtttcctggttacggtcaaagaattgctggaagatccggaatcattgttactcgaaggataaaataaatcgggcaagtgtatctcctctttacgtgtatgacaaaagcagactcttgcgagtctgctcagattgtcgagaaaccc

SEQ ID NO: 2618 - DNA, 1802 bp, Unknown
  Kingdom: Bacteria, Phylum: Firmicutes, Class: Bacilli, Order: Bacillales, Family: Paenibacillaceae, Genus: Paenibacillus
ataaaatgggggcttgaccaaaggaagggggggctctttttctttgtataaatgcaaatccgggcttctgaagataccccccagtgccgaatggtcagattactcattttgaatcaaggcttaccctcgtcaaagctgcatgataatcacttcaaattcttttgtacgcacaagtctgccaaaaagttttcaacttttatgttttaaatcataaaggaaattaaaggaatttgtcgaatctaatcaaaaaggcattgatagaggtggtattattgaaaagttttcaggataaaacaaatgcagaagataaatcaataggctttgattatcaatattattattttctttatctattactaggtctggaagaaggccagaaaataggtattgaagttaaagacgatgtacatatcgatttgaatgatggttcgcaagtcttactgcaattgaaacattcaatacaaactaatgcttcaggaaaagcagttaatctaactgaacgggacagtgacttgtggaaaacactttctaactgggtcaatattataaatgatccggtaggtgggaggtcaaaaagtgatgagcaacttgcttttatagagcaaacttctttcatactcgtttcaaacaaggctagtaatgagagtaacaaattcctacaaaaaattaaatgctttaaacagaagtcaattaatattttggaagtaaagggatacttagaggaattacaatcaaccaccgctgatgaggatattaagaagtatgttgaatcgcttaaaaaacaaacacaaaagtggcttactaagtttcttactaaacttgaatttgaactagatcaagacgatttgattttaaaaataaaaagcagaatcaaagggaagcaggtaaaagaatcaaaaattgaggatgtatttaatgctgtggacagtaatttaagacaacgtaactacatcaatactaaatcgaaagttaaaaatgtaattagctttgaagagttttaccatgattttcatttatactttgataaaggtagaaatgaaaagttacccataaataaaaaccccattcactttgataagcctatagaagaacaagtatttattaaacaacttattgacattttagcattagataagactgcaacttcggaaatgcttagacttgcaagttctatgttacagatcaataaccatttgaaggattggcttaatagaggacttatagtgcaggaacaaatcgatgaattcaacaatgactgtattgcaaggtggagaaattgtcatgacgaagtccatcgagaaattaatttggatttaaaaatgtttggaacagcgccctcagaaaaggatatcgtattggctgctctgaagtgcttagacgctgttagaaaaaatgaacttgtctttgatgagacagcgcttgatactgaattgagtaatggtcaattttatttgttgtccaatgagcccttaattgggtggcgaattgactgggaggaaaagtatgagcatgatacccccaaagaatctatataataatgaaatgattggtgcaatagctatttattcagtgctttttcatttacaaaccataagcgtcgctaaatcaatgcttatattcccttttatttcgcatcaaggcacactcgatttcttgaaaaataacaacactaccttgcgtagtcttgaggaatttataattaaaaagcccgatttcttttcaaattataacgaccgttactattcacttctgactttgtcagtgaattcaataatattacttaaagagatagaacttataag

SEQ ID NO: 2619 - DNA, 66060 bp, Unknown
  Kingdom: Bacteria, Phylum: Firmicutes, Class: Bacilli, Order: Bacillales, Family: Paenibacillaceae, Genus: Paenibacillus
caaatggggtgcagttcagtcttgactgtttttttatagattgcgattctctgttacaacttaggctcgttcaataatggtgttcagcgttgtacgatccagattttgaaccagcttgatgatcagctctttggctgcatcataatcatcagtgtgaataatggacgaggaagtatggatgtatcgtccacagatgcctatgacagtggatggcacgccaattccgctcaagtgcacttgacctgcatcggttccccctgtggagatgaaatattgatacttgattttgtgagtttccgccatgtcttgcacgtactccacaatcccgcgatgtgtaatcatacctggatcaaatacccgcagcagtgcgcctttaccgaggtgcccgtaagcattcgggtcgccgcccatatcgttggctgcactgcaatccagtgcaaagaatatatccggctgaatcagattggccgctgtgcgtgcaccacgcagtcccacttcttcttgaacagtggcccccgcaaacaatgtattgggaagcttgtctttttctttatgtaatgcttcaagcagttcaatagccaagcctacaccgtagcggttatcccatgctttagccatgatttttttaggatttgccagtggagtgaaatcacagatcggcgcaatggccgttcctggtacgatccccagatcttgcgcttcttgtctgctgtctacgccgatatccagatacatatgcttggtgtccataggtttgctgcgttgcgattcatccagcaaatgaggcgagacagagccaactacaccgataactgggccttttggagtcaatacttgaagacgttgtgacataatggcttggctccaccagcctccaaccggctgaaaacgaatcattccagtttccgtaataccattcacgataaatccgacttcatccagatggcctgccaccattacacgtggtccactctcttgaccgcgtagcaccccaaaaagactgcccaatcgatcttgcacgatttcatcggtataaccggatattcgttccttaacccatgcccgcaactcacgctcatgtcccggaatggaaggaaactccgttaaggtcttaaacaattccaatgtttttgattccatgatgtatacctcactccttattaattaaccagtggtcgtcatgtattcagtatgaatggatttgtatcgaatgtccacgatatcattttcctgacataacatttctccaaaaagctcataatgaaaaagacccaagcaattcgaaccgccaagcgcgaaaacttacagataaggggtggtgaatgatgccagctaaatccgggcagcacggttttcgtaccaatacgtcgccgctgtccataaatgagaaggactatcagaatatttcacaaaagcatgaaccctcgagaaaagtatttgccaattgtgtgcgcgcttttctggttggaggcgggatatgtgtgattgggcaggcgattcaagaggcttttatggcaggaatgcacatatcagccaaggaggccgccccgccgacctcatcgatgatgatcttgctggcggtcatattaacctgtatcggggtttacgataaggttgctcaatgggcaggagcaggaaccgctgtgcccattacaggctttgctaactccatgtgttcggctgcattggaatatcgttctgagggactggtgcttggagtgggcgcgaatatgttcaaacttgcaggctcggttgtcgtattcggggtggtggctgcatttatcgtaggcgttatatatgccatccttggtgtgggaggcaatcacttatgagaagacagggcggacaaacctggaagtttgaatcgagaccgcgcatcattggaagtgccactgttgtgggcccggatgaaggagaagggccgttgtccacagattttgattatatttatgacaatatagaaatcaacgagaaaacgtgggaaaaagcggaacgtagattgattgagcattctacagagctggcgctaattaatgccaatttgaacaaagaagaagtgcagttttttattagtggtgatctgatgaatcagattatcagtagctccttttcggctagcaagctggctattccctatttgggtgtttttggagcctgctcaacatcaatggaaagcttagccttagccgcacttattgtggactcagaggccggtgactacgtgatggcgggtacgaccagccataactgtactgtagaaaaacaattccgctatcctaatgaatacggatcacagaagccccctacggctcagtatactgttaccggttccggcgccgcaattgtaggacatgccaagtcagggacggtggtggattgtgctaccattggacgtgtaatggacatgggcattaaagacccttttaatatgggtggagccatggctcccgcggctgcggatacactgttgtctcattttcgagacactggtcgtgaccctggttactatgatctcattgtaacgggcgatttagcctcagtggggctaccaattgccaaggagctgctcaaaaaagatgggttcgatatgaatcagacggaatttaatgattgcggtttactgatttacgacatcaataagcaaaagaaagtcattgcaggaggcagtggttgtggctgctcggctgttgtaacctacgggcatttattgaagcggattgaaaaaggagagctgcagaaggtactggtcgtggcgactggagcgttattatctcctttgactacacagcagggtgaaagcattccttgtgttgcacatgccgtagcttttgaagcgggaggaacagtatgatatttctatgggcttttttagtgggcggtgccatttgtgttgtgggccagttgatgatggatgtgttcaaaatgacgccggcacatacgatgagtacgttggtggttgcaggtgcaattgctgatgctgttgggatatacgatccgcttattaaatttgcaggggcgggtgcgaccattccaattaccagttttggtaactcacttgtacacggcgcattaactgaattggagaaggacggatggctgggtgtcattacagggatctttagtctgacaagtgcaggaatttcctctgcgattattttctcttttctggcatgcttgtttgttcgtccaaaaggaagcatataaaagcagcttactttagatttgacataaaaataaatgattatatacatgtgcccttcggatctaatgaccgaagggtttttaattgttctgcacactgaagatcgaaaaaaggatggagtttgaataatacgggcagggggttaagtgtactctgtgcccaccttcatgtacaataataggaaacatgttgctatctaggaggtttacagagctatgcccgtacgtcaagaatctgtgcagattgtatctgcaatccgttctaatctggaatcatgtatattaggtaaatcctttgaaataaaattactgcttacggctatgctggcgggtggacacattctgatcgaggacgttccgggtacggggaaaacgcaaatgatcaaggctcttgccaaatccatgcgcggtgattaccgccgtgttcaatgtaatcctgatattctcccgagtgatattacaggggtatccatatttcatccacgggacgagcgtttttatttccgtccgggtcctgtgatgactaatattttgctggcggacgaaattaaccgagcgacgacgaaaacccagtcggctctgctggaggttatggaggaacgcagtgtgacagtagatggggacactcatatgttgcctcatccttttatgctgtgtgcgacacaaaatccgattgattttgaaggcacttatatgctgccggaagcacagttagatcgttttatgctcaaaatcagcttgggttatcctgacatggagacggagcgaaacatgctgcttcatcatcaggcaggccagccagcagaccgcctggaggctgtagctcatatggagcagattgctgacatccagcaggaaattagagggatttatatggacgaagcagtgacgtcctatttacttgatatcgttcgtgcgacaagagaacatccatccgtgctgctgggagctagcccccgcgcggcgcttgcttttgtaatggctgcgaaggcatacgcttttctggacaaccgtgactatgtgttgcctgatgatgtgaaggcgctggcaccttatgtgctaacgcatcgtttgttgctgcgtcccgaggcgcgtctggacagttccagtgcccagtccgtgctgcaggctgtcctacggcaggttcatgtacccgtacgaatggagcgtccttagggaatgaatatggtcaaaaggaagcgcaggcttccgcggctgtcaggccgcatctggcttctggtggtcatatgggtggtatgcctgctatatttgttgtttcagggcggcaagacgtcggtcatgctgttgtctatggttacgctgttaatcgtttatttatggatcgttggtctgagcggagttcgccgtgtgcaaggctcccggcagctttcgcaaggctcgcagtttggagaaatgctgcatgcgggagatcaggtgcatgtaaagctgagcctcagtatacctggttttcttccattaccctatgtcattgtccgtgaggtcctcaagcgacatacaggtgaatcctggtcgtttgaggacagtgtcattcccagtctaaaagggggcggtcagcttacatttcagactcctgctttagagcgaggaagctatcactttgaggatacagaatgtgtgagtgaggacatcttcggtctgttggagcacaaaggcagcttgaacgcacgcggtgaatttcgggtgctgccccgaacggtattcattccgtattggcagatgaatgatcgtcgctcaaggatgtctggaccgcagaccgttcaaactcgaacgcggcgtgaaacgacacaaattaacggtgtacgggattatgtatatggagatcgattttcgcgcatccactggaatgcgacggcgcgtacaggtagctggaaatccaaggaatttgagcatgagaccgttcctaaaacgatgcttgtgctggacgtacacatgaagcattatgtaaacgccgaacagtttgagctagctgtatcctctaccgcttcattgctggaatatggtggacgggagcgaatgggggttggattgtgcacagctggagagaaaggtaccgtctttcagccaagtgagcagacaatggaacgacaacgaatgatgcatcacttggtagacatacacacaacttcacaaggtagcttgaaatccgctatagaaagcagtgtacgccagtttccgcaaggctgttattttatactgattagtccgctgaaggattatcaggcgatggagcttcttcgctgggccgatacccgggggatgactccgtgccacgtctatatcggagaaggttctgctgagggagaagctgaagaatggatgagcatgcttcgtgcaagaggaatcaagggctacgatgttgagagccttgaggagctcccggctgtaatggggggaggaacactatgaagagcttgttacaatcgttaaagggttcctgggcccccgcttttacatttttatggattattattattgccatgcaatgggtttcttttgcttccgaattatggctggaagagacaagagcacttgtactgatgaccattacgatgctggctctggtgaagattgtactaccatttcgtccttggattgaatttattgttaaggcggcggcgctgttttttattttgtatcggacattggtgtcttactccatcattatccccttcggaggggtagccaatcgcctggaccaatttatatccaatatgtctccttatatttggttttcccttatcgcttggctagttattgaaatggtgccgctcatcgttacaacgaagcaacggattcttgtttttgtgggtattaatattgccgcgctggcagtgcttgattccttcacgccaactgtgctgtgggaggaggttgcttggatcgtctttgctggtatgggttggctggtgacacagcatctgcagtattttcggcagcattatcctcaagggtggaagcatattcggcgctatccatataaaatagcagccaatattgcggtcatttttgcgctcattattatggctggtgtcaatatgcccgaggtacagccagctttgacggatccctatacagcgtggacccagagagatagctcaaccaccgctgggatcagcaatggatctggggcactgaatcagcggatgaacaccgcatcgggttatagtcgccaggataatcggttgggtggaggttttaattttgattattctcctgtcatgaccatcacgaccactcagcgaagctattggcggggggaaacgaaacgaacctattctggtacaggctggagtgacgggggcaacgatgatcaaacgctaaatgatgtgccgatgaccgcagagcttgaaaacacacaagaaacgcggcattcgactgagcaggtcgttcagaccattacgatgcaaaacgaccaaagctatcctgttctatttggcgcttattcggtgcagcgtgttcaatcggtggacagagattcacgggcagacgggttacgttggaatccggaacaggcggagctgctttggaatccatcctcccgaagaactgcttatcctaaaacgtatactctggtatcgcatgtccctgtgatccctgagaaagagctacgcacaaaaacttttaatgagttgtacggaaaaaataaacaggaagcctatctacaaattccagatgagttgccacagcgagttcgtgatttggctcagaacgtaacgtcaacggcgaaaacgccgtatgaaaaagtcggattactacagcagtatttgcagcaaaattatgcatatacgaacaatccggacctctcacggaaaagaagcagagattttgtggatgcctttctgtttgagattcgggagggctattgcgattattattccacctcattagtcatgatggctcgctctgttggggttccagcccgctgggttaaagggtatgcacctggtcagcagacgttttcagatgatgcaacaacgggcgaaagtgacgaaaatatgtcctcttactccgtgacaaatgcggatgctcattcctgggcggaagtatatttaggtgaatacggttgggtccctgtagaagctacgcctggctttgatatgccactgcttacggaacaggaggattcaaagactccagaagcccctgaggttaaagatcaacctgaaccagaacagcctgagcagaccccgcagactaatccggaggaaggttcaaagattcatcctgtaattataggttctgctgttgcaattctgctgctgtgggctgcttatatcgtctggcgtaatcgggcagacattcacttttacctgctgcgtttacgcagaggtaagccgctgactccggatgaaaaggtggtcgtcgaaactgagcactggttaaggtacatgcgaagaagaggatttgtccgcgccagtcacgagacgctgagggaatcagttgatagatggtcgctagaagtaccggaacacgcttcaattttacatcagctgcttggccgatttgaacaagcgcgctatagcccctcatccgtaaccgcagaagattggcatatggttcgccagcaggcatctctgttacacaaagaaggatggataaaacgatgggctggacgaaaagctgcgacggatcagaaggatcaagactagtctatttttgattaggtccaaacgccgtctattttaatctttagctatatatttagtgaaaaagctgtccgtttgttgcggatagctttttactaagccatagtaatatggtatagtttgtcgtatgaaactgaggtgaccgacgttgtttgaaatgctgatgcccaaattacgggtgaataccgtctttgatattgatcttgaaggcttgtatgctcaaggatatcgcggcattattacggatctagataacacgctggtcggtgcaaaagcgccgaatgcgactcccgagctggtggcctggtttgagaaggtcaaacaggcgggttttaagcttgtcatcgtgtctaacaacaatatggaccgtgtatccgtgtttgctacgcctttggacattgaatttatacatgccgcacggaagccctccaactcgtcttttcgtagagccatccgtatgatggggctgactccggaagagactattatggtcggggaccaaatgttgacggacgtattgggaggcaaccgactgggattgcatacggtgttggtgctaccgatatccattcatgatgaaggagtcatgacccgatttaatcggcggttggagcgaatcgcgctcacaaggttacgtaagaaaggcttatggcttgaggaggaaaagaagaatgactgaaagacctgacggcggcactgccgtcaaatgtagtggttgcggtatcaccgtgcagaccactagcccggagcttccgggatatattcctgaaaaattgcttactcgcgaacctgtcatctgtcagcgttgcttccggatcaaaaactataatgagacgtcttcagtgacggtggatcaagatgagttcttgaagctgctcagccagattggcgacaaggatgcgctcgtcatccacattgtagatatttttgattttgaaggtagcttgatttccggtttgcaacgctttgtaggctccaatccagttatactggctgtgaacaagaccgatttgctgcctaaggtaacgaattggaacaaggtacgtaactgggtacaaaagcaagcgaaggagcaaggacttcgcacggaagaaatcgtactgtgctcagctaaaaaaaatcagggctttgaccgtctgttggatgtggtatctgagctccgtggtaaccgcgatgtatatgtagtcggagcgacaaatgtgggtaaatccacgcttattaatcgcttaattcgtgattatagcgatatggagcaggaactcacaacgtcccgttacccggggactacactcgatatggtgaatattccgctcgacgacggcaagcacattattgatactccgggtattgtatacccttggcgattcagcgaaatcgtctcccgccaggacttgagcgctattatgccagacaagccgctgaagcctgctgcatatcagcttgatgctggacaaacattgtttttcggcggtatggcccgatttgattttgtggagggtcagcaccaatcatttacctgctacattaacggtggtcttaagatacatcgcacgaagctggagcgagctgatcagttgttcgctgatcatgccggggaattgttatctccgccaacacgcgatcaattggcagagatgccggaatggacaagacatgagttccgcgttccacgcaaatctccatcggacatctacatttccggtttgggatggatcagggtaaatagcgagaacggagctctgattgcggttcatgctcctcgaggagtccgtgtgcttttgcggcctgcgttgatataacgttgctgtaaccatgttatagggcggcaaggaacaggtactggttcctgccgccattcatgtatttgtgcggcctaatattttgcaatatgggggagagcaacgatgaacagcggggagtctgaagcgaccgaacaaggtcttgtactattgggcgtattgggtgatccgatcaagcactccaaatcgcctcttatgcataaaatagctttacaggcagcggggattgaaggagattttgtacctcttcatgtcaaaccggatcagctggaagatgccatgaaggggattcgcgctttgcatttccgcggagtcaatgtgacgattccccataaagttgaggttatgaaatatctggatgagattgatgaaggggccagactcattggcgctgtcaatacgatagtgaatgacaatggacgtcttaagggctataacacggacggaattggctacgtacgttccctcaaagaagagacttctgtcgagttgaagggcgcaagaattgctgttcttggagccggaggggctgctcgtggtgtgattcatgctctgttggaggagcaaccggaatcggttattattttgaaccgaacacgtgacaaagctgagcaactggcattagagtggacgacggaagcgatcccagtgaggggttattccaacgaagatgccaagagcgtgctcgccacagtgaatgtgttgattaacacaacctcggtgggaatgtctcctttatccgatgaacttccactggaaacgagcttgattccgaagggaatcattgtgagtgatttgatctacaacccgctggaaacgagacttttacaggaaagccgtgaacagcgcggctgcactgtacatgggggtttgggcatgttcgtgtaccagggggctgtggcttttgagtattttacaggggttgtccctgctgtagagcaaatgagagcggctgtgctgagtagcctgtcgtaagtaagattgtacattaaaattatggaaatgctgcattgtatatgtggcgacgaaggggttaaatatacatgttaacaggtaaacaaaaaagatatttgcgttcaatggcgcatcatttggacccggtttttcaagtaggtaaaaacggtacgaatgagcatcttatgcgtcacatcaacgatgcgattgaaaagcgtgagctgatgaaagtgcaaattttgaacaactgtttggacgacaagcatgaaattgcggaagaactggccgcggagacaggttctgagcttgttcagatcatcgggagcactattattttgtacaaagaatcccgtgatcataaggaaattgagttgcctagaggataacacgcggggagaaaattatgaaaatcggtattatgggtggtacatttgacccgattcatattggacatctgctggctggagaagcggcaagagatgcctatgggctggatcaagtatggtttatgccttctcatattcctccgcacaagcatcaggcgggggcgagcggtaaggagcgtctggagatgacgagtgaagcggtagcgggtcatcctgcttttgaagtgctggatattgaagtgcttcgcgggggagtatcctataccattgacacgatcaaggagcttcaagagttgcactctgctgtggatttttattttattattggtgcggatatggtgaactacttgcctcattggcagggaattgaggagctggcgcagcgaatttgttttattggtgttcggcgcccagggttccagcttgcgttggatgagttgccgcattatttgcaggacaaggtactgctggcggatatgccggtggtggatatttcgtcgacggatattcgagagcgtgctgcggaagggcgcactatccgttatcttgtgccagatcgtgtgcatgactatattacaaggggctgtttgtatgaagtacagccgtgagcaattaatggaagccgtatctggtcaaatgcctgaaaagcgctggaagcacacactaggtgttatgcatacctcagtggagcttgcgaagcgctatggagcagatccggataaggcagaactggcggctattttgcatgatgtagcaaaatattggcctgttcagcagatggaagaggtgattcgcagtcatcccgaatgtgatcaggagcttttggaacatgacaagcagctctggcattcagaggtaggatactgcgttgcagcaagagattacggagtggatgatccggaaataaggaatgcgattcgctggcatacgtcaggacgcgtaggtatgagcctgctggataaagtcgtgtgtctcgctgattacatcgaaccgggacgggattttccgggggttgagcatatccgtaaacaggcaaagaaaagcttggagcagggccttatcgctggattcgactccacgatttcattgttgctggaaaagaaaaaggttatttttccactaacagtcttgtcgcgtaatgacttgattcaacaactaaaacagagaaaaacggaggttcatgaatgatcctaactaatgagcaattaatgcaaacagcggttgatgctgcaaatgataaaaaggcaatgaatgttgtcgcactggatttgcggggaatatcactagtagctgattattttgtcatctgccatggtaattcggatacacaggtacaggcgattgcaacagaaattcgcaaacgcgctcatgatgagggtgtaaccatcaaaggaatcgaaggaatggattccgcccgttgggttctaatggatttgggggatgtcgtagtgcatgtcttccatcgcgacgagcgcgaatactataacattgaacgactctggtcggatgctaaggttgtggaaagggtatgagtttgatcgccggtacttatgtcaccattatggtggatcgtgaggtatctcctttcggctactttctcactgttggtgagcaggatgtgctgctgcattatacggagctgacacgtgaaattgaagttggtgaacggttggaggtatttatttttcacgatacagaggaccgcttggccgcaaccatgaaaaagccgttcttgtcgttgggcgaaatggcaaagcttgaggtggccgatgtgcatccgcgtttgggttgtttcctagagatgggattgggtcgtcagcttttgctgccgattcgtgagttgccagaaaaccgagatttacatcctcaggtgggcgactacgtatatgccattatggagcatgacaagcaaggcagactgcgggctaagctggcaggggaacaggagcttgctccgttgtgctttcacgcccctgattcgtggctgaatacgtgggtgcaggcgactgtgtacaagccgcttcaaatgggcacgttcgttctggtggacggaggtgtgcttggttttggtgcgattgggatgattcactcctcggaacgcaaccggatgcttcgcttgggcgaagaggttaaggtacgggtcacacttgttcgcgaagacggtcgggtcaatctggcgatgtcgccacgcaaggaagtaggccgtgatgaggatgcggagcggttgattgcttttctgaaggagcgtccgggtggcggcatgccttactctgacgcaacgccgccggatattatcaagcaacggtttggtattagtaaatccgccttcaagcgtgcgatgggcaagctgatgaaggaaggaatggttacacaaaaggaaaactggacctacctggtggagaaaatgccgaaaccgaaggacgggaatggggaataaaaatggcttcttaccggaagtttgcctatgtgtatgatgagctgatgcaggacatgccgtacccggactggttacgctttgcacggcaggcttgggatcagtacggtatgccgcatacggtggctgagctgggctgtggaacgggttcgattacgattcccctagttaactcgggcttcgaagtgtctggaatcgacttatcctctgacatgctggcagtagcccgtcgcaaaatggaaaccactccccagggacagcgattgtttcgtgagggaagcgttcgctggatacagcaggatatgagagaatgggttttacccgagcctgtggattctgtaatttctttttgcgattgtctgaattacttgttggaggaagaagatataatttctacttttcgtagaactcatgctggtctgaagcctggcggaaccttcttgttcgatgtacatcatccgcagacgtttttacgttatgatgaagagcagccattcgtactggatgatcgctctatctcatatatctggacatgtgcgttggacactccacgttgtgaaattgagcatcatcttagtatctttgcaaaagcagaacatgaaggacgcgatctgtatcagcgtttcgaggaaattcatgtacagcgtgcctatgatccagattggatgaaggcagaattgtccaaagcaggttttcgtgatgtgaaggtatatgcggattttgaatgggtagaagcagaagatgacgcggcgagactgttttatgttgctgtaaaatagtgaagactcattgagcaaatttaggaaaagaaagacgctcttcatgatgacatgaagggcgtctttttgcactcatatattcactttatagttcaactgaagctcatcacccggtacaccccgaataccccagttctgtttgggcgtttcaaatatagtaatctcaagatcctgtggagcaatgccaaaatggtccgtaattcgttggaataacagctggatgagctgcttcttagcttctgtcgttctgccttcaaagatactgatttcaataatggtgtacgcctcagagcgaccatcggcatatataaagtcttcctgatccatagggaaaaaacgatgaaacctcttgtctggagggtatttgaatgcatccaccacagcagaatgaatcacctctgaaagctgccttttgattggatttagagcttcttttattccgaaaattttaatctgtgccatgtctcagctcacctttcttatctcaactcaactcaatttgcatcaatttaattcgaagttattataaaacattcgtatgcatgtgtcatgaacaattagtatgaagagggtatttaacaccaaagctagtccttatttgacttttttcgcggttttcaatataatagtgccattattaacggttaaacaatcgctgatgaggaatagtagctttgtctggacatatagagagccggcgggtggtgcaagccggttgacagcgcaaagtgaactcgcctcggagatatgcgtccaacgcaggaacgcctttacaggtgcttgtatcctgttattaacccgcatcggatcacctccgttatcaggtgcaaagggagtagaacgcgaagaacgctttctgctaactagggtggtaccacgggaatataacctctcgtccctagcgctgacacgctacgggatgcagaggtttttttgttgcataccgtttgaggaggaaaagacaatgacagacacacagccgaagcacggctatcaaccgcaaagtattgaaccaaaatggcagaaatattgggatgagaacaagacgttccgcaccggggaagagccgggcaaaccgaagttttatgctttggatatgtttccgtacccatctggagccggcctgcatgtaggccacccagagggctacacagctacggatattgtttcacgttataaaagaatgcgcggctacaacgtactgcatccgatgggttgggacgccttcggtctgcctgccgagcagcatgcgctggatacaggggagcacccacgcgaaattacggtgaaaaacgtaaataacttccgccgtcaaatcaaatcgctcggcttctcctacgactgggatcgtgaaatcagcacgacggaccctgattattacaaatggacacagtggatcttcatccagctgtacaagcgcggccttgcatatgtagctgaagtacccgtgaactggtgcccagccctgggaacagtgctggcgaatgaagaagttattgacggcaagagtgagcgtggcggtcatccggtcgtccgtaaaccaatgcgtcaatggatgctgaaaattacggaatacgcggatcgtctgctggatgatctggaggaactggattggtctgagagtattaaggatatgcagcggaactggatcggtaagtctacaggggcagaggttcgttttccaattgaaggctatgacgagcaactcacagtatttacaacccgcccagatacactgttcggcgcaagctactgtgtgctggcaccagagcaggaattagtggatattatcactacgcctgagcaaaaggatgctgtacaacagtaccgtgaacaagctgctcgtaaaagcgatctggagcgtacggatctggccaaggataaaacaggcgtattcacaggagcttatgcagtgaacccggtgaacggcgaaaagctgccgatctggattgctgactatgtactggcaggctacggaactggagcgattatggctgtacctgctcacgatacgcgtgactgggaatttgccaagcaattcggattgaatattattgaggttgtccaaggtggagatgtggctaatgagccatatactgaggatggaccgcacgtcaattcaggcccgctgaatggacttaccaacgaggaagcgattccgaagatgattgaatggctggaagccgagggcaaaggacacggcaaagtcacctaccgcctgcgtgactggctgttcagccgtcaacgctattggggcgagccgattccggtaattcatctggaggatggaacgatcaaaacggttcctgaggaccaacttccgctcgtactgccggagatggacaatattaagccttcaggtacaggtgaatccccgctggcgaacgcaacagattgggtggaaaccattgatcctgagacaggtatgaaagcacgtcgcgagacgaatacaatgccgcaatgggcaggaagttgctggtattacctgcgctttattgatccgaaaaatgacaaagagcttgtatccaaagagaaacaacgtgaatggatgcctgttgatttgtatattggcggagcggaacatgcggttcttcacttgctgtatgcccgtttctggcataaggtactgtatgatatcggcgtagtggaaacaaaagagcctttttataagctggtcaaccagggtatgattttgggcaacaacaatgaaaaaatgagtaaatcacgcggtaatgtcattaatcctgatgatattgtcaatacgtttggcgccgatacgctgcgtatttatgagatgtttatggggccgctggaagcgaccaagccatggaatgagaatggggtagagggagcacatcgttttctgtcccgcgtatggcgcctgtttgtttccgaggatggtagcctgaatgataaaattacaaatgacggcggtagcgatgagttcaatcgtacttggcataaaacgctgaaaaaagtaaccgaggatctggatgcgctgcgcttcaatacagcgatcagccagctgatgatcttcaccaacgatgcatacaaagcagaccttctgccgcgtgcagcaatggaaaacttcgtgcaaatgctgtcgccgcttgcaccccatctggctgaggaattgtggcagctgctggggcacaatgatagcattacctacgcggcttggcctgcttatgatgaagcatggacggtggacgccgaagtggaaattgttgtgcaagtaaatggtaaaatcgtacagcgtgcaacgattgctaaggaccttgatgctaaagcgatggaggcatacgctgtgtcgttggacaatgttcagcaggcactggccggcaaaacgatccgcaaggtaattgctgttccaggtaaactggttaatattgttgccggttaatcggctttaagccgaaggagacatctaccttttgcatgtcctcttcatacttgttgtgcgtggcctgtattagctcgggaaagacgctatgcaggctgatgtccaacaatgcgagagcttcggcggtaatacctccgggaaccgccactctggcctgtaactcggctggtgtcatcccgccttccgtgagcagctttccagtgccgatgatcatttcaccggccagggcgcatagctccgtacggtctatacctgtagcttgaactgcggcttgaatccactggtccataaaaaaggccaagaaagcaggaccacaactcgaaaaatccgacgtgatccgagtataagattctttaacccgaatcggcctgctgatgtgggacataagctcttccagaagggtgcgatcctcctttgtaatccggcttccatggatgcatagtgaggctccgctgcccacttggtgggtgatacttggaataattttggacactttggctttcagtgcatgttccaaaatacgaatctgcaccgggcttgtgatagatacgacgatctgctcttctgtaatgacgttgcgtatttcatccgttacggcttttgattccagcggcttcacacagataaacagaacatcgctttccgctgccgtttcacggttgctttgggctgcatgcaaacctggatagcgacggactagctcggttaccttggaatgcgttcgattgcttgctgatatttgctgcggcttgagtgcgttagaattaataaaagactcaattagcagacttcccatgctgccagtcccgataaatccaactttcattgttcaacgtcctcctttcatactttgcggtatagacgctgtgctgtcagctgtcattcttcttagtgtatgcgcctggtcttggccgacatgacgaattttatgtctgagcatgttagatcgtccccggggtcgtaccacttttttgtgaaaatgctcacagcgagaccgtatggaggttgtttgcaccctccggtttaacgggaattggacagacttgctctgtttgattgagacggtgttttcagtcagctcaatttcccgaaatccatgtggagtaggggacgatacggaaatgaaacgtgtatggacaggaacagcgataacgcttgctgtaatcgggagtggacttattttatttgccggagggcagcgctctgagccgcaagaagagtggactttacttaaccataaggtggagcaggctgtggcgatggagacagagccaaacgagtcgcagcgcagcagtgactacgcccagaaaaagcctggtgtaaaagaaccttcagacaaagctgagcgcagtaggaatgccgaagccgctgacaatgtgaaacgtgatactgtgcagatttctactggtgtatctgctgctgtgagcgaaaactctattgcgggaaattcaagtaccgaaaagcagtcaggtgttgcgaatccgagctcagacacaggtattattagttcgagtggtgcaacgacgagtaggaccaatagggtaagtgattcggttactacacccgattccggcgaaaaaaaggtaaacatcaacacggcgactgctgctgagttaatggaattaccaggggttggggctaaaaaagccgaggctatactgaactaccgtaatcagcacggggcgttcaaacgtgtgaacgatttggatcatgtaaagggaatcggagctaaaatgttggcgaaaatgaagccgtatgtcagtttgtaacttatataagattataatgtacaggtcctgagaacggcggtagcggatatggtttacgttttaacttgtttatacgggagagatggaaatgagtgcagatgtacgcaaggactgggacacctatttcatggatatcgcttatatggtatccacccgttcgcgctgtgcgcggcgtcatgttggagccgtacttgtacaaggtaaaaagcttttggggacggcctataatggagcaccatccggggtacctgactgttctgaggcaggctgcatgatctcagaagagtatgaggtcgttcaccgtgatgggcgtgaggaaatggttaagaagcagcgttgtattcgcactattcatgcggagcagaacctgctgctgtttactgaccgaattgatcgtgaaggctcttcagtatatgtcaccgaccagccatgctggacgtgtgccaatatgttggcgaacagcggtattgtggagattgtataccaccgaccttatcccaaagatgccgacaaggttcgtgctatgatggaggaaaagggaatcgcctttcgtatgctgaaaacctatcatccaccaaaagaaacactgatggatgtaatgaattaaaaaagtaaacgaggaagaacctctgacgaatgctattttgtcagaggttctttttgttttgtgttttttggacagaaagcaatgtttgctaccggaaggtgattgtattcaagctaagcttgtgttaactagacctatattgacccttactgtttgttggattacaggaagtgcgggagcatgtctgtattctggacatatgcttttgttactctgggcgggggttaccctgatctttccgcttatagctttatggatgaaaatccccatccggcatatggtattactttggcttgcattcagtggtggtggatttcattggttttggcatgatacgcataatgttagcagtattcccgatgctcttcatgtatcgtcttctatggtggaagacatgcctgttcaagtagcagggcttatcgcttctaaagtacaggtagatggtgatcgaacacagtttgagatgagagtcacctcaatcaatcactacggaagtcattcgaaaaaggacgagaatcgtacaccaatttctgaacaggtcattgttcatatcaagttggctgccaagcaggaacagcaacttgcggcagcatggcaacgtggagatgcaatcctagtgcgtggcaccttaaaggctcctacaaaagcggggaactttggaggctttgattacagtgaatacctgcacacacaggaaatccactggcttttcaaaggcgatggggtagcctcgttacagaaacaggaggcttcactgtggaaccgctacactttgttcagatggaatgatcagctaagggagcaactagggcagagaatggaatcggcatttacatcacttcatcacgcaggatatatgaaaggactggtgcttggggtaacagatgagttggacccagcaacgtataacgagtttacgaagcttggtttaacgcatattttagcaatatcgggcatgcatgtggcggtatatgcagctacactattatatttactcaagctactaagagttagccgcgagacatctcttacagtcgttttgatactcattccggcttatgtcctgctgacaggtgcttccccctctgttgtgagggcgggaattatggcgatgatcggcttgtttgcagctcgacgaggtatgctcaaagacggacttaatattttaagtatatccgcgttgctcatgctgatttggaatccatattatctacttagcgtcagctttcagctttcctttttggtgacaggtgggttgctcatttatatgccgcttatgaagccgtttttcgccaaatggcctttcctaatcggaggtgaagttgcgattacaattacggcacagcttgtttcgtttccaatgacggtattctactttaatcaattttcgctgttatcatttgcggccaattttgtgcttgtaccccttattacatatatcgtgcttccaataggtacggtggcgatggggctttcctttttgtggggggatggggctcgtattcttgcgtggccggcagagcaattgaacgatttgacctttttactagtgaaatggctgaatgtggatgatgcttatgtgagtatttggccgtcttcctccatcctgtgggtcatggcgtattacgcagctctgtatagtgttctgtactggcttaaaacgtggctgacatctcgcaggcaaacagacgataattctgttttgaattccacacccatatcatcacccgtttatacgggattagctgcttctgccgaatgggctgctgttttgaatacagctcatgaacctgagggagcagggaaatttgcgcgtcgacagtggaatggttatcgtcatttggcactggctctaagtgttatcgcctggcttggcatattgtatacaggttaccaatctcctagtggaggaaatacgggaactgttcaatatctggatgtgggccaaggtgacagcattttaattaccacgccgggcgggaaacatattttggtggatggcgggggtacaatggactttgctacagggaaaaatgcttggcgcaaacgcgcagatccctatgaggtaggtgaagatacgattgtacccttgctaaagcaacgaggtgtacatcggctggacgctgtcattttaacacacggagatcatgatcatgcaggaggactacaggctgtgcttgaccagattcccgtatctaccttgttttttaatggtaccctgacagataaagccccattccgtaagctgttgaacacggctttagacaagcagattaagctgtacggtgcacatcatagtatggaatgggaaccagaccaggctacgaaaatccgctttctctatccgtttacgccaccggagaacgaatctgagcagttgcctgttatgaaggagcaaaatcattactctgttgccatgatattggagatggagggagcctcttttttgttcacaggagatatggatgatgcagcagagtcgtcgttgctctctgaattaactcgtttttcatcaagtgtgaaagataagggagcagcgggggctgtcgggaaagctgtagatgtcatgaaaatagcacatcacggtagcaagtattccacctcggaagagtggttatcctactggcgaccgaaagtatccgttatttcggtcggtgcgaccaatacttacggacatccgaatgaagcggtattggaacgtttatcggcagttgattctgctatatatcgaacagatacgatgggagagatacagattcgagcgcagcaaggtaaactgagtgtgcggtatcaacgtaaacggtacaaaacagatactaatacaacaacatactaaaagggtgctcactctcaggagtgggctgtttgctttgaatccaatctgcatggacagtagctgtaagctttgatagaatcatatgagtaatgaaaatgagaatcattattaacgggaggaatattgtgagttattttaaatttagagcctcagcttgtttgttcatcatttcattaatgctggtattgagtgcatgcgctacaagtgggggtgggactgtaacagaaagcggtcaatcgactgctcccaagagcacatcaattggaggtgaggctgccacgcgtacatatgaaagtgataaaggtacaattactgttcctgagcatcctcagcgtgttgtagttgcagttggtgattatgtaggtgatgtgctagcacttggtattacacctgtaggggctccagataccgtatttaatgctccatattataaaaaatacttgaatggtgttgaaaatatcggtgacagctccgcattgtcccttgaaaaggtgatcaccctaaagccggatctgatcattacctatgatgagaaagcatatgaaaatctgaaaaaaatagcgcctactgtgtttattccatatggtaaatatcaatataaggaccgtctgatggagctgggcaaagtgttaaacaaggagcaggaagcgaagaattgcctggctgattttgcaaccaagattgctgagaagaaacaggctttgtctgacgtcattgattcgggtaaaaaaatcgctatttttgagattacaggaaaagaattatatctatatggaaaatcttatggacgtggaggagccatactttatgatgagctgggacttcatgctcctgagaaggtagaaaaggcagcgttcgagaaggggtgggccagcatttcaatagaggctttaccgaagatgctgggcgatgccgattttttaatgttgggtattcgaggcgacggagcagaccaaggaaaagatattttatctaaaaatgtgtggaagaacctttctgccgttaaatcaggtaaagtatatcaatactcaatcgacgatttttattttcaagatccgattgctctgacttatcaattagaactcatatctgattttttggtttccaagaagtaacaatatgatcttgcagctcgaaggctagcatttagatgtatgtaggagctaggggaaggtgactaccttccctttttctgttattctaagggaggatatgctggggattctgggctttttggtataattttttttgttaaaaaaataaaattagtgtcagacgtctatcctgcaacaatttgcaaaatggatacgtctgtaatattgcagggagagggggatcctttgtggtagagcagggactcattcgagccgctcaatcgggcgatcgcgacgctctcattaccctattaagagagatagaacagcatgtgtaccgtacggcatattacattctaaacaatgagcaggacgccatggatgcttcacaagaagccctcatacggatctattccaaaattaactcttatgaggaaaaagcgcagtttaaaacctgggtccaacgcattgtaacgaatatatgcatcgacaaattcagaagaacgaagccctcggtttccattgacgagcacgacatgatattcaacgatccccaaaacgtggaggtcgaggtgttgacctcttatatggcacaggatgttcgtgaggctatacaacaacttccggagcaccaccggacggtaattgtcttaagatatctgcaggatttttcctataacgagattgcagattctctggatttgccgctaaatacggtcaagtcatacttatatcgtgcaagacagcaattgcaagggctacttcaggaatatcagaaaggtggtgtatcaggatgaagtgtggggaagaggtgatggattggatgcagcgttatgtggatcatgagctgggcgaagaagaaacgtcccaattaatgaaccatattgcgacttgcccggactgtgcggaaaaatttcttattcttcagacactctctcgcgagctggaggaattgcctgcggtttccccggcgttcagcctggtggattccatcatgcctcagcttgatgccattgaccgcgcacgtgaagagcagggaagtgcgcttcaggaaatgcagcctgtgactgtagagcctggaccagtgcctagacagcgtacccagcctacaccttggtggaatcgaatggctgggcgcgctgctatgggcgtggctgccgctgctgttgtactggggattgtagtatttaacttcgagcctaaaacagtgcaggatgcggaaggcatacttacaacccagacgcccgaagtgacgaatccgcagaatcagacgggaattcttccagatacatccaatggcagtggaggccgtgatgcagccattggttcggattctacacagcagccgtcagagcaggggcaaggaacggatgcatctcggccacctgcggataaagaacctgacctgagcaaacaaggtgcaaccaatgcagacgatgaaaagaactcttccaaacgggatgctgggaaacgtgacgatcagcgagctggggaggaagattcgacgaagtctacaccagctgaacattcttctcgtcaggaggaagggcagggacagctacgtacggatcgtcaggtggcaaaggaaaatccgtctgctgcagatgcttctaaatctgaggacaaacagttaagtcaggaaaaatctgatcaacccacgattgctcctgatgaacagttagaaccgaaaatggaaaaagcgcccctagcgggtacgggtacggctcaggacggtaataacgatagcacgagtacgaatgattcatcttcgtcgcttagtcaggaattgaaggtgcaggagcggattgcgtcaaacgaaacgtcgaaagacacgacttccaaaagcatcactaaggattcggggaatgccttgggaacggatagcagcaatgcagcttctaatgatcagcaatcatccgtgtcacaagacccggttcgtaaagaaggctttgtatctaattcactggtctctccagacaacgataatgcttccagctatagtgcccaatccgcatctacagatcagctcaactcgcctgatggtagctatgcggtggctattgagggcaaaaagctgaaagtgtataagctttccgataacggtgtagaccgaacaaccctggaagtccgtactttaaaaggtgcctgggtcaaaggaagctggtcagaagacagccagacctttatgtatgagacggagcaggatgggacagcaagtaaatatacgtacaccgtcccgcgcagcactggaaaatagtttccgtaagttgacacacttttaaaaacagagaataaactatatgaaccgacgtcgtatcccgacggccgaaagtttctagagctttctgctgccgtgttgatatagatggtggtgaagggatcctgcctataggcagggtcccttcgtttgtatcatgacttgccttccggtcggatgtcgggtaccatcattgggtggggggagaacggaaaatggatgtaaaaacagcctctaaggctattcgcaaaggcgacatttcgccagtgtatttgctatacggcagtgaaaaatatcaaatgaagcagtttgttgagatgcttaaagagaaagtggtggaagaggagcaccgtgacttcgccatcattccttatgatttaaccgaaacgcccattgaggtggtcgtggaggaggcggaaacagcgccttttctggtaccaaagaagctgattattgtacgggataccagtgtatttgcagcaggcaaagatagcggtaagatagagcaccggcttgagacgctgttgacttatatggataacccgactgactatagcgtcatcgtttttacggttcaggctgaaaagttggatgaacggaaaaagattgtcaaaaaactgaaaagtgatgcttcggttattgcttttgctccaatgggtggagatgatcttgtggcttggattcataagcgtgcaggagaaagagaagtgcaattggctgcaggagctgctgaaagcctcattcaattcacaggtactgggctgcaatccttggctgctgagatagacaagctctgcttgtacgcaggagtacagggaaccatctcatccgctgatatagaatccctggtgcctcgtaacacagagcaaaacgtatttgcgatggttgaggatctggctaatttgcggctggataaggcactcagtattttctatgagttgcttaagcaaaaagaggaaccgatcaagattgccgctttgatcacgcgccagttccgtattatgttgcaggtcaaagagctggcaggccaaagctattcccagcaacaaattgcgagtcagcttagtttgcatccttatggggtgaaagttgcaggagaccaagcgcggaggtttcgccctgagcagctgcgtcagcttctctacgaattgggcgagctggattatcatatgaaaacaggtgtcgttgacaaggtactgggactggaattatttttgatgaaaatgggtgcgggagcttcaatctaattccccccatgtgctgttatagagtcagctaatgtatcgtgaaaagctgactctaaaaattaataaaagttataaactaaaaaaacctgatcagccaaggctggtcaggtttttttcattaacgtatgaaagtagctcttgcttacgcttgagctgtaagagcgttaagttttttcgccaagcgggatttcttgcgagcagctgcatttttgtggatcagacctttagttacagccttgtccagcttttgggaagctactttgaaagcagcagcagcagtttcagcttcgttacctaccaacgctgtatcggcagcttttactgctgtacgaagcgcagatttttgggaagcgttcaacgcacggcgtttgtcgctagttttaacgcgtttgatagcggatttgatgtttggcattacattcacctcctgtaaaggcattacttatgaacacaaacgtttcacaacttaaaatattttagcatgccacacctcaaattgcaataagaaaacattctgaggcgatgcgaattacaggatgaaaatggatgtgcataaacctgttgggtgtctcgcacactatagtcaaagatggtatccaaggaggcttaaaagatggatctggatttgcagaagtatgcggtacgcacggatttggcattagaggcaagagaactggccgaacgggatcagcctgtacctctggcgggcataagtgagaacgtggaggaagataacggaatcaaaatcacacggctggatgtactgaatgaagaaggagccaaccgtattgggcgggtacaaggacattacgtcacgctagaagtacccggcttgcgtgaaggcgacacggggcttcagcaacgtgtcgctattgcatttgcaaaagaaatggagcattttatacaaaaaataggaatctctaatacggcaaaggtactggtggtaggtctgggcaactggaacgtcactcccgattctctgggtccgcttgtcgttgaaaatttaatggtgactcgtcaattttttgaactaacacctgatcaaatcaacccgggctatcgagatgtgagcgcaattgcaccgggcgtcctgggtattacggggatcgagtccagtgaaattgttcaaggcatcgtggatcgcacaaagccagaactgattattgccattgacgccctggcgtcacgttcactggagcgcgtcaacacgaccattcaggtggccgatatcgggatacatccaggttcaggtattggcaacaagcggcgcggtatcaccaaggatattatgggcgttccgtgtatcgctatcggcgtaccaacggtatgttacgcttcgaccattgtcaataacgtaattgaactgatgaaaacacattttaccaaagaaaaggcttctacaaaagcaatcctggggatgttggacgatatttcagaacctgagagacttgggctggtgagagaggtcctacaaccgctggggcatgatctgatcgtgactcctaaagagatcgatgaatttattgaagatatcgcgaacattattgctactggattaaacgctgctctgcacgaagctgttgatcctggcaatgtcgccgcctatacgcattaatcaagggttggtaaaatcgtatttcatacacaaaagtctctatttaacaggaatctaatctctttcaaaaagggaggtggtatacctgtagtagagattttttgtgttctagcaattgttcttcgttcatagagttgaagtataagagatttccgcagcagataggaaccctatgttcctaaataaagcgggtttcgacgggacgaaggaggacaaggctcgcatgaaaaaaattcagacctggaacgtcggaagatggagaagaaaaggtatcgaaattttggcgatgggacatacgcttgtgctgctgatcatgggctcggcgcttttatttgtcgttttggggctagggggattggcagaaaatcgtctacaaacctctcctgtttcttccatgaaaggattggcaggttcggtgtccagcggttttttcgcggatatgctaggtatggaagtacctcatttggcacaaaagaagcagcaatcttcgttgtcgggtgaacaatggtcgccttttgtttttcagatgcttacaggtattaatccgcaagatcccaaaagtctcatttctcgtgagattcctggcatgtctgcaggagcacctgtcttgctgcgcaagggttcagggaacatcaaggtagagggtcctacggattatcagcccgatcaggggacgacggatgcccctggtggctcagatacatctgagaatccaccgactactacgccggatattccgacaacaccggaaacagacccggtacgtgaggatcatccaggtgatacagccaaaggggacaagcgtatattaatctaccattctcatcccagagaagcatataacccactactcagcaaaaccagttccaatcctaattcaggttctaaatcagctaatgtgtcaagggtaggggactttgtaaagaagaggctggaaaagcaagggatatccacattgcatgtaaacaaggattatgccactacagttcaaaattacaattggaactactcctataaatattcacgcgaaacagtcaaggaagctttagctggaaataaaggtttaacttatctgcttgatatccatcgagattcacaacgtcacggaaaaacaacagcaaccattaatgggctttcctatgccaaggtatattttattatcgggcatgacaacaaaaattggcgcgagaatgaagcttttgctgctcgtattcatgaaaagttggaaaaatcgtatcacggcgtatcacgtggtgtatgggggaaagatggtggcaaaggcaataacggtgagtacaatcaaagcttgtcttcccacagtattttgatcgaaattgggggtattgacaacaccgaggaggagttaaaacgtacctcggacgttttggcggacatgatcggtgaagtgtattgggaagatcagaaagctcagaaagcgggcactaacgtatcggatacaaaaaagagcaacagcggcaattaaatgaggtagcggtaagggggaagggtaatgtctggacattttcgtaagaaagcacttggatttgtactgctcatgggggcaggcattctactcggtatgcaactggcaggatctggccttcgttcagtgtatggaccggaatggaatggggatacgattcaatcggtaaatcaacagaaagtcggatatgaacagacggttattgaggatacacccgcagctaacactcgtgcatatagcggtacgtatagcacaagtggaaatgttaaggttgagccgacaacgggagtgggtataaacgaagctagtggaagggaagaaaatgaggaacagacggagcatggggcatccaggtggtattcgacgactgtgcagcatgtcaatactcagggcctggagacaccgcgtgaactgctggccgtcaaggaacagcaagcctcggtggataccatggcggacaaaacagctgggttgcttcaaaacctgtcgagacagggcattcgatgggtcgtatctgtatttgatggagtaacagaatagaaatattgctgaccccccttacaactgctataataagctgattgacactaggcattgtgtgggggtaaggcatgactgacattttggcaagacaacgtaaaattcggaactttagtatcattgcacatatagaccatggtaaatccacgctggctgaccggattttagaatataccggtgcactcacttctcgtgaaatgcaggaacaagtgcttgaccagatggagttggaacgggagcgcggaattacgatcaagctccaggcagtgcgactcacttataaggccgatgacggcgaagagtacattttgaatttgattgatacaccgggacacgtcgattttacgtatgaggtatcccgtagtttggcagcctgtgaaggtgctttgctggtagtagacgcagcgcagggaatcgaggcacagacgttggctaacgtatatttggcgttggataacaatctggagattttgccggtgcttaacaagattgatttgccaagtgctgatcctgaacgggtaaaacaggaaatcgaggatgttatcggcttggatacaagcgagaccgtacatgcttcagccaaagctggaatcggtatcaaggaaattttggagcaggtagtcagaagtgtacctgctccacaaggtaatccggataatccgctgaaggcactcattttcgattcgcactatgatccttataaaggcgttatcgtatatgttcgcgtcgtggatggtagtatccgagccggttcgaaaattaaaatgatggcgactgacaaaacgtttgaggttattgaagttggtgcttttatgccgcgtatgaacatcgtggacgagctgaatatcggtgatgttggctttatcgttgccggaattaagcatgtaggcgatacgcgtgtcggggataccgtgacagatgcaaaaaatccaacattagaaccgatgccaggttatcgcaaaataaatccgatggtttattgcggtctgtatccaatcgaaacatcggagtataacgatctgcgtgaggcgcttgaaaagctacagttgaacgatgcttcgctcagttttgagccggaaacatcaagcgcgttgggctttggcttccgttgcggattccttggtctgcttcatatggacgttatccaggagcggattgaacgtgaatttaacattccgctgattacaacagcaccaagcgttatttaccgcataaagttgacgaatggggaaacgatccagatcgacaacccatcgaattatccggaaatcggacggattgaacatgtggaagagccctatgtaaaagcaggtattatcgtccctaatgattacgtaggtacggtgatggagctttgtcaaaccaagcgtggagaatacgtaaatatggaatacctggatacgacacgggtaaccattacgtatcaaattccgctgtctgaaatcgtatatgatttcttcgatcagcttaaatcaagtaccaaaggctatgcttcctttgattatgagatttcaggctatcgccagtccaacctggtgaaaatggatattttgttgaatggcgagcaggtcgatgcgctgtcgttcatcgtgcatagagatcgggcttatcatcgcggacgtattatctgtgagaagctgcgcgagctcatcccgcgtcaaatgttcgaggtgccgatccaggcatctgtgggaacaaaggttgtggcgcgtgaaaccgttaaggcgatgcgtaaaaacgtcttggccaaatgctacggcggcgatatttctcgtaaacggaagctgcttgaaaagcaaaaagagggcaagaagcgtatgaagcaggtcggtaacgtagaagtaccacaggaagcatttatggcggtactgaaaatagatgagtaaagctgcttgaagtattcgtccattctttcatggggcatttgccgtgcatggagaatggacgttatttatttgagcaagctatccagagatggagtgtttgttatctcagttgcaaaaatagtataacaacagcatctttagcgtatttctaaagatgctttactcttactgcaacacctacaccacaaaaaaatgaccgatggtggtaggcagcagcggagtggatggaatcgttctgaagaagcgttagcgttcgcctttatccccggattttaccctattaagtttatttagaaagaaaaaatccgggggtaacagcgatcggaagaatgatccatccacggagcgttctccccctcttcgccatttttttcaatcaccacactctgaattgacaaggaggatcggtatgaccgcatccatacaaaaacatgaacattcatccgcccctcaagcggtttacctgcatatacctttttgcacgaataaatgcttttactgtgatttcaactcttatgtgctcaaggatcaaccggttatggaatatctttatgcactggaacgagaaatggaacatacagtcaagcttcacccgccaggagagattaaaaccatttttgtcgggggtggaacaccaacaaccctaaacccgaaggaaatggaatattttctgaagagtgtccgaacctatttcccacattgggcggaagatattgaattttccatggaagccaatccaggcaccactgattttgaaaaactctctgtgatgaaagaaggcggcgtcaatcgactgagctttggtgtacaggcttttcagaatgagctactcacaggcataggtcgtattcacagtacagatgacgtatatcgtagtttggaaaacgcccgtaaggtcggcttggacaacctgtcgattgacctgatgtttggtttgccgaatcaaacggtggacatgctgcatgaaagcgtgagtagagcactagagctggagcttcctcattactctatctacagcttgaaggttgaagaaaacacgctcttccacacgctgtatcagaaaaatcagctaccgcttccacacgaggatgatgaactggaaatgtatttactcctcatgcgtcgcatgaaagaagcgggttatgagcagtatgagattagcaatttcgcaaaaccaggtttggggagcaagcacaacatgacctattggcgaaatgaagactattacggtctcggcgcaggggcacatggatatgttggcagagagcgtcatatgaacattaagggtattaacccttatgtggaggctagtcgtaatggtttgccacgtctggatagctttgaggtgccagcggcggaagctatggaggattttcttatggtcggtttgagaatgctagagggcgtttctaagtcccgctttgaagctcaattcggtcaggcgttggaggatacatttactgctcctctcggaaaaatgctcaatgccgggttaatcgaatccattgaggacggttatcgtttgagtgaacgcggcattttattcggaaatgatgtatttgcagagttcatcggttctatcacggtaaattcataagtcgtaggcttcagtacagtacgtttcaactttataagctgggacgaccattttataacaccattctgtcacagcagggtaaatggagtattgcgattctatgcgttatgttgtatatttattcattatatgcggcaagcggcaggaggagagcaagatggcttcagtgtgtaaagatgtattgtgcagaagtgcggttcctgaggatgtggagcctttatatcaaatgattagcggctatgcagagcgggggattatgctgccacgttcgagggaagtgcttacgcgccaactggagctgtttattgttgcagaggtggacggcgaagttgttggttgtggttctttatgcaaattgggcgctgatctggtagagattcgctcccttggcatctctgagggacacaaaggtatgggtattggctctaagctcgtggagggccttattatagaagcacggcggcaacgtattcctaaaattatggcattgacctacgaggtctccttttttataaaaaacggttttgatgtagtaagcaaagagattttccctgaaaaggtatggaccgactgcattcactgtagtaaacaaaacaattgtgatgaaatcgcagtgttgaaagtactgaactgacctgtcaataatgaggtcagttcttttttcatcaggacctaatcatgcgtatattatacagcctatattgtttaatcctgattcatttctcatctgttttgagcaaccaccaaatgaattgatgatgaggttccagttcggaaggtattccattcaggcttcttatgggatggtccttatgataatcagtatcattataaaagtatgcagtgccgtctaatggaactcggtgtttatatttatacaaggcgacaacatatctttcagacgctccgcttctgcttggactatatgtatatcctttccaatcggctagtgttaaatcatcgtaatgttgtattgccgatatactgtattttatttgcttgggaatacttggactgaattcttgagggtaaaacaaaatggtattccatatgcttaaaagtattgtaggaaccaagattaaagcacaacacagggggcttaatttacgaattaaatggatgactgaaataataagggctgcattcaggatgaaaaccaacggcaaagcaactattcttcctagtcctgtatacggaaacaactcgattaaaatctgaaacatacaaattgtaggtaaaagtgcgatcgatacgtataaaaggttgcggcgattagttctcaaatttaattcctcctcaaggacaaagaagctataatggtatggagacatagtctcgaatttttctattttctgtgtcactatacataaatacggtttttatacgctggataatgagattttttgtgaaaaagtgtaaacgttctggattcattccagtaaactaaactgttgtgataaatcttgtttattgaaaatactgatctgacttgacaatgatcaggtcggtttggtatttttgtattatcggttagcactcatcgcgaacgagtgctaatgattccatttaacaatcgtgctattatggataaacaacaaggggggattcgcttgttaaccgaacgtcagagactcattctgaatgcgattattgatgactacattcgttcggctgagccagtgggttcccgcagcatatccaaaaggcaggatgtcggattcagcccggccacgatccgtaatgaaatgtcggatttggaggaacagggctatctggagcaaccccatacttctgcgggacgcatcccgtctcataaaggttatcgttattatgtggaccatctggtgccactgaatacgctgaagcctatggaaatgcgggaactgaaagccttttacgccgaaaagctgaatgtaatggagcaagtgatccagcatgcgtcaggcattttgtcccatatgaccaattatacttccatcctgcttgggccggaggtttttcatacttcattgcgtcattttcagctgctgccgctcaacgaaacgacggctgtggcgataatcgtgaccaataccggtcaggtggagaataaaacggtagatatcccaccgggaatttcaatttccgagatggagaaggttgtgaatttactgaacagcaagctggtcggtgtgccgatttatcagcttaaatcacgcctttacaccgcacttggtcaggagatggagaagcatgtgtctcattttgaggacgctatgaaggtgctggataaagcactggataatgaatcggatcagcgcttgtatttgagcggtgcgacgaacatgctcaatcaacctgaatttaaagatgtagaaaaggttaaacatattctcgatctgctggaggaaacaccaacgctacttaaactaatgacacctgttgccggggcacctgaaattcaagtccgcatcggcactgaaaatgatcatgaagcgtttgccaattgtagcctgattactgccacgtatgcagtagacggagaagcgttgggtactataggtatactgggtccgacacggatggaatatgcgagagttattaatattttgggtatcctgtctaaggatttgaccgcaatgctaacgcagcggtttaaatagaacaagaccgcataggttgcggtactacatgttccgcgccgggatacggtttgtatcctgcgcgggtgcattgtcgcgtgtttttgtaaaggtagttatgacttgaaggaggtgaaacattttgaaggaagaacaagcgttccaagaagaaaaacaacaaaatgtaagcacagaggaagccgccgaaacgagccagcaggaagagccggttaatgaagcggcggcactggaagatcaagaaaacgaaacagagctgaccaagcttcgcgctcaggcggaagagcatcagcaacggtttttacgcgctcaggcggattttgataattttcgccgtcgtacgctgaaagaaaaagaagatcttgccaaatatgcatctatgaagctggttaccgagttggtgcctgttttggataacttcgagcgtgcgctggcaacagcaccgcaaggagcggagtctgagtcattcagcaaaggcgtggaaatgattttccgccagtttgagagtgtgcttcaggcagagggagtaacggccatgaattcagtgggacaaccgtttaatcctgatttccatcaggctattatgcaggtagagagcgaagagcatgaggaaggcatcgtcgttgaagaggtacaaaaaggatacatgctgaaggacaaggtgcttcgtccagcgatggtaaaagtgagcatgtagctttttcaatatacattagaaatacatcattttgattcaaccattctggcctgcgggcctcgtatatacagaaggaggaattgtccgatgagcaaagtaatcggtattgacttaggtacaaccaactcttgtgtggctgttatggagggcggcgaagcggtcgttattccaaatccggaaggcgcacgcacaaccccttccgttgttggtttcaaaaaagatggagaacgtactgtaggggaaacggcaaaacgccaagcaattacgaacccagatcgtacaatcatgtccatcaagcgtcacatgggtacaaatcataaagaaagcattgacggcaaggaatattccgcacaggaaatttccgctatgattttgcaaaagctgaaatccgatgctgaagcttacctgggacaaacggtttctcaagctgttatcactgttccagcttacttcaatgacggtcaacgtcaagcaaccaaggatgcaggtaaaattgccggtctggaagttctgcggattgtcaatgagccaacagcagctgcattggcatacggtatggaaaaatccgaagaccaaacgatcctcgtgtatgacctgggtggtggtacattcgacgtatccattctggaactgggcgacggtttcttcgaagttaaagcaacaagcggcgataacaagctgggtggcgatgactttgaccaagtgattattgattacctcgtaaatgagttcaaaaaagatcaaggcattgacctgagcaaagataaagctgctgtacaacgtctgaaagatgcagcggaaaaagcgaaaaaagaactgtctggcgtactgacaacgacgatttctttgccgtttatcacagtagctgatggcgttccacagcatttggagttgaacctgactcgtgcgaaatttgaagaattgtctgaaggtctggtagaacgtactttgggacctactcgtcaagcgatgaaagatgcaggcatgagtgccagcgacatcgacaaaatcgttctggtcggtggttccacacgtattccggctgtacaagaagcaatcaaaaagctgacaggtaaagagcctcacaaaggcgtaaaccctgatgaagtggtagctttgggcgcggcagttcaagcgggcgtactgactggtgatgtgaaagacgtcgttctccttgacgtaactccactgtccctcggtattgaaaccgcaggtggcgtatttactaaaatgattgatcgtaacacgacgatccctacgagcaaatcgcaggtgttctcgacgtatgccgacaatcagcctagcgtagaaattcacgtgttgcaaggtgaacgtgaaatggcagcaggcaacaaaacgttgggtcgtttccaattgggagatatccctccagcaccacgtggtgtaccacaaatcgaagttacctttgatctggatgcgaacggtatcgtgaacgtatccgctacagataaaggcacaggtaaaagccaaaaaattacgatcacatcttcgagcggcttgagcgatgaggaagtagaacgtatgatgaaggatgccgagttgcatgcggaagaagataaaaaacgcaaagatttggtagaagcgaaaaacgctgcggatcaactgatctactctgtagacaaaacgattaaagatctgggcgaaaaagcggatgcaggcgaagtcgaaaaagcaaatgcagctaaagaaaatctgcaaaaaacgctggaaaccgacaacctggaagacatcaaaaaagctactgaagaactgactgaaatcgttcagcaattgtctgtgaagctgtatgagcaagctgctcaagaagcacaggctcaacaagctcaagatggtgcagcagacagcaaaggccgcgacaatgtggttgacgcggactatgaagttgttgacgaagaccagaagaaagactaagttacggatcgggtagtggtagctttacggtacaccgatgcgttatgatatactgaatagtaattgcagcgtagctgccttgataaataacaattagccgaagggtaacagttatttccaagataaataagcatattacgggttgtactgccttgaaatgatgggaaggtcaaagccgggtcatcccgtgcctttggctttccttttatatgtagtgcagacacgttgtaggcatgggggtggaacattggctgataagcgtgattattatgaggtgctgggcgtcgcgaagggcgcttcggatgaagaagtcaaaaaggcttaccgtaagcttgcgcgtcagtatcatccggacgtgaacaaggctgcggacgcggaaactaaatttaaagaagtgaaagaagcttacgatgttctcagcgatggtcagaagcgggcaagatacgaccagtatggtcatgtagacccgaaccagggcatgggaggcggctttggtggtggtgccgacttcggtggcgggtttggcgatatttttgatatgttctttggtggcggcggcaacggtcgacgcgatccgaatgcaccgcagcgtgggaacgatcttcaatatacgatgacaattgagttcaaggaagcggtgttcggtaaagaaaccgatattcatattgaacgtacggaaacatgtgatacgtgtcacggtacgggagccaaagcgggtactcaaccacaaacctgctccgtctgtcacggtagcggacaggaagaagtggtgcagaatacaccgtttggtcgtatggttaatcgacgcgcctgctccaattgcagcggttccggtaaaatcattaaagaaaaatgtacgacttgtagcggttcgggtcgggtacgcaagcaacgtaaaattcatatccgtattccagcgggtgtggatgacggcgcacaaatgcgtattaacggtgaaggcgaaggcggtgtcaacggaggaccggcaggtgacttgtacgtcgtgttccgcgtgaaatcgcacgacttctttgagcgtgagggagacgatatctactgtgaaattccgctgacgttctcacaggcagcattgggagatgaagtcgagatcccaacgttgaccgagaaagtgaagctgaaagttccagcaggtacacaaacaggtacttacttccgtcttaaaggaaaaggtgtgccaaaactgcgcggcgtaggtcagggtgaccagcatattaaggtcgttgtggtaacgcctagtaaactgagtgaggaacaaaaggatttgctgcgtcagttctcttcgcttagcggagagcagacacatgagaatgagcagtctttttttgaccgtgtgaagcgcgccttccgaggcgactaagcccaattaggaatcgcggagcttcaaccatgaatcaaaggaaactattccgcaattgcgggatagttcctttttttatattcacgtaaacacatacataaccatttttgtataggaatgttgaactgttgaagacttaatatcaagtagaaaggggtgagttccatcggaaatgtacagctcaagctgcgtcggggtaaaccgctattaaagctcagaggcctaattacactgctagtatgtctagttatggcacttgtgcttctgcctgtaaccctgttatttgctgagagagtggagcatgaaactgagaagggactagaagaaaaggcaatgtccatcgcgcgtacactcgcccatacgccgcttattgtcgagcaattgcaagggacgggttcgtctccttccatgcaggagtatgtgaagagggttttagcagcaaatcacatccagtttatcgtggctatggatatgaagggaattcgtaaaacgcacccggatgctaggatgatcggcaaagcctttgtcggcggagacgaatataccgcacttcatggccatgagagcgtgtccgttgcgaagggaacattgggcttgtccatgcgagccttttcccccgtgttcagtttaacggggaagcaggtaggggcgattgttgtgggtatatccatgcaagatgtacagatggctcaggaaggcaacaaccgtcttattgcaatagccattggcactggaatgttgattggcactggaggtgcggttgtgctggctcgtaaaatcaaaaatatgctagtcggtctcgagccgccggaaatcgcacgcttgctggaggaacgcagcgctatgttgcaatccatcaaggaaggagttattgcggtagatgaattcggttgcgtcatgctgatgaatgcagaagcgatacgtctgcttagacaagcggggattgaagatttctcattctccggacaggagattaccgtttatctatccgcttttcgattgcaagaggtcttggaagcgagtactccacaaatggatgaggaaatggagctgggtggaataactttgctgaccaccagtgttccgatacgggtcaagggggaaattgtgggggcaattgtaacctttcgggataaaacggagatgaaccagcttgcggaacgtttgacaggagtgtccttgtacacagaagcactacgtgcgcaggctcatgaatttatgaacaagctgcatgtcattatggggatggtacacttacgaatgtatgataaactggagcattacattatggatgccgtcgagcatcatcaagtggagattggctccatcacccggcagatcagggacccagttatggcagggtttgtgttggggaaattaagccgggccagagaagtaggggcgaattttgaactgactccaggtagttacttgcccgaatccagtcaaactcaaacgacgcatgaactgattactattcttggcaatctgtttgataatgcggtggaggcgatggaatctttggagcacaagcggattaccctttcactttattatgaggaaagtcagaagaacggttatctgacctgtatcatgtgcgataatggtccgggtataccggaagggcttgtaaaggctatatttgaaaaaggtttttcgaccaagggagagtcacgaggaatgggcctttatctggtgacgcaaagcgtgaagagattacagggaagtataaagttgatcccagccgagcaagggtgctgttttcagattacgattccatacattatagcggggaatgatgaacatgattaatgtcctgattgtagaagatgatccgatggttgcggaatttaaccgcaaatatatggagcaggtggaaggttttcgatgtgggggctgggcttcttctgtagaagaggcgaagaaatatatagctgaacaggccattgatctgatactgctagatgtgtatatgcaggaaagcaatggcctcgatttactgtcattcatacgggagacaggtgtaaatatagatgtcattgtcatctcggctgcaagtgacatgaacagtgtcaaaaaagcgatgaacttcggcgcggtggattacttgattaagccgtttcactttaaccgttttttggaggccctcacggggtaccgagagcacattagcatcgtgcgtgagcacaatctactttctcaggaggaactggaccgactgatttatcataaaagcttgactaaagacttggcacggttgcccaaaggcataactaaatccacgctggctatgatatggaattgtatccagcggcataataaggtactattttccaccgaggatattgcggagagcgcagggatatccagggtgtctatgcgcaagtacctggcttttatgacagagattgaggctctttccatggaaaccatatacggtaccataggacgccctgtttaccaataccgaatattgccacaggcagaaggcatcatgaacagttttatttaaatcttctttctgattactttaattacaaaagtgaatgattagttataaaaccaaataaagcgttttccaaggtgtagaatggaaacatgatcatcattcttcactttatggagggagatttatggaaaatgctacgaatcagcctgtcattcaaaaggggcaaagatggagtaaaaattttgtagatggcatcagaatgctgggtagggtaaagttgggggttattcctcttccactctatgccgtgatcgcgctgattgtttatgcagctgcagttactgaaagacttccaaacgatctgttgggcgggtttgccgtcatcatgattttaggtatactactcagtgatctaggggccaaacttccgttccttaagcatattggcggaccggccattttatctcttatggttccatcgttaatggtatttgggaatatgtttagtccatctgcgatgggtgcggtacacacgcttatgaaaacctcgaattttctttacttctacatcgcatgtctagtaacgggaagtattcttggcatggatcgcaaaatgctgatgaacggaattgttaaaatttttgcccccattattataggatctattgcagctgttggcgtgggaatggtggtgggtatggcttttggctatagtgcctatcatacattttttttcatcatcattccgattatctccggtgggattggggaaggcattttaccgttgtccatttcttatggattagtgctgggcaaggattcggcaatattcgtatcccagtttatcccggctgcaattatcgggaacattgttgcaatcataggtgcgggtgttctgaagagattagcagagaagaatccgaaaacttcaggtaacggaaggttactaaaactagataaagatgcagacaagttagccccggcaagtctggaacaatcgatttcttttccattgatgggaggaggtctgctgttggcctgtactttctttattgtgggtaagctgctggagccgtatctccatattccaggtccgatcctcatgattctggcggcggcattaattaagtgtattcagatcatgccgaacacattggagcagggagcttttcacttgtacaaaagtataacggcaagtctgacgtggcccttgatggtgggattgggtattttgtatgtacctttggatagtgtagttgggattttaacggttccttatgccattacctgcgcatctgttgtagttgcattgattgttaccggatacttcacaggaaaatggattcatatgtatcccgtagaagctgctttggtgactagctgtcgcggtggattagggggcacgggagatgtagccattctgtctgcgtccaatcggatggaactgatgccttttgcacaaattgcaacacgtattggcggggcaggcacggtcattttagcaactttgttactccaattttggagctgatgagttttatacacaggactgagtttcatatccaaatagagacatgaaaggacggagaaaaatatgagcagtttaatagacgaaattagagaattacatgcaggtggcaaaatggagaccttaccaaagaagcgaattgaaacgatggaggggttgtccaaagtgtatacgccgggtgtagctgaaatttgtatggaaatcgccaatgacccagccaaagcgtatcaattaacgatcaaaaagaatacagtagcagtcgtttcagacggaacagcagtacttggattaggagatatcgggccggaggccgctatgcctgtaatggagggtaaagcagtgttgttcaaacaatttgcaggtgtcgacgccttcccaatctgtctcaacacgaaggacgctgatgaaattgttcaaattgttaaaatgattgctcctgcctttgggggcattaatttggaagatatatcttcgccacgctgttttgaaatcgagagacggttgaagcaggaactagacattccagtatttcatgatgatcagcatggtacggcagttgttgtattagcgggtctggtcaatgcattaaaggtatgtggcaaaaaaatggaggatgtcaaagttgtatttgcagggattggtgcggcgggtatggcctgctcccgtatgctgcttaaggcaggtgtgcgcaatctgattggcgttgatcgacagggagctattcatcgtgacgtggagtacagtaacccgcattggacagagtatgcgaacatgactaatccgcacaatttaagtggaagtttatccgatgtgattgtgggagctgatgtattcattggtgtgtcaggcccgaatatactgactgtagaggatatacagagcatggcaactgatcctattgtgttcgccatggcgaatccgaagccggaaattgatccagctgtagccgcacctcatgtacgtgtacttgctaccggtcgctccgattttccaaatcagattaacaatgtgctgtgcttcccgggaatttttcggggtgctctagattgccatgctacgacgattaatgaggaaatgaagctagctgccggacttgccatcgctgatgcgatctgtcctgaagagctaagtgaaacttatatcataccgaatgtttttaatccgaaggtggttcaaaaggtacgggatgctgttattcgtgctgcatgggagacaggagtagccaagtcaggtgaagctccggcagctactttacacccgtaaaagttatagtcttcacaaactatggttcaccgtcttggcctgctgttctcgataccgcctgcatccgtctagcctgcgtagggaatataaaatcgtgccgatgagcaggatataacaaagcgtaacgctctatgcttttgaagagcagttacgctcaatactacacagggagattttgagatgggcgaaaaaaatattttagcgtatttcaaaagtcctgaggaagcacagggagccgctagaaaactggaagctctccgggtagccgatgtgtcgatagaccgatttagccgctatccgcggcagtctacgggcaacgccggattacctgtattttcaggacagattagcagcttgtcctcactgacacagggcgtggactttacagatgcaactccagcaatactggctgcggctgatccgtccgccagtggcatgagtgatggaggacaaggcggaccgacaggccgcgatattttgttgaccgctgtggtggatgaatccatacatcatcaggcgatgtccatcgtggaacaggcgggtggaatgctgtgaaaagtttggaaggagcagtgaccgatgtccaaaaacaaacggtttgataaagtgctgaccaaaaccgaaaaaatcaaacgcatgcaatctgctaaaaatgaagatgttgagttctcggcagatcaggcagatgctgaggatctagaagcgatccggcgtagcgaagtagctgaccgtcgtcagcagcgtatcataaacgacaatgagtagaatttaataaaacgggttatccccatcaacaatgatgattttgggatagcccgtcttatttgtgttctttcctcttcctattcattatccgctatatgctgttgcactaaaaacaagcggaccggagacaaatgcagtcgtcgcaggcgtctgattttcaataatcagttggtagttttgcacgcccagaggtgcaacgtctaccgtttcgacattaagaataatattgttatcgaagacattggattccagtccgtaataaatttctttgccagctctccaaatccgtacaagtactctaatgttaccggcaccgacaaaacgtagtccaatcgaggcttttaactctactcggttgttgacagcaccaggaatagcaggatcaataaatacagacgttgtagcaattccaagtccggctggagaaatcggaacaggaagatttataccattcgtgataggtgtaataacactggcattataatctaacactgtctttgccatactaaatcactccttttctagtatattgtattgtatgtactagagttaagggtgcttggactaatagaggacaacatatacaagttcaataaaaaatattttaaattccgataatactagcttttttgaactcctgtgcatgtatatagtacaatgtaatgtatgcatgtgaaatgaggaggaaatgaaaaccatgttgtggaatgaaattacaatacatacaacggaagaagccatcgaaatgatttcgaattttctgcacgaagcaggtgcaggaggggtttccattgaagaatccggttcgctcaacaagccgcgggatacgtcctatgggcagtggtatgatcggcctttgaacgacatacctgaaggacaagcgatcatcaaaggctattttgccgaagaagtggacatggatagtattcgttcgcaaattgtgccgcgcgtcgaagaattgagaactttcgatattgatcctggcgaggttcagtatgagctgaaaacagttgatgaggatgactgggcaaatgcttggaagcaatatttcaagcctttgcgtgtatcggaccgtctgacgattaaacccacttgggaggaatatgagcctgcgagtgaagaggaaaaaatcattgagctggaccctggtatggcctttgggaccggaacgcatcctacgacatccctttgtctgagaacgctggagtctgtgattaagggtggagaagaagttattgatgtcggcacgggttccggtattttggccattggagctttaaagctgggagcgaagcatgtacttgccttggatttggacccggtggcagtatccagtgcgcgggaaaatacgcgtttgaacggactggaggaacgcatcaccattaaagaaagtgatttgctatctgtgcttaatgcaagcgatccaacgctgggtatccagttaccggtcaagctggtggtagctaatatattggcagagattattctgctgttcattgatgatgtatataaagccctggaaccaggtggtatttatattgcttcagggatttggaagaacaaagaagaggttgtcgaaactgctttgaaagcagctggctttgagattgccgaaataagccgggatgaagattggctggcgtttgtggcgagaaagaggtaagtatggattttctacaaaatatttttcgtgtaaatttaaatgttcttcccttttatttactggctgtgatcatatcgttcacggttcatgagtttgcacatgcgtattatgccaataaatttggtgaccctacggccaagctacttgggcgcgtgactttaaatccggcagtgcatattgacctgctgggtacgctgctgctgttgatcggaggctttggctgggccaagccagttccggttaatcgtgacaattttagccgtccgcgcctcatgggtattatcgtatcggctgcgggtccgctaagcaatctgctgcttgcatttgttactactttgatctatgccgtgctccttcattttcaagtattgccggggatggagaaccaacgggtagctcaagcaatctatttgtttatcaatgctctgatcaatttaaatctatttttgtttatctttaatttgatcccactgcctccactggatggataccggattgtggaagatgtggcccccactcctgtacgccgtaaacttcagcaatttgaacagtggtcgatctttatttttctgcttatactggtcattccgcaggttcgagctgtaacgattgaacctctttacacgctggcccagatgatttatatacagtttttgcagttctctttttatatcactggattgtttggagcctaagggctcctttttttacgagaataggtaggtataaactgaatagaagagggaacagactggtcatacaggcgcaaaagatgatatgatgttgcttggtgatttattcggattttgtacggaacgttagtggacaacagttatttttagaatgaggattttgcaaaatccaggaataggtgtgagagagaatgcagcgttattttattccggcagagcaatttctagaagatcacgtgattgtcgcgggtgaggacgcgcggcatatcgctaaagtcatgcggggccgtagtggtgacaaaattatagttagtgacggggtgtctaaagaagcgctggttgctttggatacgattgagcaggatcatattacggcgacgattattgagccgctgaagatgacctctgaaccacatgtgcaggtcaccatcgctcagagtcttcctaaaggagacaagatggagacggtgatgcaaaaatgtacagaaatcggagcaaccgggtttgtaccgtttttgtccgagcgtacggtcgtgcagtatgatgccaaaaaagaaggcaagcgactggagcgttggcgcaagattgtgaaggaagcggctgaacaaagccaccgtaaccggattccagaaattagcgcgcccatgacgtggaaagaacttctggcttcttttgctgggtatgatttgatatgttattgttatgaaaaagagcagggtaaacagctacgggatgtaatccagcctttggcaggacaatgggcgtcgacggacatgccgcgtgttctgctggtggtaggcccggaaggcggctttactgaagcggaaagcctagaggccgagcaggccggggcacagtctacaggactgggaagacgtattttacgtgctgagaccgcaggtatggctgcattggcatgcattttatatgagacaggagaaatgggaggggtttaatatgccgtcagtggcattttacacattgggctgtaaggtaaacttttatgatacagaagcgatctggcagctgtttaaaaatgaaggttatgaacaggtggactttgatgagcagactgctgatgtctatcttattaatacatgtaccgttacgaataccggtgataaaaagagtcgtcagatcattcgccgtgcgattcgccggaatccagatgccatagtggcagtaacgggctgttacgcccagacttctcctgccgaaattatggatattcctggcgttgatctcgttatcgggactcaggaccgggacaaaattattccgttcgtgcaggaaattcaagggacgcgtcaaccggtgaacgccgtgcgcaatattatgaaaacgcgtgtatttgaggaaatggatgtgcctgattttgctaatcatactcgggcatttttgaaaattcaggatgggtgcaataacttctgtactttctgcatcattccgtggtcgcggggtctatcccgcagtcgtgacgctgcgagcattattgcacaggcgcgtcaactggtacacgcaggctacaaggaaatagtactcactggtatccatacaggcggttatggtgacgacatggataattatgacctatctgatctgctgtgggatctggagaaggttgaagggctggagcgtatccgtatcagttcgattgaagccagccagattgatgaaaaaatgcttgatgtgctgaaccgttccactaagctggttcgtcattttcacataccgcttcaggcgggggatgacactgtattgaaacggatgcgtcgcaagtacacgacagaagagttttataacaaaatgcttatgattcgcaaagcaatgccagatgtagcgattacaacggacgtgattgtcggcttccctggggagacggatgaaatgttccgcaatggctatgagctgatgaaaaaaatcggtttttcggaaatgcacgtgttcccgtactccaagcgcagtggaactcctgcggcgcgtatggaggatcaggtggacgaagacgtgaaaaatgcacgagtgcatgagctgatacaactgtcagagcaaatgcaactggcgtatgctgagaagtttgtaggtcaggtgctggaggtcattccggaagttgcgccgaaagggaccgaagatagcggcatactccatggatatagtgacaattatattcaactggcgtttgaaggtactgaggatctggttggcaaggtatgccgcgtgaagctgacgaaggcaggcattaatgaaagtgaaggccaattggtccgcgtactagagaatgggctgcaaacagctctgtaagaacaaaaaaagcctgaacaggcaatagagatggtagacaaggatttcgcctttccttacagagaggacggaatccttgttgcgcaaggaagggagattacaggatggcagcaaaaaaggaaatttccgcaggcggcgttgtgtttcgcaaacagggggagcagcttgaagttcagctcattactgaccgatatggcaaggtatccttggctaaagggaaaatggagttgggagaaacaatcgaacagacggctttacgtgaaattcgcgaggaaacagggttgaacgggcggattatccagcatgtagatatgattgcttatacgtatcagcatccagaatttggggaagtagataaagaagtacactattatctcgtagaggcactggatggggatttacaggcacagatcgaagaaattaaaggagttgcgtggcatacgcctgaggaagcatggcgtctccagcgccagggtggatatgacaataatgatgtcattttaagcaaggcgctgtccatgctaggaattaatgtttgattctgtggggagatatacgatcctctaaacgcgtccacacaggtagatagcagagaggcaagaccagcagagagctaataacgttaaacagagtttgggcatgggctaccttggctccgggctcggtagatatccaggcagcggccatctccagaccagggatcaacggcataaagagcaaggctccgccgacgttcagcagcacgtgggaccaggctacaaatttgccggacacgctgccgccaacagcggcaatcagggcggttacgcaggtgcctacattggagccgatgacgatggcgatccccacatcggctggcaaggctcccgcagcggcaaggctaatcgccatgccaatgacggctgcgctactgtgaaccagcgcggtcaggcaggctccagcagcgaaggcccaccacatgttggctgcagcgtgaccaagaaaccaacggaatagtcctgcctgctcaatccagggtccgaccgactgcatcacgcgaatacccgccagaatcagcgaaaatccagcaaagacgaggctgatatattgtacagcctgcggacggctgagcccattggagccggatgaagctccggcagacacatactggcgactggggacagcttcactccacaggacggtagtgctccagcagagcagtgagccgcagagcagcggaatagccagcttgccgagctggagccccatcagctcggtggtcaggcaggtgccgatattggtgccgagaatgatgccgagcgtgcggccgtaggtcaacagcccggcgttgaccagtccgatcgttagcaccgttacggcggtgctgctttgcagcagggcggtaatgcctgagctgaacagcatgccccgccaaggggaaactgtggcgtggttcaaccagcgggtgaggaaggggccggccaaatgccggagggctgcttccatcagcttcatcccgcccaaaaaaataaacagcccgccgcacagcggcaaaataacgtgtataaacacgagcatagcccccttttctaggtgaaaatacttatgtaacagcctatgatctaccgaggacagccatgacaagcatggccgagctgtttttttatagaacgataatttttgtagtatcttcacaagctttaaaagcgtgacgtcgatatacaggcgggcagtagcgaagcggatcatttgaatctggagaagcgagagcgttcgcctttgcagggggattcttaccattaaaatcatttataaaatccaaagaatccccgtgcaacagtgatcgtaagatcaaatgatccgcggagccgcgcccctatcgaacaacgttttaacactttgagtaatccaagaatgggagtgaaggattttgccttcagtaatattagaacgcagccgtaaaaaaaggctggagcacgcacacccttgggtgtttaaaaacgaaatagccaagattgagggtgacccagaggcaggcgatttggtcagcatcgttaaccatcaggggcgttatttggcgacaggttactataatccggcttcacaaattacagtacgtgtgatgtcctatgagccgctggaagcaatggatcaaaacttttttgcccaacgctttcgcaaatgtctggagcaccgcgaacgttttgtgaccgggggagaagcttatcggttggtgtacggcgaggctgattttttgcctggactgattgtagatcgatttggtgatgtgttggtcgtgcagttgttaacgcttggcatggatcggcgcagggaagaaatcagggatgcgctcgttgaagtagtgggtcctgttggtatatatgagcgcagtgatgtatccatccgagagctggaaggattggaacaaacaaagggtcctttgtacggtgattgcccgcgtcatgtggtggtgacggaaaatgggctacacatcaaggttgatatcgtagagggccagaagacgggttatttctttgaccagcgtgaaaatcgtgcggccatagcaccgttgatgacaggttggggagcacgtagtggaattacgctacaagaagttgctacagactcaggggacgctggcacaatggtcatgaagccagtgaataaaagtggtaaggttgttgaattcccattctgggatggtgcaaccgtattggaatgtttttcacatacgggaagctttacgctcaatgcatgtaaacatggtgctaaaaaagtaacatgtcttgatatttctgagcatgcgattgagagtgcgcgggataatgtcaagctgaacggttttgaggaacgcgtcgagtttgtcgtcgacgatgcttttcaatatttgcgtaatcaagtgaaaggtgtagaggaacgcaatgcacgagccgggggcaaaggagatacatccaagccgctgacagcaggtggcggacgcacctttgatgtggtcattctcgatccgccagcctttgccaaaacgaagaacgctgtcaaaggagctacacgtgggtataaagatatcaacctgcatgggatgaagcttgtcaatgagggcggctatctggtgacagcgagctgttcgttccatatgcggccagagctgtttttggacactattaaggaagcggcggcagatgccggcaaaatccttcgtctggtagactggagagcggctggtaaggatcatcctcaaattttgggtgtggaggaaggccattacttgaaattcgccatctttgaggtgcgcagccggacacagctttaggtttcatacaaagtcaaagtcaatcgcctttttggtgattaaataggtaaaatagactcattttaggtataaatcagtcctgtagagaaggcatgcaccaagccaacctgcgggactgatttatttttagggggaggatcaattgctacaacatggcaaacgtacgttcttttctcccttgcctgatatgctatactgtttaatagaatgttgttcgttggaaaggaggccgcatcatgtcggtccgcttgttgatcggccgctctggtagtggtaaaagtacgttaatccgcaatgaaatgacgtctatgttacgcgaggagccgctaggtaagcctatgctgttacttgtaccggagcaatcgtcatttgcttccgagcatgcgttacttacagaagccggaaacggtattcaggggtcggtgcgcgcccaagtgatgggatttcatcgtcttgcctatttagttatgcaggaaaccgggggttcagcactggtgcctgtaacggaagaaggtaagaagatgcttttatataaaattattcgtcgtcgcaaggatgaactgagcttgtttaaggattcgggagaccagctcggctttgtggatcggttgaatacattgtttacggagctaaagcagtatggaaatgatactcggtctgtacccgagcaactggagcgaatgaacgctgtgggagagtcaactccgattttgcgcggcaagctcaaagatatcagtctaatctacgaggattttgaacgagagctgacgcttaaatatatagacggtgaagatacgctgcgcatgctggcagaacagattgcggagtcttcccttgtgcgtggagcagacatttggatggatggctaccgtagatttacaccacatgaatacaaggtggtggagcaacttatgctgcatgcctcttcgttgacggtggcgctgacttgcaaccgaagctacgagagcggacagcttccgcatgagttggatttgtttcatccttcggcggctacctatgtaaagctcaaaggaatggcggacgagctgatgatagagacgcagacacaattacttcgccctgatccgttgccgagatttaaggagcgtccagcgttggcatatttggaggctaactttgaacatcgtacagggttacggaatcaggaacaacggatgcggctgcagcagctacgagagcagtggacagaagaacagccggagggcataaaactgtacactgcggttaatcgccgtgcagagctggaaggggctgtacgcgaaatgcgccgtctggcccgagatgaaggcgcgcgttaccgggagatggctctgtttgtacgtcatattgaagattatgagccatgggtggaaccgatattcaaacagtatgaggttccagtatttctggatcagcgaagaagtgtattgcatcatcctttggtggaattgattcgggcttcgctggatatcgtgcagcggcgttggcgatatgaggatgtattccgtgcggtcaaaacagaccttctcttgccgctggatggtcgggtgagccgtgaggagatggaccgtttggaaaactatgttctggcctgcggaatacaaggcagccgttggacagacggtcggccgtggcaggctgtgcccagcttgtcactagagctggaggagcaagaacggaaccgtaggcgggatgaaacgttggatttgatggagctgtgccgggatgtgatcgtgacgcctttacgtgcgtttgagaaacgtatgggcaaggcacgaactgcacttgagaagtgtgaagcggtatatctgttactggaagatgcagaaatcggccacaagctggacgccttcattcatcaggcagaggaagcaggaaatcctgagcaggcgaaggagcatcgtcaggtatggaatgcagtgcttgaactactggatcagatcgtcgaaatgatgggtgatgagagactggatacctctttgtttgcgggcgtgctggaaacgggattggccgagttccgtatgggacttgttccgccagctctggatcaggttctggtcggaaacacggaccgtacacgtgtgtccggtattcaacatgcctttgtgctaggtatgaacgaaggtgtgatgccggctgtattccatgaggacggtgtgctgaatgagcaggagcgtacggcattaaacgaacgaggcgtagagctggcgccggatatgacaagacgtttgttggacgaacgttttcttgcttatacggcccttacctcagctggtaaaagcctgtggatgagctatgcagtgactgatgaagaaggcaagttattgttgccgtctgagttagtacgacatgtgcggcacctgtttcctagtctggacgaacgtccgttggctggataccctttgcctggggatgcttggacgacgcaatgggagtatgcttctcatccgtccgaggctttgccgcagctcattgcgcaattacggcattggcgacgtggcggtgacattttatctccttggtgggaggtatataactggtatgcaagccagcaagggcgtgagaaggacaagctgcgtcagttgttaacctcacttttttatgagaaccatgctgaaatgcagaaggaaacgagccgccgtctgtacggtagcaagctgcgtaccagcgtatctcgtatggaacgttttgtggcatgtccattttcgcactttgcctctcacggtcttcgtttgaaggaacgtcaaatgtatcgcctgaaggccccggatatcggacaattattccatgcagcgcttggagagatggcgatcaatctgcgtaaacgcaatgtcagctggggcagtctcagcaccgaggaatgccgacaagaggcggaaagtacagtggagcgtttggctcctcgcctgcaaggcgagattttaatgagctccaagcggtatggctacattttgcgcaaattgaaagacatcgtgagccgtgcttcgttgattttaggtgaacatgcgcgaagaggtagttttgagccgattgggctggagttggactttggaccgggtcagcagcttcctccgttaagcttccggttagataacggcgttgtgatggaaattgtcggacggattgaccgtgtagatgtggcagagggagaaaaggggttacttttgcgtgtcatcgattacaaatctagccaaaaggatctcaagctgcatgaagtgtactatggcctgtccttgcaaatgctcacctacctggatgtgctgctgaatgcggcggaggaatggttgggcgagactgcttatccagcgggtaccctgtattttcacgtccacaatccgatgttgcagtcgcctaacggtcttagcgcagaacaggcccgccaggagcttttgaaacgttttaagatgaaaggattattgcttgcagatcgggacgtagttggacaaatggatacagcattggacaaaggatattcctctattttacctgttgcggtgaaagcagacggcagtttttatagcagtgcttcggttgcttcgccggaacagtgggacagcttgttagcctcggtgcgtaataatattcggacgattggcacacggatgacagagggcgatgtggccattgaaccttatcgaatccagcaagagacggcttgtaccttctgttcttttaagcctgtttgtcaatttgacgacagtctggagggcagtggctacaatcaatggggtaaacccggtaaggatcaaatctggaatctgttgggtcatacgcaggaagggaaaggaggaatggaccaatgatagacacgtcaaacactaaagacatgccgaagccggaaggcagtatgtggagcgatgaccagtggcgtgccatttcggaatcgggtaacaacatgctggtcgcggcagcggcagggtctggtaaaacagcggtgctcgtagagcgtattattcgtaaaattgtcgatccccagcttggcttcagcgtggatcggttgctggtagcaacctttacgaaggctgcagccgccgaaatgcgtcaacggatacgcgaagcgttggaacgtgtgttggaacaggaaccggaaagtgagcatgtacgccgccagctgtcgttgctgaatcgggcctcgattacaacgcttcactcattttgtatggaggtcatccgcaggcattatcaggccattcctcttgatcctggttttcggattatgaatgagcatgagacagaattgttgcgtcaggagcttctagaagaactgtttgaggagaaatatgaggctcatgatgaaggtagtacattccgcagactggtcgactggtttagtggagaacgcaccgatgatgcaatgtacgtgcttgttcagcggttgtatgatttttctcaaagtcatccttggccagaacattggctgcgggagacagcggcagcatttcgtgtacaggatgtagccgctttgggagagactccctgggttcgcagcattttgacggatgccgtactttctttgcgcggagcagcgagcttgctggaacaggcgtatgaaacagctatgcagcccggcggtcctgcaccttatgccgtgacgctgcaagaggatgcggcgatggtgaagggattactgcaggggctggagacacagccgtgggcatctctatatgatcattttcaggcagctgccttcggtaagctcaagcccgtcaaaaaagatcagactgagcctgcattgcaggaacgggttaagacgttgcgcgaagcagccaaaaaaatgattacagatatgaaggcttccctgtttggcaggagagcagaagcctattgggaggagctacacgccgcggctccgctgatggacgaattggtagaaaccgtgattgtattcggggaacgatttcaacagcacaagcagtcaaaagggttggtggatttcggggatttggaacattattgtctgaaaatattacgacatcccgattctactccgtacaagctgctaccttccgacgctgcactcgaatacaaggcgcaatttgacgaggtgctgttggatgagtatcaggatacgaataccgtacaggaagatatcgttaggctggtatcacgggaggaaccgggtaaccgttttatggtgggcgatgtgaaacagagtatttatcggtttcggctggcggagccgggtctgtttttgaataagtatcaacggtacggcatgcaggagcaggaagatggttttttagttgatctggcgcgtaatttccgcagtcggcaggaagttgtcgatgcggtcaatttggtgttccgccagattatgagtgtggatgtggcggaaattgagtacgatgaacgagcctggctggtacacggcgcatcctatcccgacccgtcggatcaagacaccgcatctgtatacgcacctgagctgctcttagttgataagggtggacagggtctttccgaggcttcggagctgtccgaaacgggggacgaatctgctctacaggaaagtgagctggctgagcttgcggagctagaaacggcacagttagaggctcgtgcgatcgcgcaacggattaaagaactgaccggagacactggacaaccactattgatttacgacagaggattaaaagcgatgcgcccggcagtctacggcgatatcgtcattttgcttcgttccgcaagcgtgtgggcccccctaattgtagaggaactgcggcttgagggcattccggcttcaggggagcagacgacaggcttttttaaagcaacggaagttgaggtgatgttgtctctgctgcacattattgataatccgcagcaggacatcccgcttgcatccgtgcttcgttcgccgattgttggcttgaccgaagatgaacttgcacaaattcggttggagaagccggatggattattttatgacgcattgctggcggcggcagaagctgacccactggaagaaagtgaaaaagggatctcagctgacatcatggagttggatcttttccctaaggactctttatcttcatctgactttggtaatagaaatgacgggaatacgttatctgcccgactacgttcatttttgcgtaatttgaaagcctggcggcaggaagcccgacaaggaagcttaagtgcattgatttggaatgtgctggaggaaacaggatatctggattgggtcggtggactgcctggcggctcacagcgtcaaagcaatttgcgggcgctatatgaccgagcgagacagtatgagacttctacgtccaaccgaggattgttccgatttctgacttttatttctcgtctacgggagcgaggcggtgatttaggatccattagcggggggactgaacccgatcaggctgtccgtattatgaccattcataaaagtaaaggacttgaattccctatcgtgtttattgccgggacagcaaaaatgttcaatcaacaggatctcaatgcgccgtttcttatgcacaaggagttggggtttggtcctaaatatgtggaggaacaaaatcgtgtcagctaccctacgctgcctaatttagcgatccgccgacgctcacaactggagctattggctgaggaaatgcgggtgttatacgtggcgcttacgcgtccgcgtgaaaagctgattatgaccggaaccgtgaaggatctcgcttcgcgcgcagcgggttgggcacgtgccaaagaacatacggaaacggtcttaccagactatatgctggcggcaggtcgcagctatctggactgggtaggtcctgctttgattcggcatccttctgctactttgttgagggaagcggcaggcgatcaggatggatactatcacaggctggaacatatgccgggaacagactggttatttaaaatcgtcgcctcggaaacactttccggctctcgtgtgaactcagatcatgaggaagaggtgtcgggcgaagaacgccaaaagaagacagaagcactgagaaatgcggagctaatcgacttgaacgaagagagtgaaacggatattgaagctgctctttcctggatctatccgtatgaacgggctggcaagacggcagccaatacatcggttactgagatgaaaagatggctggaaatgcaggagataggttcgggcgattggctgaatctatctaactctctactagcagagttaccggaggatcgggaggattctcacactgtgggaagtcaattacacttgcgcagacctaagtttatggggaatcagcgactgactccaacggaacgaggaacaatctatcatacgttgatgctgcatttgccattagatagggggatgagcgccgaagttattgaggaaaccaaagctcgtttgctcaatcagcgtatgttactggatgttcatgcaaaggcgctagatacggataaaatattacgctttttcactagtgagctgggtagcagaatgctgggggcatcccatgttcaaagagagcttccgtttacttataccatgcgggcaactgattactggaaccacagcttaccatcaatgtcaccaggacaagaaacaggttcggaaggtggacaggacggcgataaagtgctgatgaacgggattattgactgtctatttgaaactcccgaaggactcgtgctggtagattataaaacagatcggatatctgaatatcgtacactgtcccatttaacagaccaatatcgttttcaattggagctgtatgcccgtgtgatcgaagagattacaagcaaaaaggttgctgagaagtggctgtattttttagaagctggagagagtgtacagctgtagttatatgatagggagaggaggaatagcatgcggattttgcatacgggtgattggcatttgggccgcacgctggaaggacgcagccgtttgaaggagcaggaggcgtttttggaagagttggcgaaaatggctgacgatcagcaggccgatttgattatgatggctggagacgtatacgactcagtcaatccttcggccgcagccgagcaattgttttatgaaacgtctgcccgtcttacggctggaggaagaccactcgtcgtcattgcgggcaatcatgatcagccggaaagggtatcctcggtcacaccgctggtgagcgggcgtggaattacgttgctgggactgccccatggggaagcggtacgcgttcgtacaccgcgaacgggtgaaatggcatgcattgcagccttgccatatccgtccgagtctcgtctgaacgagctattgtctgaagacggagatgaaacagtcttgcgcgaggcatacagtcgccgtgtgggcttgctgatgtcacaactgggtacagcatttcggcctgacaccgttaatttgtcgatgagccatatttatgtgcttggcgggctggagtcggactcggaacgcccgattcaggtcgggggggcgtataccgtagatccgtctgctttgagcattggggcacagtatacggctctaggacatttgcatcgtccccaatatgtgaagggagacgggctgatgcgttacagtggctcgccgctggcttatagcttttccgaagccggacaagccaaatcggttacgttaattgacgtggttgctggcaagcctgctcaggtcgaggaactgtatatcaccagtggacgcccattagtgaggtggcgcgcacggggaggtctggaggaagtatatcgctggctggacgaaggattggatgccgatgcctttattgatctggaaattacgctggatgaagcgatgtcgatgggagatattcagcggttgcgcaaaagccgtgagggcatcattcatattcgtcccatgtatccagaaatggctgccgcacagctggagcaccaacgatcagaactgccagtgcatgagttgttccgggcattctatcagcggcagacaggtggagcacagccagatgacggattagtacagttgtttctggaactggtggaacaggatgatgcaagagaccacgctgaggaggatgacgcatgaaaccaatccttctaaaactggcggggttgcaaagctaccgggagtcgcaggaaattcgctttgacgatttgaccgaaactgggctgttcggaatttttggcccaacaggtagtggaaaatcaacgctgctggatgccattacgttggctatgtacggcaaagtggagcgggcagtgaatggtacacaaggcattatgaatcatgctgaggatacattgtctgttgcatttacgtttgaattaatgtcagctcaaggacctcgtcgttaccgtgtagaacgacgtttcaaacgtgctggaggcgtatcggttaataatacgcttagccgttttattgcgttaacagaggatggcgaggaagtgcttgccgataaggtgcaggatgtgacgcgctgtgtggaggagtatatcggcctgaaaatggacgattttacacgagctgtcgtattgccacagggaaagtttgcggaattcttgtccttaaagggcagtgaacgcagacagatgctacagcgtttgttccatctggagaagtacggagatcaacttgcacagaagctgagccgtcgtgtgaaagataacgatatcgcactgaaatcgttagaggcagagcagcaagggctgggagatgcgagtgctgaagcgcttgaacatgtagagttgcgtctcaaagaggcgattgccaatgcagaagcttcgcgtcgtgagctagagcgtgtctcacgtgaatgggaggcgctaaacaaaacccgtgagctggtcgtcgagctcagccaaagatcgaacgagctggagcagttggcagcacaggagctgggcattgctttgctagagcgcaagcttcgacaagcatctgcagccgaggcattgctgcctgcgctgacggactggaaggaagccattgctgaagcggaaaaacggcaaaagactgccgaagaaatggaagtcttggccactaccgcgcaggaggctgcgcttgtgtctgcgcaagcagatgagcaggcccggcaagcactcagtgccgaagaaccgaagctattgcttcggatcgaccaactagagcaggcacttcaactggagcgtgatacggaagcattgcgtattgaacgggaacgtctggcggccgagcttgtgcaaagcgaacaaacccttgctgaacatgcagaaggactcgcaaaggaacaagagctacagacgcgaggcttgaagcgacagcaggagcttcaacaagagctaaagcaaaatgaagtgcgggcagatgagcggcgtatgctgcaagaggctgtgcaacggttgcaacagctggaaatcgcgaatgagcaattgcgtgaagctgaactggagtacaccgctcaggagaaacggcttgcgcaagctgacgaacgtctaaagctgacggaccaggagacacaggagacagaggcacggcgttctgcccttgctgcacaggcagctgatggtattgaggcattgcttacgttggaggcagagatcaccgccggtatgtcgtcactggcctccgaggaagaacaactgcgccacgagctccgtgcggaggagctggggcgtctcgcacagcatctcgctgccgagttgcgcgaaggcgagccgtgcgcagtgtgcggctcgctgcatcatcccgcgcctgccgtcgttgcggcgcatagcgcggatgccgctgcgccagatgagctgcaccgcctgcggcttggtttgcaggagctgcgcctcacactgcgccagcagttgcacgagcagcgcagcttgctggcgcagcccgccaccgcagacagcggcgcggccgccacgggcgagcctttcacgcctgcggcagcgccagcagagccgcgcggtattgccgcttgggtggagcgctgcac

SEQ ID NO: 2620 - DNA, 352485 bp, Unknown
  Kingdom: Bacteria, Phylum: Firmicutes, Class: Bacilli, Order: Bacillales, Family: Paenibacillaceae, Genus: Paenibacillus
tctcccatgcaggaaaaggatgtatcgggtattagctaccgtttccggtagttatccctgtcttgtgggcaggttgcctacgtgttactcacccgtccgccgctaggttgtgtagaagcaagcttctacacaaccccgctcgacttgcatgtattaggcacgccgccagcgttcgtcctgagccaggatcaaactctccattaaagaccaaccgaagctggtttatagaaagagcgataagctcatgttgaaactgacgagataaaaatatctcttgtttgattttgcgaacaaaatcgttttactcactcgttgttcagttttcaaagatcaaacctgcataatgccttactttgtttcaccaccgcatctcagcggtgacttaaataatatatcatgttttctacgtctttgcaacactttttttcgaaagaattttttaatcaattctgctttgttttcgtgttgctaactatcttgcaaaagacagctataagaatataccacaaaattacgctaaaaggcaacaccttttttcagtttttttctcatctttaaaatcactgcatttaaataaagagaccattattcccacaagcagaataacagtctctttaacattcatttcttcctcttaatgaataataaagccgggcactaccaggaggttcctctccttttacatatagccacgtcagtccttaatccacggatttttacgcgaacgtgcattataggatgaggagccggatttttgctttttattagtagcatttttactggaaaccttggctttggatgtctcttctttggatgtactgccagagctgtcttttgatttacctttacgcacgctacgatcctttgatttagaagaagaaccaacttcattttgggatgcaatagtcagattgttaccaatctcctgcgatcctggaattgctggtgccgactggacgttctcttcccggcatccacagtctggcataaacatgtagggtgttgtatatccctctaatggatacataggtgcattcccatgcgcaaacggatgataaggggaattcgcagattgttgtccttgtagttggctatagtcggacacgtgcccacccgcaggcgaaccatatggaggtcctccccatgcctggctccattgactgccctggactgtactctctggatactgctgtggatgcccttgatggataaatggaggatagacagggtaggatgcattttcagacgcctcatgactcggataatatccaggggcgcagcaatctgaataggcaggataaggtgttggatgggcatttataggtggtgtctgcacaggcccccagcaccatggatgctcacaatcatgatgatagcccttatcagaaactacagtaggagaggcgtgttctgctaaggaggtatttataggcgcattcccccaagtttgaggagactcaatccccggataccacgagttcggcattgcatttatttgtgggctataatcaaatgtcggctgttgtatcgaccactcggaatttaccatcggctccgattttgtgcagccgcaaaatttttcagctacaggttgcttcacaatagttgtaggaagctgtggcttagatgcgatgggttgggtaactataggttgcatttgaggtggagcaggtggagtaactatgggctgcatttgaggtggagcaggatttacgggtgccataggaacttcaggcagttttaattcaggaagcttaggaggattcactgtttctttcggctgtgtcatctcttctttggggctaggcatattttcctgcttaggctgcgttaactcctccttgggctgggtaagttcttgcttggttggggattcaggtttaggctgtgtcatctcttctttgactgcggtattttttttattctccgtaaaatcagacgtctcttctttgtagtgtggaatattaactgtttctccaaccagaagtgcgttcgggtttttaagctgggaattggcatcaataattagcttaagcggtacgttccacgccttggacaatttccacaatgaatctccttgcttaaccttgtgttgatataccgttgacggctgtgtttccatcgtaacagggtctgttggaattttaattttctcgccgatactcaactgattagggtctgccaattggggattggcggcaataactttctccagcgtcacattatacttctgtgccagcaagtacagagtgtcaccttttttgacgatgtgtattttcacaggtcacaaacctcctagactttcgttcgggcgggataaacgcccggcttctgttattacatcctatgcacctcccgggcgaatgaccccatacaaacaaaaaaatcctctcaaccgaatactcacgcgagcattcagttaaaaggattcggttttattttagtcctgccacactttgtagccatcctgatccacgatctttcggaactcagacaggagctccaaagtcactgggccagcaacgccggagccgatcgtacgaccatccacttcataagctgcaataacttctgccgcagttcctgtaaaaaacacctcgtccgcaacatatacatcatgcagtgtaaaaggttgttccttaagggggtatccaagcttagcacacaaatcgataatagcattacgagtaatcccctcaagcgcccccaaatagcaaggaggtgtatatagcactccgtttttgacaatgaaaatgttgtccgcagagccttccgtcacatacccttgggaattgagcataatagcctcacctacaccagcatagttagactggatcttcacgaggatattgttgagatagttcaatgatttaatcttcggattcaaagcgtctgggatgttgcgacgctgagagacagaaattgtcttcaggccagtcaagtaagcttcttccgggtaaatggcgagctgctccacgataatgatgacactcgccttcgcacaacgaagaggatctaaacctagatttcctgcacctcgggatacaatcagacggatatatccgttacgcatttcgttaagacgaatcgtttcagccattgcttccaacatttcatcaggagacaaaggaatgtttaactgaatggatttagcagaatcatacagacgctccaagtgctccttacatttaaaaatattcccgttatagatacgaatgccctcaaatataccgtctccgtacaagaatccatgatcatatacggaaacctttgcgttttccttagtcacatgctgcccatccagatagatccattgttctgccattaaaaccacacctccgattaatgttcctttaaaataggttcgatcgctgcttcaacatacttgtagcttggataagagccaagaacacgtacatggcaccccaaagcctcgatctctgcaaaggctgccggaagcagcacggaatgcagagattccaaaacttcaatgtaaaaataataattccccaattgctttttggtcggacgcgattcaatacgggacagatttaacctgcgccatgcaaatgcggataaaacctgatgcagcgctcccgggaaatcctgcggcggcgtgaccaaaatactggttcgctgaccttcaggcgtacccgggagacttatgggttgatgaccgatcaagacaaagcgggtaaagttgttatcgtgatccgtcactttgctggccaaaatatccaatccgtgtttggcagccgcaagcttggttccgagagcggtccagcctttaccggggttatgtttaacaatttcgacggcttctgccgtacttcctgcactctccaactcggcctgaggagcggaagcctgtatgaattctttacactggggaagcgccacaggatgagacataattttgaccactttgctcaaatccagcttgtccaaatccttcgtaaattcactgcgatgaccaataagattttgaattgaaggatatacccattccgcctgcatttgaatgtctacttcatgtacaagccaatccatatgcaaacttacagagccatcaatcgtattttcaatgggaattacactatagtctgcctgacccttgtctactgcctgaaatacgtccgcaatatgtttgtaaaaaagtaattcatgggacgtatctcctaacaaatacttaatcgcttcatgagaaacagtcccctcaggaagaagtgcaattcgtttcatatcgtaagttcccctttaatcatatccataaaagggagagtattcccttctgtatatactttaactccttcattctcagggcgcaattttaaaacagaagcagtgatcccctctttgttcatggtatccgttaaatactgctccagctctgctttccgattttcccgccgatctgtcaatgccagcaacgttggtccagccccacttagagccacacccaaagcaccataatggtgcgcatcctgcaggatctctgtcatacctggcacaagtgccgcgcggtaaggctgatgaagctgatcacgcatcgcttcggcgattaaatcggttcgtcccgacgccaatgctgctactagcatggaagcatgacttatattatatacagcatctttcaatgatacatgcgcgggtagaacctctctagctttcgacgtggacagctgaaaatctggaataactaccataacctccagattggcatctggttcaagccgtaaatgcctagcatgctcgccgtcccacatcgctgtaataataccaccaaacagggaagctccaacattgtccggatgtttttcaatggcgcttgccatatcgaacagcttggaattcggcagaggcgagccaatcaacgtgttggcagcgaccaaggcgcccacaatagcagaagcgctgctacccaaaccgcgggtaagcggaatatccgagtacatcgaaatatcgagctcaggaacagatacacctgcttcccgaaaaaccatttgtgctaccttgaaaatcagattagttttatcttggggaactccattcatttcatctccgtataaatgaaaagccgtctgttcggcctccttcatttcaatccatgcatataaggacaatgccatgcccaatgtatcaaagccgggacccaagttggccgtactcgcaggcacacgcactcttgctgtttttaaaacggtcatacagactattcctcctgcttttattgactatccctctactcgatatacgctcttgatgcgacgaatgacgtctaaagtttcaaaatgctccaaaacctttttcatactcgctttactggctaaatgagtcacgataataatttcagcatcggggttaacctcattcggttgctgcacaacagatgccagactgacattaaattcagcaaatacttgcgtaatccgtgccaacacccctgctttatcatccacatgcagaagcacgaagtttttgaaatacacatcttcgtcgttactaatttttttagggttgtaaggaacgatagctttaagcccattgacaccaagtttgagatttttcactacagctactaaatcagctacaaccgatgttgccgtcggcatttcacctgcacccgcaccataaaacatggtttcacccactgcttcaccatgcacatacaccgcgttgaataccccgttcaccgaagccaatggatgctgcttgcgtaccatggtcggctgaacgttaatcgtaaattcatcaccctgacgctctgcaatgccgagcaatttcatttcatatcctagttttttagcaaaagcaatatcttcactggttacctttgaaatgccgctgacacttacatccttgagctctacattagagcggaaaccgagcgtgccaagaattgccattttacgagctgcatccagtccttccacgtctgatgtcggatcggattcagcatacccaagctcctgcgcttccttgagaacttcctcgtacgaggctccttcctgactcatttttgttaaaataaagttggtcgtaccgttcacaatccccataatgcgggtaatacggtcggaggagaaaccttcaatgagtgtgcgaataatcgggataccgcctgctacactagcttcataaaaaatatcacattgcttttcctgcgcctttgctaatacttcagaaccgtgcaaagccattaagtccttgttagctgttacgatgtgtttaccccgctccaacgcttcaagaatgtactcctttgtctgatcaaccccgcccatgacttcgataattacatcaatttcagggtctcgaataacttcccatgggtcctcagtaagcttggccgtgtccacttcaatggaacgatatttttctatgttttttacagctattttttcaatgatgatcggtgaaccgacttgtctgctcaaatcttcctgattgccttctacgattcgaacgactcccgttcctaccgtccccaaacctaacaatcctactttgaccggtttcatccattcccctcccgcaaacttatatctaatgaactgtattgccttaaccttgcccaatcaggcgaacacgtttgactccagagatgtcctccaagccctccagtagaacacccaactcttcactgagtctggacatttctaccgagataactacgttggctctgccttgcagtggaatactttgctggatcgtcagcacattgcctccgaaatcagccactctgccaagcaccctggacaacattccggattgatgttctaaatcaatagagatattgacaattcgctcacgctccagctggttaaccaaatgtatgccatccttatatttataaaaggcgcttcggcttagcccaacttgctccacggcatcatgcacggttttaacatctcctgaagccagcagcagtttcacctgtatggtcttaacaatagcttcaggcaaaatatcttcccgtaccaagtaatagcgctctttcaagaacgtcctctcctcaaagacttatgtttttgtatagaggacattatatcgaaactcatgaaaatcggcaagctaacaatgcaaaaaacggctactgccttctatagagtttcctatagtacagtaaccgttcaggttttagacctttatttgatttttagtagtagctgctgccttcaacaaattcgaactcgaaatcagcaatacgtacagatgtaccatctttggcgccacgcttgcgtaactcagcatccacacccatgtggcgtaacgttcttgctaatttcaaaatggcatcatgcgagttcaactgcatgcgcttcatcatgcgctcaattttagggctctgcaccacgaatgtgtcgttttcacgtacaattgtaaagccatcgtcttctgctgtatccagcttaaataccttacgttcattgacttctgctacttcctcaacaactggctcgtccggtatttgatccagcaaatcagcagcccggtagagcagttccttcacaccttgacgtgtcagtgaggaaataggcatgatttcaagatcaggacgtatagaagcaatctgctctttgaagtgagccaagttttcttcagcttctggcatatccattttattggccgccacaatttgcggacgctcagccaatgctgcattatattgcttcaattcgtcgttaattttagtccaatcttcaaacgggtcacgtccttcggagcccgccatatccacgacatggataataatacgcgtccgctcaatgtgccgcagaaattcatgtcccagcccaataccttcatgagctccttcaatcaaaccaggcaaatctgccatcacaaaattacgatgatcacccacatccacaacacccaaattcggagtaatcgttgtaaagtggtaggccccaattttcggttttgcggaagatacaaccgacaacaaggtagacttcccaacactagggaacccgaccaagcctacgtcagccattacttttaactcaagcgtgatataacgttcttgtccctctgcgccgttctcagccaactcaggcgctggattactcggcgtagcaaaacggatgtttccgcgtcctccgcgtcctcctttagctacgacgacttgttgaccatgacgtgtcatatctgctactacttcaccagtatcatcatctatgatgaccgttcccggtggtatacgtacgatcatgtgctccgcattggctccgtgttgacttttgttgcgaccttttactccacgctgggctttaaaatgacgttggtaccgaaaatccatcaaggtacgcaaaccctcatctacacggaaaattacgtcaccaccgttccctccgtcaccaccacctgggccaccttcaggaacgtatttctcacggcgaaacgcaattaatccgtctccaccgtcaccgcctttaacaaaaatcttcgctttatctacaaacatggttacaccttccttatgtctggcactgcatccgaatttgaagcatttcgcccgtaggaagcttctctgttcgaatgcgtttacttccgggtacggatctgacctgctttaggatattcaaatccgcaggtatgtcacttccttcaaaacggacgataacatcattctgatccataccgaaaaaaagtgtcaatctgcgcacttctccccaggacgaccggcccccgccatattgatacgcacgcaccgtttctatgacggccgaggcaagcgactcgccgtcttcgggagacatgacagcgtctaactttaactgctcctcaacctgtaccgacaactgtaaattaccggcgttcacgcgaaaagactgcaaataaaacaccagtgagggaatacccaacttagatattttactgtcttccgccacgcgcccttttattgtttccacataagcaacagatttatcatgcttattcatacgaatatatccataaagcacctgcaagtcattcatccagtcatgccgatgatggttaagcattgaaatcgctgtacgctcaaaagaacgcaaagcagctttccgttcatactcaacctgtctttgcgtataccacataccaaagcatgcagcaactacagaccatactgctaataagataatcgttaatactttaggatagagcagtgaaaaaaccaaaggaatcagaatggaacccaacgccagataaggcgctcttatccgctggaacatggcttctctccgttctgcgaaattaaatggattattaaagaaccttaatccagtatagcacagactaactttccagttcattaccatcatgcaaaaaagcctccgacaaaagtgccggaggcttttcagcgtgtctaagccgctattaagcttctacagtagctgctactggagcaacgtcgatcgggtagatgctcacctttttgcgatcacggccccaacgttcgaacttcacaacgccgtccactttcgcgaacagagtgtcgtccttaccgatgcccacgttcgtgcccgggtgaattttcgttccgcgttgacgaaccaggatgctaccgccggtaactgcttgaccgtcagcacgtttcactccaagacgtttcgatttactgtcacgtccgttttttgtggaacctacaccttttttcgatgcgaataattgaagatccaatgtcaatttcaacatgatgtctacctccttctttgattattttctatttgaatatacttaccgtatgattcagcaatacttgtcagcataatcaccatggactccagcaacagttgaacctgtgcgttcgcatcatgataactttcaggagaaagatacgcgcttaaaaagccgttttccatttccgtttccatctcaacgtccgtaagagctccaatcgaattgacagttcctactgttaccgccgaaacgccagcacatacgatatcctcgccagatttagcgaaatttgcatgtcctttaacggaaaacccctgtatgctgccatcctccagtcgtgtaatacgcacgataatcacttatcgcaccctcttacgcttggattttttcaatcgtcactttcgtgtacggttgacgatgaccttgcttcacatggtagttctttttaggtttgtatttgtatacgatgaccttttgaccttgaccatgcttctcaactttagctgttacagaagctccagaaagaagcggtgtacctgctgtcaagccattgtcgccggacactgccagaacacgatcgaacgttacagtttcaccatcattagcttccaacttctcgatgaacaatacgtcgccctcttgaactttgtattgcttaccacctgtttcgataattgcgtacatttgcttgcacctccttatgtctcagactcgcctaatagcaggtggcagattcccttaggatactgcacttcagtacctgattggagcggttacagcatgtgcagccaatcttacgcatcacacatactaaatgattgtagcacaagcttggtacacattcaacctttagttttaaaatgatttttggttacgcatcgctctacacgagcgtcttttcctcacgcacttttttgcgggtcatttccagcaaacctaaccgcgtccaaccgacaacataagatttggtccgatccttcttcaatcttgcttccagcacagaggatacttcccgacggttctcctcttgttccatgtcaataaaatcaatgatgatgataccaccaatatcacgcacacgtaccaggcgggcaatctcttcagctgcttcaatgttagtccgggtcaccgtttcttccagattactgcctcccgtaaacttcccggtattcacgtcaatgacggttaatgcctccgtatgatcaatgacaatgtatccgccgccctgcagccatacctttcgcgcaaaatcgcgttccagctgctcatgaatgccataagctttgaaaattgtttcttctggaccacgaaatatacttacatgagctttcgcaggaccgatctgttgcagcattatttctgcatcctttgcttgctcttcactgtcaatgaccagttcatcctgttcaggtgtaaatacatcccgaatcaaccgctgaacaatacttaaatcccggtgtaattcgcacggagccgagtgttcaccagctttacgctgaatagccacccactgcttacgcagttgatttaaatcattttcaatcgcctctatactcatgtcctccgaaacggtacggattatgagtccttcctcacttgtgcgtagctgctctcccattgctttcaaacgggtacgttcgccctcacgttcgatcttcttagatacggccacataatcagcacggggcatatatacgatccagcgacccggaagtgaaaaatgagtggtgaccctggctcctttactaccaacagcctcttttaatacctgcactacaatttcctgccctacctttaacacttcagaaatggatggctttacctccggctgcttgtccaaatgagcatgaagtacgtcatctacatacaaaaaggcattctttcgctgtccaatgtcaacaaaggcggcttgcatacctggtagcacattgaccaccctcgctttgaaaaaagaacctaaaattccccgttttcgcggtagttcagccgcatattcaaccaatcgtccctcttccaacagcgccatttgggtcatctgctgctggcattgtacaatcatttgcttcatggtttttcaacctctctggatacagcctcttccttaactcataaaacattatttgggcttgggttctccaccatctggcgggcgtgtcgcaaaataagagcgaataagacgttgctccggcaatacggctacaatccgtccctgttcattcataacataaaccatatgataccgatctcttctgaaaagacgcaaaataggctccaaatgtttcactggcagggatacaataggtaaggcaatacttcccttagctacttcgtggtaaaaaagctcgtccctccccagcaaaaaccgtataaaacggtaagggatattccgataatccacaatattagaataaagcaaaaaaatccctaccgctagcagatttaaatggataggtccattttgccttaacaacggcgaaataccatatatacaaaatagcaaactcgttacgatactggctctaaaagtccacactaatgtgcggtgataagaacaagataagctaatcagtgcctgcaatatttttccaccgtcaagtggtaaaatgggcagcaaattaaacagtgcaataactgcattcccctgaatgatataatttacataatcatactccagtccactcacatttctgaaccacaaaaggatgatgatcatgattccgttttgcagggggcccgctagcgcaatgacaatctccttccacgcattgagcttcccctgatcctcaatgaccgccactcctccaaagggtaacatctgtatggaaagcacccgcgcacccaacaacgaagcagctgtcgcatggcctagctcatgaataaacaccaatgtaaataaggttatgatctcgataaaatgtcccgttaatatagaggtcagcataaccaatacaaacagtggatgtagtgataaggtcacccctcggacattaatcaagggctaccacttccgacgggtcaatgtattgatcccctctttgaactgccaaaaacaaagtcgccgcctcgctgccgctgtgacttgctggcagtacaccgatctcatctccctcctgaacccagtcgttcacttttaaggtagagcgggaaagccttccgtaagttgctgtgataccgccagtgtgtcgaattgtaatcgaaatcccgcttttgggatgatttaatatgtctaatactcgacctgcatctatacttttaacagcgattgccccgttatcggtaacattcggcgtaatttctacccctttaaggctcagtacaaaaggttgtgttatattgccttcaatcggtggagagccctttcgacttgcgtctaccttgtgcgtttcatgctcctcgccaaaaatcggcaaaaaggaaggtgctccgtcaaaataagtttcataccattgtccgacggctgcaaaatccatatccttattcaaggcatccgcaataaacattctcaaattcactgcatagggaatatcccaacgaaacattccccataccattccaaataacaccgttgctatgactgatcttcgccaaaaggaagtccaaaaagacggaccacgattcgtcccaaaagattgctgccagcgttgccgctcatttttccactcagtttctgggtctctgggcgagttggcactgtctataggcatcgacttcatatctttatccccgtgcctgttctgatatatgccagagggatacgtctccgctttgcttcccgcgattagctgctgtatacgttcttctctgcgctgcttgattccggaatttttattcatcctgttcagccccctcagcgaggtatgtttgatacatcttatgaggacgggcttcaacttatgttgtccggttcgggattacgcacctaaaaatcaaaaaaaccggcgctagcgcaccggatatgttttgtatttatgatatttatgtagtgaccctaaattttgagaaaccgtattataggaatttaaaaagataaaccaaaaacacttaaataagattatcacttatttaagtgtctagtattacaattttctcatccacccataccaaaaaacttcttaaagcgtgtcatcacgcttttcttttggtccagctgcatgaggggcactgtatcgcctaagattcgtctcgcaatgttacgataagcaatcgcggcctgtgaatctggattcataacggtaggctcccctgtattagcggctttaattaccatttcatcatccggcacaatcccaataaggtctatgctaagcacttgtaaaatcccatcaatatccaacatatctccggatttaaccatgctattgcgaatgcggttaaccaccaacttgggtgataccacatgtgagctttccagtaaaccaattacccggtctgcatcgcgtacggctgcattttccggggtggtcacaacaatggcctgatcggccccggcaatggcatttttaaagccctgttcaatacccgcagggcagtcgatcaatatatattcaaaatcctttttaagctccaaaataatatccttaacctgctccggcgtaacagcactcttgtccttggtttgagcggctggcagcatatacagctcctcaaaacgcttgtccttaaccagtgcctgatttaaacggcaacgaccttccgctacatcaacaaggtcataaataatccggttttccagacccatcacaacgtctagattacgcaacccgatatccgtatccaccaaacatacctttttgccgagcagtgcaagcgctgttcctatattggctgacgtcgtcgttttgccgacgccgccttttcctgaagtgacgacgatagcctctcccatgtgctacacccctttgaacacgttaaaatcgcggcccagacgcacaatattgctcattttatctatttgcatagcgccatccttgagatacgcaaattccataccggattcacgtgtctcccattcgtctggtggacggctgatcatttcggaaattcgcagctgtgtcggtgcaaaataggaagccgcaatgatcgcttcactatttccctccatccctgcatgcgccatgcctcgcaaagcgccgaggacataaatatcaccagtacatgttataattccgcccgggtttacatctcccaaaaagagtaggttcccattgtgatgaagcacttgaccagaacggataatccctgtcaccgtgtgaatagggggctttccctgcacttccacaggcagtccaggtgattctacagacctgatgagcagattccccttttgcttcaagatctccagaatactttccttctgttcctctgtcacttctcggcttcccagcttaatatccacatgaatgatcgggcctgttaaaatattttgatgactgtgctccagcttaaaacgcagctcacctagcaaatcctcaaactcgcattgatcgtccagcaggaataccaggccatctttgatgcctttaatcgtgacatgattcgatttcaccgccattagcctgtccctcctatctcaatcatttcgtccccgggacgtcaaatccctgctaacccggacaaaatgtgtgtaaaaagacctagacggcctcttcctttttcacacgggtacccaaacgctgcaattgcttgcgaaccgggacataaatgatgagggcgaacagaaaatggataaataaatcaggaatcatatattgagcaagtgcccagttgaaagtctgatgattcagctggaacagctgatcaatggcaaatagcatagaatccagcaggaaactaccaatcaacacggctgccatcataatgggcatctgcgcacgtcgagctgtaaaaacaagccccaataagtatgcagacaaccccattgcaaaagaataaggtccaatgataaacccgtagaacactacatcatgaataagtccaaaaacaatacctagcaccaatgctgtatgacggctgtaatacacagacacaaacaagatcacgacatacacaaaattcggaaccattcttgaatgccaactatccggaagaagccacggaagaatcgtcccttcagctataaacagtacaaacagcagcagtattagaacctgaccgcgcatcttcattattccggtacctcaggagtgtagaggatgagcaattctttccaatccacaaagctggctgccggtttaataatcgctgtccgtgttttgccaaactccccaacctgaatcttctctaccgttccgatcattaggtttttgcggaatttcccgcctgcaccagacgtaataatctgatcaccctttgcgattggatctttttcctcaatgcgagtcatttgaaatctgttcgtacccggatcatagctttcaatcataccaaacgattgattttccttgcccaagactgtcgctgcaatggcataagaattcggatttttaggatccagtgtagtcaacagtgtaacggtggacgtaaaattccccgtttgactaatgactcctacaaatccttcaagcgaactgacttcctgaccaaccttcgctccgtccttctcaccaatatcgatcacaagcgttttggaatcattgctgacactgttcacttgagcaacacgataatcataattatttttcgccttttgcgtttgggtgaacttcagttcattctgcagtctggcatttgtttcaacataattatgggtctgaatctggtcacgagtcagctttgctacagcaatttttaatcgttcattttcttcgtagatgctgcgcatatttccgatatcttcaaagaagcccgctattgctgaagcgggcctgtaaaagataccttgcacaaagccaattgaatctctggcgaacttctcgggccaggttaaggaatttctctgtccaagtgtaatccccataagggcaataaacagaacgattccgatcaatagaacaaatagtcttttattgccaaacagcttaaacagttcctacacccccgattcaacgtttggaacggacggcagaactgctgcgcgatttgaacaaatgaatattttccagcgctctgcctgtaccgattgccacacaatccagaggattttctgctacgatcaccggcattccggtttcacctgccaacagcttgtccagattacgcagaagtgctccaccaccagtcagtacgattcctctatccatgatgtccgctgccaactcgggagggcatttttccagtgttactttgaccgcatccacgattgcattgactgtatccgataatgcttcgctaatttcatcagaagtaatcgtaatcgtcttcggcaaacctgttaccagatcacgtccgcggatttccgaggtttccacttgctctaatggcatagctgagccaacttccattttcagttgctctgaagtccgttcaccaatcatcagattgtattgacgctttacgtattggatgatggactcgtccatttcatcacctgccacacgcacggagcggcttgttacaatcccgcccagggagatgactgccacctcggttgtaccaccaccgatatcgacaaccatacttcctgttggctcccatacaggaagatcagcgccaattgctgctgcaaacggctcctctatcgtatatgcttctcttgcacctgcttgcttcgtcgcatcttcaacagcacgctgctccactgcagtaatgcctgaaggcacacaaaccatcacgttcggatgacgtggaaacaaagagcgttgggcttgcgcctgacggataaaatatttgatcatcgttgctgttgtatcaaaatcagcaatgacaccgtccttcatcggacgaatcgcacggatatttcccggtgtgcgaccgatcatttttttcgcagattcaccaacagcctcaatggtttttgtatctgtacgcaaagcaactacagatggttcacgaaccacaattcctttacctcttacgtatacaagcgtgtttgccgtccccaagtctattcccaaatcttttgtaaagccacccagcatgatgtaatctccttttctcttccctgaaatctgttatccatgtataaacggtttattcaggccggattatccggtcgtgtttaaatgtttgatttaaatattatattatatcagaccttgttccttcaaacttacaaaggtcccgtccccgatcacaatatgatcaagcacgtcgatacccacgatgttgcccgcttccatcaggcggcgagtcaactgaacatcctccgggcttggcttcggatcaccgctcggatggttatgagcgcaaattattgaagcactgctgcatttgattgctgcccgaaatacttcacgaggatgcacgatggcagaattcaggctacccatagatagtgtttcctgagcaatgacatgatttttagtattaaggaacaagcatacaaaatgctctttctgcaaataacgaagctgctcaaacagcagatctgccacatcccgcgggcaactaatcaccggggtctccaaatggcgagacaatgctaatcgacgccccagttcgatacccgcttttagctgtatcgctttagcatccccaatgcccttaatctgggtcaactcgctcaagctcatatccaccagttgacgcaaatttcctgcctgctgcaaaatacgctgcgctaaatgcaccgaagactcattttgcgttcctgtacgcagcaatattgccagcaactccgcgttgcttaaggcatccgccccatatgtcatcatgcgctctcttggtcgttcttcatgggggaggtcgcgaagcatcagtattggcgactccagcatatgtttatcccctttatggacgcaacacattcactccaaaatcggacagcatgtccgacagcaaggaaagcggcaatcctacgacgttaaaataacaaccctgaatagattccaccagcgtagcacccatgccttgaatgccatacgctcctgctttatcagacggttcaccagtattcacgtatgccacaatttgctcttgactcagaggcttcattgtaacctccgtttggcgatgtctgacaagcatttcgccggttccggtatgtatgcaggctaccccggtgtacacacggtgtgttcttccctgcaatgcagtcagcatgcgaaccgcgtccgcatggtcggcaggcttgcccagtaccgaaccatccagcacgacaatggtatcactgccaatcaccagtccggcttccttcgactgagtggcggtgttcacgaccgcttcggctttgcgtgccgcaagggtctccacgatttgctgaggcgtccagctctcaggcgtgctctcatccgcatgactcggcaccacctcaaaggggagtctcaaaaatgcgagcaattccttccttcttggtgaagtcgatgccagaataatgcggggcgtaattttcccgtccataagggaagctccttttcatcagttagagcctgcggtacagccagaacgcggcaatgatgccgatcagactaagcaggctcaattcaaaatttatcgttatgttgtagctgataatatccaggtccgctctcggcgaccaagatatcctagtggggtgggtcagaaaggaaaggaatttgatcgattgaagggctttggcaatccatgcacccaagagccaaccgagcaacaaaaacagtataagcattcctacattttttttcatcctgatcttccctcgccattttttgacaccttcattattatacggtgatttgtactgcaatacaaacagaaatccggcatggggaactatttccagttccttgccggaaaatatggttagtctattgttttatgaattggataaattccttctcacgcaaaacatattccatcatggaggactgaatctcccaaatgtgttccttggctgtattcttattatattccccaagtgcagagatcgcgctgttcatcgccttttcaagtgaggttgcggaagcaaccgcttcctttggaagaccggtaggaagtgcagtgatattttgtgtccactgctgatgcaggtcgttcagctccttcatgtcggaggctggcaccgtattcggacctccttctcccagcaaggttgaggaaagtccgctcaacttacccaccaataaactacttaactgaaaaaagccagtgagtttatcgccttggcctccgtaagccgctttttcgaatccaggcaattcaagctcacgaacatacaattcgactccttgtgttttcaactgattgctgagtaacttagcttgctccctatccggtgatattcctgcatatacccggttttggtcctcggtatcccctcctgctgcaatgcctgccttcaacagttcttcttttgcttgtaaggcccgttctggagtgctgaaaaccccatattgcagcaaatagtaggtttgtggaggtacctgagcctctatgacagtgacagggacagaattctcttttgcagatattgcatccacaccaacggattctttaaagaccggtacagcctcctctactgagggatctgctcccggaaccatgcctcctccgttaaacagtaacaacataatatatccaaacatccccccggtcaccagtgcgctggctacagaaccaaccagtttccatctagaagggtggggcggacgttttctgtactcttggccagaatgataagcttcctcattctcttctaggctatctggtagaacgtccgcatctgaccaagaagccgccgaacggccaaaggggtcatcccatccctcttgtactcttaatgtcggagcaaagtgccgacttgaaatgcgtttattcagatcctcaggctcattgagctctgcttcttgcgtagttacattatttttcttcattcctctaatcgtttcacgctgttcgttcgtaatcgactcgtttttgtacggaagcacctgtagcttatcctcccggcttgtctccggcaactgttggtcgaaccggaatgtcatcttggtcttgttcatggatgcactccctccttgtcccatacttcctcatagtctgttgtatgagtcaagctaagaatatatgccccagcattacaaaaaaaaggtatcccgaaacacagtcgtgttcggaatacccttgaataaatgtaattcattggcgtaacagctcatttttatacgtattacacttgctgtccgcgaagatggcgcgctaacgcgtcacctgctttccagatgtctcccgctcccatcgtcagcacaagatcgcctggctgtaatcgatctttcaactcctcgatcacggcttctttggtcggcaaatagattgcattagcattgctgttttggacgattaaatccacgagcttggaagaatgcacgccttcaatctgcttttctcccgctggtgaataaatatcggtaatgatgacttcactagcctcgctaaacgcgcggctaaacgcatcgagcaggaaaaaggtgcggctatagcgttgcggctggaatacagcaataatacgcttgccagtcgctctcgctgcgctaatcgtagcctcaatctctgttgggtgatgcgcatagtcatcaataatcagtatgtcattgctttcacctagtacttgaaaacgacgcttcgctccgtgaaattctacaatagtagcagcgatttgattgaatggaatccctgcttccaaacaggatatcacagtagccatcgcattatacatgttatgtttacccggcactgatagctcgatcgttccgagtgctgttcccttacggctcatagtaaagcttaatcgacggtcacctaattggatatctgtcgccatataatccgcttcatgctccactccataagtaatgacccgagtctggagctgaggcaacatttcccggatgttctgatcatctgcacatacaatagccgccccatccggtcgaatttgactcaaaaactgtacataggcacttttcagacgattaaagtcgccatcgtaattttccaaatgatccgcttcaatattggttacaatgccttgccaaggatgatattgcaggaaagaaccatcactctcatccgcctcagcaacgacaaactcgcttttacctgctttggcattcgtccccaaattcgtgatttcgccgccaataatatacgttggatcaacgttacatctttccataaccagagcgatcatggaagaggttgtcgttttaccgtgcgcacccgcaacagctattcccttacgttcgttaagcaagcgagccagcatctgcgaacgatgcagagttggaatattcaattcctccgctgccacccgctccacattgtcacgtgacaatgctgttgaatagacgacgatatccgcgcctgcaatatgctcaggtgtgtgtccaatatatatttttgcgccttttgccgccagtttttctgtcagctcctgtgatgccacatctgagccagtcacggtataacccatctccagcatgacccgagcaatcgcgctcatcccgtagccgccgataccgataaaatgaacatgttccgaagtaatcaacaaatttcaccaacctttttccgaatcggtttgatacataaggatagcccgtacatccgcaataaggtacagcgtgccggacaccacccccagatcttccgcttccgtatgtgactgaagcaggcctagagcctttttccagtcaccttctacaattatttttaaatccgttttggcataagacggccgcagcttctccacgagatgagccaattcagcggcattcattttgcggcgaaaatcgggctcggtcaggataagcgtatccactagtggcagtatatgctgcaagtatgcttcatgatgcttgtttgacagcattcccatcattaaaaccaattttctgtacgaatacacttgaggaagactcttagccagcgtctgtgctccttctggattatgagctccatcaaggacaatcctcggcgaggtactgacttgttcgagacgccctgcccaggcagtttgcctaaaaccctccagcaattctgcatcatccaacacaaaagccatatactgacgtaggacctcaagtgccatcatagctcctgccgcattagaacattggtgctcgcctaacaacgtgatgtcaatttccatatgtcggaagggccccgcgaatgaaaaggtctgagctgtttcattcccatttagccgttcatacgtaaactgttctcctgccaggtacaaggtagctccttgctttgtcgccgtttcacgtatgacctgaatagcctcgggttgggaaacacaactgacgacaggtacacccggtttgatgataccggccttttcccttgcaatctgttcgagcgtatctcctaaaatatccgtatggtcatagccgacattcgtaataactgagacgattggattcacgatattagttacatccatccttcccccgagacctgtctcccataccacaacatctgggaaagataccgtagcatagtataaaatagccaatgctgtcgatacctcaaacattgtaggtgatcccaattcactatctgcgatttctttcaccaacggatacaagcgattggcaagcaaaaccagcgtttcatcgggaatatcggtcccattgaattgaaaacggttcgtaaatcgggtgatgtacggagacgtaaaagttccgacatcgtacccacatttcagtagcacagaggtcagaaaggcacaagttgagcctttaccgttggttcccgcaatatgcacaaatttcagatgtcgttgcggatcacccaatttactcattagctgttcaattcgttccaatccgggtctgataccaaacggaatcaagccgttaatccattccactacttcatcatagctttgtaaaggagccgtgtctccgcccctgatcgtatctgacatcctcttcaccttcaggtcattttattgtgagtgaaattatcccttgagttcttcaatacgtgcgataactttagcgcgcttatctgagtaatcggcttgcttggccttctcttcctcgatgactttagctggtgccttcgccacaaagccttggttagataactttttctccacgcgctccacttcactgttcaaatgctgaagttctttttccagtctgctaatttcctgggcaatatcaagcagtccggccagcggcaggtatagctctgcgccactaactatagatgtcatcgctttatctggaacggtgaattctaatcccgcgtcgaattcagacgtattacagaatctacgtacatattccccattgcggttaatgatatcgagaacggcttgatcaccgggttttatgagtaattcaatttttttactcatcggcacgttgacttcagcacggatattgcgcacagcgcgaattacgtcgatcagcaaattcatttctgcaactgcatccttatcctcaaaagaaggatcataaagaggccaagcggccagtgtaatcgtctctccctcatgcggaagatgctgccatatttcctcagagataaacggcatgaacggatgaatcatgcgcagtgtccgatccaatacatatgcaagtacggactgcgttttctttttcgcctctgcattttcgccgtatagggaaagcttcgcaaactcgatgtaccagtcgcacaaatcatcccaaataaagttatacagaaggcggcctgtctcgccaaattcataagcatctattagacgcgtgatgtcgcgtgaagtttcgtttagacgatgcaaaatccaacgatcagcagtgcttaagtcaccagtaatgtctatatctgccgaagtgacgccttccagattcatcagcgcaaagcgtgacgcgttccagattttattggcaaagttacgggcctgctccacccgctcccagcggaaacgaaggtcttgcccaggcgtgctactggtggaaatcatataacgcatggcatcagtaccatattggtcaatcacgtcgagcggatcaacaccgttgccgagggatttggacatttttctaccgtccgcatcgcgaaccaacccgtgcataagtacgtccttgaacggaatctcttccgtaaactccaacgcggtaaaaatcatacgcgatacccagaaataaataatgtcatagcctgtaaccaagacattagtcggatagtagcgtttgaggtcctctgtctgttcaggccagcccagtgtcgaaaacggccataaagccgagctgaaccaagtatccagcacatcctcatcctgttttaactttctgccagcatactcaggcaaagttgtagggtcttccgccgatacaataacttctccagtttcttcgtcgtaccaagccggaatacggtgtccccaccataattgacgggaaatacaccagtcacgcacattttcaatccaatgcagataagtacgttcaaagcgatccggtacaaagtttaccccgttgccagccttctgcacttcaatggctttagctgccagaggcttcatttccacaaaccattgtgtggacagataaggttctacaactacacctgtacgctcgctgtggcctacttgatgtacgtgctcttcaatacgaatcagcacgccctgctctttcagatcagcgacgatttgcttacggcaatcgctacgatcaaggccctgatatttgcctgcttcggcattcatcgttcccgtttcgtccatcaccgtaatttgtggcagctggtgacgttgtcccatttcaaagtcattcgggtcgtgagccggtgtaattttaaccgcgccgctaccgaaatctttatcaacgtagtcatccgcaatgatcggaatttcccgtccgatgattgggagcacaagtgttttgccgatcatttgcttgtagcgttcatcttccgggtgtacagctacagctgtatcgcccagcatcgtttcaggacgtgtagtggctaccgtaataaatccgctaccgtctttcagtggatattgcaggtgatacagatttccgttcacctctttgtattccacctcaatgtccgataatgcagtacgtgcagcagggtcccagttaatgatacgtttaccgcgataaatcagacccttcttgtacagtttaacgaatacctcacgtaccgcttgggacagtccctcatccagcgtaaaacgctcacgagaataatcgagagaaaagcccatcttttcccattggttatggatattatctagataaagatccttccactcccacactttctccaaaaacttctcgcggcccaaatcataacgtgtcaggccttcttcacgcagcttttgctctacctttgtttgggtagcaatacccgcatggtctgcccctggcagccacaaggcatcatacccctgcatccgcttggcgcgaataataatatcctgcaaagtaaagtcaagagcatgtcctatatgcaacatacctgtaacattcggtggtggaataacgattgtaaaaggctctgcctctggatgttgcccagcgcggaaatagcccttctccatccacgttttgtaccatttttgttctgctgattttggatcgtacgttgttggcatttccaaggttgtcttgttgtcttgttctgacatatcaggatacctccatgatttttcaattggcaaacaaaaaaagcctttcatcctcaaaggacgaaaggctgttctctcgcggtaccacctttgtttcacccctagtgtatgtatccactgatccattacacatggtgtgacactttatgcagataacggttgcggaccggccttattctaccgtgagcctcttatcttccgtaggaattaaatgaggaaccgttcaaacaggcgactcccgggtgacttcggccagtagcttcctgcggaacctcacagcgctgcaattccactctctgaagggcttgctgcctactcttcccgatctcagtctttcaataactataccacatcatacatttcccattgactatagtcaacacccgccgtgcatttttcagcaaccggatcaagggatatacaatacctgtccttcttccacatgatgctccgccaatctgttatacagttgaagctcacgtgtgctgagctgataacggtcagctatggtttccagtgtatcctcgcgctgtacaatgcataaccgcaccttgcgaaaaggtgtttcatcttgtgtatgaaaaaaaaggttcttccacttggcattctctcgctcttcttcggctttctgatcctgatcctgcggctcctgctccaactgctgctggtattcggcttccttcaccgaacggctggattggagtaatgatgagtagacaaccgggtctggctcgtctgccctttcatcctttttactgttgagcgctacacgcatctctggcttatcctcagtaaaggtgtcatgggcctcgtggttaacctgttctgacgcttcaggcctgaagtcgaagttatctacttgactcgcttccaactgtggctccagatagacctcggactccgtggcaggatgcggttcagacagcaaaggttcatatactatattaggagatgcggaagatactttgggctcatttccccctgcccatgcttcctcttgctgaaatccccacacttccggagacccatgctcatgcttgacctcgggagagctgtcttcaactgctttgcccgtccaaggctcatagaatcggttaggatctactgccgactcataagcttgctgttccgacaatgacttctgttcctcatgttcctcagacggctgttcccaagaaacggactcctgttgtgctggcaccctgtaggaagtttcaggatctgtaacgtaatcggaggacgagtcattggtagaataggcctctgcatgatgctctccatcggcggaaagggattgaaccggatgctcaggtgcatgcactacggtaaattcctcatccagccaaaccgccgtctcctccgcgtgcgagctttccacgccatgcaaagaaagaacgcctgtaatgtttagactacgtaaagaaagcaggtccacatcaaaattttcaatctcgacagagatatcttccaatctccctacgcggtttagcggaatggtaatttccacagggatcaaatgatgaagctcgctcgtgatctgttcaggtgtgcggtacacgccctccagcagcaaatgccctcgcaaagcggcatggtcgccgtgggttacaacctgaatgcgtggcagaagctcaatttcctccaactcagcaatcccggcagcttcctccgtcaaatgaatgcgttcataaatatcaaaacgcaagccttgcggctgatcattctgttgtttgttcaaggatggcatcctcctttgggcagtctccgcacatcctctgacttctggtcaggcgcacggaaactccatattgcaaaccgtttctaggttcaagtatatgcgccaaaatagaaggcatgccatcttttatagctgtttgtgtagcttttgaaaatcatccggccaagcatcctccacggtaatcgtttcgccactcagcggatgacagaaagtaagacgctctccgtgcagcgcctgcctgccaaaatcagtagcccgccccccgtataatacatccccaagcaatgggtagccagcatgactaagatgtacgcgaatctggtgcgtccggcctgtctccagcgtcagatatacgagactcactgcacttggaccgcttccccatacttctccgagttcaatatgggtaaccgccttttgcccagttggagatacacgacggcgctgcttatgatgcctgtccttgccaatcggccaatccaacgttcgcagcgatgggggtactttccctcgtaccaaagccacatacctgcggcctatatccttagctcgcatttgctcgtccagcttgagcaacgcaaattcatttttggcatatagcactgggcccgtcgtatccacatccagacgatgtacatgccgtaccgccgcatgaatgccattcatctcatagtaggatgcgacagcatgatccaacgtcagcggaccatcctgcacagcgccatccggatgtactgccatacctgccggtttatgcactaccaggcaaaaatcatcttcatacagtaccttcaaatcataccaacgaggggtgattccaaggttcattacaggaaaaagggccagccgcagccggtcccctgtaagttcaatctcttttgcatgacgcagtctgcgccacagcttttccggtaattccaaacgattcagcaaccactgatctacagcatcagcattgtttttttccccgtctgtgatttcccgtcctggcgtgacttccagccacggtcctcttcttttccagccaccttgccagctcatagacgtttgagcgcgcgatagttcgcctcaatggtggcatcaatatcctctaccgtatgcacgcccgacacaaacataccctcaaattgagatggtgccacactgactccctcattcaccatttcagtaaagtaacggcggaagtggtcctgattactcgttttagctgtgtcaaaattgacaaccttttcttctgtaaaaaatggacaaaccatggaacccacgcgattgatcgtgacagggatacccagctcgctcgcattacgttcgaatccggcttgaagtcttgctgcccgctcttccaggcgatcgtatacttctggcgtcagcaatttaagtgtcgaataacctgctgccatagccagcggatttccgctaagcgtacccgcttgataaattggccccgatggagcaatctgctccataatatcgcgacgtccgccgtaagcacctacagggagtccaccaccaatcactttacccagacaggtaagatccggcgtcacaccaaagcgaccttgagccgaatgaagtccaacccggaatccagtcatcacttcatcaaaaatcagcagacttccgtactgctgggttacctcacgcaaaccttccaaaaatccaggctgtggcggtacaactcccatattgcctgctactggctcgacaataattgcggcaatctcttcgccaaatttctcaaaagctagcttcaccgaagccaaatcattataaggaacggtgatggtatgggtggctacgacttcaggtacacccggactatcgggcaaacctaatgtcgcaaccccagagcctgctttaatcagcaagctgtccgcatgaccgtgatatgatccctcaaatttaagaattttactacggctcgtaaatccgcgtgcgagtcgaatcgcactcatagtcgcctcagttccggagttaaccatacgtacaatgtccatagaaggaacacgctcacatacgagcttggccatttcggtttctgccaacgttggtgcgccgaagctggttccttttacaacagcagcctgtaaagctttaaccacttcgggatgtgcatggcccataataagcggtccccatgaacatacatagtctaaataggattgaccatcaatatcatatacacgcgatccttcgccatggtcaatatatacaggtgtaatcccaacagatttaaaagcccgtaccgggctgttaacgccacccggaatgtattgttttgcctcatcaaaggctactttggagttcgtatccttgcgcactttccgttgttcgtcgatcaatctgaccactcctatcttctaaaaatagacttattgcttcaaccatcttgccgcatccttggccgaataggtaataatcatatctgcacccgcacgcttcatgcttgtcaaaatctccagcaccattgctttttcatcaatccagccttggagagcggctgccttgaccatggcatattcaccactaacgttgtaagccaccataggcagatcaaattgatccttaatcgtgcgcatcacgtccaggtaagaaagagaaggcttcaccatcagcatatccgcaccctccagcacatcagactccgcttctcgcaatgcttcacgtgcattggcagggtccatctgataggatttgcggtcaccaaactgcggcgcagagtctgcggcttcccggaaaggaccataaaaagcagacgcatatttgacggaatacgacataatcggaatatgtgaaaagccttccagatccagcccctgccgaatcgcctgtacaaaaccgtccatcatattagatggcgcgataatatccgcaccagctctggcctgagaaacggctgtacgtaccagcacctctagagattcatcattcaatacttcaccgcatatctcaccatcgtgctcatgcatgtgtaccataccgcagtgtccatggtccgtaaactcacacaaacaagtgtcagccacaaccagcagttcgggataacgcgacttgatcaaacgagtagcttcctgaacaataccatcgtccacaaaagccgaagtccctacactgtcttttgtttccggtatgccaaacaggagcacggcgggaatgccaagctcactaatctctttcagttcttcctccagccgatccagagaaaaacggtatacacctggcatagagctaatttcctgtttcaccccagtgccaaatgttacgtagatcggttggataaaatcagcgggattcaataccgtctcacgcaccatgctgcggattgcagccgactggcgcaaacgacgatgtctagtaaaaggaacactcatgaatacaaacctccattttttatacattcattagcaaaaacaaaaaattataatgtcataagagtacttgatcgtttccagtcacataacgattggatcagactttcaatggttgccttctctgacataaaactcacagtcaaaccggcttgggtagctgtctcaccggtcaaaggacctatcacagcaatcgtaactccctccagcagcgacaacggatcatggattcccatttgtctgagcgcttccagaaaaaaggtgacggttgaggaactcgtaaacgtaatcgcgtgaatggctcgttcctcaagcagcttgaggagctcgtcatcctgtgtgttggctgccagcacagtttgatacaaatcagcctcggtcacatgaagccccatctccctcagcttttctggcagccaaggccgagctagatcacctctaggtagaaatacattctgccctgcctgcaaatcctgctcaaacccttcgagcaagccttctgcctgaaaagggccttcgatctgttctgccacaattccatgtgtccgaagcgcagctgctgtagctggtccgactgcggcaatacgagctttgaacagcatgcgtacgtccttgccctgttcctttaagtgcgtgaaaaagtattcaactccattaacgctggtgaaaaacacccaatcatattcaggtagtcgcgcaaatgcctctttaatttcctgtttggttggctcgtccgagggggcgaccgtctgaataactggaaattcatatggctcgccaccaagctcctcaatccggcgaaccagactgctggcctgcgcgcgcgcgcgagtaaccaaaatccgtttgccaaacaaaggcatgtcctcagcccattttaactgttcacgttgattgaccacttctccgacaacgatgacggcgggaggttgaaaattcgcggccttcaccttagcttcaatatccgccagcgtacccaccagcgtatcctgctcggcgcgggtcccccaacggatcaaggcaacaggagtatttgacggcttgccgtgttttatcagctgttcactgatatagccgatcttggctacacccatcataaagatcagtgtgcccgttgcgttcgtcactttatcccaatgaatacttttgtcgagtttatcgggactttcatgacctgtaatgatagacagcgatgaggccatatcccggtgtgtgactggaatgcccgcataggcgggcacactgattgctgatgtgatgccgggtataatttcataggaaataccatgtttacgcagtagcccggcttcctcgccgactcgtccaaatatagtggggtctccccctttaagacgaacaactgtttttccttccaaggccaaatccaccagcagctgattaatttcctcttgcttcatggtgtgacgatctggcaacttgccgacatagattttttgggcacctggcttcatcaatcccaagaggcgcgggcttgccagtctgtcgtacacaatgacatcgcccaattgaatgcattcccaacccttgaccgtaattaatcttgcgtctccaggtcctgcacctaccaaatatacttttcctgccatgctatcatcccctcacctgcgccagaatctgttccgctcctttggctatcaaactggccgccaccgcttctcccagcttttgcggatcatttccctggagcgtttccttcaaaataacctcgccatctggcgagcctaccatgcccgtgaggctgatttcttgatcagcccagaccgcatgagccccaatcggcacttggcaccccccatttaacacgcctagaaaggttcgttctgccgcaacggtagccgaggtatctcggtcgttgtaaaggcgcagcaaggccaatagctcttcatcgctcgcacgacattcaatacctagcgctccctgcccaaccgccggcaaacagtcttcttccggtatataggacgtaattcgctctttccagcccatccgatgcaagcctgctgccgccaaaatgatagcgtcaaaaccttccgtctccagctttttcagacgggaatcaatattaccccgcacaggctccaattgtagatcaggtcgcatggacttgatttgactggctctgcgcaggctgctcgtgcccacctttgccccttgaggcaaatcctccaggctcttggcgcccaatgtgatcaggcaatcacgtgggtcctcacggcgcggcacagcgccgttgacaagcccttccggcaattcggaaggcatatccttcatactatgtactgccatatcaatctcaccagccagcatggcctgttcaatttctttgacaaaaagccctttgccacccactttggacaaggttacatccaatattcgatcacccttggtcaggattttcttcacgacaaattgcaaatccattccatgcttcgcgcacagcgcgttcaaatcttcaatgacatgcccggtctgagttaacgccaacgcactctgtctgctgcctaccacaattgttcgcatgttattcctcctgattttgcgcaatccataggtctatttctttttcggtccaagccataaattcatgacgccgtatttgatccaaaatcccgctactcgccaggcgcctcagtagtttggtcctttgctgtggggaacttatcttacgtttgatgatctgtcgcatatcgtgcatgaaatccagatatggctcgtattcgctaccaaacaacgtattcaaagctgatgtaatatcagtggttacagcagggccagccccttctgtggaaatactaatcgtcagtcttcctcgtcgaatggtacccggcgttataaagtctccctcttccgatcgatccgccacatttaccagtatacccctttgtctggcctcatgcgcaacctcataattcacttctctctggttcgtcgccgcatatacaagaaaggctccctggaggtcaccctcgcgatatacgcgatttacccagtggagctgcttgtgatccgccagaacctgtaaatccggcgttatattcgggctaatgacggtaatgaatgccccactttccatcatcccctttacctttcgttccgcaatcctaccgccacctacaacacaacagatcttattcttacaattcaacgaaatcgggacaaaatgctgcaaaaggcttttcactctcccgtccactgatgaaatacagaccaggaattcagcaaaaaattaagaatcaatagcgtgtagcccaccaatgcccactttgccattacaagccctgaacgctgattcaatcttttgctcactaaaaatataatatacacgcacaaggcaatcgctgtcatcagcaccttggtatctagcaagagacgccagcgttcctcggcaataatagaaataacggcaactacaatagagacccccaacaaaggagtaccaatcaacagcgccatatgcgtataccggtccatcatttccagactcggcaggcgtctgatcgtgtcattccatttctttactttcaatttacgatgcaaaaacagatataaccccgaaaatacagctgctaccgtcattgctacaaaaccaagattagccagcgcaatatgaatcaggagcagaccatgcacggtatgccaatttccaagcgggttgtcgagaggctccatccatatattgttgagcactagcactgcaaaactaataatatcaagcaacaataccgcaaattcggatcgctgataacgtgtcagaatcaaagaaatcagtaccaaaataactgagaacagaaatagaaaatcgtaggtcacgaaaatagggagatgcccttcattccaggttcttatccccatataagcaagctggagcaccagaacgacaacaagaagccctgtacctgtccgtttagcattcgcattgcgacgaatcccatccgagaatacaaacagaaggctcagggcaaaaacataaatcattgaatcatatataagcatgcctgaagccacttctgttcacccacctttacaggctggccggcgcaaacgacgctggcaaagcctgagcctgaacggttttttcatgaacaccggcttccggtttcattaacgcagatgcatcgcttttatctactttctgagcggcgtcatccaaacgatcctccaaagcaaaaatatggctaaacatgtctagggcctcattcccctgcttttgaacagccagttcttttacccgattgatcggatcatgcatcatctgattcagcatacttttcgtcaagcggctaatcactttgcgttgccgttcatccagctcaggaagcttattgaacaagctttccaacgtatcctgatgtacagactccgctttttcctgtaatgcacgaatcaccggacgcactcccatcgttttcaaccattgataaaactcgctaagctcatcttcgatcatatgctcgatttttgtagcttcggtacggcgcatttccaaattgctctccacgatcccttccagatcatcaatatcgtacaggaaaacattctgtaattcaccaatagccgggtcgagatcacgcggaaccgcaatatcaatcataaacaaaggacgggactgtcgacgtttcatacttgcttcaacccgagtccgatccagaatataaccctgggcacctgtcgaactaatgacaatatccacatccgccaaccgattcatgccttcctccatcgtaaccggcgttccatggaacttggaggcaaggtcttccgcacgggacagggttcggtttgctacaataacctcagctgctccaccgctgtacaaatgcttaacagtaagctcgctcattttaccagcaccgagaatcagtacctttttatcggtaaacatcccgaaaatccgtttgcccagctcaactgctgcatagctgacagatacggcactttctccaatagacgtctccgaatgggcacgcttgcccaatgtgacggcctgcttaaacaacatattaaaccacgttgccgtaattttctgggattgagcctgaagaaaagcgttctttacctgccccaaaatttgtgtttctccgattaccatagaatcaaggccacaagtcacacggaacaaatgccgaatcgcctgctcgtcctcatatatatataaatgttgtgtaaattgatcacgcggaatgccaaaccattgctccataaaactgcgtataaaataaccgcacatgtgaaggcggtcgaccacaacatatatttcagtccgattgcaggttgcgacaactacgccctccaacacacttttggtaagtttgagttgttccagcgcttttggcaaatcttcttctgcaaatgtaaaacgctctctgacttccacaggcgccgtacgataattcaacccaacaacgacgatgtgcattgcaaattcacctgcctaaactgtaataagaataaccactgttatcataaactatgttaattatatcacagaagtccgaatctccttcggctgttttatgaattgtttatgaaaattggatggcgttcatgaacatctagcacgttctgtatgatttgatttagtgtaaaccacttttaaaacaaataaccatggaaatgttccatggttataatataggacgcacaaagggctccataaaagaacgatttacaccaactcagccaacttgcactccggtgattccacctgaagttctcccaagccgcgaatcagcttcttcgcatatgtttttttcggttttagaacggataccaggtaatcaatagccagctgcggatcgacagtctcaccgcaagtataacaatcaatagcggcaaatcctctctcaggatacgtatgaatagagagatgactctccgacaacagtacaagcacggtagctccctgtggttcgaattgcttggattgaacggacatcaccgttgctccgcaagcttcagctgcttcaactaattgagcctccaaaaactgcgcatcattcagtaattcaaactcaacaccccaagtatctacggcaacgtgtcttccgaaagttgagtactccaattccatctttcggttcccccttcctaggaataaaatgtttgaaaaaatttcatccgctaggacctacgtcattcacttcccgagggaataacctctcgcaacattcaatgtcctgagtgaatcctggttcctatattcattttcaacgagattaaaaataacatctatgtgcagcaaatgcaatcatttttttggaataaaaaagcccctttcggtaaagaaagggactacactgcataacgattcactccatgtattcatgccttattaagcttccagtgcaaataatttcgagcaactcattcgaagcttgtggtcaatctgctccagctccgagaaagtacgcgccaaattccgctggtcaagcaacgaattaatgagatgatatacgtctgatatttcattttcgacgttctgatgctgaaaaagctgttgcagttcctgaaccgtatttttatattcaaataccagcctggagcctgcggcattcttctccataattttacgaaccgtaccttcattataaaaatacaccatagtgaatcctcgatacattcggtaaacgatgccttcgcccttaaaacgaacaaaaagtttgcgtataaacaaggttaattgcggatgaattaagcggcaagtcaattcacacacaaacgctccctcttgggcctcaaaaaacaaatgaacttcctcacccgcactatgctccagaacgatttcctgtcttccgttatctagaactttaatatagtaatgcacctgggaatcattcactgccctcaaaaattcgtccatttgagtttccgacaaggtcaaagtggttttaacatactctgtggctaaccgctgagccataccaatctcctcaattctttcctgaacctataagtttaagctttatgctttattatacatcagacctacaacgcttttcttgcacatcaaatcataaatttccgccatacatcggaaataaacagaaaatgatggggttgagactgcattatccctcatatactcactttttaaattccatcagttcctttagttattatatattattcccaccattttagtgagtttaattttttaaagcccgaatcatgaaaaaaggacgcccttaaggacgtccctcatcttacttacaattccgtctgctcttcgtcgtcattctctatatagctggagatgacagaccacagctcttccttgcccataccttcttcggatgaaaaggggataaacaatcccccgggaagtattcctagttcctgcttgattaccttataatgcttttctcgccgcgttttagggattttatctgccttagtgcctacaacgcagactggaagcccgtgatggcgcagccaatcgtgcatcatgatatcgtccttggacggcggatgacgcaaatctaccatttgaagcaccagcttaagtggctcacgctctagcaaataagactcaatcatctgcccccaagccttgcgggacgttttggataccttggcataaccataaccgggaaaatcgacaaaatagaggtcatcattaatccggtaataattgagttgctgggttttacctggcgtagaactggtacgcgccaaatttttacggttaatcaaccgattaatcagtgaagactttcctacattggagcgccccgccagagcaatctctggcaaagcgtccacaggaaactgatcggggccaaccgcacttattataaattctgcttttgttactttcattgtgttcttaattcctctctaatgtacccttgcctgctcaaccaaagcatgctttagcacctgatccatatgggcaacggggacaaattcaacatcctgccggatactgtcgggaatatccttcaaatcccgttcattatctttgggaagcagaatttttttgtagcctgcccgatgggcagccagcgacttctctttcaaaccaccaatcggcaatactcggccgcgcaaagtaatttcgcccgtcatagctacatccttggatacatgacggttggtcaaagctgaaattaatgcggtagcaatagtaattcccgcagatgggccatccttcggaatcgcaccctcaggaatatgaatgtggatatcatttttctcataaaagtccagttcaatgcccagatcaactgctttggaacgagtgtagctgaatgccgcctgggcagattccttcataacgtctcccagtttacccgtaagaatcagtttaccattaccaggtacgaccgtcacttcaatcatcagtgtttcaccaccgacctctgtccatgccaagcctgtaaccgtaccgatctgatcctccagttctgcaacaccgtaacggaatttagcgatacccaaataatccttcagattatccggtgtgatttgaatcggcccttcgccaccagatacaacggacttcgctgccttgcggcacagagaagccatttgctgttctagattccgcacaccggattcacgggtatattcacgaatgacacgcaggagcgtatcctccccgatgaccaactgttcctcgttcaagccatgctctctcttctgcttgggcaataggtaccggttggcgatttccagcttctccagttcggtgtagcctggaatatagagtgtctccatacggtccattagcggacgcgggatgttgtgtgcagcattggctgtcgttacaaacatcacattggacagatcaaacggcagctcgacaaaatggtcactgaacgtattgttttgttcaggatcaagcacttcgagcaatgctgccgatggatccccccgaaaatcggaagccattttatcaatctcatccagcaaaaataccggattagacgttcctgcggtcttcatcccttgaatgatccgccccggcatcgcgccaacataagtccggcgatgaccacggatttccgcttcatcccgcacacctccgagagaaatgcggacaaattcccgacccatggatttggcaatcgaacgggccaacgaggtcttgccaacccctggcgggcctacgagacacagaatcggtcccttaatggtcttcaccagcttgcgcacagccaaatactccaatacacgttccttgggtttatcgagtccgtagtggtcgttattgagtacctcttcagctttgacgatatccagatcatcatcggtaaacttgttccacggcaagcttaacaaccaatcaacataattacggatgacgccaccctcggcagaacttgccggcattttttccagacgatcgatttccttttcgaccttctccttcaccggagcaggtagctccagttcacttagctggttgcgcagttcttcaacttctcctgcgcggccttccttctcgccaagttccttttgaatcgccttcatttgttcacgcagataatactccttctgcgtcttctccatttgcttcttcacacgctggttgattttacgttccagctccagtacttcacgctcattgttcaaaatatccagaagcttctccagacgctgagtaacgtcgatcgtctccagtatatcctgcttttccttaattttgagcgtaagatgacttgtgatcacgtctgcaagccgtcccggctcctcaatatcggataccgcagcgagagtctccggtgttacctttttggacaagttgatataatgctcgaactgagttaatacagtacgcataagcgcatccgtctcaggctgtacgttttctgcctcgtgcagctccttcgccattacctcgtaatattcttcattgtccgtatattgaataatctcggcgcgttccagcccttccaccaatactcgaatagttccattaggaagcttgagcatctggcgcaccttggctaccgtgccgactcgaaagatgtcctcttgtgtaggttcttcaatatttacttctgattgagaacacaggagaatcaaattgtcttcaaccatcgctttttccaaagccttgaccgatttttcccggcccacatcgagatgcagaaccatgctcgggtagaccagaagtcctcttaaaggcagcaaaggaaaacgacgaccttttgtcttggtgggtcccatcgctttcgcacctccagtgattctcaggttccggattttacaatcctcacgttgttatctttcatattttatcaaatgttttatgaaaaaaccaatgaaagggtggttcatcagcaagatcctgtatctgatatcgtcccgctatgcgttccatcagcctgtaacaaggaagattgggatgggcgaaaagtctcaattggcgcatgcacaggcaaatctgacgtcatctcttccccaaacacatgtcggaacacttcggtaactgactgtacaggaatgacttttaaaccctcaataccgtcaaaaagagcttgccagttgtcctgcggaatgatcacctttttggctccagcctgaaaagcggcttcaaccttggctaatacaccaccaatcggtttgacacgaccatggatgctaacttcgccagtcatagcaatctcatgatccaccggaattccccgcatcgcggaagcaatggctgttgccatcgcaattcctgcggacgggccatctaccggcgtacccccagggaaattgatatgcaaatcgtaattcgatggagacaatccgagcgtacgcaaaacggttaaaacattttccacagaacctttagccatgctcttacggcgcagcgtgcgggacccacctccaatttcttcctcatccacgacccccgtaatattataaattccctttccctcaggaaccggaactgctgtaacttcaatttccagcagcatccccatgttcgggccatatacagctaatccgttaacgaatccgatttgcggcaagcccggtatttttcggtcaggacgtggttgaatttgactgctgcccgctacccattccacgtcggaagcattgagacgctcccttttctcggtaagtgccaaaccagcagccagctggatcatattgaccgcttcccgaccgtttgttgcgtaacgctgtacaacttctaccgcctcagggcaagggccaaagcctagcttgtggacagcatcctctgcaatacgagcaatctcttgtggctgcaaggcacggaaataaatctccatgcaccgggagcgaatcgcaggtggcagttcatgcggcgaacgggtcgtcgcacctaccaaacgaaaatcggctggcaaaccgttttgaaaaatatcgtggatataagcaggagtgttcgaatcttccgagttgtaatacgcactctccaaaaataccttgcgatcctccagtactttcaacagtttattcatctgcgttggatgcagctcaccaatctcatcaatgaacagcatacccccatgcgccttcgtcacagctccgggcttaggctgcgggattcccgccacccccatcgctcctgccccttgatagattggatcatgcactgaacctatcagtgggtccgcaataccgcgctcgtcaaagcgggccgtcgtagcatcaatctccgtgaatttggcatctcccttgaacggggaggacagattcttcttagcctcttccagcaccacgcgtgcagcagccgtcttccctacacctggcgggccataaataatgacatgctgcggattcgcactacataacgctgccttgagtgcgcgcaatccgtccttctgacccacgatatcctgtaatgtggcaggacgtgtgcgttcagccaacggcttagtaagtgaaatagagcgcaatttgcgcagcttatccaattccttgcgggattcccgatccaccgcactacggttcgttttctggttccgcaggaggttccagaaatacagaccaattacaatcccgaaaaacatttgcaccaataacaaaatcatagtcaagtccatcgtatttcctccgtttctcatctcagcaatttgaaaaatgccgctctatgaaaaacagtatttccttttccgcgatagctaaacggcggtctttcaaaagatcagagagaaatataaaaacgccgtgaagaacagttctgtagcagagctgctctccacggcgtttaaatgatgacaatagattatgactatgcctctttatataactgctttgcctacaccttctcggcggtatgacgttcttcacgtccagggattttccctgtttcctcataagccttgacgatgatatcaatttcttttttcaattcgtcgaccatatcagcctcaggtactttacgaatcatttttccataacggaacaaaaggccttcaccgcgtgccccagcaattccgatatcagcttccttcgcttcacccgggccatttactgcacaacccagtactgatactttaatcggcaccttgagtttcgcaatgtagtcctccacctcgttggcaatagagaacagatctatatccagacgtccgcacgtcggacaagaaatcagtgtagctgcgtttgtgatcaatccaaacgtcttgagcaactcacgtgctaccttcacttcttccaccggatcggcactgagcgaaatacgcattgtagagccgatgcctgaggccagcaaagcacccatacctgccgcgcttttaaccgtaccagtaaagagcgtacccgcttcggtaatacccagatggagcgggtacttaataatttcagcggccttcgtataagctgcaatcgccataggaacgtcagacgctttcagtgacacaataatgtcatggaaatcaagttcttccagtatcccgatatgatacagtgcgctttctaccatcgcttctggcgtagggtagccatacttatccagtaaatgctgttccagtgacccggcgttcacaccaatccgaatcggaatccctttttccttacatgccttcacgacagcttccactttttcacgtcgtccaatgttacctggattaatgcgaaccttatcaattccattttcaattgccagtagagccagcttgtgattaaagtgaatatctgcaaccaacggaatatgaatccgtttttttatttccttaatggctgcggcagcttcctcattgttgacggtaacccgcaccagttgacatccagcttcttccaagcgaagaatctcggctacagtcgcttccacatctgctgttttggttgtacacatactttggatgatgacttcattgctgccgccaatcgtcagattcccgactttaacgggacgtgtgtcttgtcttaagaacatgtacttttctctcccattaacgccaaacctccaccccttaaaacctcatacaggtttagtgaagtggagatccggcttctcatgttttagagatcgcgaagtatcaatccttaggcgctctcttcttgttttttatccttatctgtaccaccgagttccggtgcgattttgtcttttacaacctgctcattgatgacgcaagttgtcacatcctcacgggaaggaacctcatacattacgtccagcataataccttcgatgatcgcgcgaagaccacgggcacccgtgttacgcttgatcgcttcgcgagcaatagcttccagagcatcttgcttaaactccagttgcacattatccagttcaagcagcttctggtattgcttggttaacgcatttttcggttcggacagaatacgaaccaatgtgttctcatcaagcggctccagcgtagaaattactggcaagcgtcctacaaattccggaatcagaccgaatttcaaaagatcctcaggcaataccattgaagtatattcgcctggtttcagatctttttgttcgctagtagcgttgaagccgataacctttttaccgatacggcgtttgatcatttgctccagaccatcaaaggcaccaccgcaaatgaacaggatattcgtggtgtcaatttgaatgaactcttgatgtggatgcttgcgaccgccttgcggaggtacagaagcaactgtgccttccaaaatcttaagcaacgcctgctgtacaccttcacccgatacgtcacgcgtaatggacgggttttcggatttgcgggctactttatcaatttcgtcaatgtagataatgccgcgttcggctttttccacatcataatcggcagcttgaatcagtttcaacaaaatattttcaacgtcttcacccacataacctgcttccgtaagggaagtggcatctgcgatagcaaaaggaacgttcaaaattttagccatggtttgcgcaagcaacgttttacccgaacctgtaggtccaagcatcaaaatgttacttttttgcagttccacatcatcaattttattttgagtattaatacgtttgtagtgattatataccgctacagacaacgattttttcgcttgatcctgaccaatgacatattggtccagaatgtcacggatttgcattggtttcggaatgtctttcagatctacttcttcttcatgacccaattcctcttctacaatctccgtgcacaactcaatgcattcgtcacatatatatacgcccggtccagcaacaagcttgcgaacctgatcctgagatttaccgcagaaagaacatttcaattgtcctttttcatcattaaatttaaacatagagccacccctttacagattaatcggtttagacagcacctggtcaatgataccgtatgcttttgcctcttccgcttccatgaagaaatcccggtcagtatcacgttcgattttttcgaggggctgacccgtacgctctacatagatttgattcagcttagcacgtgttttgataatccagtccgcatgaatcagcatatcggaggcttgcccttgaatgccgccgagcggctgatggatcatgacttcactgttggtaagcgcgtatctcttgcctggcgcacccgctgtgagcagcaacgaacccatacttgcagccatgcctacacagatcgtcgatacgtccggcttaatgaattgcattgtatcatatatacccatgcccgcagttacagaaccgcctggcgagttaatgtacaaattaatatccttctctggatcttccgcagaaaggaacaataactgtgcaatgacgagattggcgacatcgtcatcaatcgggccacttaggaaaataatacgatccttaagcaaccgcgagtaaatatcgtaagatcgttctcctcgattcgtttgttccacaaccatagggacgagactcatcacgaccaacctcttttctttattaaaatgaacacctgtattcatccgcttccttatgtcccattaaaacggaagcagcaagcatgaaacgtgaacaccttacaaaatattttaacatgttcagagtctcgtgtcatatttgcatgcgctcatatatgcagtgcgggctgtttacagtacactctgccgagaccttctcatatttaaccatgtttcgtatgtatgtgcaaatatacggtagtgacttatgtaaaacaaaaaaacacgactcacagcactttccataaacgactaaaatttgggttaccaaaggtaaaaataaggcacgtaactttcactacgtgccttatccctatctaattgctacgttgcagcttgttacagcatactccgtatattttatcgtctgaattattcagcagcttcaactggcgcttctacttctttgctgttttccaccaacaaagcaatcgttttgcgcagtgaaatttcttctttcaggttagcgaacgagccgttaccttccagaatgctgcggatttcctcaactgaacgtttgtaagcttcagccatgtttttcagttcttcatcaatttccgcttcggaaacttcgatgttttctgctttagccacttgctccagcacgaggttgttacgtacgcgcttctcagcatcagctttcatttgctcttccaggtcttccttgctttgaccagagaatccgaggaacatttcaaggttcataccttggctacgcaaacggttgtcgaaatcgcgaaccatgttttgcacttcgctcttcaccattgcttcaggaatgtcgattgttgcattctcagcaactttctccactacagcaccctcgcgggctgctttagcttcgttttccttacgatccaacaattgctttttcaagtcttccttgaattcagccagtgtgtcaaattcgcttacatctttagcaaattcatcgtccagttcaggaagaactttgcgtttcagttcgtgaactttcactttgaataccgcttgtttgccagcgaggtcagcagaatggtagttctcagggaacgttacttcaacgtccttggaatcgccagtgtgcaaaccaaccacttgctcttcaaaaccagggataaatgtgttagagcccagttccaaagaatacttctcagcttgtccgccttcgaatggtacaccatccacggaaccgtcgaagtcaataatagctgtatcaccggattgagcagcatcttcatcaacgacaaccaattcagcatgacgttgttgcaggcgctccaattcttgagccagttcttcgtcgcttacttcgagtttgcttacaggcacttctacgcctttgtaatcgcccaaagtcacttcaggtttaacagtaacctttgctttgaatttgaaagattcgcctttagcaaattggtcaatttcaacgtcagggctgtcaaccgggaaaatgtctgtttgctctacagcttggctgtaagcttctggcaacaggatgtcaattgcatcctggtacagactttcaataccatagcgtttttcaaagataggacgtggtactttacctttacggaatcctggtacacttacttgttttgccactttattaaaagctttgtcgagtgcagcggctacacgatccgcgtcaacctcaacttcaagaaccccaaggttcttctctattttctcccaagttgctttcattttatgctttcccctccaacaaaatcttcacttagttttcattacaatcaacgcacacaaaataaccactatagtatatctaacattactgtctttttcaagagcagccctttgaatgcttcacaggtaaacgtttccggtcattaaggagtgttcattcccgccgctacgaatagtcgcatcgaccgatacgcctgctcaaaacggaagcgcagcgcatctgtaatgccatatatagcccgggtttcttcctcattattatttccgttcaaactttccgaaaccgtctgatggagtgctgcagcccaaatatccggcatcccgtcctcttccaccaacattgatctataatctttcgtaccgtatactgccatcacaaactgtgaccacagctcctgtgcgaaatagaatagtgtaggctcgtgcacctcagtctgatcggccacccgttccaaaatacgcataatcgactctggaaaatcacctggctgtaacggaaccgtttcaatgtcgatttccgcttgttcatcaccccgtctgatttctatcgtcccttccattccgcgtcgtcgcattgtctgtagaacacggaattgaagtaaaggatggatttcccgttccgtaatccagcgaagcaaggcatcgtcgatttctggcagttccagataggacaactgctccaacgctaaaatcgtctgttcggataagggttcatccatagccatccgcaacagcttgttgccgtagcctgcatcctgctcctgcttaaagcgtgcatgacggcgagctaactctacttcactgacctcttcttccacagcgtccgttaccgccccgctgtcagcgtactgtggaaatgcagcttccagccattgtaatagagcgttccattcatcgtattgcttctgctcctgtccctgacactgcattaaaaaacgcagcatcgccatcgcctctccgtaacgttcgttttcaagcatcacagtaagttgaatttgataatagtccagtgtcttcggaaacaatacaatattattttcttttgtcgtcaccttggagtcctttattcaaggcaccccctctccttcgcaagctcaagtatttgtagattatatgagaaacagtagccgaagtccaaccactcgtcttacacatattcacctgtattctaacatacccttttataaggcaaaaaaaactacgtctactcagaatttatgctgtataaagcctaaataagcgatatatgcaaaataagacttgaatttcttttatccatatgatatattaatattcgcttgaattttatgtcccagtagctcagctggatagagcaacggccttctaagccgtcggtcgggggttcgaatccctcctgggacgtcataacaagaagcttccataatggaggctttttttgttctcatgagataaaccacgggggaacgtcgggtcatcgctatcgttagcctatacttcgcagccgaccataggaagagtatctctcttgataaattacaccaaaaatagcttccgcaagggagctttttttcattataaataatgtagaaagattagtctgcccaacgctactttaggcgctggtttcaagtctctactctttcaaaaaaacgcagaaattgctatcatctatcatgttgcaccatttcaggaccattttgatgaaaaacctttgaagtccagttagaagatatttataagcttatgtcaacaaaggacacacaaatcacatcgcttgaccgcgtgaattagcaaggagattaacaaatgaaattaatatcttggaatgtaaacggcttaagagcctgtgtgaccaaagggttttatacttatctaaaagaaacaaatgccgatattttttgcgtacaggaaacgaagcttcaagaaggccaaatcctcatggagaacatggaggaatacacacaatactggaattacgctgagaaaaaaggatattccggcacggctattttcaccaaaatcaagccgctctctgtgcattatggacttgaggaaaacgaagaaccagagggccgaaccataactctggaattcgaaaaattttatctcgtcaatgtgtacacaccgaataccaaacgggacttatcccgactgccctacagactggaatgggaagaccgttttcgcagctacctgcaacaactggatgctttgaagcctgtcatcgtttgtggagacttgaacgtagctcatcaggagatcgacctcaaaaatgccaaggctaactacggaaatgccggattcacgcctgaggaacgggaacgcatgtcacagctgctagacgccggatttatagataccttcagatccttttatcctgaccggacggatgtttattcctggtggtcctacatgccaaaggtgagagaaaggaatatcggctggcggattgattactttctcgtctcggagagacttcgtccgcttttgatggatgcgagcattgattgtcatattacaggcagtgaccactgccctgtgatattggatttgcaagatatttcagcataggccccccctgtcctgacacaaggatttatgaaaccttaaaaagccgttatgctctgctatggcagcatgacggctttaattcatggagctatgtccccaaatatacctcgatacgggaaatcaaccgactctcacatcttgcgcttctttttgatctaatacagcctggcatatcgtcttcttttcgccactgacgtaatgcagtacatattgggtcactctgcattccgttgcataagtatccttacgatccgtattaaaataagtcacctggcaacttgggcttcagcctcaaggatagttccctatgatcatagccaaacggctgccccgccagactttcattcaccttatacatacccagcttcctgtcgtaaagcccgctctgcctgatttgccgatatagctcctgcccatttacaatgtcgccaaccactttcatagcccgggtcggtccctctagaaaatatggggtatccttacgttcgaaggaatgtatgtttacgagcttgcccccgcagtcatcctcctgtacctcgaattctctggcttcataataaaagaaagttggatatatcccctcaccgataagcagagccttatccatcccctgttggagtttacgttcagcttggcccaaaaacaccagtacatcttcaaacgctaatggtgtttctgccccttcaatccaaaacgaaccgtttcgcgatacgcttctctagcatccgaaatccgtgaccagaagctgtaatccttgctttcatccctgcaatcagcctcatcagaatcgtggtagtattcctccattgcgagcctcagctgttggatcaacttagcaacttctcgcggcagccgtagcacagaattacccgaaagcttcacctgtgcatgtattaaacatcttacaagtcgctgtaattcacacagttcactgaatccagaagcaaacagccccggaagtccgttcatggaatcattccatcccggcttgcccggctccatctcaattcccaagccctctgggtccagcgtggacagcttgatggctactaatgacagcagcttttcatataaatttgacttataaatctctccgcttccatgtttggttcgaacccaatgaacatcgcgatcccgggcgtgcagctgagcttctttctccttgctctctacgatcgccccgtactgacggatacgtccgtccttcatctgcacgtatttgtttcgacgtggctgtatccatgccggactgtcgtaatacatgtactctcgggtcgcgagcaagagttcctcttgtttgtctggatagatacttagataactttcgattagatccatgttatatgtccaatggtcgatccagaaaccttcaccaaaatcagcctcatagcattgttcggaatgcttgagagcttcggttacaaacgtctcaaccgtttgctttagcgcgatgttgtcatgaatgatatgtttagctcacccggggtgaacgacaattggaaaaaagcacgcaaagacgaatgatctgccacctccacctatcccagcaacggttccagatccccatgcttgcgtgaaaatacatgatatacaaacggttgctcagtgccgttgtccagcagcaatggataaccaccacgtaacaggttatccagatagttctgacggcagtattcgtcaaataacggaatggatgtccgcgttgccatttcatccgtcaactcttcgatcaacgctttggcttcctccggcttccgctcgatataaggcatggttgcgatttccgtaatccgttcattgatagagtgaatatcattcacatgcccgatgatcgtacagtgattgacggcagtatctgctgccagtcgtgctgtgtagccgctaaacccacaaggcactttattcgtcgtcacaggctgctgtgaaaccaagtcttcgacgccttttctatttaaaacccgttattagccatcacttgcttgaaccacagcgcactttgtttgggtgtccgttcctgcgtgtcgtaattgatgtgtataataccaaaacgtttgctgtatccccaggcccattcaaagttatcgaggaatgaccagacaaaatagcccttaagctgacctccctccccaataaagcgatggcatgcctttaaatgttcctcaatgtaatactgacgtccaatgtcctcaatctttccattcaccagttcgtccttcatcgctgctccgttttccgtaatcaggatgggtaatcccttggaaaaatccttctcaatccgcgttagcagcttataaaaggattcagggtgaatctcccatcccatatccgttaccggttcctctatggaaacctgctcgacctgaagcaacgaagcgtctgtagtcgctcgaatgatactgcgggcgtagtagttgatgcccaaaaaatcccctggctgctgaatcagctccatatcaccaggctgtacaaaatccaatccattcaagtgcgccccgtaccattccaccatatcctcagggtatttcccgttaaacaatggttcggcaaaccatcgattaataaaaccatcccgccggacagcagcggctacatcttcggggtgttcagaggctgcatcgacatgctccatgttcagcgtaataccgatgttgcccgtcaggcccttttccttgtgtaagttcatggctatcccgtgacacatcagaatatgatgagcggcagtaaaggcttccctccagttctcatggccgggggcatgctctcctgtgccatagcccaaaatagaggcgcagtagggctcatttatcgtattccaccagcttatacgctgtccaaatcgatccatgattacagaagcatacgttttaaaatgttggataatctctcgctgcgtccaaccgccttcgtcctcaatccactgcggtagatcccaatgatacagcgtcagcattggaattagcccggccgactcaatctcatccagcagacgctcatagaagagcaacccctgttcgttaaccacgccgggtgcgggaataatgcgcggccaggccacggaaaaacggtaatgtaaaaagccaagtcgcttcattaattgcacgtcttccttaaagcggtgaaaatggtcacaagccacatctccgcagtcccctcctatcacctttccaggtgctcgacagaaagtatcccaaatagaaggcgctcttccttcctcatccacgccaccttcaatttgataagaagaggtcgaagttccccacataaacgtggtggggaatgtataggtattctcactcatactcggtatcatcctttcaggaatcaagacttcacagctccggccattgcaccgccgacaataaagtgctggaggaaaatatacaaaataacgagcggtagtgtaacaatcagaatgccgcaagcgagcagcggccagttgttcatgtattgtccgtagaaagagaacaatcccttggtcactggctgataagcaggatcagacaaataaatagtaggacctataatgtcattccacgcccctatagctgtcaaaataatgcctgttgccaacaccggcttcatcagcgggacaagaattgtaaacaaatatcatgaatatccgcacccgtccatggcagccgcttcatccagctctcgggagacagacttgatataccccacaaacatcagaaaagcgatgccggtacctgttgttttcagcaaaataaaaccaagctgggtattgtaaagtcccaggctattaatgagagcaaattgcggaatcagcgaattctggagatacatggatatcaggaaaagcactttttcagcattgcaaaattccccctgtactcttagaataaatgcatttacttttacgaaagcggtttagttaattgcagctactattatgtatcggatagcctgtatttgtaaatagagaattgtaaattatcaaataaaatataaaccaccgttattactccttaaaaggcaacatcctttattcacactgttgactcacttctatgaggtagcatagaatacgagtaatcattaagtttgaaataaaagtcaatttaactaaatcagtttagttacggaggattccatgaatataaaaacaatagctagcatggcaggcgtttcagtggcaacggtttcgaaaatcattaacaattacacagacatcagtggggaaacccggcagcgggtacttaaaatcatggaggaaacaggctatagaccgtcctcctcggccaaaacgcttgctaccaaaaaatctaatctggtaggcgttatatttgctggcaagctgaatgttgattttagtcatcctttttttgttgatatcattaatgtcttcaaaaaacagattggcttgctcggttacgatctgctatttttctcaaatgagaaatttctggataatggagaggactattgggctcgctcgaaatatttttcagtggacgggtgcattattattgctggagatgaggtggagaagagtgtttttgatctcgatgccagccctatcccctgcatcggtgtcgatattgagctaaccggagctagttcctgctacattatgtccgacaatcagaagatttcaatgaaggttgttgagcatttttacatgaatggataccgcgaaatgggctttataggcattgaacgcccctctttggttattaaagagagagaggaagcctttatcgcctcactaaaacggtttagtcttgatgttagacctgaatgggtcgtatatggtaaggactacgcagcagaagatggataccaggtcgcgaaggcgtggatacaacaaggaaatttaccaaaagctatttttgcagcgaccgacctgcttgcttttggtgccatacgtgctttcaaggaaagcggcttgagggtacccgaggatattgctgtagtgggatgtgatgatatagaagcctgtcgttataccgaacctccactgacgactgtaaaacaagacaagcaaaaaataggccgtctagccgctatggtgctgtttgacctgatgaataaacaaatggatacgaaatgtattaaagtagagccggaactagtcattcgtagctcctgcggagcccggcaacattgggaccatacgaaggtcaagagttagcatatgccttaaaaaagatgactcctgataaattcagaagtcatctttttgcagtttaatatccagagacccatcgcttaatctattacttgtaggccatcgtcgcattcacagcctttttccagccttcatacaagctttcacgtgttgcttcatccatattcggggcaaaagaggtttccaccctcacccgcttgcgaagttcatccgtactcttccaatatccaatagccaaacctgccagacatgcagctcccagtgccgtcgtctcatggataactggccgctccactgttgcatccagaatatcgctctggaattgcatcagaaaattgttcaacacagctcctccatccacccgcagcaatttcactgcaatacctgaatcaatctccatggctgtaagcacatccttggtctgaaaagcgagtgactccaatgtggcgcggataaaatgctccttcgtggtcccgcgtgtcaaaccgaacatcgctccgcgcacctcgctatcccagtaggggctgcccagtccgacaaaagcgggtacaagatacactccttccgtagacgaaacacgggcggcataaggttcactgtccttcgcctcacggaacatacgcagcccgtctcgcagccactggatcgccgaccccgctacaaacacactcccctcaagtgcatattgcactttgccttcctccagtccccaagcgatggtcgtaatcaggccgtgcttggattccactggttgatcccccgtattcatcagcatgaagcagcctgtgccgtaagtgtttttgatcatccctttttcgtaacatgcctgaccaaacaaggctgcctgctggtcacctgctgcaccggcgatcggtacattctgaccaaagaaatgataatccacagtgtgcgcatatacctcggaagaaggtcttacctcaggtagcatgattttcggaacacccagaatgtccagcagctcttcgtcccactttagttcataaatgttgtacatcagcgtcctggctgcattggagtagtccgttacatgtgccgttccgccggatagtttccagatcagccacgagtctatcgtaccgaataacaggtcacctcgttccgccttttcccgcgcgccctccacatggtccagtatccactttactttagtgcccgaaaaatacgggtcgatcaacaggcctgttttgctgtgaaaaagctcctcgtgcccttgccgcttcaattcttcacagatgtccgaagtttggcgtgattgccatacgagtacgttatacacgggaactcctgtatttttgtcccatacagccaccgattctcgctgattggtaatgccgatggcagccacttgatttgcttttacaccggattcggaaagacaggaggcaatgaccccgagaatagagctccagatttcattcgcattctgctctacccagccgggatgaggaaaatactgcggaaattctcgctgagccgagtacactacatctccttcgctattgaacaaaatcgctcttgagcttgtcgttccctgatctagtgacaaaatatattttcccattgtttatctctccccgtgtaaatccatcgtttttacgctgtaagtttgtgatccattttatgatttttataagttcgactcatacggaaggtaatcaagagtacaaccacgatgacccctagcaaaatccaaaaagccggagtcacactccccttaaaaacggcctgataaaatggccctgcgaaagatccccccaatagcggtcctataacgggcacccatgcatatttccagttggacgcccccttaccgggaatcggtagtaaataatgcatcagacgcggcccaaaatccctcgctggattgatggcatagcccgttgtgcctccaagggataaaccgatactgacaactaaaaaaccaacaatcagcggtttcagaccatctgtaaatgaattggcgccaaacgacagtaaagcaagaacaaagatgaaagtacctatcatttcactaagcacgttgccaaacggatgatcaatagctggtcctgtcgcgaatacactgagtttggctgctgtgtcctccgtctctttccagtggggccaataatgcaaaataacgatcactgcacccgccatggccccaagaagctgagcaacaatatagccgggaacatcttgccatggaaaactaccctgaaatgccaacgccagtgtaactgccggattcaaatgcgctccgctgatttgacccactgcatacaccgcaatagctactgcgagcccccaacccattccgaccacaatccagccggaagcgtgggcaaatgactttttcagggacacccctgcgcacactccgccacctaaggcaataagaatcattgtccctatgaattcggctgcgtatggcgacatacaacctacctcctcaatagatcatccgattttgatcgctttcatcgcacaaaaaaagaaaagccatcacaaaccaaccctgtgctgtaccatgggatgtctgcgtggctctcttgtctccgtcacgattattaacttaaatttgatactatataagcatgtaagcgatgtcaactgcggatttacgtttcttcatagcttaaaataatcgttgaccatgttagattctccgatttatgatgtgaaaaaatggtttaatgtgaggatttcaggatgaatacgacactcccaaactcgatgaagaagggaagaatgttatgctgaaatttctgcaaaaaatcggcaagtcgttaatgcttccagtagccactctacccgctgcagggatcttgcaaggattagctctgattaattatgaaacggatataccacttggtcccggagttggcggatttctgaatcattatatcactccttttctgaacgagggggcgggggccatcttcggtaaccttgcgctcattttctccattggtgttgccattggtctggcaggcgacgcagtagccgcattatcggcagtcattgcctatatggtgctgacccgtattttggcggcagtgccgggtatatttgcatatattccagacgacgtcaagctggacatgggcgtattggggggtatttttatcggtggatggtctgcttttctgtttaaaaaatatcacaatattcagctcccggattggcttggcttcttctcaggcaaacgttttgtccccatgatcaccgccttcacgaccatgattctggccattctgctcggtatgatctggagtccggtacaagatgggattgcagccttcggcaactggattgttgggtttggcggaatcggatcaatggtattcatgattgccaatcggctgctgatcccagtcggtttgcatcatgtgttgaactccatcgcatggtttcaaattggtgactacaccaatgctgccggtgaggtcgttcatggtgacctgacgcgtttttttgcaggcgatacatcggcggggatattcatgtccggcttcttccccattatgatgttcgcgctgccagcagcagccctcgcattcatccataccgccaaaccggaaaaacgtaaagccgtcgcttccatcttcatcggttccgcgctggcatcattcctgaccggaattaccgagcccctcgaattttcgtttatgttcattgcaccattactttacggcgttcatgctctgctgacaggcctaagtggcttggtcgtatacctactggatgtcaaacttggcttttctttttcagcaggactcattgactatctggtcaatatgaaactctccacccacccattgcgaatgatcccggtcgggcttgtcttcgccctcatctattactttctgttccgatttatcattctcaaattcaacctaaaaactcctgggcgtgaagatgatgtagaagacagtctcctgtctgacgttaacgaaactatatccgatggaaaggcaagcaccacatccaacactcagtccagtcaggcaggcagaatactaacctatctcggcggttcagacaatatccaaagcattgatgcctgcatcacgcggctgcgtcttgtcgtcaaagacgacaaagcggttaacgatcaagctctcaagcagctcggagcgtcgggaatcattaggcttggtaacggtactctacaggttattttcggaactcggtccgaaattctgaaagatgaaatacagcggctgatgtcataggctgaatccctaacttaaacacgtgcgttcttcatataacagacgcgcgtgcttttttttagtaataaacgtttcaaattttttgtttttggttaaggcaatgcacataaatgggtaacagcttcatatgatggagctaaaccatttacaacttgttaggcaggtagattatctcagacagcaaggagggaaatgatgtgaagacagtacaatggctggtattatgtcttgcttttctcacgatgttcagtgcttgtagtgaaccctcgtcctctgaaagtcaatcatctgaaactaatttgtcaaacagaaaaaagataacgcttacattgtggtactggaaccgttccattgacgatgaactactcgctcaggcggaaaaacaatttcccaacattgaattaaaaactcaaaaaataggcggtgacttcaaagccaaactgaagacaacgctcgcagctcgttccggtgaaccagacatcgtagctctgaacgattggatggtggagctgttccccagtgcggatcgtttttatgacttaagggaacttggagcagaccgcttgaaggatcaatatttggaatggaaatggaatcaagggatcactcctgatggtaaaatgattgcatttcccatggataccgggcctaccgccctcttctaccgaagtgatctgtttgaacaagcaggcttgcctagtgatcctgaaaaggttagtgcctccatccgcacatgggatgattacatggcagccggagaacaacttcagcagaaattcggaagccgttcatttttggctgataatattgtaaacgtttacaatcagatactcgctcagcacacaaacctttacttcaagccggatggcagctatatcggcaatcaatctcctgatatccgtctgggctggaaaaccgctgtcgatttccacaagaagcatctgctcgccaatgcggatggctggactcccgaatggaacgcttcggtcaataacggaaaaatcgcctcttttgtaggggcaatctggatgaagcaagttctcacagaggccgcgccggatacagcgggcaaatggagagttgcccgtgctcctggtggagacggcaatctgggaggttcattcatttctatcctcaaatccagcaaacatcccaaagaagcctttgaagtcctgacttggctgcaaaacccggaacaccagctggaagcctaccacaaaatcggactgttcccgtccactcccggcgtctataacgatcctatcatggagacacccgagcctttctttggtggtcaggccaccggactcatctttgctacctccgcacgtcatgtgaaaagcagctatttcggcgagcgctatcctgtcatccacggcattgtgacccgtcgccttgctaatgtcgccaagcaggatgccaatcccgaaatattatggacggaaaccatggttcgaatcgaacgggaattacagcggtaaaaaaacaaaattcaaaaaaggcgtgtggacaatatgctgagagaaatctggaagcaccgtgccgtttatgctgcgatctcgccgttttatctgctgtttggcatctttggactgtttccgattggcttttcattatatctagcgtttcacaaatgggacgggatcggggacatgacctacaacggctggggcaactttcgctaccttgtgacagacaatgaattttggcaggctgtaggcaacacctttgtgatctgggtgtatgcaacgattccgatgctattcttcgcactgattattgcctttctgctttatgccccttttgtgaaaatgcgcaccttatggcgagttggattcttcctgcccaatgtgacgtctattgtggctgttgccatcatatttggtgccttatttgccaacaattttggatttctcaactacattctgcaactcttgggactacccatggttcaatggttgaatgtgccatggggtatccaaattgccatttcttctatggtcgtatggagatggatgggctataacgcaatcatctatctggctggactccagagtattccgcatgtgctatatgaggccgccaaaatagacggggcaaccggagcgcaagcttttttccgcatcactatccccatgctgcgcccagtcattctgtttacggtcattacgtccaccatcggcggtatgcagctcttcaccgagccacaggtcctggtcggtaatgacggcggttccggggcaagtggcatgaccatcgttttatacctgtaccgcgagtcgttcattaacaactattttggatatggagcagccgttggatggggcatgttcctcatcattgctctattctccatcataaactggaaactcgttcaaggtaaaaaataacgatgggaaggagcttcacaacatgatgcagacacgcgcaaaatcctttgttttatatgccggattgttggtgggaatcatcctgtcgatgtttccattttactggctgatcgtcatggcaactcgtaccacttcagacatctaccgttttccaccgcaattgtggtttggcagccacttcttggataacataacgagagtattacagcagattaattttgccggagccttttttaataccctttttgtagccagttctgttaccctattggttctgtttttcgattcactcgcaggttttgcattcgccaagtttgattttccgggcaaaaaagtgctatttatcgttctgctagctacgatgatggtcccttcacaactttcgcttgtcccctcctttgtcatgatggcctcctttggatgggtaggtacgttcaaagcgcttatcatcccggggatggtaaatgccttcggcattttctggattcgtcaatatgcggaagaatccatcccaaaggagctgctggatgcgggccggatggacggatgcagcttttttcgactgtacttgaatgtagcactgcctattctacgtcctgcgttcgcttttctcggcgcgtttacctttataggagcttggaatgattatttatggccgctaatcgtcttaacggatgagcgtaaattcacgctccagattgcactgtcacaattgaacggaatttacaatacggattatgcgatggtcattgcgggcaccctgctggctgtacttccacttattattttgtttcttttcattagccgccagtttatttccgatcttgccgccggagcggtcaaagattagatttacctgaatacccttattcatttcatgtttaatagttaatcgtcatttcaaatagcttacatgatgaagtcagctattcgacagacaatcaggttaagcaagttacgattggaccatgaactatgaactgaggggaactttccagatgaacaaattcacatattataaccccacccaatttattttggagaccatcaaattgaagaactgcagcaggggctaaagatgacggcgatgtgtcgaatgttatcaacaaaaagcacatgccgacccaggctctgccattcagcaacatccacacactcgcccccaccggttcagaaatgaacccggattctgttatcaccaactgagaaacgaacgaaaaatacgtatggggcagcgcggtgacgcatacgagtgcattctggacaagtctcggtgccccttccaccctggtcgattacaatattaatgatgagcaatcagaaaaaatcgtaaacattgcagccggtgaaatggaatatggaggctttggtaaaagttgaatcaggcatatattatggctactttacgcgcatcactttaaaatcaaaaagggagtgtcctcaagcctatgatggctgagggcactccctttttgattttatgaattaaccgtttgtcctttttcttctacttggatagcagcccctacattggcacctgcaagaatgccctttttcttattaggatacaaagaatccatataggttcgggtttctgcaactacgattcccgataagccaagcagtgcgatcagattcgggaaagccatcattgcgttaaagatatctgccagtagccaaatggcttccaacttgatgaacgcacctcctgctacaagtgcgatgaacagataacggtatggtttaatccatttgacacccagtaaatattcaacacaacgttctccgtagtaattccagcccagtatcgttgtgaatgcaaataaaataaggctaatcgtcacgagctctgcaccagccggaaaggcactggaaaacgcatgctgggtcatcagacctccatcgtcatttccactccatattcccgtaaccagcaacgtaaatcccgtcagattacaaataatcatcgtatcaataaatacgcctgtcatggatatcagcccttgttctgcaggccatttcgtcttagcagcagctgctgcaattggcgcacttcccaaaccggcttcattagcaaaaatacctctggcaactccgcttcgcatcgccaacataatcgtcgctccggcaaatccacccgttgcagatgtggtcgagaaggccccttgtaatactaaagcaatcgcatgaggaagctctcctgcaaacttaatgagtacaattaagcaaactacgatatagagccccgacatgaatggaacaatctttgtggataccttggcaatacttttgagtcctccaatcgtaacaacagcagttaacacggaaataatgatcgctgtaactaccgttggcactccaaagctactttccgtcgaagaaacgatagcctttacttgcggaaaagtaccgattccaaatagggctacaagaacaccagaaaaggcaaacaacatcgccagcggcttgaaacggcggccaagtccgttttcaatataatacatcggaccacccgaaaattgtccgttccggtctttaacacggtatttaacagataataatccttccgcatatttggttgccatcccgaaaaaagctgcaaccagcatccagaataatgaaccgggcccacccagtttgattgctgttgccacgccgacgatacttcctgtacctacagtagctgccagtgccgtactcaatgctccgaagctgcttacatctccgctaccttcgtccggcgctttaccaattagcttgagcgccaaaggcaatcgaataacctggagcagcttcaaacggatcgttagccacaacccagtgcccattacgagaataagaagcggcgctccccatatccagctgtcaatcgtttccaatacatgtaccaaattcatttcaacccgctcctccagcatattagaaaacaaaaaagagtcaaatcagctgattcgactcctggagaggttaaaggcacgaaaaaatacaaccatcttgtgcaggttactacctctaatagctcataaaaaagcctagggtattccctgtcacaggttattcgcgtctctgtccttttgcctgagagtttaagcagatgttatctgcggtgcaccttcggcgcccaattaagggtctctccagagttctgtccgtttacggtccccgcttgttgctgtaatcagcctaagcacctgagagttttgccccttcggtcggaactttcgttccatctcccgcaaacatcaaccagacatatgaaatttttattcattatacagaaaactttcagcttattacaagtgaaaagtttgtgaagccctctgaaatattattatgtctatcaaaaaagcagatacagcaaatttcatccttaggatgtcctctgctatacccgcccgagatgatatggaattacaattcttccccattggttgctatcacatttttataccagttaaaagagtcctttttggagcgttggagcgttccgttaccgtcatcatccagatcaacgtaaataaatccgtagcgcttggacatttcggatgtagacatgctcacaaggtcgatagggccccagctggtgtaaccaagcagatcaacaccgtcggcaatcgcttccttcattgggcaatatgctgacgcaagtaatcaatgcgatacgtgtcatacacagaggtcaataaccacaccgccaccggtgaacgggctcatggtcattacattgatttcattaaaggtcatccagtattttactttatccttatagcgtgtaaacactgtttcggcataatttacgtaatgctatgacttcacgacccagccagccattatacttctgagtcagacctagcggtgtctcataatgtgacaataatactttaaagcccatttcagcgaacaatgcaacctaacgataaccgttctcctttgaaatgcattgacagataccttaaaatagacgtaatgccttcataagcatcctaatcgttgtaacgcgtttcatgtcaagtattttttcttatgtgaggagaagcaccatgtcgaatcttgatcaaattgcaaaactggcgggcttttccaaagctacggtatccagagtattaaatcagtccccccatgttagtcacgaaacaagagctaaaattttgaaaatcatgcaggaattagattatgttcctaatcgaaatgccatttctctatccaagggtcagacgcttcagatcggtatcattacttcaactattaatgaaattgttctcgcttttctggacagctttgtggaagtagcgggccaaaatgaatttcaaaccattatttatacttcgggagaagacaaaaagaaagagcttcaagcctttgaggatttaaaaagaaaaagagtcgatgcgctggtcatcatttcctgcgtgaatgacactgattttttgagcacctattgcaaatatggcccgatcgtgtcgtggcaacgaatggagcataccgatattcgctccgtcgctatggatcagtatgaaggatatatgttagcgctcaaacatttgatacaaaaaggctatactcgtatagccaatgcttttggccgtccgagcagtattaatacccatagtagacaacgagcctacgaacagatcatgagtgagcacaatctgccagtgttgcaacactggaatcactcttctatttataatatccgtgatggcgaacaggtcgtacgggatttgttacagcatccggacgaatttccagaggctattttatgtgctaacgattatgtagcagtgggcattctctgcgaagcacgcagacaaaaactgaacgtaccggaagatctggcaattgttggattcgataacacggatttggcgcatacgctggggattacaacgattcaaaatcctatcatggctcaagcacaaaatgcctttttcatgctttcccctcagctgattggacgccaaatgaagcttcattcgctagagtacagcctcattgaacgtacgactacataaggtaacgatgtacttgcaaattaggcaaaagggccttgataagaaatattttttgtcgaaacagaataaaatatgttgaaatcgcttttttttgtgctacaatagcactatatcgaaggattgtgaccggtgatgcgggcaatgcctgagttcaattgagtgctattgctaacaatagtattgaattgtgcttaggcattttttattggtaaaggatgggagggggaacttcaatgattattgagaaggtgctcaataacaacgtcctattgactaaaaacgataaaggcaaagaggtcatcgtgatgggaagaggtatttccttcaaaaaggtggctggcgatcaagtcgatgatgataaaatagataagattttcatgttaaatgaaaacgagttcacggccaaactaaccgagttgctgaacgatattcctgtatctcatctggaggtcgtgaatgaaattgtaaagcatgcaacggaagtattggatacggagttaagcgataatatttatttaacgttgaccgaccatattcattttgccatacaacggcaagaaaaaggactggcactccaaaacgcgatgctgtatgaaattaaacgcttttacaaaaaagaatttgcagttgggctggatgctctccaaaaaattgaaaatacgctcggagtaaaattaggcgaagatgaagcgggatttattgcattgcatgtggtgaatgcacggatcgacggtaacgaaatgaaatccacactaaaaatgaccgagattgtccaacatatcttgaacattattacgtatcattacggaattgtgctggatgagtcttcttttagctattcgagatttttgacacatttgcaatattttgcgatgcgagtgattcgcaaagaagtcattcacagtggtgaagaatttttgtacaaccaggtgaagcagacgtataccgaagcttttgcttgtgctcaaaagatcaatgagtatctggaaaaaacatacgatcaatatttaagcaaggatgaatacgtatatctaactatccatattcatcgcgtaactgaacgtaataacatataagactaacaacttcataccttcatcgttcatggattgtgactggtaaggcaggcaaaacctaaactgatggtgaaatcgacgttcctctataggagagagtgcgtagttttcaccacgagtttaggtttttcttgtttacaagtttaaaaaaagatgcacgccggcgtatcttagcaacagctgtaaacagtaaatcctatcagtagcaagaataacccataaggagttctgaacatgagtgataaagaactatctaaaaaaatagtgaccctcgttggtggcgaagagaatgtcaattcggtattccattgcgctacacgcttgagatttaaattaaatgatcgtacaaaagcagacaaagccgcactggaagcaacccctggtgtcattaccgtagtggaaagcagtggccagtttcaagtggttatcggcaacaatgtaggtcaagtgtttgagcatatgatggcagaaacaaatttacaggatgctgacaatccaaatgcgaaaaaggaagagtcttccgaaaaaacgaatttccttggaaaagcggtcgatatcatttccagcattttttctcctcttttgggagctcttgcaggggcgggtttgctcaaagggattctggccttaattttgtcgctccaatggattgataatacaagcggtacgtatctgattctgaacgccgcttcagacagtgtattttatttcttgcctctatttctggctattacatcgtcccgtaaatttaagacaaatgcctttgtatctgtcgcagttgctggagcccttgtctacccggatgttattgcagcggtggacaatccggcaaaactggcttttctcgggattccaatcattttaattaaatacagttccagcgtaatcccaattattctcgcggtatgggtacagtcctatgtggagcgctggttcaattcctttatccatcaatcggttaaaaacattatcgtacctatgctatcactactggtcgttgttccgttgacgtttttggcctttggtccagtcggtaacctgatcagtcagggcttggcgaacggttttacatgggtatacaatttaagcccattgatcgccggagctgttgccggagcattctggcaagtatttgttatcttcggcgtacactggggctttgttccaatcatgctgtccaatattgcaacattgggttatgacacgatgcttccgatgcttacagcagctgtactttctcaagccggtgcaacactgggggtattcctgaaatcccggaacacccagatgaaggctttggctggttcctctacactggcagctgtattcggtattactgaacctacgatttatggtgtaactttgaaattgaaaaagcctttcatttatgcttgtatttccggtggtattgggggcgctattatcgcttctggcggagcgactgcaaaatccttctccctgcctagtttactcgcgttaccaacttatttcggaactggattcttgtgggtagtcatcggtttgctcgttgcctttgtactcgcagttgtgttggttatgattttgggctttgatgatccaaaagaagaaactgcaaaaacagaagctgcacccgtaaagaaagaagtggcaatcgagaaagaaattctcgtaagcccactgcaaggtaaagtattgcctttggaacaatcttctgatgttgcttttgcttcaggtgctatgggaaaaggaatcctcattgatcctacagagggtgtgctgacatctcctgtcaatggaacgattacgacagtattcccgaccggacatgcaatcggtattacttccaatgacggagcagaaattctgattcacgtgggtgtgaatacagtgaagctgaaaggacaattctttgacaagcacgtcaaggaaggcgatgtggttaagcaaggacaactgttgcttgaatttgatatagagcaaattaaggcggcaggctatactacagctacaccaattatcgtaacaaattccgctcaatacctggatgtgttgaacacaatggaaactgaagtgaagcgtgaggattacttgttgactgttgtggtctaacgttttaactatcagaccaaagaagctttcccaacaatggaaagcttctttttttatacatattgagacaagtgttacagctagaaatggaaatatcatttactgtaagtgtaagattgtaaaaaaaggaggatttctgtgaaaaaaggatatatcgccgggttaagtgtcattgtattacttatcattggtatcgctatttcagctgtagctaaatttcaagacctagagcaggttgttcaacaaaaagacaaagaaatccaagcgagcaaaagcaattacccggaaatatatgaccacttgaatgcggttacatttgaaaattttaagagtttaattcaacaggatcgaagtgtacttgtctatgtcggcagacccagttgtggcgactgcaaccggtttgagcctaactttaacaagatgattgagcagtataatctaggctctaaaattacttttttgaacgtacacaaaatccataaggacaagtcccaatggaataaattcaaagaggattacaacataaaatacacccccactattgcagaattcagaaatggcaaactggttgataaaatagaatggacgcctaaaagagaccttagtacggacgccgtaaaagagtggctgacttctaagaaaattattttataagtctcttttctattcatttcattacaaacacaaagaactgtttatgcaaaaaaaaaggtattcatgtatataactcatgaataccttttcttaggaatgcacaggtcttccaagctctaataaaaaatagttcctcctactcttcactgcgttctgataaacgctcattcatatctatcagtccctatattgtagacacttcatagagtatggtcgtcaatcgaatcaggaaattcatatcggataatatctgtttcggatacgatatgtccgatttgtgactcaatgaattctaaatctccctctactgcccatataaaatgctttgtaccgggttctacgacgataacctcacctgggctgactgtctgtgtcacgccattgatagagacacttccggttccagaaactatcgtccaaacttctttacggtactggtgctcatgatagctgataaatcttccgttcgatatgaccacgcgtttggtcactgtctgcaatccacttgccgcctgttgatgggataatacagtttgctttccccagaagcgctcctcaaaacgcgggccgatttcaatttccgccaccatatccttaattcctgttgacgactgtcgatccgtaaccagcacgccatctggaccagcaacgacaataatgtccgggacattccagatgctaaccggaatctccagttcattgatgatatgcgagtcatgtgaagcttctgaaatatatcccgggccacttagcttcgaacttacttcccgcaccaacgaatcccatgtgcccaagtctctccactctccatgatatggaagcacggagagcttatgagtatgctctactactgcaatatcgaagctagttttaggcaagtctgcataatttgtcgaaagagaattgtagtcggctggtaaacccatctgctccagaatatccaacaaaaagcccagtctaaaagcaaacaccccgcaattccataaggccccttcgcggatcaacgcttctgaacggatcagatccggcttttctacaaatgaactaactctgtaatatggctggtcaagtgaaggagaggctgaaggcacaatatatccgtatttatcagatggctccgttggagcagcccccattaatgcgatatggcttcctgatttctctaatattgaaggaagcctgcgcagatgttcaaaaaattcatcccccgcatacccgtccacaggcatgacccctacgatctcgtcgcgtgatgcgcctgcaacgtcatgcaagtaggccgaagccagggaaatggccgggaaggtatcccgctgagtaggctcctcaatgactacagcacctccgccaatttgcccccggatcagctcggcctgagttccactcgtcgaaaaataggcctcatctgccaaattcgcctcatctaattgcctccatattcgttgcagcatactttcgggccgttcgtcgtgacgtagtatggaaagaaactgcttgggacggttcacattggataagggccatagacgtttacccgaacctccagataataaaatcattcgcaaagatgcaaccttcttcctgtaaattaatactttcttacattataggactgttcgattttcgcatttctgccgaatacataagtatgtattatcgtggcaaatacatgattatgcaatgctattgtatctttgtctgtacaggagatgtcagtcatgcccataaaaatactcgtcattgaagatcaaaaaagtttggcagatatgattgctcttcatcttcgggaggaaggctatcataccgagcttatttatgactctaaacttgcaattcctacacttatgcgttttaagccggatattattgtgaccgctctgatgttttccggtaaagtcgaatgtgcgctgatcagccaaatccgtcaatttaccacagtccctatgctggtcatctctaataacaccgtgctgaatataagaataaaggctctggatgacggagcagatgacttcttatgcaagccgttcagtctgatagagttaaatgcccgcatcaaagccctgctgcgccgctgcggccgcaacatgctcactgaatcgcaaacggtaactcaaaagattaaaaaagtaagggtttgggtgaatgattaccgtcattgtctgttagtcgatgaccaagaaatagaagttactcaaatcgaattttctattataaaagagatgtcctgctatccaggtaaagtctttacccgcagtgagctgatggatcggatcaaaggcggagatggcgcttatctggatcgcactatcgacgtacatatttccagcctccgcaaaaaaatagaacgtgaccctaaaaatcctcagcacatccgtactgtatggggcagaggctacaaatatgagatgtagctgtatcatggctacccattcccccacagagcagcttgctttttatggaagttttcgcttcttccaccgccgataaggaagaaaacaagctgccccacccagtatccctatgaggaacagcacccaaccgaaacggtaggcggaagccagaataacgacgaccttcccgtttccgttaccatcggtaatgaatccggtagtcactccattgacggacagacgggctcgctgattttcgctacccagcctgaactcccacagtggattggatgattcggtctcccggatcagcacctgttgatgcgttggattatatagcgtaaaactgcgttccatggaattttcacgagtagcctgaatgctttccgaagcatggggagccataaaaaaggtatccatatccgttccctcaaacaacgtaaattgatccacagtgatcatcgcttgataagggatgatggaatattgcttcatctgaaataagcctgactgcttcttgtgcgcatgcgctaaaatctgaaactgcatcatggcggttcctgccggagccttcacaatttgatcataatgattccattgttccttatctctttcctccacctcatcaatataggaggtttggagaacctgggacgctttattcaaaaaaatgaccttcatatgccgacttccaatttgttctgatcgcgcatccaactgcacggcatactcttgcagcggctctgccttcattttcttggacgcataaatattccagtcacaggaatagctaggtgcgtaacgaatagacagttctttgtccttgattgacatattcgtctgactaggtcgaatatccgccacacatccgacatccgtcgtgctcaatgattccttcgtatcctccccaggcatcaccgtcacttcctgcccgcccattcgatgaatatctccaaaactacttaatgacggtacttggctgtccagcacaagggttaagtgatactttcccttggttaggaacagatttttgaattccactcgaccatagtcattcagcagaccgggaatttgtatgattttcttggcaaaaccatcctgattgggcaccgtttcaataacctgtgtttcggataaagaggtagcgggtaaccgcttatacgactcccccgtatgaatcgttctggtcaacacctctccagtctcttcattcgtccacttcatcgttaatgacccctggtacccggcggggagattagccaaaatagctgtggcataggttcccgttttggcgacttccacatccctgcttaacgttcccttctgatagctgattccccgccccatactaagtctcggtaaagcacattctgtctgcacattcccttcggcgttaaaatcgttctctgcctccaaggtgaaaaagagcttgctccgcttcaatgcttgctctactggaaaagatagctgatctagctgatccacaggcacaatcgcaaattgattgaccgcattaaagccttgcaagttattaaccgtgaccggggtatctcctttgggaaaggcatgcactcccagatcgacccattggaattggttcaagccatcatcctgagttttgatattaaccactttgtccggcagcgtgacttgcaatttcccgcctgccttattcataaacactctagcatatacatgcgaggtttgaggctgatccagttttttgtgcatcgtaaacgtgttaggcttgctgtattgccccaaatcacgcagctggatatcatgaatccaccagtaatttttttgctgtggacgctgtaaggttaacaaatccattcgcatccaatagctgcctggcggcgaaacgtattccccgtaaaatttcacactgtcaaaattatatccctccgagggcgccacaacatagctaacccccagctcacgcatttgcttatcgtaaaatctcatttttacatgcattttgttcgtcccgcggccagaaacagtaatttggaactgatacggattattttccttggcttccagcaaacccgatctagcgacctgccatatattactcgggtctcccttcataatttcgccgtgcagagtgggcacatcattcaattcctcacggggattagcctgcacactgaacaactgcggattatccggcttgaagaaggtttctgttcgcaacatggaatcaaagtccacgaccgtcttcccagcgatgctgctcatctgatacggggccacatccagcttcttactggcaaaggtaaccgcaatccctgcatccatttccatatcgaacggaaagttccgtatattttgggaggataaataccataaccaatcgttggtcgaggcaaaggttttggaccattttaaaaaggcattaccatcctcaatggcatcaaaaggccgtaagtaatcctctgctggaagctgtgacaacagcaagtcattaaaggacgccgcttccacataatcccctttgttaatcgtctggatggtttttagctcaggccttaacgcactgaacagcactccaaagcggttaaaatcaaaaccaggcagatgactgtagctctccagtcggctaaaaccgtaaggtgttacaattttactcgcaaggatgttcatatagggcggtgtctgatcgagattgaatatggaaaatagcccgttttggtacgtacgtttcagcccggtctgaccttccagctgagacaggtggaaatcctgccgcttctcctggcccacatattcatcatggtagaccaactggttgaccccaaaggtagagaacagccagcctaaccgggagcttaatccgttgtccataacatactgcagaaaattcatatagtatgtaatgccgggatcattcccctcatgatgaaagatcgtatttttaggagaagagtatacctgaaaatctccggttgccttctcgtttgcggtcttccctttattccatttgggcgtggctactccgttatagctctgaatcatattgtcagcaatcggaaagtataatgccttgctatcgtaacgatccgggtcagtcagcttttcagccatttgactataagcctccggcacttgtaccggcttgtagtacccctcaatgaactgagtacgcaagggagcaaaatataccccgaggcacaagacaacgataactactgctagctttttatatacacgctgtaacggggatgatccgaaccattccataaattgaatgacaccaaaggtcagcaacaccccgaaattaagggcaatcagtccaataaatttgttagggtcacggaaaaccgaaccaatcacaggggttttcgtaaccaaaatgacaaaccacttggcaatggatgggaacgtcgtcccggtagctgcaactagaaacagtagcgtaagtagcgagaagatcagaataatcggatttttatgtgaacgtgtcaccatcgcatatccgatcaatagcaacaaaaatccccctcctacataaaacatgctaggcagtgaggacaaggaaaacatgggccaccaatagctcagtaaataacctacgttatataaactgctgttgcggctgaacagagataacgtatccacgacgttgatattatgctgagacgcttgagcgtccatcaacatgctaccgacatatagagacaaccaataaaaactgagcagaccaaaaaagacgccaaaaatgatccctttacgcaaaaaattgccgtataacggctgcaaatagctgcgaccagcctttcggtgggtccaagttagtttgatcagtagcaacaaggtgaacaatcccaaataaatcatgccaaagaaaaaataatgaattgccgcagcactaacggtgaataccgcagccaacaggaacaggtcgatccagttccgttgataaagcttgtggggatgatagtttttaatttgttgaatttgaaacttggggtccaccgcactaaagaagaatcgcagcattaacggaaacagactatatccacagagcaaataaatatgctgaatgcggaaaataacccacggattcagcgcataaaacaacgagccaaccatgatggcaaaaatacgggtcttcgtaaagcttggtgaataatacacgctaaccagacgcttggcaaaggcatacatcgaaaatgccgaaacaaataacaagcctgtaataaacgacttgagcaagaccgggccgctttcgtcaaataagagtgacagtccatagaagggcaagatgtacaggatacgtggagcattgaacaaggtcgaggtagaccatcgctcgttccatactccggttatttcctccagataccgatgagaggtggctccaaaagcaatgtcgctaaacacaatttgccctggtccatagatgggtgcaagatatgcaacaatcgcaatcagcatcaacatcattgccgccatatcgtagcggtagcgaaatatccattttttcatgcttgtccccctctcttgaacttctcgtatatctgtcggttatcttgggcctatcttctcaaacgaacgattgcctgcaagccctgatcggtattacgcagctttaaacgaccgcctatggtcttcaggtatgcatccatatgatacaggctgaacgcatgctcctgtgagttttgggaatagtctggctggaaatagctccaacgcattttatcatcaataccgccgcccgtgtcttcaatgttaataataatttctccttcttccagccgtgaactaaccttaagcacttgagattgccgcttggaccgcagacctgttcggcccttttcctgattctcaggctgctccccaccttggcccatggcctgcactgcattttccagcagcccctgaatcgttttgtacagcatgggtgcttgtgctgcaattgatggaacaggctcttgccgcaagatcacttgaatgttgttcatgttcaatgaacggttcgcccatttcagcgactcagacaatacttcattcatatctgtaaagctaattccactattatcatgcatcttctcttccagctcatcgcgcaagctacgaactcccgtcagtaactctcccagtgaggattcctgtctgagacgaccctggatgaaattttcatttaactcgcgaaaatactccagttcctcatgagaggctccttttccctgactcgaagccgcttcaaagcggtttgctagatcatgataaaatcccagtagcttcaaatcatcaccgcctgtgagacggctagtctgctcttgcagctcttgtagttgctgctcaatcgtctgcattaacggcaaataataggtgtcctgctgctgtcgcatatcttcatctcgccgttggtcacgcacctgattgttcacgatggcatcctttacaatccgtttgcggaactgtacgagcatggcccacagaatgaacaatatcaaaaccatgaccatccataactgtttacgaaaggagctgattcgctgagctgtatcctcactggcatccttaaccgatatgtaaagggcctcttccccaaggcggctgaatcctattccgtgtttctctccgccatcttcgatgatacctgtattgccttccagcagcctacgggttacgcccgtgatgtccgttcggttaatatccgaagtacttcgggaagctacgaccttaaattgaccgttataaaataaagtctcatgctggttaatcggtttacttttaataatcccgctgagcatatcagcgtcaaccgtgcgcaccataaaaccgcccatctgcgccccttgaatcctgcatgctatatactgggcaggctgatgatcctctgtcacaaaagagcttactgcacaaccattttgcagccatttaatctgctggactacacttttcatctcacgattgtctcgtccgaccatcacatgatactgctcatccagcacataaaaggccccgctttcacgcttaaaaccctcaggatactggcgtgttccctgattcagcatatctctgcccagactggacgacagctccttcagttcagcctgccatgcggcataacgctcggttatgctgctagaaagttcctgtacctcatactggagctgttcgttctgaatctccgccaagtgaacactgaattgtcgcacgacaaaccattgaagcacagcggccagaaacactgtcacacccaggacgatcaggtacaggatcagcttttgccaacctggtttcaacaaagcccattgtttcatgcttccctgtcccctccattttgttcaagacggctcaaaatagcctgcatcaggcattccagctcgtagctgaccagcggtagccgtgcgcacagcaaccggggagtgcgacgctggagggcagcaaacctcgcagcggtttccgttgccccgttcgtcagtaggatcaactcgcatgtttttgcgatatataagcgatccagctcttcctcgccgtattctcgcagatcaacaacgtaaatatcatgacgatcgtccatatgctgaagtgcgctggagacagccagggtcactcctgtatgccgtgcagcatgatactgatgaaggagacgcatacctttttcccagagggcatgttcagccgaatcaaatcgttcacaaaaaagacgcaacgcccgttctgtattgacatctttcaaaaatgccaaaacgctgatattatacatgtagttcctcatttcttacttcctgattggagttgcgcagttcttatgacaccccaaaacattctatttgttgacgacagccctatggttctgtccctgctcgaacggaccttgacgcaagaagcatttaccttacataccgctcacacgcccaaagaagccttacaagtgctggaacagcacccgatcgatgtggtcgtttccgatctgctcatgcctggtctggatgggattaccttccttcgcatgattaagaaggattatccacatatcgtacgaatcattttgtctggtcacctgcatacgcagtccattttatcggcaattaatcaagtcggtgtgttccgttttttgacgaaaccgctggagttggatgatgatacgctaaagaaaatactgtatgaggcgcttgatcaggccaaactcaaccgaaatagcctgcatgcagaacagaacgtagcttccgacctgtcagcatttatagacagcattttgaacgctccgtaccgaccctatgtgctactgaatgaacaagatatcgtaaccgctgtacacattgcactcgctgagctgtatcctgtcggctgctcactacgtcatcctgacggggaaggtattcagttaaccacgcattcattatatataccgtatgaggagtcggaatcttccgatcccgacctgtacacgctggatacgctgacccttggccattcatcgttacgccttatccgccttagcgagatcgcctgagtgacgggtgccgccctttaacacggcggctaccccaatcacagtcaggcatacatacatccacaacatccccatcgtcagcaaggggtgacggatatagtttttcaaattcccccatgtatacagcaccggacggaagaagtaccaacgttccagcgcctttcgcaatccgccctcttcagatgacatcgtacgatccatcaccgaaaagtagtaagcttttttacgtaatacatcgtgcagatacacctgtttttcatcatggtatacccgtgtaaataccgcccggcgaataactccgccagactctatataacgcaaggttggctgtatttcttcaaaagcaatctgctccgcattaaatccgcccgtcgattcataagcgctcattcgccagaagcgtgccgcttcaatggagcgttttcccaaggtctcacccgcgttattaatcacatttcgctcaaaaactttcactttggaaaaaaaattgtccgcttccgaatacgcctcctccggaatgaccaaggcgccaatatcctgatgatcgtcaaaaaagtcgatgctctgctgaatcagatgttcggctaaaatcatatcggaatccaatacaaatatgtattcggcccccaagtgttttgcttcctcaaccgccctgaccctggcgactccccgctccccatggggaagctccagtaccgttacgggtactgaacttcctgccgacagcatacgaatcgtctcgacggtccggtcattggagccatcatcagcaattacaatatgcagatccttgtaattttgccccatacagcttcgcaaacaaggctctatcgtccgctcattgttgtacgtggagaagagtatgaccactttgtccactctgttctgcctcctctacccaatcttccatcaactgctcaaacgtagcagccgtatgatcaaaatggaatcttaacgcatattgatacgcccgctcacggatggccatgtaatcttcgccgcccttcgctgctctttccatttgttcagataatccccggatgtcgccgtgaaagcatagatacccgctttttccgaaatccgttgcatccaccagccccggtgaattgctgacaatgctgggcgttccaacggctgcggcttcggtaatcgtcaatccccagccttcacgcaaggaaggaaacaccagcgcgtgggcacgactcatcagctccagcttatgctctgctgaaacaaatccgtaaaaggtaatatcggcttgcgattgcccctgttcatccggttctccgtatgttaatccatatcgtttcataatcggcaacaattgttctgccacataggttttatcggtttttccggcaatccataacatagcctgagggaacttttccttgagctgcccaaaggcctcaacaaccagatcaatgcctttatatttgacgaagcgcccagcatacatgaaggtcggattaggctccttcgttaaaaattgttcgcgcggccaatgatcaaactcaatgccttccggtaaaagatggacacgatccgggtgaaagcccagcttaagtagatcgtatcgagtagacggagataccgtaagcgtccgatccttacgagccagcttaagcatcaagggctccatatgaaacccaataacatttagcgggaatttggcgttctcaaaccatatctcccttgttagctgatgtatgaaaaaaatccgcttggatgcctccacccaaaatcgggtaaagaattgatgcgtattcgcctggttaatcacatagtcgatcttccttcgatgacgacggtaatagcgcatcgcataataaataacactgtatatgttcccttttcgaatatacgtaataccgtcaataacttcatgctcaggcatcccctcaaattgaggtgaaaaatgaatgaactggaagcggccttgctgtgaacgtttaagcatttcgtgggtgaaaatttctgctcccccgcttttaggtgaacgaatgtcacgccaggaaagcaatagaactacggttttaccgtcctgttcatgtatggtattcatggggtaaatccccctttatctttattttgaacaaatgcacataggcgtctattacaaagtagagagccatagctccgtaaacaatgaactcagatagcaaaaaatctaccgggtctgtgtgggctatatgaaaggctactaataaggccgcggctcctgccatcagactgaacataaatttgcgtctgcccaccaatacgtgcacatgtacaaaaaacagcacgatggaaaatagccagtacacccagcccccccatggaatataggcctcggccgattggtaagaggctccgaataatatgggaatagaggatgggaacacaaaggtcgtgcccacatatacacagattgcagctacagccattaatccggcatagacggcaatcaacttgcccaaagcttggcggtcatgcccctgtgcaccgatctttggaataaaggcagcaatgaggctatacgaaacgtaatagaccaattggctgtacttcagtgcaatggcatagctgctggcctgctcgggaaagtaatgctgtacatacaacatgtcgatggagatacaaaacaaaataaataaattcgtcataaggctatcggtgaaatcctgactcaatgatttccatagcccagaagggatatgttctctaccgtatgtgaataaggacaagccacgagcagaaacgatccagccgtggagcagcgacagtaacattcccccacagctcgctaacagtagggcttccagctttaaccccagtgcagccaggacaaaaaacaggctcagcttccctagtacctcaatgtaatagttcacattgagcgccaacatgcgttccctgccctgtaaatctccgcggcacgaactcacaagaatatgcagtccgatcaagccatacagcatgaacagcgggtcggattcgacgcctaataacgaacgcagtaacggatgaaagatgagtaaaatgatcatggcaagcacggttagcaccaaaggtgctttgagtaatagagaaccgagcggtaagcttcgtagcgcaagcttttggtctcccttagagaccagtttggcagttaatagctggatggataaacccaaaacggataaaagcgcaaaaagcgccagcagcgcattcgcctggccataagcttgtccggtaagataccaactcgctgcaatgtggaagaaaaaattaaatccgttaagcagcacattaaagagaggaaacatcaacgatcgcaatcggttgttcacgttgttatctcacccgccgatccagtcgccaaatatcaatgatggagcgcaaaaaacgaatagaatccttccagacatggatgtgcgagccatcccggtcaatacatttgacgggtaattgcagcacacgaagctggagtcgcttggcaataaacatcatttccaaatccaacgccagtccgagctgttcctttaaatgcggaaacattcgcttcactgcaaccgaactcatcactttaagcccagtctgggaatccaccacacctgtgggtaaaaaaggacgggaaatgactcgcttaccaaagctgacgacagatcgcaataaagatcgattctcagcggtcatatccttggttccgatcacgacatcataatagccctgctgaacaacattaatcattctggcaatatcctcaataaaaaaggagtcatctgcgtccacaaatacgtagtaatccgcaccaatggtccgcatcccttccagatacgtccctgccttacgtgtattgcgtcccaattcccttgtttgaagcagcgggctaagattctgattaatccggtttacggacaagtccgtggctgcctccagcgctttaatcaaggcattcgtaccatcgtagctgccatcatcaatgagataaatcgaaccttcaataatatggctgcggataaagacctgcaatcgttcagcaaaggttttgacatgaacaaaacgttgctcttcgttatatacagacaagataaatgcaatatgttggcttttggtcgaatactcgggatagagcaagctttgtatttccgaaagcatttcttcgttgtcattggcttgccaaaatagtagccgcaaacgacctactccgatgatttgcaccatatgctgatcactgaacggaaatgttacatccgtcaccagtaacagtggcatttgcggaaattggctacggatctgattggctttccgcactgcctgccccggctccctataatcaatcaggcaacaacatgcgttctcgtagactgaagctgcctccgtgtcctcgcactgtatatattggtaaaaacaaatcacattgggataatcaatagccctgtcgttatcgctaaaaatggctataggtccctgcacacaaacctctccttttcctccgaatagttctattttgttgaaaaagaattaagaatgtttgcttataggagttaaattaatgtccaaatacttcatatttccttaacaaaataactgacactccatgatatatatggagataagagaagaaaaactaattttcatatttgataaaaacagagcatttagacctgattcattagaaccaaaatcatcaggaatggttagggaatctatattgaaagttagttcttttatatcattagaaagaaacaaatatggttattttgtcatagataaatgcaagaataaaacatatttgcacgtccatactatggacaacatgtcatctttcgttatgaatagttatgaaaatgaagagaaggaaggtctttctatggaagcattttatgtcaatcgcgatgggtcattatctactccattacggggaaaggatgtgttggcaaatccccttttgaacaaaggtgtcgcttttacagaagaagaacgcaaagagctgggtttggaaggaatccttcctccaaccgtcctttcattggagaaacagagcgtacgggcatatcagcagtttctggcacaacccacgatgctgcgtaaaaatgcttctctcaacgaccttcacaatcgaaatgtcgtactctactaccggctgctaaccgatcatttgagtgaaatgctgcccgtagtctacacgccgaccgtaggaaccgcgattcaagaatatagtcacgagtacaaccgccctggaggcatatatttgtcgatagataacccgaacggtattggacaagcattccataattctggtttgagcggccatgatgtggatctgatcgtcgtgacagattccgaaagtattttagggattggtgactggggcgtcggggggattaacattgctatcggcaaacttgcagtgtatacggctgcggcaggcattcatcccgggcgggtgctgccaattgtactggatgtaggtacaaataatgaaaagctgctgaatgatccactgtacatcggaaaccgccataaacgggttcgcggagaagcctataaccagtttattgatacttttatcagcaaaacgttagcgcaattcccaaaggcgcttttacattgggaagacgtgggtagcgtaaatgcacgccatattataggaaaatacggtcaaagtatactcaccttcaacgatgatatacaaggtacaggagcggtgaccttggctgcgattctttcggcggtgggtgtcaccaagactccgctgcgtgaacaaaaaatacttgttttcggcccaggggcagcaggaatcggtaatgctgatcaaattcggggtgctatgatcgaggacggcctttccacagaagattccttcaagtccttttgggcctttgattatcgcgggctgttaatggaagatatggaagacgtattggagtatcagaaaccgtatgtgcgcaaaaaggatgaagtcagctcatggacccggtcgggtgacggcaaaataccactgctagaggttatccatcaggtgaagcctacgatattgattggaacttccggtgtagcaggtgccttttctgaagagatcatcaaggagatggcgaaacatgtagaacgcccgatcattatgcccatgtccaatcctacaaaccttgcagaagcagtacccgaggatttgatacggtggaccgatggcaaagcactgattgcaaccggaagtccttttgagcccgtcacctataacggtacgaaatttgagattggacaggcgaacaatgcctttgtttttccgggactgggtctgggtgcgattgtggttaaagccaaaaggattacccctgcgatgtttacagcggcagcagttgctgttgccaatggtgtagattcgaatacgcctggcggtgcactactccctcatatccgaaaattacgcgaagtttcgtacgctgttgcgattgcggttgcaaaagccgcgatacaggatcaggtagctcaggcgcacatttcagatgtggaacaggctatacgagatgcaatgtggaaaccggaatatgccaaggtcaaagctgtggaaaatgtaattcatcaccctcactaagcccaaaacacctaactagaggaaatttcatattttgcacactatgtttgacatagcgtatgaacgtatgtacagtaatagtcaaaagaatagaagtccactaggggagccgctatggctgagacaagaacgtatcttggaccctttgaacctgatctagttcgtactagcgtaggaaagtggagccttcgtatataaggtttcaaacgtttttttgcgtattgggcctattgttgaagccgctcccatttttccggggcggctttttagcgttgttccggaattatattcttacaggacttcttgctcttcaatttaatggaggtggggaaattgagttttacacaagaactccgtcggcaggcggacggcatttttcaagcgatttttgagcacccctttgtgagaggtattgctgaaggaagtttgacaaggggacaactgattcactatgtaaaacaggactttgaatatttgaacgcctacatgcggatatacggcatcgcaatctccaaatgcacgaatcgggaggatatggctgtattaaatgaacaaatctcttttattctccacagcgaggttcatccgcatcaaaatttctgtgctgtcgcaggggtgacctatgaagagttgcagggatatccgctcgctccgtcggctcatcactatatccgtcacatgctgacggttgcgcatgagggtagcctgggcgagatcttggctgtgctgctgccatgtatgtggacgtatgccgagattggtcgcaggctgctggatgaagtaaagccggatgagtctcatccgttctatgaatggatgggcttctatggagaccagcttgatgatacaacactcaagttccgagaacgtgtagatgcttgggcgaaagacgcaacggctgctgagcgggagcggatgattgagcattttatactgagctgccagctggaatataagttctgggatatggattataagcaggaagaatggccggtccagatgcaggcagcggtcttggaatagtcagcctggcgattcgatgcgtgaagtacggttaatgccctgttgaaccaccaactatagagaggataatcattatgagtacatgggaaaaaagttattcggatctcctgacgaaggtacaaaacagcaaacccctcgttcacaatatgaccaatgtggtagtcaccaactttacggccaacggcctgtatgcattgggcgcctccccggtgatggcctatgcacccgaggaagtagcagatatggcaaaaatagcaggcgccgtcgtgttaaacatcggtacactgaaccgcgaactggtggatgccatgatcattgctggacaatcggcgaatgcacacggtgttccggtgctgctagatccggtcggtgcgggagcaacgagctttagaactgaatcggcactgcgaatcctgagtgaagtcaaaatctcattggtgcggggcaatgcagccgaagtcgcacatcttgttggagaagcgcgtgacattaaaggcgtagatgccggtgacagtgctgacagcggccatgtcgatctggcaattcgggctgctcgaatgctcaatacgatggttgtcattactggaaaagaggacgtcatcaccgatggggccgaagcacgaatgattagcggcggagacgcgctcctcacgaaggtaaccggagcaggctgtctgctgacctctgtgttaggtgcctttgcagctgttgaacccaacctgctgctcgcaggtacagcaggtttggcattttacggtgcagcagcttctcgagccgcaacacgtaccgcagagctggggcccggcagcttccagattgcctttctcgacgagctggccaaactgcacacaggttcactagaagggtatgtctcgatccatgaagccggaacaacagcagcaggtggtgcgcgatgacagacgtttgtgtacccagagcgctgacgattgctggttcggacagtggcggcggggccggaattcaagctgatctcaaaacctttcaagaacttggcgtgtacggcatgtcggctattacggccattaccgtacagaataccttaggggtccacggcgtatatccgctaccagaggaagcaacagcggaacagatcgaagctgtaggattagaccttggagtggatgccctgaagactggcatgctgtttaatgccggcatcatccgtcttgtgagcgagcagatccgaaggttcggctggaaaaaggtcgtcgtcgatcccgtgatgatcgccaagggaggcgctgaactgctgcagctggaagcggtgcaggctttgaaggacgacctgctccccttggccctggtcgttacaccgaatatcccggaggcggaagccctgacagggatcagtatccatacgatggaggatcgccgcgaggctgcaagacatattagcagtatgggaccaaaattcgttgtgatcaagggtggacacgctgacgagagcgagagcagcggacagattgttgacctgctttttgacggaaccgcctttatagagctgagcggcaagcgagtacggactgtccatacacacggaacagggtgcactttctcggcagcgattaccgcggaattagggaaagggatgtctgtaccggaggctatctcgaatggtaaagccttcatccaggcggcgattgaggatacgttgtctctgggacagggacacggcccaaccaatcattgggcctaccgacgtcgtcaggagatgcttctatgagcggcagaatattgtcagaggtggtgcgccgccatctacagatatatctggtgcttggaagcgtaaattgcctcgcggaaccaggctgggtcgtgcaggaggctctggctggcggggcaaccatggttcagttccgggaaaagggtctcggcgcgttaacgggcgctcctatgttcgaacttgcgcgccagctacaggaactgtgccgtcacgctggtgtccccttcatcatcaatgacgatgtggagttggctcttgaactcgacgccgacggtgttcacatcggtcaggacgatgaatccgccgattccgtccgcgagcgtatcggaaatcgaattttaggcgtctccgcccataccattgaggaagcacgtcgagccatcctgcaaggtgctgattatctcggcgttgggcccatctatcccaccatctcgaaagatgatgcccatgccgtacagggaccggcaattttatatgagatgcgtaaagcgggaattgatgtgccgattgttgggatcggaggtattacagtggaccgtgttgaggaagtcgcacgtgcaggtgcagatggtgtagcggtgatttcagccgtgacacagacagagcaggttagaggtgcggtcaaggaattaaagaaaaatatgctctcatttctcaatgatccgatctacatgtttgatattgattcaacagatcatccagctttttagattgttctattactttgggatgtgttaaaaatccatactttttctggacctggtacagtttcttcctagctctttcgacacaaagtaaagtcacactttgattcatcagcatgatccctcctatatgtcatattttataacaaaaagacgttttttggattttcaaatgatgcgcctaacaaaaaaagaacattccaaaagtttgcataaacagcgaagccccaaaatccatgtaaaaaagcctccgtctccactaataaagtgggaccgaggctctttccataaaaagattcaatgaatattagaacatacaacctaaccgttttaagcacctccaatttgtacttgaggcgttattctttgattttggttatgtgactgaacaggcattgctaaaataaacaagaagctagctgcgatgaccagcagaatcatttttttcaacattgtctaaccacaccttttctaatagtttgaaatactcttccctcgtttcgggaagcgcatgtgcttggaaatgtgcaaaaagtcccgtacagtttataaaataagtctcattatttagtatgtgggcttttaccaatgcatatattaagtgtttaaagccatcattgaacattccccgtcttaaatagtaataagccagttcataaccaaaccatgcaaaataatccggcatcacttgttgggtgtacatatcagtagattgtgatagcagagcaaaagaattaatctccacttcaaaacgtgaaaggacatcattgatatctattgcatatcggttagcagctatcataacgttcagcaacttggatagcttttcattctcggtagtgattgatgtggatgcaatatattcaacatactgaggaagcacattcgtatctccagataggagtttatttacataagtattaccttctgcccaatgcttgaacaagttgacccagtgttgagttttctggtctgtctcgatcacccaatctaaatctgcgtaggcatttgtaaattgtaatgcttgctgataatcgccttgggcttcacagacactcgcacacagtaaatcagcataggtaatgtacacaaacatcggacgactcagcctcttttcagactcctcccactctcgctttttctgttgatgcttcaaagaatattggatctccgctttggctctcatttttcgagcagttgcatcgagcttgtcccattcacgcagagaacgatacacattcgccaaatcttttaacgcatcgagttgatctatttcattcagacgttcgacaaagggttcaaatcgtgtagccgccttgagatttcggatctgattgttacccacctgaatggtaaacagacgatactgacagatagccaaacgttcagaatgctggtacttctcgccttctgcaatcccttcgtagagcaacaatgcagcattgtgctgaccttgtgcgaataatttttctgctgcatcaaataactttggggaatatagaaggttgtccataatatgtcccactacaagctggatagcatccaacttgtccagttccgcacagcgaaacaacaacggctcaattcgcctccaatccggggaacgctcaatgatgtagttatctatgtatagttcgtaaaaaaaaccttctggtagtcccatagcccaagtgattcgatcaagctgatgtatagcaacaggacgatgcttggcaatccaattattaagtgttctttgatgaacacctgaatgttcggcaaattgtgccagcgtcaaattgttttcccctaaataatcctctaacttcgtcaaaatcgtaggtgtatgtcccaagtcataaccacccttcatacaaaaaatccaaattttatactttcacctcaaattattcaccaagttttaacatgtgtcaacatttttcttccattattcctactatataaactttaatatggaaattaataaccactaacatgaggtcccttttggaatcaggtggtcgctcgctctactaatttgaattccagatgatgtatcgtttcttctagcccttcgagggcatttcgaatcataatgaacgcattctcagcttgcttgtctatcgggtaatgaatcgtagttaaatcaagcaaatgcgagatttcggtgttatcaaagcctactactgcaaaatcactcggtacagaaacacctagcctacgcgcttcagtcaaaagacctgctgccaaataatcggtagaacaggcaaaggcgtccggcctgtcagtttgtgctcgttctgcccaccaatgagctatttgttcaccagctgctattgaatttaaatcataaaaatgcgggaaggcctcagcgtccaaatcatatttttcgcaaaagtcatgataagatcgaatgcgttcttttgtattcaacccccgcatgctgccgtacacattcacaattttccgatatcctcgggcgtacaaatgttccaatgccagcgtatagccctgatactgatccataaatacagacgggattgcctcaatgtttacacgctgccaggtcacaatcgggccatattttgtataatgctcaatcacactccactcattgacgcgaatcatacagaccaaagcgtccagttgctttctccgcaacatttccagcgcttcaagttctcgccccttctccccattcgtaataaatagcgctatattaaagccatgctcctgggcatacattgtaaatccacgcacaaataaacccaatgaatcattaaaagaaagtgaaataatccctatgagcttggtcatgcccttttttaaagataccgcatttaaattgggaacataatccagccgatctatgacctcctgcacacgctgccttgtgggttcactcacgtacggatggttgttaatgacacgggacaccgtagccgaggatacccccgccagctttgcaatttcatgaatattcgccatttttctcacctcgttctttctattttagcatgttcgtgtttagcatgttcgtgtttagcatgttcgtagtgtccgccctataattgtcaccttcccaaaataagttttttaaaagcgcttgacctgtaatgcattacagggattacagtgaatttgtgcttaagaaagcggtttacaaaacatacttaggaggcactaactatgaaaaaaggcataaagattgcaaccattggcggaggctccagctatacaccagaactagtagaaggcttcatcaaacgttatgcagagcttcccattcgggaattgtggctggtagatattgaggcaggacgtgaaaaactggagatcgtaggtgctatggccaaacggatggtgaaggccgcaggcattgattgtgaggtacatttgacgctggatcgtcgggaagcgttgaaggacgccgattttgtaacgacccaatttcgggtaggcttgctggaagcccggattaaggatgaaagtattccgttaaaacatggcatgatcggtcaggagaccaatggtgccggaggaatgttcaaggcgtttcgcaccatacccgttatcctcagtatcgtcgaagatatgaaagaactgtgtccgaatgcatggttaattaattttaccaaccctgcaggtatggtcaccgaagccgtgcttcgttatggtcagtgggataaagtcatcggattatgtaatgttccaatcggcgcgatcaagagtgcatcagctgtgctggacaaaccggaagaagagctgttctttaaatttgcagggattaaccaccttcattggcacaaaatttatgacaaaacaggggccgaattaacagagcaagttattgaaggactgtatgctccgggtgcaaagccagagaaagtcgttgaaaatattaagaacatgcgcttcctgtatgatcaagttcgtcaattgaaaatgctgccttgtccttaccatcggtattactatatgacggataacatgctcaaggaagaattagaggaagccaaaaacgaaggaactcgaggccaagtagtcaaacgtctggaagagagtctgttcgaactgtataaagatccgaatctggattacaaaccagaggaattatccaaacgcggtggtgcgcattacagcgatgcagcctgtgagatcattaattccatttataacaacaaaggcacattgatggtggttagtacacgtaacaatggtgcgattgatgatgttccttatgacagcgccatcgaggtgaccagtgttattcgcgcccatggtgccgaacctgtcaactttggcaaattcccacctgcacagcggggcttgctgcaagtaatgaaggcaatggaagagctgacgattgaagcggcggtcactggtgactatgcaacagcactgcaagccttcaccctgaatccgctcgtaccaagcggggacattgctcaaaccgtactggatgaattgctggaagcacacaaagagcatctgccgcagttctttgctcataaagagaaggcgacggtataaaaaggtaggtcgctatcatcctgctggaacacaaaaaagcttcctacatgtaggaagctttttgctatacgtcccaggagtacttgctgggacattggtgttattggtttgtacttggcttgacaatccgtcattaagcttattgataaatttgttagacttttttaaagtatgatctccgttgaaaaagcaataaccgctttccccgtaatttgaactaatacgggttttccctgttcctttttcacatgaacatgcattgttccctctcttttgattgcctcaccttgtaaaatatcaaaatcaaaagactgctcattctcattttgcaaaatgttgtagtgtaccaaataggctccaagcggtccgtttgcatttcctgtcaccgggtcttcagctattccaattgcaggagcaaacattcttccgtgaaccaatatatcctcttgtggatttaatgtaaaaacataatatccattacatccaatatgcttgctgatttctgtaagcttctgcaaatcaggttttaaactatgtagtatttcattggagtaaatcggaatcattaccttagaatgacctgttgaagatattgcaactggatattccatgcaaatatctttacaagaaatacctaacgcatttgcaatctgacttcttatttcatcatttaaaggctctgatacagaaggttctccctgtgtcattacaatagaatagtcatcttcatactttataacatcaacaggcaatatacctgcttttgttttttgaataattcttccagtttcagattttctctcaattgcataaatataatgcgctgctactgttgcatgaccacaaattggaacctctgttgttggagtaaaaaatcttacttcaacatcataatttgaagaatctgtttcaaaaataaatgcagtttccgaattatttaattctcttgcaattctctgcatctgctcatctgtaagtccatttgcatttggaacaaccccagcagggttaccatgaaatctattttttgtaaatgagtctacttgatatattctatattttttcataatttcgcctctataaatactagtttgtctgtctgttaaatctgatattaacatactttttaggcagtttcacttaaattacaagatataatatggcactttaatgaaagcgaactgatccttattatagaatcgcgctcttttatggaagattgttattaaactaaagccgcagttagctgaaatggtcttctcaatccttatctaaaaatggcaaaaatattttatgattatagatacttttagattctgccacgcctgttgagtaactcaattcataaaacaagaggtgtctgccatcaagccttattgatctatttcgaccccctgaaggggttgcccattttctgctcgtaaagcgacatgaagtttaatagctgcacgctctccgtgatatggaacccaatggatcgatagctaccccattgttccaacgcagccatgcaccagtattggagtaaatggtacaccgtaaacttgcgggctttgtcttcataacctattaacttcacaaccctttgaacttcttcaggagtcagcatggattgaagatagatgtaatcgtgatagaatttctcataagatagtcctctttcggattcgtttggatggtaataacgattctgaagaaaagacgatcctttttcttccatttcgtggttattcaacaggcgtgctacaatataggggtattagtttatatagcgtgtaaaaatcgtgtgtataatttgtgtaaacaggtgtattaatcacacctttttctaacgttttctatcgtaaacccccataaaataaaaaacgccccaaacccttatatatcaaggatttgaagcattttaaatttcgtccaaactttacatatctgaactcttcgacgtcccaggagggattcgaacccccgaccgacggcttagcttaccactatagttttcactacttatactaggcataccaagcgtttgagacgtattcaattcgtactaggggttcggtcaaattacgttctaagaccgaaagtatctttaatcaatacaataactctatttgatattttaatcaatacttatcatttcgttttcaaaatccactttccatacgtgtatcaggttcaatcattcttaatacccaaaacaccaatatatcgaaaaataccacctgtgtatccgttatataaacaacaactataacttttcttgaagaatagattttaataattcaattgctggttcatctgttggatcgtttgtacctagttcacctttgaaggcttttgagagaacagcagacttgatttcatcgacatttatattcaataattctttaacttgaatttccttattaaagaattcatctaataattctacaattttcaattgttcttttaaaggaggtaacggtaatagaaattcactaatcatagtagcacttaaattctcttgatttccacccttagcaatactcctaaatctattatacccctccataaaatagtaatataagtattcaggtgttatataaggagaaggtaataatgcacaaacagcttgattacatgttgcttcaatatctaaaatagctgctcgacctctggttaaaccttgtccatacatcgccactaataccgattttttgggcaaccatttagctgaacttttttctacacctaattgagtgatatgttcttctgcttctgaaattctattccatttaatttcacctgtttttatccatggtactttaccatctacataatattctttaaatgccttttttggtgtaccaccagaagttatttttaaaacatcacctaacttaacccatttccatgtagaaggtatagaatgtctaatatcagactcaagaatgtcaggattaattttcgctttaaaagtagcttctgatttcaattttttatatagaatatgtgcatcttctacaacttcattttttctaaatgaagttgtcaattcaccttttaatgctgcttctaaaacccctgcacgtctaagtccaaaagtttctttcgcttcatcaatcagttgtttagcttcatcaattttatcaaataaaattgaaattttatttgctattttttcttgctcatttttacttggtagcggaacttttaatgcacctaatattttggaatttgcacctggctgtgcaataccttttttagaaagcataatctgattccaatacacgtgggttttcatataattttctataaaagatgcattagccaatttattcaacctaatccgaattaaatatgaagcaaaaacagcattttccacttcttctatcctataacttttccctgtcgttgctcctgtcctagctactaaaatgtcatttttatccaacctatattttgcaaattcattttctttaatagcacaatagggaactttgctccaatcaacttgattatcttgaatgtctgtaatccttacaaattttggtcctattttttctaatgatgcactttcggtataaccatattgaatagattctgccaaagtatttagctctacccaaacccagccctcaggaagagcataaggttgttcatcctctgttactaaagtttcttccaataattcatctaaagtctttttcttcttactcacgacctttcacctctatcgctttcagttcagttacgacttcatttaataaattcatcgcttgttgcaacttatcaatagcttcttctgctgattcaattgggtctggtaagttgtcataagctgataacgattcatctgcaattaaaccaatatctaagttatcacctttagctgcaatcgcttcacgtgtaaatagattccatctttcatcttgcacttttgtacgttcttcagacatataagcttcgatgaaaccatcaaaatgcttttctgttaaaggtgtacgtttaccgaatgttggcatatttgtacgtaaatcatatacccaaacttcttttgtattgccttcatcttttgttccacgttcgaagaataggacatttgtttttacaccttgcgcataaaaaatccctgttggtaatcgaagaattgtgtgaagattacatttgttcatcaagtcttgacgaattttagcacctacaccatcttcaaataatacgttatcaggtaatacaacagctgcacgtcctgtaccatctgttacaagcgaattataaataagctgtaagaagtttaactgcttattagatgtttcaaatgttaagtcatcacgtgtagcacgttctccacctttttttgtaccgaatggtggatttgttaatacgacgttaaagttcttcatccatttaccatttgtagataaagtatctccttgctctaaacgcccttccatatcatgaagtaatgcgttcattaaggctaaacggtgggtatcttttacaagttccattcctgtgaaagcctctttcttttggaactcagcctcttctggtgaaagatcaaaataatcatcagttttttcttttaagtaacggtctgctgcgatcatgaaaccaaatgtaccagctgctgggtcattgcatcgctcacctactttaggatcaatcagttttaccattacatcaattaatacacgtggtgtgaagtattgtcctgcacctgattttttctcactcgcatttttttcaagtaagccctcgtataaatcgcctaaaccttcttcttttgcgttgtaccaatctaactcattaattgatttcagcaatttctcgaggttttttggctcatcaatacttgttgatgcaccgctgtaaatttgacgtaaacgttcatttttaacttcactttttccaagctctaatagtaactcttgataaaactcttttaattcaattccttctttcgaaagtaaatcatcccaacggtaaccttctgggataacctcttccatttcttgctctttcatcatttttaaaaataagatatatgttagttcagttacatattgctgatatgtaatcccatcatcacgtaatacatttgctaagccccaaagttttgagacgatttctgtgttattcatgttcttcctccatgtttcctttaatctttgtacattataacctttttaggttaatcgctctattagaactatcaaaaaaggagttccaacgtaagaactccttcacatattattcaataattgtcttttctgtaaaaataatctataatttgccacagctttttaactagcatataaactctcattaattaacttcacaatttgatcgacttcttcacctagttctttcttcaaacgattatatccgccctgacttttaaatggctcttctgaaaaagcatcttgtggattcggtgaaagaacaggcatttcaatgagttgcttctcaattcgttctagccatttacgctgtctcggtgtccaatcatgcatagaatatacttttttcattgcatttttcacacgtgattcagtagacactaaagcttcacctaatgctgcttgacgaatgaaactaataatatcagctgcaatttcttcattcttcgcttgtttccatgctgtttgtaaatgatcttgcttaaagtgctttgttgctaaaataacttcaatttcacgtaagtctttacgagttaagtctttcggtcgtgtacacacaatttgaagtgcagggatttcattcatattttctcgaatgaactgtacaaaaccatctaaataatcggttggtcgctcgttaccttccccgtacccacgttttacatccgtcacttcatcttcatgatttgcaatgacttgtagctctttcttcgttttatatgtcgctacataatcaaacaatacgctatgattctgtgcttgctcaggtgtgtaggtttgtaattctttcgcccattcatctactgttacaccttttgaaagttgctcaaattgtcgttttgcctcattattgaatgtttgtttcttacgttgcacctttgccactaattgatctaaaaagtgctgtgcctcatcttgcgtctctgcttgtataaaggattcatgcagctctgctattgttaccttttgctgcttcacaacaggcttcatatctgtatattgctgtaactgattatagattcccaccgcatcaaaaatacggaaatgagatttctcaatctctggacataaacgagtagcacgccctaacatttgatcgtatagaatacgtgactttatacggcgtaagaaaacaatgtttgtaatcttcggtacatcaatacctgtcgttagtaaatcgactgttacgacaatatttggtaagcgttcatttttgaaacgtttaatcatttcattgggatgataaatagaacctgtaattttcacaattgcatcatctgatacatcatcaccgttttccgcaaatgcttctttaagtaaacgaacgattaaatcagcgtgttgatctgttgctgcaaaaattaatgttttttcttcgctttctggatcaatataatcaattaatttcgttaaaactgctcggttaaagccttctgtaatcactcgtttattaaaatgctctacttcaaatttcagttcatcttctagccgctctaaaatgatttcgccttcttctggatcataaacctctacttcttcgcctttctcaaacgaaataccatgctgttgtaattccgtttcaaataaataaggtggctcatggtcgactaaatagccatctaaaaccgcttctgtataagaatatttataaataggtgaaccaaaaatttctgtcgtatgaagtgctggcgtagctgtcagaccaagcactgccgcatcgaaataatcaataactctgcggtattggcttacataatcattttgatctcggaatagtagctcatcatctgtcatttctcggtcacttgtataacctcggtgtgcttcatcgacaataataaaatcatattgcccaacagaaggtaattgctcttgatcgctatagaataagcgtcttactatgccttgaactgttgcaatttgcacctttgtttccacatctggtgtcatatcttcaagtgatttcacatcataaatcgatgaaaacggtaaaccattttccatcttagaatcttttaaagcatctgccgtttgttgacctagtgaattacgatcgactaaaaataatattcgacgacatttcttcgctttaattaaacgatacataagagcgattgctgtacgtgttttccctgtacctgttgccattgcaacaagcatttttctagctccttgcattaatgcttcttctgctgctaataccgctttttgttggtagtcacgtaaaccaaacttcgtaacatcctcgttttttaagctttcatttgcttgtctatcatccacgtctaatagcatctttaaatctgatggtgagtgccaaccttctaaagcatgagatcgcttcgtttgattacgtgcatcccaaaaccaaatacccgattgatcttcaagctgtcttaaatacggtctaccattagaagcaaaaataaacggcactttatattctccattttgtggcaataattcaataccttctattgcttgtacttcacgtgcatatacttttgcttggctttcaagtgctgatggaatatcacgatgctttgcttttgcttcgacaataccgaccaattgcagcccaatgaataaagcataatccgcatatttcgaaccaactttccattctgctatcgccatatttttatttttttcgggcatcgttttatgtttcttttgattatatttttctgtatcaacaagccagccagctgcacgtaatttatcatcaattaaaatacgtgtttgagcttctgataaacgatgcttttgaatatgtagctttgatttttctttacgtcttacacgtacatcttttgtaatttcatcctttgtaattgtatcaagctgcgttagaagttctttttcctttttagcaatttcttcttctaaagcttgcaccttcaattgaagctccttagaactctcttctctctctggctctctatatgtaggtgcgacaaactcccaatcaatatatacttccataaaccaaatcgagatttgatacgctaatgctagtaactgttttgcttcttctgtcgtaccataggatgcttcatgagaagcggtattcccttttctgcgtaacgtgtggaatatatctaacatttctggctctgctaatccttcttttttcattgtatttaaacggtctacttgccttgtatcatacgcttcacgaatgttatcagatgctaaaacagcttttgcaattgattcacctaataaacgtaatttcataatggaagtatgcggatcattatataaattatgctcggcactttctccaagcttcgctaatacttcccattctcctttaaaaaaagaaaagttactcattatcatcatccaccacttttctaagtatttgatctaattgtagtataataggaattattggactaggagaacaaacatttcaataaagcttatcgtttcgaaattttagtcgtggtatgtgttcagagcgagtctgtaaaatatattgtgaaaactctcaaacccattaaaatggaagtaagggaaggttagagaaacacataggactttggtcaaaggagcaacttcggaaatttattaaggtgaacaaacttaatcactacacaagatatcgaacgtaactggcatcgaagagcaaatcattgctctgtatgccaaaggcatcagtaccaaagaaattcaggatcatttaggacagatgtatggtattgaagtgtctcctacgcttatttccaatgttacaaataagattgtcgctttcattaaagaatggcagaatcggcctcttcaaggtgtttatgcagtcgtctatctggatgccacccacttcaaggtcaaacaagacggggccatgatcaacaaggccgcctacatggtcattggcatcgatttggacggagacaaggatgtgctaggcatgtgaattggtgagaatgagtcctcagttctggctgagtgtgctgaatgaactcaagaatcgtggagttcaagacattctcattatctgcgtggataacttgttcgggttctctcaggcaattgcagtctgctatccccaaactgaaatccaaaagtgtgtcattcaccaaatccgtagctccactcggtagtttcgtacaaggatattaagaaagtaactgccgacttaaagcccatttacaaggcagctaccgaagaaggcgccttacttgaactcgaccgttttgagcaggtctgtggagccaaatatccccttattatccgttcttggcgaacccattgggatgagctcgctaccttttttaaaaacccgctagagattcgcagactcatctacaccaccaataggattgaaagttaccatcgccaacttcttaaggtgacgaaaggaagaagcatccttcctaccgatgaagccttacttaagatgctctatctggctaccatcgacgtcactcgaaaatggacaggtcgtgtccaaaactgaggccaaatgttgctccagatgtcggtcttttttctcgatcgggtcggtcaacacttgcgaaaaatcgctacttccccctcgggggaatctgtgcctaaaagagttttcacaaaatttttgacagaccctccttttcagagaatctgtcccacttagcttgacaatccgtaatataaaaaaaagggattctgcatcagtgaccgaagccctgaccgaagccctaatttctcacaaatccatttatatcaacggtttgtgactgatttaattacgtcccaggagggattcgaacccccgaccgacggcttagaaggccgttgctctatccagctgagctactgggacaagatgctgatcaataaaaccttatgtattcagcgcattgattattatatcacatttcgagcaactgtcaaaagcattttttcatgatatagcgaagtgggctgcaaaaggaatcatttggacgctaacggggtattatgtacaaagaaccatgcataaaggaggggttaatctgtgagaggtcttttgtcgtcactttgttatttcagcattttcttcgcaccttttctagtgcctgtcattgtgtggattgcagtacgggacgaatatgttcagggacatgcaaaaaaagctattttatcgcatattttccccattattgcggcaattccgctcgtgtattttattattacggcgaatcatgcaggttcagtgatcggttttgtactgctattcgtagtggtctatctcggggtttttgtttataacatctacaaagggattatgacgctgcgtgaagcggcttagttcaaaaagaagcctcctacataccgctaatttggcgggatacggaggcttctttagggtcatttttgatgagttgctgttgctatttggttcaatggctgcttatttattcccaaagcgtttaggacttctccgtacttcatgtcttacgtttttctccagcacttcttccgcgaactcattgttatgaatataactgctgcctttgtttttcttataattcgctttgccgtctatgatttccccctcctttcacgctgatccggcgatggcgccggggcccaaatcaacaaaagccgaggcatagcacaccatatcctcatgccccgaactccttggcgaactctgtgctgagctgcccataggagagcaattcttttttaaacttctctcgctcctcaccagcagtaatgtgtgtagagtcggtaaaagccttgtctgtcacttcctcaaatgccgaatgcagattattgtcgtaccaatccagctccagatcggcgtcattgcggatgatccgtaccatgtcatagtcatgctgaccatccgtctgatccttggccgtgatatagaccagcagttccgggtcatctgcggcaccgggccgcacctctacctcagcgcagcgcactccgtcaagttcagtgaaccggcgtattttggcatccttgatgtagtacatggtctccctccttccttgcgagtagacgggttgccccatctgtagttttcggaacggacagacattttatgcttcttttcggcatatatactgatgaactggggatttagtttttgattcattccaacactggatgaacacgacaaagagaggatgaacagacatgtgcggaattacaggtttcatacagtggaacggagacttaatgcatcaatctgagctgctgctgaatatgacacaaacgctctccgatcgcggaccggatgctgcgggtacctggatatccaacccgtgtgccttcggacaccgaagattgagtgttatggacccggaaaatggtgctcagcccatgatccggcagctggaggatatcacttatacgattgtatataacggggaaatatataacgcgcctgagctgaaaaaagagctgcaacagcgcgggcattttttccgtacacaatgcgacacggaggtgctgctcgaatcctatatcgaatggggccctgaatgtgtggatcggttaaacggcatttttgcgtttgcggtctgggatagcgagcgggagcaggtatttctggcacgggatcggctgggagtgaagccgctattttatagccaaaccgaagaagtattcgtatttggctcagaacccaaagcactgctccagcatccagcggtagaggcagcagtggacgccgagggattggccgaaatttttatcatcgggcctgcacgtacccccggacacggcgtctattcgtctatgaaggagctacgccccgggcatacgttaacctacagccgcgacggcgtgcgcatccatgcctactggacactggaaagcattgcgcatgaggataacaccgaagaaacggcacttaaggtacgagaactgttgctggatacggtggagcggcagctcatttcggatgttccagtgtgcaccttattgtctggcgggctggattcaagcgctctatccgcattagctgtcgattattacaaacgtaccgggcagggacaagttcatacgtattcggtcgattatgtggataacgacaagcattttaaagcccatgcgtttcaacccggagccgatgccccctggattcagcggatggtggatgaattagggacaaatcatcactggattgaattcgatacgccagaagtcgtagcagctctgaacaactccacgctaacgcgggatttacccggaatggcggacgtggattcgtcgctatatctcttttgccgggagattaaaaaaggagctacggtcgctatttccggcgaggctgcggatgaagtttttggcggatatccttggttccaccgggaggatatgctgaattcgggtacattcccgtgggcagttgcacccgatatgagagccagtctgttgtctcctgaggtacgggactggatcaagccgctggagtatttgaacgatcgctactctgaagcggtaggagaagtgccgaagctaccaggggaaacaggaaaagctgcgcaaatgcgcgtcatgtcctatttgaacatcacccgctttatgcctactctactggatcgcaaggatcggatgagtatgggagccggactggaagtgcgggtgccgtattgcgatcatcgattggtacaatatgtatggaacattccgtggagtatcaagatgacaggcggacgtgaaaaaggtattttgcgcaaggcgctggagggcgtactgccggatgatgtgctgtatcgcaaaaaaagcccatatcccaaaacgcataacccttcctatcttgaggctgtgaaaaagcaagcgctgcagctactggatgattcctcttccccactgctcaagctgatcgatgcgcaaaaggtacgtgatattgccgcctcaccggaggcatccaccaatctgccttggtttggtcagctgatgtcgggtccccagttgttcgcctacttggctcaagtggataactggttgcgcacttacaaggttgctattcgataagctacgctgaatgctgaagcaatagagcttctaagcggcagcggcaatttttcgctgtgtactatatggggaacagaaagtaccaaaaaggctatccgcagcttatgactgacggatagcctttttttcgttatgtgaatgggggatgatttcgcccctgttaccaatgctatgcctgtggattacccagttttgttgccaaatcacgcagagctatccctcggtgactgatagcctgcttttgttccaacgtcagctcggccattgtcttttcaaactctggcaaataaaacagcggatcatacccaaacccgccgctgccggcggtttcagtagtaatccagccctccacagagcctgtcgattccaacgtctcgccagtctgcggattatatagaatcaaggtacagacgaattgagccgggcttagcaaaggctgtcccgtatcatcacccagctgcttcgattctagaacgtcgagcagcttaatattgttttcgtgatcgctggcaccttctccagcataacgggcagagtatacccccggtgcaccgtccagcaagtccacgcagaggccggaatcatcggccagtacgggcaaaccgagcacatctccaaccgctttagcctttttcagtgcattttcggcaaaggttttaccatcttcaacgacatcaggaatgtcgggataatcgtacatgcttctgacttccttgccaaacggcgcaaaagcatgcgcaaattcccgcacctttcctttatttttcgtagcgacaatgacgaccgggccatccagccgcattaggcgccagctcctgtacgtccagcaccgatcttatcagcaatcggtccaagcacttctttttggcgctcaatcatttgcagaatcccttgttcgcctaagctaagcagttgatccaattcgttacggtcaaatgggctttcttcacctgtaccttgcagctcaacatattttccactgccagtcatgacaagattcatgtctactttggccttggaatcctcttcatagttcagatccagcaacgctttttcaccaacaacccctacgctgacggaagccagaaaatcggtaattggaaaaacaggcagcttgtgctgggtggcaattttattgaccgcaatcgccaacgctacgaaagaaccggtaattgaggttgtgcgtgttccaccgtccgcttgaatgacgtcacagtccaacgtaatcgtccgttcaccaagcgcctgcaaattgaccaccgaacgcaacgctcttccaatcagacgctgaatttccatggtgcggcctgtcagcttgccacgcgcagcttcacgctgattacggctatgagtcgcacgcggaagcatggaatactctgcggtcacccagccctttccttgtcccttcataaaggggggtacgcgttcttctacagtagccgtgcaaatgactttcgtctcgccaacctctataaaaacagagccctccgcgtatttatttactcctgctgtcaatttcatcgggcgcagctcatcaccgtttcgtccgttagatctactcatgctttttcctcctacgtcgtatgcaacctgttcttatatgtttattttaccaaagtgtgcaggcaaaagcaccccaaggacgattcccgcccttaaagagggatttcgttaatatgttgcggcttggctacaggctctccataattttgattattttgtccaattacgcttttttcaccattcagttcaatccgaatttttgttttgaccgcatcatctgaattgtctgccgctgtcagcacaaccgattccaaaaattcagcaggcacagcttctcctttagcaaacatatcatctgagagagataccgtaattacgttgtctttggaacgttctaccgatttcagcgccgtctcccctgtcatcacttcttgtaacccatctttggtctgcggcccttgaatcaattgatgcagtgctgactggacacgatctttctcagggctaaccaaccgtgttacaggtacatagtattgaactccagcaggagaagaagaagagaaatacacagtgactggactggaatccaggggtgtcacgccatgaccaatttccaaattaatacctactgcacgcgtcaatggatgatccagcggtgtgccgccaacaggcatttcgttcagctttttgccctccacccagatctgtacgctctcaatatcaggacggtcggttagggtccaagtcaagctctccattaattttcgttcttcctgtggcttatagttggcgaaagatttgttgaattcgacaacagccagcttgttgttcttgtccactgtcacactttttacttctgtaccctggggtatgacccctttaaatccctctggtaataatccagcatacggcccgccctcgaccaatgtttccagcgctgacttggcatctgcctgcacatcgcctgtagcaatcggtaaagataccggggccagcaaaccgttatgatcttgcaaaaaaacagccctcagttgacctgtactggcaggtgcttttccggttacagccttaatcatggactgctctgtcgtggacggcggggggtcaatagatgctgattcgtcgccgaaaaggctgcagcctgacaacaacaggggtagggatagcagtccagctacagaggtcatacgccatgggtgttttatattcataagtgaagttcctccctaacaattttgtacagattgtactaatatgtatacgagcctcgcgtaaaaaataactactttttcagcagactggacacactggtcataattgcagtagaaatcaggatctatacgaggagggaatttcaactttatggacaagaaaaaagcaccatacagcctgaatagtaaaaaggtagccgatgccacccgcgagttgctgcacaagcgtggtgtacacctgactgaaatcgcagaactggtcatgcttttacaaaaaaaatattacccgaccctaacgatggaagaatgtattgagaatgtggacaaggtgctgatgaagcgcgaggttcaaaatgcagtgctcacgggcatccaactggatatccttgccgaacagggcgctcttcttcccccattgcaggacatgattgagaatgatgagggattatacggagtggacgagattctggccttctccatcgtaaatgtgtacggcagcattggatttaccaattacggttatgttgataaactcaaacccggtgtgctggaacgcctgaatgataaaagccttgggccgatccatacgttcctggacgacatcgtgggcgctatcgcagcttcggccagcagccgtatcgcccatcgcaaacaggcagaacgcgagcaggagcttggggaagaaagtgcaccgaatacaacccgttaaaaaaacaataacaccctaaattataaacaacacgttagaatataacagatatagacaagcttagaggagaactagacatggcaaacgtaactgaaggatatacattccgtacgatgcaggctgacgattatgatcaggccattgagctttggaatggcttagacggattaggattaagcgaggctgactcaccggagcggattgcacgctttttacaacggaacgaaggacttagctttgtctgtgagtacaatggaaacattataggcacgattttagcgggtcacgattctcgcagggggtttttgtatcatctgggtgtagccacagcacatcgtggtcaagggatcgcgcccagactggtggataaggcgttatctgctttgctgagagaaggcattgataaatgtcatctgtttgtaatggagcataacgcagggggtcaacgcttctggtcagctaacggctgggagaaacgggatggaattttactatattcccgagggcttgaatagggtctaagtgcttgatctatacaaataggaacgccgggtctgattcaagtcgagttagaaacgatcagacccggtgcataaaactcacaacatattgattagcaatcctgacatttcaagcccagattaccttcattcataaattacaatccattttttggacgcagtgcacgttctacaattcccagcgtggattgacgagagaataaccgggatacctgagctacccaatagttctggcgaccggaaatgatgtgactacgccccttttcaaatgctctcaacgcgttcttcacaacggtttggggagtttccctaattccaactgacgcttcacttgcgccaacaatatcaaaaaaaggcgtttctgttgagcctggacaaagggccagaactttaagcccccgtttccgattttcggcccatagcgcttcagtaaaagaaagcacaaatgctttggttgccccatacaccgccatataaggatcgggctgaaatgcagctgtggaagaaacattgattaatccaccatcccgcttacgcaataaatcaggcataaatgcatgtgtgatgtcgactaaagcagccacattgagcatcacttcctcatgctgtcgttctcctgaaacctgctcaaagtatccataggtggcaaaaccggcgttgttaatcaagagatctacctttagctgttgcttttgaacctcctgatgcaatgcttgtggtgctcctggtgtggaaagatccatcgcaatcaccgttgcttttacgttatatttagctgagagttctttagccagcgtctctaatttggtttcattgcgtgctaccaaaatgagattacatttcttagctgcgagcgaataggcaaaggcctcgccaatccctgatgaagcccctgtgatcagagctgttttgtttgcgtacataaacatgatgataacctccatagtaccatagttttattttagaaacattgttaccactactctataatgaactgaagtcatctactttgacgacctcagtacacttcatatttacgatggggatgaggatgttttaaatgctacgagcgtattcttcagtgtaaatgtatacactccttgagctatatctacatctgaaaaatgacctgcaaactgaagatgtatgactccatgtaaagcagaccacagcattcggacaaccaacagcggatcttcctctttcagtgcccctatctccatagcatgtgtgacggtgtgcagaattcgtgacaatgccgttgtggtaccctccaagctctgttcatccggcttgaaatcagataatgcaccgccaaacatcattttgtaataagctgaatgaagctgcgcaaattcccagtacgcccagcatagagcttcaagatcagcgagtacgctttcggtaacaggtacttgctggaaggattcagccaatagccgacatccatccaggtacatctcattggcaagaccgtccttactgccaaaaatactgtaaatgatcttggtggaacagcttaatttctgcgcaactcgccgcacggtcacggcctctggcccttcttccgcaagaaggatgcatgccgcatcgatgacatttttacgtagcaattgctgctgctgtagcttcacttccgaataggttttatagggatgcgatggctcggacatgattcaatacacttccttttgcttattaagaactgtcgcttgatgctactataataaattaaagatctacacaagattttaggaaacagtgtttccgttaagaatcatagtattctaagcttgagtatttgtcaaatgaaaaaaagaacgcaatgagtaggtacacttaccgcgctctggttgaatacttaaaaatgaagctatttttgcgttctatgattagtaggcaatgcctacccgtgtacggataaattcgtaactcttgcattgacgataggtaaaatcagccgtatccgcggtggtaatttgtgagccaccttcaggcaaaaaatctttttccacacgataaatccctgtatgctctccatctggcagataggttggacatacgattgtccagtctagtgctgattcacgcagcaattcgtacactcgccgatgttcctcggccgcacgagtgctgcgtcgccgggtctcggaggactcgtaccgatacaggtccggttcggtccggctttgtaaaattcctgccgttcctaccgtaatgagccgggaaatggactgctcctgcatgagccggatcagcagggctatattagcggataaggtagtcgttccatccgtattcagcgcactgatcacagccgtcgccccacccttcagcgcttgtgctacgtcctctgcattagtggcatcgccttgtacgatttgcagctgattcccgtatccgggtgcgtaatcctccagcttgtccggtgaacgaacaaggaccgtaacggcatggccgtccgctaatgcataatctaatatgtaccgtcctacgcgtccggtagctcccagcagcagcaaattcataaaatcctcttttccggcatgcatgccgcttgtcatgttgctcttgtcatgtcactttgttggttgactttccgcgactattgacggcaaaggggatagaagcgcgtgattgagtccgtctcgctcatagaggcccgttcacggcgcaccagttccaccagatgagccagcgtctcggacatggcaaaccttagctggtgaatacccagcttgccaccgaacatggccatgcacagctcataggctgtgctgccctccggttggatcagctgctgaaatttctccagccgttcttcatgatgcgccagcaacgcttgcgtccgctcccgaaaataaccaaacggattgcggtgccccggatatgcccacgctacctccagctcgcctagacgctgcaagccgtctacataagacttcaacggctgggcatcactgtctggcagcagactgatattaggagaaatctgcggcaaaactgcgtcaccgcagaggataacgccgctattcgggtcatataaggacacatgtccgggcgcatgtcctcctgtctcgacggggagccaactgcgttcaccccattccagacgagcgtccatcccggtaggaataacggtaatttcaggctgtggatttacttgcaaatatgcctgccgcatatgtaattccaaggccgacacttgctccaaaggaaagccatgctggacaaaaaagctgggaagcctgttctccatagcgaccgtcgactctggagcgtcccacatcatcatcgcttccttatggcttcgagctgacatatgtacacgagcctgactttgctgctgcatccagcccgccaatccgtaatgatcggggtgatgatgagtcaccacaatgtcagagatatccccaaaagacatccccagctgttggaagacatgcgcccattctgcctcagtgtccatattgcgcggccccgggtctacaatcgtaaaaccgtgctgtcccttgagcacatagctattcacccagcgcagcggaaaggacatggatattttgacctgaaagcctccgtctattcgctcacacggtgtaagctctggcaatttcatggcttccatccgcctttctgttttaagcccgcacgccgacaaaaatcattcgaggcgaagcatcttcaatatattgatcttcattatagcttccgtgtacctgctctacagatagtccggcttgctctagcaatccacgaaacttttcatatggatatagcttcactcgttcatgatacacacgcgcaggttctccctcagtaggagtcgtgcccagagcagaggctacctcagtgcccgcaacggatgcagctgaccgaatcgcaatttgttttttcacaaagccatcttcaatgacccgatgctcctcaatccaattcccttcatcctcccgtgacgaatgcggtaccaaatgagcggttacataagcagggttcaaataatctatgataaagcgtcctcccggcttcaacagccgatatatttcctttaatactttaagctgctcctcatccttttcaaaataaccaaaggaggtgaacaaattcatcaccgcgtcatagttttcatccagcggcacctctctcatatccccttgatgccaacttacccgcccttcggaatcagctgcacgagcctctctcagcagcacattggaaaggtctacacctgtcaccttataacctgcatctgcgagcgcaagcgaatgacggcccatcccacagcataaatccaatacgctggagccttgcggtaatttgagccaggagatcattttttgcacttcctgataggctccctgaaagtcgcgatgcttgtataccaataaataatcttccccaaagctttgctcgtaccattctgccatatcgtttctcctccatgaactcatttcgctctattacatactatattagctttttcaaactggaaactcaaaagcattacgaataagagttttacaaaaaatcctgaacaacaaacatgttacaataatcgttatttgaatccatttcataataccttcagtagctttaataaagagtacatatagatcaaaatggtttaatcatttatgaaatggattcatttgagcttaaatattcataggaacttcataccaacttcatgtgattcaccccattttatcattaaaatgattcatgggaacgcctttagaaggattcataagagaaaggagcggggaagttatgattcaaattggacttacgggttggggcgatcatgatgacttgtatccaaccggcaccaaagctaaccaaaaactaagcgtctatggaagccattttccggtagtagagatggatagttctttctatgcggtgcagcccacagatcgtatggcacgctgggcggcggaaacccctgactctttttcatttctcgtcaaagcctatcaaggcatgactggacatacccgcggcaagcagccttacttcaaaacaatagatgccatgtacgaagcactgcatgcatctatacagcctcttcgcgaagcgggcaagctcaaagccgtgctgtttcagtacccaccctggttcgactgtacacgtgagaatgtcgctgtattgagagacacgaaaaaaaggatggaagaggtcccatccgtacttgaattcagacatcaaagctggttcacacccgattttcggaaacaaacgctggcattcatccgtgaagaaggctggatacacagcgtatgcgacgagccgcaggcgggaccggggtcggttcctattgtgccgttggctacagacggcaatctgacaatcgtacgtctccacggacggaacatatcgggctggaatcaaagatccgcgcctaattggcgggaggttcgttatctgtatcgatacaatacacaagagttgaccgaatggagagacagattgctggagctggagcagcaaagccgtgaggtgtgtgttattttcaataacaattcaggtggagacgccgctgctaacgccaggcagctcatgaccatgcttggcatggaccctaaaccttttccccttcgcaagccacccgaagaggataacggaccggaacagcttgaactattttgaggaacgggctgagggtggggagttgcaaatagcctccttgagcttgcgtgcattatccagtaaatgcgggtcgtcgggtaaatagcgtaaagcggtttggttatgctcatacgaagcgtccagctgacctacatgggcatagcaatggctaagccgcacatgaggtaaccaggagtagcatggtagtgaaacaggtcgcatacccggaaggtgatgctgttgctctaatgccttttcataccagtatgcggcggtggtccattcgtttcgtgtgaaaaaccagtcaccgatcatgcagcacaagtctgattgcggtacaccgtatcgaaaggagcgtaacagattatccagctgttgctccggcttcccgaggtgaagatagcattccgccgaccgcgcacaagcggtaatccgatcctcacggtagccgcttggctcctctaacagatggttgaacgcctctgccgcctcggcatattctttacggtcaaaacattcattggcgtgcaaatacagcagacgcccctccagcttgccgctttcgctgatccaccgggcgagaatacgttggttacggagcgtgtggtcttgcattcggcggtgagttactgccacatccgaatgcacgatttgcccctgaggtatcaccagatcctcatgcagacgcccttcccagcggtattgtcgctcacgcttcacgagacggatacggcgtgaggtgaacaacagttcaccctgctccccctctgccagatgaagtggcattaccactgcgtcgatatccatagacaaacgctgcttcaaggcacgcaggcgctcacggtccggctccagcagcacatcgtccgcatccagccacatgatgtaggaacacgtcgccttgtcaaacgattcattacgggcggctgcaaaatcatccctccatacaaacgtgtatagccgatccgtatagcgggctgcaatcgtcttcgtctgatccgtcgatcccgtgtccacaatgatgatttcatccatcaggtctgcgaccgaatccagacagcgggccagtgtctgctcctcattttttacgatcatacacaagctgatagtcgttggatgctcaatcatgacttcacgtcatcccctttacctttggctgattctgccgtcgcttttccggtagactcgccatcagtatatgcacctctcctttcagcctgcgtcttgtctagctgttcgacacgtgcatacctgtgcaacggcaaaagttgttcctccatatgccggattcgctgtaccgccttgtcgagtgcggcctttcgctgattcattttgcgaacatgctgctgctccaccagtcgaaattgctcctcgtccagtttcatccattcattcagatgctctacccctggtttggcctcacgcagttctttcgacttcttgcggccggcaaagcacaaatatttgtgatgcacctccagcgcttgttcatcaaaataaggatacaacacacgggagaggctcccggcatagtaagtccgcttgtgatcatgaaacggatggtatccataaggtacagacaagacgagcgttccctttttattcaacaagcgataagcatgagccagcagggtgtggggatgcgcaaaatgttccaaaatctcccctaaaataatggtgtcaaatccaccgggaggacgctcgaattgtgaaatgtcctttaactgaaagtggactcttccccggacgggtgcggattcctggcgaagttcttttttcgcataagaaatgctgccctcttccaaatcaatggctgttaccttaaatccttcccgcccaagcaaaatggacgttatgccctgactgcacccaacatccagcacagtatggccctgtacatggcggcaaatccagtgaattctattgcgagtggcttcatgggactcttccgaattgatttgcccgtaataacgttcatttacctgatcacggttagccaacagcggcgccccctccatcaccgggatgccccaagatgacgacatgtccacctgtacaatgtgcagtcgcattacgtgtatcgaagaccagcggggcatggtcgaccagctgttggtaatccaccacagaatggtctgtcgtgatgactacgatatctgcactttcccataactgggcatttgccgttcgagaggagattgcttcaccgttcagtttaaagctcgatacatatgggtcagtgaagctcaccgaagctcccatttttattagatgttcaaacaggacaagagctggggattcccgaacatcatcaatgtcctttttgtaggccacacctgccagaataattttggctttgtttatggctttacctttctgagcgagcatggcttcaattcgctccgcgatatacagcggcatacgccggttcatgcgatctgccaagtccacgaattccagtggaaaaccatgctgctcggatttccatgacaagtatagcggatcaaccgggatacagtgccccccgatcccaggtcccggataaaaaggcatataaccgaatggcttggttgccgccgcatccagtacctcccatatattgatgccaattttctcacaggcggctgtcagctcattaaccattccaatgttgacgctgcggaatgtattctcgaacagcttggcggcttccgccacggttgtcgagctgactggtacaatctggtccaaaaaggacccataaaaacctactcccgccgccagacaatccggtgtgcaaccgccgatcaccttgggtgtgttgcgaatgttaaaatgaacgctgcccggatcaacacgctccggtgaaaagcacacataaaaatccttacctactgtccagcccctgcgctgctctatcaccggccgaatcagttcctcggtcgttcccggataggtggtgctttccagaatcaacagtgtttgtctacgcaaatgaggtatggcctgatcaatagccgtttcaatataggacgtatccggctggtgtccgtccgtcagtggcgtaggcacgcagatcacaacgacatccgcatgctccagcaccttgatatccgtaaccggatgcaattgctgcccgatcagaccttccaatgcatcatcgccaatgtctatgatgtacgactttccttgaaggagcttggctactttgacgggatcggaatctacaccatatacatcataaccagcctttgccatttccactgccatgggcagccctacataaccgaggccgatgaccgcaacctttacagttcctttagttattttctccataagctgcaaaatacccacctctttcatcgttactccatgcctctcaatagctcagcaattccagcgcggttcatcaactcatcgtccgagcgatattgatcgaagctcactcgttccaatccaccatattggctcagtaagcgttcgtctgcttgctggggaagaataacaaaataacgatcatcatagcgatacgtgtgcggcacctcatagggcgaaatcagcacctcatgcagcttttctccaccacgtataccaatctccttcactttcaacgcaggctgccccgcctgttctttcatcacttctgccagatctgcaatattgcagcccttcattttcatcacaagtgtctctcccccaatcgccgtgacagaagccttcagcagcaagccaatcgcctctccgagcgtgaggaaaaagcgtgtcatatctggactcgtcagcgttaaatcctgcccttccgcgatctggcgcttgaacaggggcacgacacttccacttgttccgagcacgttgccgccacgaatacacacaaagcgagtacgctcacttaaagtgttggcgcggatcatcagtctttcacctatcgccttcgtcatgccatatacattcaccgggtctaccgccttgtctgtagagacatcaattaccttggcgactccctgttcaatactggcccggatcacattttccgtaccgtgtacgttcgtcttgaaagcctcttccggctgtctctcacacacggggacatgctttaatgccgccaaatggaaaacatagtccactccgcgacatgcctcctgcaatgcctgaagatctcgaatatctccaataatgaaattcaggcgcggatcagattgaaattgccgctgcatggcaatctgtgcaaattcaccgcgtgagaaaatgcgaatttccgtcggtccctcctttagcaattcagcagttaggcgttgcccccaagatcctgttcctccggtcaccagcagtttttttcctttgaacaatataatctcctcctgaccgttatgaattggcaatgcctgttcccagaaattcagccagcacagcattcatttcattctctgacagccgatccttctctggcacttttttcaccgaagtattggcggcatgaatgacgttcacatagttgcgaagcggaatgacctcatgcggcagctccgttacatatccgtgcgtacccttcccaggtatgacgacacggtaatcatttagaaaatcctccacttgatagcgaaacacataaaaagaaggcgaacggtgaaacaccggtgccatctgcccctcaacggcatcccacaggtaacccatctggttcaccaacgcaaccgtctccggttgaaacttgtaatcatgcaactgttgtacaaatgactggtgatacaaatcgtcagaatcaattcgagcaatgagcagttcgtccgcgtcttcgatatacgcattgatacgacgtttactttcgatgctcgtaccaaaacgaatatggtcgggaatgggctcatgcttggccagctcctcttccacaatgtcactgcatccgcccgccagcttgacgacagataagaaatccgtatttgtctgactgagtaaactacgcagcgtaaaggttctgaatatatccagtcgctcactgatccactcacgtgtcaggcggttggggttcatcccatagttattaaaattaatttcaattacaatcttgcgattcattgatcttcctccctttcaaccgtcttctctcaagttatgaagacgcttttgaaacggcacgtacagatgcaacgaatcttgtaaaaataggtagaatccaaaaagaatagccgttcatacaaaaaccttttcgctttcgacatatgatagattacaaagttttttactccatctgaaaagttgaacaagcagggaacgacagggaggtaacatgatatgacgaatccaaggtatctggagattgacgaggtactgaaacgattgaagctggcactcgatcagcaccagtccttttcgctcattcgtattggggatggtgaaaatttggtgttgtcgcaggacaccgtctggccgatggaaaaggtattacaggaacgttgggcggtcaaagccaatctcggtcaaaagggactgtttctaccgaatacggaactacgggacgcggtggctgaggcagtgagcaaagccagcattgctggcattttgccatatgatgacgaatctattaaagcaccatcctatatgaagcgggagctgaccgatcaggtttttgctcactatgctctttcccccgcgctgacttgccatgcctgcctgaatcggtatttggctgagacacccgctttctgggacatgctgaaaaatcgacgcattctgctagtcacccgagcggctgctgaagtaaagcctgttcttgaggccgatccgtacaagctgcatatcgcccacacgctggcatttcatcaatatgaacaaatgcccgaaacactccaatggatcgcagcacataaagatgactttgatattgcgctgttctcttgtggtgtcaatgcagtcgtgttagcacaaaaaacagcagagttaactggcaaaataggtatagacttcggcaaggcgattaatatcgtcatgtttggcaaagctaattaatagataaaataatatttgtgaaaaaatccacttagcaagtaatctttgctccgtatatcaaagaagcaccagcaaaattcaatgggctggtgcttctttgatatcatatgttgttctaaagtccgtgatcgaaaagaataatctatataaagccttggacccttgcttgtttagaaatagaatttgagattccctgtcacttcttttacaatattacagaaactagcattcatcatttatatatcatgaggagggtgttgaaatgtcacataacaagagattgaagacatacccacttacaaaagcaaagcatgtaaaggttcatggtcgaactacgcaaacacgttcacctcttactctgttttggacaggcagtggcattgaattgaatatcaaaggctcagagctgtggattgaaattgaggccgattaccaggtgtatgaaccctggatcagtattgtcatcaatggtgttccgatgagtcgcctgatggtgaccgcgggacgacattggatctgtgttttgagagggttgaaccctgatacggtcaaaaatgtccgtgtggtcaaggatgtccagcctatgagttcggactcgcgctgcttgttgcaaatctatgccctgaaggttgacggggaattgctgccagtcactgataagtccctcaaggtggaatttatcggtgacagcattacctcgggagaaggaacgattggagcgaaggaggagacagactgggttcccatgctgttcacagcactacgcaattatacagccataacagccgaagcactgaatgcggactaccgagtgttatcacaaagcggatggggtgtcctaacaagctgggataataatccgcatgcaaacatacccgcatattatgagcaggtatgtggtgtgctaactggtgagagaaatgaaacattaggggcattttcagatcatgattttacctcatggcagccggacgtggtcgtagtgaatttggggactaatgacgggggagccttttattctcctgcatggacggacccagcaagcgggaaagtgtacaagcaacgcttgaacgaggatggtacattcaatgaagaggatttacaagattttgaaagcgctatcgaacgttttcttgtcaagcttcggacctgcaatcctgctgcccatattttgtgggcctatgggatgctgggtactccgatgatgccctcaatctaccgagcggtagacgcatacaaaaaaagaacgagggatcggaatgtgtcggtattccaactacctaatacgacggaagaaacgataggatctcgcagccatcccgggctctccgcccatgccaaagcagcagatgagttgacagtgtatttgcgagagattctaaagagatagaatccgagaaacacaatcaactctgtagaacacgctcataaaggaaattacaacaactaggtcaattgtgttctgggtgttgtggttaaaaattatggccatgagcctgcggcaaatgtctgccccagactcgtggctgataagctcagagcgcagcgacctaatcataggagaactatgaacagtcagtgaattctaacaaaaaatccttgtctgatatatttacaaaaacggagtcgaagcgatgcccgtgaacacctctggaccattacgaacagtggtcgatacaccagaaatataagaagaatatacggtctgtattgcccagggagcggacaaatcctgtgcattaaaagcttgcgtttcattagctccagtcacgcccagtactccctcggcgcggtagactacctcgctcggatcatagtcggctccacgtacgatttcaaccgcatacgtatcgccaagctctccgatcagaccaatagaaccactaaaagttacaatcggacccggcacaagaaaggttcgcagggtgatcaaaccgaaccgctccggtataggacccagctgtatatcgggaccctcacctgtttttgatgaattggtggagcttctcatatccagaaaaaaacccataccctatccctccaaattgcaagatactccatgctatgcaagaaattctttagcgtattggacaaattagtaataaatctatcaattcagctcaaaataaccgatagtaaatacatatggtataaatattagaaatgaatatgtagatagaaagcaggggtttgatgaaacaactgaaacgactgaaaacattaacactacgcaagaaattgacagcagcatttctactggtcatgcttgttcctagtattattgtgggctctttctcctatcaggcagcgtacaacgagacagatcgccaattactggacagtgcaacgtctagcgttaccgcatctgatcgtgctgttactcaaacgattcaggccaaaattgctgatctcgaatattactctacaacgatgacggttagtgataatagtgctgaagcagatgatgccattctgaaaaaattacaagtatatttaaaaatgcatgcagaagctgttgatatgtttgtcggaactcccgaaggtaaactcattattggcaaagccgtaggctccacaaacgatcctcgtgagcgtccgtggtacaaacaggctatggagaaacccggacaaaccgtaatcagcccggttggactcaatacggctaaggtccccgttgtgtatatttcacgcacacttcccgacaacagcggcgttctcggtctttccctgaacctgaataatttaaaagaaatcacaaagttaaaaatcggacaaaatggttttgttatgatattggatggtaccaaacgtatcgtaactcacccgacagaagtcagcggaagtaccaaaatgggggaaacgttacccaaactgtttgcctccgaggaaggtagctttagttacgattttaatggcgtagacaaacacctgattttcaaaactaatgcgctgacgggctggaaaattgccgggacgatggacaaagcagaaaccagtgcctccgcccagccgattcttatcacgacgatcatcgtgttggtgattgcagccatcatcattggtgtactcgcaatgtggctaatcagcagtatacttaagcccatccaaagattacgtaattctatggatgccatcagcaaaggtaatctttcgattaacgtagctacgaccagcacagatgaaattggtgaattatcaagatattttcaacaaatggtagataaccttcgtaatatgattaaagaaattcaagcgatgacaggcaatttgtcggcatcctcgcaggagcttgcagcaggtgcagaacaaacgacccgggctatcgagcatgtgaccatagccattcaagatgtggctgcaggcagcgaacgccaagtgggcagcgctaaagctaatcagacacgggttagcgacatggcaacagacatcaccgcgatgactgaaactatggctgaaatgaccacttactccacacaggccattcaagcgtcggatgcaggcagtgagcatatcggcaacagcgtcgtctccattgacggcattcgtactaccgtggaagaactggatacgattatcggtgctttgagtgaccgatctggacgaattggaacgatcgtcactgtcattacggaaattgccagccagactaatctgctcgcattgaatgcttccattgaggcagcacgcgcaggagagcatggcaaaggttttgctgtcgtggcgacagaggtccgcaagctggctgaaaactcagctcattccgcacaacaaattcgtgaacaaattcaagggatacagaacggtgtgtctgaagctctggttgctatggaatcagcgaaggaacgcgtaaatgatggtatcaattccattgacctatccggtcgctccttctctcgtatccgtagagcagtagccaaatcagcgaagcagcttgataacgtcgcagcttctaccgctggcgtcgcagatggaacgagtacagtcgtcagcagcatggaggaaattacacgcatcgctgaagaagcggcatcccatacagagaccgtgtccgcagccgcagaggagcaactcgcctccatggaagagatcggttcgtctgccgcagatttgacccgtctggcagagcagcttcaagatttactgacacaattccaattggatgaaacaaaataaccgttccaaccgataaatacagagaaagagtcttcacaatgaaggagggttggaacatggatatcgcagcattatcaacaggtatgagtcaggccagcttagctcaagccgtaagtgtgaaagtattaagtatggctaaggatcaggccggtgaacaaggacaggctttagtgcagatgatggaaaaaagcgtacagcctcatctcgggggtcaactggatattcgcgcataagtgcatccatatgcttggttaggggcgattctgctcaggtctgaacagacccgggtagaatcgtttttttatctccctatttttcgttcagcacaaaacgtagtaaactagacatatcgtccacaacctcggttcggaggatagcgcaacattcacacgatttacattgaaaaaggaggatacatagtttatgagttattccgaatattttgaaaaagccagagagcaacaactaggcgagttacaggagtggttgtccattccgagtatctcagcattatcggagcacaaaaaggacattaaccaagcagctgattggctggctgccaaactgactgctgccggtctggaaaacgttgaaatcattccaaccaaagggcacccgctggtatatgccgatcatttgcacgcacctggtaaaccaacgatcctcgtgtatggacactatgatgtacaacccgtagacccgcttcacctgtgggaaacgccgccgtttgagccatccatccgtgatggaaaattgtatgcgcgcggagcgacagatgataaaggacaggttttcttgcacattaaggcagttgaggccattctgaagcaggaaggcacattgccgctgaacatcaaattctgcattgaaggcgaggaagaagtgtccagtccgaacttgcttgagtttttgcaaactggagctgaacgtctggctgccgatgctgtactggtgtccgacacttccttgatcgaaaaagggaagcctgccatttgcacaggtttgcgtggactatgttcactggaagtcgccattcacacggcgaacacagatctacattccggctctttcggtggcggtgtgccgaatgccctgcatgctctggtgtccttgctggcaaccctgcatgacgacaaaggcggcgtaagcgtcgaaggattctacgacgatgtcgctccattatcggcagagatgagagaagaatttgagaagcaaggcttcaatgagagcaagctgcaacaagatcttgcacttgattccctctatggcgaagaaggattcagcttcgttgagcgtgttggggcgcgtccgacactggagctgaacggtgtatacggcggcttccaaggggaaggcacgaaaacggtcattccgaaagaagctcatgctaaaatcacgtgccgcttggtggctaaccagaatccgcaagacattctggacaaaatcgagcgccatttacgcgctcatgttcaggcaggagctactctggatattcaacagggtgaaaaagcaaacgcctttaacatcgacccgtcccacgcgtttctgcaagcggcagccgatgcttttgagaaggtatacggtgtgcgtgccctctttaccaaggatggaggctccatcccaatcgtggaaaccttctcccgtgtgctgactgccccagtcgtgctgatgggcttcggcttgccagatgagaacctgcatgcgcctaacgagcatttcaacttagacaattttgacaagggtctgctgacgattgtagagtttttgaaatcggtgtaagcacatgacaacttcttatgactaagttacaatagagagggcgaaagccctttctattttttttggaggagcgctacataatatgattattcagtttattcgtttacggtaatgtgaggtacagttcatgaaaactcaaccattttccgaaaggggttgggtctatttggctgtgccttttttcattcaccaaatacgaatgaacggggtgcttttctgtgtccaaatggaataaacacgagatgaaggctggcctgattggtaagcatgaacatctctttaggtgtcctctatgctctcaaccgatgcgtatggtggaaggtaaaagcctcctatgtacgagtcagcattgctatgatctttcaaaatacgggtatttacatttagccgcccggtcctataagaccaaatatgataaacaactattttcctccagaagaatgatgtgcaatagcggatttttcgatcccttaaatgaagcaataagcagcactataatgaaatttatgaagccgctgtttgatcaaaaatcacacctttacttgctcgatgcaggttgcggggaaggcactcatttaagccacattcaggataacctgacttggaagggaatcaccgagctaacaagcgtaggtatggatttgtctaaagaaggtattgtggccgcagccaaagaatatcctcatcccctctggtgtgttgccgatctggctcattgtccattttcaaatcaacaatttgacggtgtactcaatattttatccccttctaattatgctgaatttacaagaattctttcggaggacggctgcgtcctgaaagttattcccgaacaacattatcttcgggaattgagatgcttgtatgaacagaaaaagaataagcctgcttattcgaatgacaatatattaagccgatttaaagatcattttaaacttatatccgccgaacgggtaacctatcgttttatgttaaatgccgacctcttgaaacctttgctccatatgactcccttatcgtggggagctacggaagcagactggcagcgagtgcaggaaataaatttaccgtatgtcacagtagatttgctcatcttatgcggtaaaaaatagatactaaaaagcattcacagcatgggatcatccatacttcgtgaatgcttttttacgttagttccgtcgcttaagaaaaacgggtgtagcgcaacaggtgagccagccgattgagccgttctatctcccgatccaactcatgcagcggctgtccagccaaagcagcgtttgctctcagatcccgtagcgggttcatttttcgacccatgagtttgagaaccgtggccttccccatgttattcaccaccacatattgcgttagcgggtcaagctcaatccacaatacatgatgctgaaaaaacgacaatagttgctcttttaacgcctccagctcttcaagctcacctgtgatttgcggatgatgatgaaaagccacatagcccatcacccgcaggtcacttatgatttgttctatatggagcgtttcgtttatgtacacattgttcgtgctcatgcggtttcttgcaccattcgtatgatcttcccggatgacgttcaccacctgactatcgttatatcaagctttatctttccccttttccaatagctgcacaagccagcaacctccaaaccacaatgctcctacagcaaaaaaaacggtatacaccgtatataacgtggtcagttcaaacaagctattgtaccgattaagcaagatcccccacaagcatagcagaaaactgctaccattttgctgatgaaagcgatgcttgtagatccgttgaatcaaaacagccacaaatcctatcaacaaaacgtgattcagcaaaatactccacatttccataagccccctttttcactatagcgcaatcggctttgaaaagtcaggacgtacacaaaccttgcgaacaaaaaaacaaccggcttatacgccagttgtttcccgttccacaaaatacttattggtcatataatgggccttgcctctggaagtatccaccattccctttttgttgtcgagaaaaacaatctcccggcatttggtgcagtaccacttggtccgcttaaagggagattctgttacatacgatgtaccacatttgcaatctactttaattaaggtttcagttgatttgtaagcctgggacaactcttttaggccagtatccggctgttgaatcgggataataacctcctgatagcttgaatactgattatgcaccttaaaatcagccaccagttccgcatgcagtccaaagtactctttgccaatctcggttacaaatttcttgccgattctgtaacactcaagccattcctgtatctgttgattagacaaaggcactgtgcccttgataccactatttaatgtgtaagtcatgatgtataaagtatcatcttgtctatgtccgtacatgagaagcctccttataatacacttgataatgtactacaaagcgtaaaaaacatcaattttattatttggcaaaagatttagtatcatttccaagtatggatttaatacatggtgacaagcacacaaagacgtgttcgagtctagttagaaagcaactgacaatctgtcagttgctttgtctttccacatagtatttgttggtcatgtaccatgccttgcctttatctgtatccaccatgccctttttacgatccaggaacacaatgttattacactccttgcatgaccacttggttcttttgtgcggtgactcttctatataggaagcaccacatttacattccacctgaattaatgttttatactggctgtacgcttctaccaatgggtccagatctacagctttgcgttccattacaggctgtattatggatatgtgttctctctgctccgagtattcattatgtaccttgaaatctgctaccaactcagggtttaaaccaaaatactgtttccccacaaccgttacaaacttgctgccaattcgatatgctttgatccattcctgcacctgcttactggttaggtcgacagttccctttataccgctgttcagcgtataagtcatcaagtgttggttgggtgtcatatgtcttaacattcacctccgatcaagaatataccacaggtagctctaggcaaaagctacttcctactacctgaagcaatgagctttttctgccttgtgattcttcttcaacacctatatataaaagtatagctcaaaacctgatccatcttccatcctgtcgtcatgctgaatactgcttttgtagggatttatattcttagactatcaccagatgcatttctatcttagtataactttgtggtacagtcttatgttttgatcactcctgttagttgcactatgatccctaatggtagtttcttccttctatatatagtacatcatttacacgcaaattcccacatatttcagtggttattctgtaaaacaaaagccttcatcctttttaaaagggttacgggactgatcacatggtagaggttactgcttccttgccgtccccccgattatgttataataaaataaagcaaaaagagcgaggtgaagtcgatgaaatgggaagaaattgccgaatcacatccaaggcgatttgtgttggttgaggctataaaagccagttccaataaccgcgtgcgcaatcttgaagacatggcggttattcaggattacgataacccaaaagatgcatggagtgggtataaacattttcacaaactgtatccgtcacgcgaactgtatgtgttccataccagtcgatccgatgtcgaggttgtagaagagtttttctcaggagtacggcagcgtacatgaagattaaccttcataatggtttgccaattgtttccttaacattgagacatcacgaccaaactgctctattaccaaacgtattgttcgatacagggtgcgctgcaacagtgtttgatacggatttacttgcccaaatcggcattcacattgatttcattaacgggagagcaaagcggatgtacggggtgggcggtacaagtgaaatttgctacgaacaggtaattcctcatctaaaaatcggtcatattcaattagatacatttccaattcaactaagctctattcaagagccgtatggatttgatggcatattaggcattgattttatgctaaaaacaaaattaattgttgactttgatttaatgaacatccactccccactttcacctttaaaataattccaagcaggtggtcacatgtctcttcctttaaatctgattaccatcatgctcagcccgtagaagtattacttatacccttggtttctcctgcgggctgagcctttgcccaagggagcgtgatggtaatgaaacctaatcaaaaaaatcgtaatcgagcttattttaggcaccacagaaaacgtgttattcagcgtaaaaaacggctttcagcacaccggggatgggtcatcaaattcgatggtgtattctccaaaggaaaaatccattgttcctgctggatgtgcagtaataaaacaaaacgactgggctatcccaaatcagagctagcaagaatagataactgccaggaacagcttcaggattatcgtttctaaactaaaaaacgatcaaaacaagcgaatgtccattgctatgacactcgcttgttttacgtttacaatagattttccagcttctctcctcaatttgaaatatagaataaacttactaggtttgatcagctaacataccacaaaacaaaagccttcccgaccacccttcactgtcgaaggatcatcgagaagactttgtaccccgcaaggaacaagaggtcagatttttaattctccaagcctgattaattccacgaccgcctgtgaacgaccttttacgttcagtttctgcattacattggaaatatggtttcggaccgttttttcgctaatgaatagctgtccggcgatgtcacgtgttgttttgtcctgcacgagcagttcaaatacttcacgttcacggtgagttaacaaaaacttgtttttgtggtcgttacccttcgtcaatttcacccctccttgctcgggttttgtgtggtgtaacaaggttaagggatacagtcaacacattttatgtcatgtgctcaggtatggttcaatatgcggataaaaatgggcataggcaccttactaactcccttcgatggagggttggactctgcgtctaatttatgtattgacaggcatatgggccagccttatgataagaaaaaccgcgactgataatcattatcaaaataaaaattcgatataggtatcgcgcaacagactatggttcaaggccagtttggccagaaagggtgttcattgattatgaaactacgttatgccgtaccggccggagtgctggtctcttctattctgttcgcaggttgcggacaaaccggaactgctactcagcagcctgccgcaacgaccaaagatgcaggagcaacaacacagacaacgactcctgccgcttctgcccccaattttgatcaagcggtaacagcttaccgcacctatgccatcgagcaatgcgatacgtttgtgaagaagacagaagaattcacgaacgcagtcaaagctggcgagctggataaagccaaggcgctgtatgctcctgcacgtatgtactatgaacggattgaaccgattgcagaagcgctgggtgatcttgacccgaatattgatgcacgtgacggtgatgtggatgcagcggattggcgcggctttcaccggattgaaaaaacattatgggaagaaaacacaaccaaaggaatggacgagttttccgaccgactgctgagtgatgccaagctgctgcgtgccaaagtagaaacagttaatattgacgccagcctgatggtaacgggtgcagtggagttgctgaatgaagtatccacctcgaaggtgaccggtgaagaggaacgatattctcatacagatttgtacgactttgcagccaatgtggagggcgcacaaaagatatatgacattttgaaaacagatctgaaccaaaaagatgcggcgttggaaaaacaaatcggtgagcgctttacggccttacagcaggagttggctccttttaaggacggagaaggctatgtatcgtatacaaaactgaaaccggaagaagttaaaaagctgagtcaaaacctcgatgccttggcagaaccgttgtcccaaatggggaaattgttaggagtgtaatgatatgaaaggctttaagcggcaaaaagggcaagaaaagccgcagtatgcggaatcccataatgtacaggccgatctggtaaaaaaggatgcgaagctagtggaagatgagccgtcaggaaaaagcaaatccgtatcacgccgagacctattgaagctggccggggtaggtggactaggcctcctgcttggcggcgggggcgtgggagccgtgctgtcagccggtcaacgtctcgaaagcatgatgacggatgtggataccaaagatgtaatccctttttacggtaagcatcaggcaggtattgtgactccggcgcaggatttcatctgcttcgccgctttcgatctaacaaccagcgacaaggaacaggtgcgcagcctcttcaaagcctggacggaagcaagcgctacaatgacttctggcgtgctgcttggcaacgataatgaaaatctcaacctccctccttccgatacgggcgaggcggcaggattatcgccatcccgcacgacgatcacctttggtgtgggcccatccttttttgatggacgatacggcctggcagggcttaaacctgccgggttccgtgagctgccccgttttcaaggggatgccctggaggagcaatggtgcggcggcgacatcggagtgcaggtatgtgccaatgacttgcaggtagctttccatgccctgcgtaatttggcacgtatcgccagaggaacggcggtgcttcgctggacgcaggaaggcttccagcggacagcacaggccgatcctgcgggaagcacaccgcgcaatttgctgggcttcaaggacggtacagggaaccccgacacctccaaggcagacgagatgaatcggctggtgtggacacagaccagtgacggaccagcatggatgggcaacggcagctatatggctgttcgccgtgtacgcatgcgggtagaggtgtgggatcgttcaacattgggcgaccaggaggatacttttggacgtcatcgcagcagcggggccccactcggtaaggtcaaggagttcgacaagcttgatctggcggccaaaaatccggaaggcaagccggttacacctcccacctctcatgtggctttggctcatggggacggaagcattaatattttgcggaggtcttattcgtattcaagcggattggacaagcaaacaggacagctggatgctgggctgcttttcatcagctaccaacgtgatctgttcaagcagttcgttcatattcaggagaagcttgcacgcaatgacaagctgaacgaatacattgtacacaaaggcagtgcggtgttcgcctgcttcccaggtgtatcgcaaggcggctacatcggggatacgttattttagcagcaggcaaggaaggggatttatatgaatcggcgcaataaaagcttgggatgggtgtttgtgctggtggcagctctgctgctgaccgtaactccgttcatttccggctccgggtcggtcgcttttgcacaaacagatgccaaagctgtcacccatgatcagctaatgcctgtagtgggcggagcactagtggaggcgggacaagcccaatggacggaagcctccaaggatctgaaagaattccgcacgctgtgggaggccgccaaaacaaatggcggagattcagctcacatcgcggctgtagatcaagcactcaccgatgcggaacaaacactcgccagtggtggcggggaaccagcgaaagctgccttatccgtgctggcgcgctcggtcaatgagtacgtcactgctgccgaaggggacaaaccagccccggctggagccaaagcagcggaaaaactgcttcccatggcgaagggcagtctggccgccatgcaaaaaggcgattgggctgctgcccgggtggattacgatcgaatcgtcaaagactggtatcaggtagaaacaccgattcgtttggacaatttcccggtatacagttcgctcgaaactaaaatcagtctcatccgcatctccatgcaagctgagcctattcgccaagaacaggctctcaaggaaatgcaggaattaacgactctgctgtctgattatagtcagggtaaatctatgaacacaggtcaaggaacgaatgcaggcaatacggctgccggaacggcgaatggttcggcagcttccctaggcgatgcagtcaccttgctcgaatccgcacgccaaaatactgtagctaatcagccagagcaagcggctgacaaggtagtgcagtttatcgctctgtggccttctgtcgaaggacatgtacaaattgccgatccgacgtcttacactgcaattgaaaatgaaatgaccgagacttcaggatatctgctgtcttctccaccgaatacggacaaagccattcagactcttgatcagatgctggacagactccgtccgttgacggaagaacgttcttacactgcgtgggatgctgcgctgattttgctgcgtgagggcctggaggccattctcgtgctcgcagctctgctggcgtatgccaaaaaaagcggcgaagccgtggctggacggtggatatgggcaggagccggaacggggctggtgctgagcggaattctggcagtactattcaccacactggtggcagctgccgcatcaggcagcatgcgtgagttgctggagggtgtcaccgggctggtggcggtcgtgctgatgctgaccgttggtagctggctgcatagcaaatccaatgctgccgcgtggaaccgctttgtggaaaacagcgtgggcaacgcgctggcacggggaagtctgtggtcactatttgcggtttctgcgctcgcaattctgcgtgaaggagccgagacagctatcttttatgtcggtatggctccagccatcgaaacctcgcaattgctgctcggcattagctcggcgacggttgttctagtcattctggcgtttgcgatcattaagttcagtgtacgattgccgattcgtgcctttttcctgactgcgactgtactgatttactatctcgtattccgatttctgggcgaaagtattcattcgcttcaggtggctggcaagcttccggggcacactgcctcctcgcttccgtccattagctggctgggaatgtatccaacttgggaaacctttgtcccacaaatcgctgtactgatctttatggtatggcagcttgtgcgtcaagaaatgcgcagctccaagcaacattgagtcgatactaccctactcatcatgtaaaaaacgccaaatcacaggtccgagttgtatcggttcccatgagtttggcgtttttttacatacttacaacgcatcctcaggcaacggaatcatgcgctgatgatgcagcaggtctgtgcggtcaccgtgttcacgaatgacatgcacctccccacgaaaatcgagcagctccgccggggtagcatgtcccagaaattgtagtggactatagcttaatccataggcacctgcattcggaaaggcaatataatcgccctcgtgaatcggaggaagctgcgcttttttcacaatacaatcctcgggtgtacaaagcggaccaacaatacttaccgtttcaagctccaaggatgcttcctccggaggcccccctattcggcttgcaacctcttctaatgattgttcgacagtaacagccatttgagcagaagcgtctctctgccccatccgtagggttgcttccacttctcgttctttgggttctttcgattctcccgcttgcctgcgcataattcgcaccgggtagttgtccctaatgcggcgtcctcgaaaagtagctgcggcgtagtgattcatgccaccatcagccacgacaaacttctctcccttggattcctttgtatacaatgctcggcagacatacatgcccgattgagcaaccagatacctgccgctttcgatgattagcttaaccccgggcatgcgggttggggtctgctccgcgagtgcgttcagtccgtcaatgacgtgatccatatcaagcggttgctcatgagcaaaataaggtacaccaaacccgccgcccaaattgaccgtatgcattgccacaccatactgagcctgtacccgttctgccagctgcagcgtattcgcaaatgaagctaaaatctgatccgatttcaacatttgcgtacctgtatatacctgaataccttgaaaatggacgtgtgggcaatcttccagcaccttaaaaaagtgatccagctgcccttcatccactccaaaggggcgcggaacaccacccattttaatcgttgctccagacagatcgttatcgggattgatacgaaccgctgctctgacaagctggcccgcttgggcagcaatgtcctccaacagacgcagctccctcaccgattcgacatgaatacagccgattccataggctatcgcctcgttcagctcagctactgtttttcccggtccggcgtacagcacgtcttccgcaacatacccggcctccatagcgacgaacatttctccagcagaagcaatctcaacaccacaacctaacgaacgcagcaatccagccaaggctacgttaccattagccttgagtgcataatgtacacgcacggccgggtgcaatcgggatagcaacgagctgacgtgggcatgtagcgcgtctccgtcataatagtaaaatggcgtcggatgctcgccgaaacgctccagtaaggcttcgtcctttttatccatcacctgagttctcctcctctctatgccttgatactcagtattttgcatcattcgcttccctccgctcgaatacacaatcatactcatactgcataagtcgtctcgcccgagcgtgctgcttcatgaatggctgccagcagtctgacgcgttcagcagcctcgcgaaatggaatgggctccgcttctccccggatgataccgcaaaaggtattcaactgattgacataatagttcataggctcgaaaaccgttttggtatgcgaagatgtctgtgataacacaggcagtgcgtccgcatccgttatatttgacgcgatattctttttgatctccgtcttgagtgtcattttataaaagcctaaatttgctcgaaagcagtcctttaaagtgactactgccgaatcaaaggtcagtacatgagcacagcgataagggcgctcgaatgaaaagagggcagatgcctccaatccactcggataacgggcttgcgcacgaaatgtccagtcacagccatgaggaccatcgaaatccgattgactgtggaattccgcctgatctaatccaacgacggcctggagcaattggagccagtacacgcctaaatcccaaaaacatcccccaccctgctccggacgggatctgtaattgtccgcatgcccttcttttgccggaatacatagactcgtctctatggagcataaacgaccataacgccccgattctacgatcctccgcagctcatgctgccacggatggtgctgcaccatgacaccctccagcagatgaacgttactctgctcgactatagctgccaagggtgccagatcagccgtattcaggcataacggcttttccaccagcacatgcttatgggcccgtagtgctttgccaatccactcggcatgcaagtcgttgctgagtgcaatatatacagcgtcgatctccgggtcctttagcatatcctcagcatgccgataaacgacactgacgccaaaacgatctgcaatttctcctgccttggcaaccgtgcggttcgcaagcgcggtcacgcgtgcccctgcaacatgtcggatcggttccagcaacgcacggggagcaatggcagaacagccaatgatcccaaagcgaatatctcgcatcgcaggctcttgcgcagccaccgcagcgttcataacccctgctccattcctggggagcttactggcaattggatactattcacataggactctatataacgcggcgtccgactacgcagctctacgatcttgcgatgcatatcctccaggatctgagcactgccgtcataggtttgtatccacgtatcgtatcgcataccaagtcccagccgttcccatagatctgcattatgcttttcatgcacaccaaatggctccagcataatgaggggagtggccgtagcgaacgagtcggttaggctgccaccacctggcttgctgacaatggcctggacacgacatacttggtccagcatgctatggtaatccggtccaacctgatatactgtcttctcgcctctttttacctctccgaaaggcggaaatgtatgctccccggcttcattacgctgccatgtcctccactgcgggtccatctgaaaatagcgtatactgtcccgctgttcatccggttgatcctgatcatacaacagcagatccagctcccagcccgcttcttccaaccgtccaaccttgtcacggtaggtgcccatgccccagccgccgccatgtacgaataagcgggattgccgctcttcaaacggaacatactccacagccggtacatcaatatagtggctgactctattcttatcattttcaaaaaaggtcatttctccacagccctccgcaaaacgcgggttatgcttggctagatttttccaggaaggagaaggtgtcgaatccatgtacacgatgtccacatgcaccgactccggttctctgcgcttacgatactcctccagtacatacatccaatgaccggataagcatataaaataccgccgatcctcctccatccattggttcagcagcacttccatcgcagcgagatccagtgaattacgcatatcctgcggaaccttttgtgacattaaggccaccgcaaaattgtcatggtaagctttgcggcttttgtcgaccttgagacgagccgattctggcagcacattttcaaatacatgaatcgccgtatccacgcccagcctgcgaagacccgcttgcaacaacaagccaggggtataaaagcccaatccgaaaccggaacacaaaatcgttaccttcataagcttatccgtactcttacgcatgctcatacgcctcccgtttaattcagcactgtaaaatgatgctctgccaaaaaacgctccagctttgtagtcaaccgcattttatcctcatcgctcgcagcaaccagctctaaataaagacgccccttgcctcgtgcccgttcgcttccatcagtttctttgttaccattcaagtccggcttagccatgcagttcccttctgatccgccatcaccagcaccagcactaatcccgctcacacgaacctgcttggcaggcgatctgcctccgcgcccggttgcatttctgcttggcgtgcttgtatggcccacaatcttgttctcgccatctcgtccaccggtgttcacatataatgtattggcacccagaggcatgacaccttcttcccgttcacctgtgaacagcaatccttcacctttcagcccttccagcagttcttcataggatagactgccatcatgggacagtgaataattcgtcagcgtgccacgcatatttttcccggccagaaaggtatcgagctgatgcttgatcaaactcatcgactttctagcattaatttcgataataggctccagcttcccaccacgaagtgtcatggaatcaatgcatacatcgccgtaataaccatcctgatacaattgccgtcccacatcctgcattaaactaaaatagccctcgcgctccagccgctctaaaaaagccccgtccggcgacaaggattcccgataggagaattgtgtgttagccagccattgtacagataggatattgacatttccatcatcaccaatcgcaaattggcaagaaaaatcctgctctttctcctgaaaaggctccaaaaggaaaagcacctgtttgcctttacgctcctgtccacgtaaatacgatacgatccggtccagcatttgtgtcgaggtaatgtgcaggtttcctttgcccgatacgccaaaatcatccttgattaaaaagcttccatcccgtagcagcttacgccccgcctcagcgacatctgcaaacgaagtcacgatatagcctgggttgcgcagaccgagactgcgtttcagatcagaggaatacgttttggcatttaccttgcgaatcgtttccagcggtggctgatgcagtgttataccccaagcacgtgcagcctcctccacatgcggtaaacccgcaaacgggctaagtacacagccttccagttgaggaaacccctctccagcatcggccttacgactgcccagcagttcgaatactgaagcggacgatacgttgcctgcacgctccatgccgtcggtcaaatctcgttcgttgacagccggatgaaagcccaactgcgcgatatactgacgatgtacaggcgaaatagcataacgggtcaataacgcatctcctggctggcaaaagctgaacagcagttcatccatggctgctacaatcgcagaagaagcccggtcaggcagggctggcagggaagctaactgggcatcccgccagtaagcctccgcttcgaacgttcccatatacaaatgacgctgattcggtatcgcattcatatgattcgcttcctttcctgcttcattattggcccactacacggtagcgctactggctcgcgctcgtataatcacgtagagcaaactgccatatcaggcggatgatcgccagcagccagagaggtgcgagaaatgcccataccaccaacccggtatccattttgccgagaatgaacatgggcggaaaattacaaatgacaaacactggaagcacgaacaaaccgatacgctgaatcagattactgtacacggccatcggcacatagtttgtctcgaaaatgctgttggacagctccgtaacgccgttcgtgcggataatccagaaggctagcagttgggggagcaaaaatacggagtatgccgtaagcactccgcatccgagcagcacagagaaccctcctgtggtttcaaaattaaatggcaatccgagccgataccagccgatgcctgtcataattccgccgccaattacattcggcacggtatagcctagttcaaattgacgcagtgtcaccataaattgcagtgatacgggtttggtcatgagcacatccagtgagccggtacgaattttgtcaggcaggcttgtaaaattactgtagaacaatccactataaaatccgctcatcatcgtaaacacgccgatatataacaatatggcgtcaggagaccagccgttaatgtccgtcccggcgcggtatggaaccgatgcgtacagcagcttgatgagcaaataagctgtttcaaccagaaatgccgttataaaattaatgcggtattccatctgcgacatgacggaaaactggacaaacttccagtacagtctgatgtagcgcctaacgtttcggaaaacatttttcatgttaacctcccaccgagacaaagcgtttgaccccggcttgccacacccagcgtgatacggccgccagcactacaatccagagccattgcacgccaatgcctttagcggcttccagcaaagtcagcttgcccgttaacgcattcaccggaaaaaatacggtgtagctgaacggcagcagactgaacagacgggccaaaacatctccaaaaatcgtcagcggaaacacggtaccgctagctacgtaaatgacaagcgacagcgtataaaatagccccgccgattccgtcacccaaaaggctatgccgctcagcgcataatagaccacaaaattaagcacaagcgctcccggcaacgccaatatgtaaagcaagatgtacgatagcccgaagctgatttgtccttccaagctaagacataacagcaaaatagcagccgccagcagcacgaccgcggactgtatgactttgcctccgataaaccggcaaaaacggtaagcaaaataatgcacaggctgtaccatgaattttgccagtccaccttccttgatatctgtagcaatttcgtattcaaaacccgtagcaatcagtttcccagttactcccgccatgaccacatacaccagcatttctggcagagaatagcccagcactcttgcttgtcccgaagaaccgaatacagctagccagagaaaaatttgcgtcatgatcggcagcataaatcccgccatttggagccaataattagcccgatactccatttcattttgtataccaagctggagtaccttcacatatttgttatttcgcatcggccagcctgcccccatcgtacaaattggctatcccctcttccagcgggacgtcctcaatcgtaaaatcaacgacaggcagtgcgtccaaaatctttttggaccaagccaaggtatcttctgcatccagttcaaataccgcctccagctccgaattggagcgaagtttgccgaggctcgccaacgttaggttggatacaggggactccagtcgaaccttaagtaatttacgtgcaccgatgacctcattcaccttgtgtaagtctccgtcatagaccaatctgcccccgctgataatgatggatctactgcacaaatcctcaatatccttcatgtagtggcttgtcagcaggatggtcgtccggtgcgtgcggttataggctttgaaaaactctcgaatccgccgctgagaaacaaggtccagtccaatggtcggctcatccagcaaaatgacccgtggacgatgcagcagcgcggcgatcagttccattttcatacgctcgccgagagacaaccgccgaacctgcacatgaagctgctcctccaccccaagcagagtgaccagttcatccagcgcctctttgtaacggttttcatcaatttcatagataagcttgttcagctcgaatgactcgcttgcaggcaaatcccaccagagctggtttttctgtcccattacaatggaaaactgacgtttaaactctttttgtcgtttccacggggtaaagccgagtacggatgcctccccgtccgtgggatggagaatgccagacagcattttgagcgtcgttgttttgcccgctccatttggaccgagaaatccgacaatttcgccttcctcaatgctaaagctgacattttgtacagcctctttggtcagctgctgacgcctgaacaagttttgtaacgatttgcgcacgcccggctcctttttgtagtacgtaaatgttttcgacaattggtttaatgtaatggacggcaatcaattcccctcctctttcctctgcgcgtaacccctggatgaacgtgcctgataaggccgagtgctctggactactcggctgcttgctctgctaaaatcatcagttcctccagcatatgccgctgtctttcaattaaatgcaaagctcgttccgtaatctcaggcatccgatgcttacgcagttgaagccctgttttgtaaatatgcagattaagcttgtgccaatccgcgtacagcccctgtgccaattcaattacatgctgtgtttgtggccccagcgtagcttgatgcagcaggcaataatcagctgtataatccgtcaaatgaagggcactgcccaatcgcagattgtaatagatttcatgacagtacgtccgaaaatcctgatcctccatgtctgccaacagacggaagtcaccgacaaatgcccggtacccctcatctccccgcttgacctgcttgcctgttacagctttccccgtttgactttccgactcattagacgtaggtacgcctctccagatggcttcgtgtccagtcaaatactgtcgaatatgatgagcacacgcagcatgcatctcacttggcgaaagcggggcaggctgctccaccagccatgcatactcaataataccctgcatcagatcgtcgagccgggctgagcccacataagtcatggcatgtcccgaggaatcgagcagaaagctatcattcacctgtgctgtccgttcttgcaagtccaacccgcacaactcaatcacgtggccccttgggtaatttttcacatatacatcgtgataggttaaagcagtgctcgacgtatgcagcatggtaccgtagcccgatgtgagtacccgcaacaggtcggtttcatcgctgacacctgcgacccacggttccacccgaataacaggtccgccactggctgccatttcttgaagctgctctggatatttctcaggtccgaagcgcttcaaatctccaccatactctgcgcacatactcccacacagcatgaatagctcggattcggccatgttcaccccgtacctccgcaatgaggtacgcagggaagaatatacacaatgtttccctggaagagcgtttgccacttcttctgcaccatagtccacaacggaatcatgacgagtctccatatcggatccctgcatcaaccttgtcttttcggcgcccttatgcatatttgcccagcagacgctcaatgccttgcagtgtagatagatgctccagcactagatcgtcgtcctccatcgtaatatcaagctcattttccaactctacaattaattccacagccgataaggaattcagccccaaggttcgcagatcctgatccggagtcaactgttccagttctcccggagccagcttcaaaatcttttccagcaagggtactacatggtatacatctgttttcatttttgattccctccaatttatgagcatcctaatccagcaatgataccttccaatttgtgcgcatacgcatcagcttcctgccagctgtctgccaaaataagtgtgaaaatccggttcacatagccccgcttcacagggataccagacaatgtacccgccgtatacacaaacaccccttctggacgttcgggcgtatagagcaagccctcctccgcgagcaacccgcacaagcggctgtaggtgagaggtgtagcggtaacgttgcggtaataacgggataatgttttatgctgttctcccagaacggatgacaggaatgaaatataggtagataacgtaaacctaccgttaatctcaataactggaaccagcaaaccttcttcgtcaacaaaaccgtcaatagaggccattcctgtgtacccaatggaatagagatacgtacccagctgataggcgcaacgtctcacttcttcctccagcgcatcaccaatctcagccggcacttgagatccgatatatacggtgccatccacgttttgtctttttagcgaaaacatcgtcacaccaccgccctcgtcaatgcagagctggtagttcagatccatctgcttattgtgccagcgctccaccagccagccgccggaagatggcgacgagccgccaaagcgcctcatcacactcagcagcgtgtccagcttggacagctcgtccagcatatacatgccttgtcccgaggcaccgtgcggctgcttgataatcagcttcacaggtccatccgataagtcagccagtctggcacactccctgcggatcgccgattcgtctgcacatacagcgccttcgctgacagcaaaaccaagcttttgcgcggtcaggcggctgaatattttatcattcacctgagcactgaccgcggatggagcgccgatcagctccagcccgcaaagctccgcgatcgcttcctcctgcggtgtgaccgcataggggacgagccacgctttggctccgctgctgctgtggcctgcatctgcaaccgtacgcaatcgtgccaaaagcgcctcatccgccagcaccagctctgaaatcggcgttagcggatcagaaggctccggcacctcaatacgcggcaggctaaagcccaaccgttgaagcatgtccagaagcgcctcatccggctgttcccgaagtacaatgacatcctgacttcgacatagcaggagattcatttcctccatccggtttacgacttgctgttcatcccggtctaccatgccccccttgcggggggatggatgccacacttgctctgcgccgatattaaacagccaaatcaggactccatggtctcgttcatgcgcaagcgcttccacaaggttaatagttttagtcgtcacgtcttgtcatcatccctctctcttccatccagtaacaaacaacatccatagaaaactaaatgtacttcagagagcctgccccatgcagatacaatacgctgcatttggagcacaccggagtcaatccttcatgattaatcttttgacgagttttctcatacgcatccgagttccatatctccttcagactatgctcacgcatgcttccaatcgtgaattcactgaaaaatttgcaaggcatgaccttcccgtctggtaaaatatctgttctggaggtgagcgccaaacaatgattggaacaacggctgaccatttcctcgccatggataaatttatcaatttcctcataatccaaaccgggctgatagcgcacgcgaatgttccatactcgctcattgatccgctgtagttcctgcatcagaggatcgatgttatccgggttgattttatatttgaaagcatgccagctactaatatttttttcttcaagttgtcggagccaggagaaattacgtgtaaaatattcatccattttgagggaggtttctttggaaatgtaccaggggaacgtcagcagcaccagatccagccttttgtcctccagcatttgcagaaattcgtacatccgtccgatcatgttatcgttaatgaccgcatggacagttacccgtcccttgtacaatccctggtcgcgcagttcaatcagcttatccatctgccgcattgttttttgaaaagtgcctttaccgcggattaaatcgtgttctctttcaaaaccttcaatcgctattaataactccagattttcggacaaatccaaaatccggtccaaatatttatcaataagtaacccatttgtacaaaaggtcatttcgcgccgatcttccgccagcacgtccaaaatttcatcaaaacgtcgatgaaacatcggttcgccgccccacatgtacagtctggacttggcctccttggtttcgctcaaaatttgccggagcatgtccggagcaagatccatgttttgttcttctttatccatttggtgatggtagccttcctcgttccattcaaagcagtgtgtacatctcaggttgcagcggttagtcagcttaatgccgatcgtctggggcatgtccgttttgaaagtagggtcctgtgtggcgttacggtaagatacagaagcgtttttcaggttacgcttgatgagcttgaacgctttctcatcaatcagcacattgcttttgggctgcatgctaacacctcgtttaatggattttcaggcacatgtacctagctgtacgtcagaccgtctccattccctccagatgcgcttgttccgcatcgctgatcccctgaatgtagctgcaaaacgcatctaccgagctcaaatgctctagctcaaaggaatcaaaatcaatctccacatcaaacgcatcctccacttgcagcatgaaatgaaccaactgcaacgaatccagtcccgcatcatgaataatgtccgaatgtccatccagcttagcgaccagttcaggatcttccttaaccgcgctgatcatttcaatcacttggctttgcatagcaaactcctccttgtgaatgagattctgttcgttccacccaacgatgccctctgcaaagaaagctcctagaaaaattccttcactggaactttattcaattatactcctccaatgaagagacaagtcaataggttgttttgtaagtaaaactcgcaatatgtaaattaatgtatgataacttctacaattttcgctggctattttttcgcaaaatctaataaaaattcttctcacatctcttgcatgagcagcagaattattttacaatacacgcgaaaatgtttttctttatattctccttatatacgatacttattttcacacaaacactctacagccaaaggagcacagctcatgtcccccattcttcatacattagcccatagactggagcagcttcccgtacaagagcgcaagctggcggaatccatcctgcaatccccggaagatgtgttgcatctgggtattcgggagctgtcagagcgttgtggtgtaagtgcggcgaccgttacgcggttttgcaaatcactacattttaaaggctatcccgatttcaaaatgaagctggccgccgagttgtctcattccaaccgtaatggtgaagaatcctatcaggatattgtcgccggaaattcactttcccgaatcgtgcaggctattcaggcgaaccataccgcatccattgcagacacgacccgactgctggatttcgacaagctggagcaggtcattgcatggctgtcagccacgagccgcattgatctttatggcatggcgacatcgtcgattgtggcccaggatttttaccagaagctcatccgtattggcaagaacagcactgcctttgcagattcccatatgcagatcacctctgcctcctcgctcggagcggaagatgtcgcctttaccgtctcttattcaggggaaacccaggagaccatagcggctctacgctgtgcaaaggaacagggggccaagacactatccctaacctccttcggaaacaatacgctggcaggccttgcggatattgcgctattttcctcttcattggaggaaggaatgcgacgtggggatatggcctctcgcatcgcccagcttcatattatagatattctgtttacaggtatggtgagcgcggattttgacaaatatattccaagattggaaggttcatatcaacaagtgagcaagctcaaaaaacaaccagggggtcactaagatgaacatacgcattttgaacagccgtgaagacctgaacgctactgccgccgctgtgatcgctagcttgctgctatccaaaccacaggccatgcttggcctggccaccggtagtacgccgattggcatttaccaacatcttgcagatatgtatcgcaatgaacaggtcagttttgcacgcgcctattccgtgaatcttgatgaatatgttggtcttcccccagaacatccgcagagctatcgaagctttatgaatgagcacttgttccagcatatcgacattcccatatcccatacacgtgttcctgacgggaatgcgctagatctcgcagcagaatgtgcagcgcacgagcaggctattctggatcatggccccgtggatctgcagttgcttggcattggtcataatgggcatatcggctttaacgaacccggtcccagcttggctggagccacacatgttgtagatttgaaagaaagtacgcgctcggcaaatgctcgattttttggcgaaatagatgctgtacccaggcaagcagttacgatgggagtaggcacgattcttaaggcgaagcaaattatactggtggcttttggtgcggataaggccgacattataaagcaggctttaactggacctgtcacgactgagtgtccggcttctttgctgcaatgtcaccccaacgtacttattttactggatcagaaagcgggaggatggttcaattgaagtcacatgaaatgagtggtaacgtaccccagctactgtatgggcaagttgtcgttggaaatgacatcattgaaaaaggggttgtcgtcattgaggggcagtccattgtttatgctggttccgagggaaatttgcccgccgattggacatcggtagtcttggaaaatcaggaagaaagtgcagcgagagcggtaaaaattgtgcgtctggaaggaggctatctgctaccaggctttattgatattcatgttcacggcggtaacggtgaggactttatggactccagtccaaaggtgctggatacgatcacctcctttcacggttcacaaggaacgacggccatgctggctaccaccatgaccgcgcccaaggaacagattgaccgagtattgagtgaagttcacgcttatatggcactacctatgccttatgctcagttggagggcgtacatttagaagggccgttcatcagtccgaactggccgggagcgcaaaacccagaacatatcgtgccaccgaatctgtcatggatggcagaatgggagcagcgctatccaggccttgttcgccagctcacgcttgcgcccgaacgggaaggagcgctggaactgattgcatggctttgcagccatggcattaccgcggctctcggtcatacagatgctacgtatgaagaggttgaacaggcagcgacggcggggctgaaccatgcagtgcatgcgtttaatgctatgactccgctgcatcatcgcaagccgggagccgccggagccgtacttgctgatccgcgcattgaagcagagatcatcgcggacggcattcatgtgcatcccgccgccatttccctgctcgctaggttaaagcaggatcataatctcattctcatcacagatgccatgtctgctacgggtctggaagacgggaaatatacgctcggcgatttgccggtgatcgtgcagggcggtgtagcacgactggaggatggggtcactttggcaggaagcacactaacgatgattgaaggcttccgctatttggttcaacatgtgggtatgagtattcccgcggcatcacaaatggccagcctgaatccggctcgatccttgcacattgctgatcgtacaggttcccttgaagcaggtaaacaagcagatatcctgttactggatggagacttaaagctgcaaggtgtatggattaaaggattgcgcaaataattcagttatagttatcttcccccaaaactaaagagctatccaccagcgtattcgctgagatggatagctctttctttggcattgcacacacttatagggtttgaattagcgatgattcatcggcgcgggcgtatgattttgtgggcgtgtgggtgctgtattttccattggacggtttgtatcagccgccgaggtcgggaatacacgttcaatcacatccaccatttcattgctcaagcctctaatcggatgaccattttgcacactgtgtgtaaagtcagtggcttgtttgacaaagtccgggttagcggatacatgtacctgttcaatcgaaggtgcaaattgcttaactttattcgcgatacggctcttgactgcatcacttggttcatatgcagttcttgctccctcgattgtggtgtttccgttatctccgcgattgttgtccgtcaagccacgcaacataccgtacgagcctgtacccatcgtaccgaataaaccgtcatcacgacgcgcaggtgttccattcccggtaactccatttccggcaactccattgtctgtcattccaggcgtcgtagtatccgtagtacggtttcctctagtgccattaacgccattcacactcggtacattaccgttacgtccaatactattagcacctggagtaccgtcaatgcttggagtaccgtcaatacttggagcaccgacacctgttccgttggcttggtctttcaaggaaacggctacataggcatgtcgttcaccgaccagcactgtcgcagactttacatccggcatctcagatatacgtttggacaaactgcgatcgacttgcagattacggactggatgtccggttcggttgccattttcattcaatgacatcccgtccataccattggacttaaccccataacgattcacaccatccataccattacggttcacaccatccatatgatgtgtgctttgcgcgttatagcgtgtactgttcgtacgaacgttatgatcggcatttccgcacccggtcaaagcagccatactggcgagtaaagcagcagaaatcgtaaaactgatgaccttcttagttcctggcatgaactcatcctccatacattataaaatgtgtgacgagattatcatgcgctatgaatcatagggatatcctgactaaaaaatgactaaaaaaataaaattttaatgtaaatatgaaatacaattgatgatttaccacaagatggcatgtataataagcttgaaaaatactttattttacaaaggaggattttcgatttgaaaaagatcactgttttgatgctcatttttttgttatcagttacccttgtacccgtcggcgcttttgcaggctccactacaccccaacccccgaaagatcccgccggaagctgggcagaaggcccaccacctaatcgcgttgatcctgccaaacctgcattattattcgtacatggtttgaacagtagcgctgaagtctggaccaaaaataataacgacatgcttcatcgcgcacgtgacgccggataccagacggccaccattaatctgtacgatacaaatggtacatcccaggatatgtgggacaatggtaagcttctggccgacaaaatcaaggtcatcagtaatcactttggaaaaaagctcattgtcatcgcccacagcaaaggtggagtggatactcaaaccgctctcgtatataacggagctgctccttatgttcaacgtgtcatcaccctcagcagtccccatcatggctcacaacttgcagatctcgcctatagcagctgggccggatggctggcagacatcgtcggctcacaaaatcccggtacctctactttacaaacatcttatatgaagtatttccgatccaagaccgatgcactcagcaacgcaactacaattccattcttcacgtttgctggtgataactggtctgacggcactgcttcctacatactcggcggactttacctctcaacctttggtaaaaatgatggggtggtcacagtcgacaacgctaagctccccggcggacgtgtagttaaaatcggatcttgggatcatgccaaggttcgtaccggttcttacgtcttctccctgatccaaccctacctccaagcgaacactccagcattgaatcaggaaactgaagcactttcagcatcttccctgactgcttctgctgtacaatccacctataacgagatcgataattcatactttatccgaggcggcgattataatggaaaagcctcagaaaccctcactgttgaaaatggtgtcaaatccattgatctggactggatcagcgataaacgtgtgagtaagctggaactaaccaagcctgacggtaccagtgaaattattaatctgaaagcaggctatgatgacgatatttttgctggtgcctggcatcataatgccgtcattcaaaatccaaaaccgggcacctataaactgaacgtcatagttcctgatcaaggagcatatctcctgattgcacgttaccaggctgttcaagttccagagctgaaatacaatctgaatgcagtgggcccgaagctaaacctgaaaccacaggatgccccggacagcgttacacaagttacttaccaagttcaatattatggtgacccgcagcaaggagtcacttctgcctccaaaggtttgacggtacagcaaaaaaccgttaaccctaccggacaaatagagctatccaaagcggacaagcccggcatctattctgtaacctatgaaattagcggcaccacagaggcaggttatccgtaccgccgcacagctgttcaatccatctatattgatgctgacggcaataagtatgttgactaattaaatctacaacctaaaaagcctgcgaacccctacatatatggggcgtttgcaggctattattcattacaaaacttcttgatagtggtaatactttgtaatcccattcttgtgttcaatcggttgtttgattctgattcctcagcttatgaagccgatagtagcggtgtaaatccataataaaatggaaaagaacaaatgccagcatggagtatacactgatcaatactgtggcaactaattgttgtgtagcaaatccgagggaaacattagctatcagataaccagccccagtaaatgtggtgatcgtcactacaggcgctctcttgtttttttccttaacttttggtttcttcttatgttctgaaggatctttgaatttcgccaaattatattttataaaggaatacaaggcgactccataaagggcaaaggaacctataaaataccatgaagtatccagacccaacatgccataagcaaacttttgtgtcatgataatgaagcctatagaacaaatcaaaccaaataccccacggaataaagtgtaattcaactgcaatttgcgtggcatgatgaccagtactagagcccaaatgtttatcataacaatcggtggcaacagtacataaacgtaaactgcaatgtatggatttcccactaaggggataaccagaaacagatctaacagtaataaaacaagaatgatgacattggaacgaatactgttgactgggtacatcttcatacttttctcaaaagaagccctgttatcactcataaacttataagccctccgttaaataagtaaacctacggataaggatagccaaggctatatccattgtccacttttctattgaactgtttttaactcttgtcgcagttcttctataaaatcagtcacaatgctttggacagcatcttcacgggacatacgaatataccgactggtcttttgaatgtcttcctcgaacaattgaagtatcctatacatggcctcctgatctccacttcgtactaattttagcaattggacgaactcagcatccgaaataactctttgagcattttctttttccatttattcaccgcctgttgggatagctttaactcttttgcaatctgtgcttcggttttgtctagtatgtaaaggtcaaagatgatcatttttccgatctcagaagatagagagttgataagctgtagtgtgtacatattagagtttgaagattctgtaaaagatggggcgctgacggcttcgttcttttccattacaaattcatgattggtttgtacccgagcacgatactggattctccaagcaatgcggtacagcttctttcgatattgttctaccaatgttagctgatactgatccattgtaaatcaccctttctctttggatttgactttttctaatcctcatactatagggtaatttccaaacctattttacaaccaaaatcagaacacttgttcttatttattatactatttttacaatcagttgtatatggttcttttaatttaccttcctttatatatggctaaaaaggagggaatacattgcaaatggatgatgctctttctctggttaccaacgtaggctttccagctggactttgttttattttgttgcggcacatcctgcacacgatggaggaaaagctggacaagctggatctctcacttcatgagctgattcaggttatccaagaattaaacgacactaacaattcttcttccaaaagcagcaaacctgacgagtaacgaacacaaagaagctccagacgacgatcatccgccgttggagcctctttgtgcactaatttaattctaatgattattttccagtctgagcttggtcgtgtccattctgttcagcacggttcacgtcagatactgacagaccataagcccagttactttgtggcggtacaatccatacgttatctggatcatcgttaagcatccagccctgatagaccaactgggaatcatccttacccagcgatacgttcagcgtaaagcggtgaacaggcttgttcagctcagaggctttgcgcaaggcctgactgctggctaggtttttgatttgctgcgagagggaagtcgccgtgtcactggctactgactttccgttcagcgtccaagatgtggaagcactgtctccggttccgctgttaccggaggatttgagcatccatgaagcattttggccttcccactctattccgctcagcttggtatcgtcccaatcgaacggtgttgtatctataaaatcattagcacccagcaacaaccctgaaagtgtatcgataggtacagaagctatctcttttttgtctgataatacataaacagcatctccggaaggcaacgtttcaccgaaggcaaaggtacgaacgtcacccttcttggtcttaatctcaatctgatcattggtagcgctgatcccatatttggctacgtctgtaggagaagattccaccacttcacccaactttacattttcaatcgctgctagccaattgtctattgtatattggtttaatgggtaagtccgtggcttgctcatactccattgaccatcatgttgttcaagttccaccgacttgccgtcctttccagtgatcgcgaaagacgtaatatccccttgcgtaagctgaaccagctggcgagccgccggcgcttgttcacgaaagaagttttggctcttcgcatagattatacccgctcccaatacaactaacagtagcactgtgggtatccattttctcatgctcttcttcgcctccaccataataagattccgatgaccgcgaacagcaacggcaatccgatgacagatatggtcaatatcgttttcgcttgtgcaggagtcaagtaagctaccttataatcctgctcctgacgaggacgaatggtgagcccatcagagtgttcctgcacataattcagactgttcagcacaaagtctcgattgcctcctgtgctgatctcagtgtcgcttaagagggccgacgttccgagaataacggctttgggcttgccgtctttcccttctaccgcataaccgagattcagcggcccctgcgggtctttgtcatccttttgcgtttcgttgttcagcagtccttggatattcgtttcaccatagctggctgcagaagatttcatcaaaagcgtcgtcttccaatccttctgctctcctgcctgcaaagcaatagacagtgaaagaaccgggtacagattggaagctgccaacttatcggtgatcgcatgactgccgaaggtagggaccgtccatagaggtccaagtgtattcgtctgttcctgatccaccacgatggcatgagtgtccttcactccataatcagctgctaatgcatcaaggtttttccaatcggaccccatgttcgggtgaaagcctagtgccataaaaagctttccgccatcattcagatacgtacgaatactcttcagttccgttgcactgatatcacgttctggtccgacaatagccaatacagacgcatctttaggcacgctacccgcctgattaagctgaacttcctctgttttcacattatcttgtgacagtgagctgcttaattcagtcatttgggacaatgggatttcctcatgtccagtcagaaagaccactttcccttgacgggtagatgataatcccagcagtccactagtcagcttttcttccccggtaaattggtatgccccttcaccactcccctgagcttgcgtaaatagactcccaatatctataacccgcttcttctccccctgcaccaacacaatagatgctgaagtaacaccatattgcttggccagtatcggttcctgattcagatcgtattgctcgaccttgagcttgttgttacgcttggcatattcattcagcatgtccgtaacatcccggttcagcttctgattttgtgaagtagatacggtaaaagcaatgagccgtacgtcttcctttaccccctggatggtcgtcaacgtttggtcagacagcgtatactgcttgcctgccgtcagatccagttgaaagccccctaacgaccgcagaaataacgtcaataaaataaaaatccctacagcagcaattgatagtaccacactattggtatgacccagccattttttcatattcattacctccaccgtttccgttcaaccacctggatgctgaatagcaaaaagagcaccgccactgtcacgtagtacatcacatcggctccattcagcaaccctttggtgaaactatcaaaccgtgcggttagtgaaaaaggttccagccattgctgcaccgccgcagatgcacccgtctgtccaccaaacgaatccagcatccagaacacaagtaaaataataaaaccgacgaccgctgacatcatctgatgctgtgaaagcgtcgaagcgaataagccgatcgccatcatggctgcgccaagcataaacagaccgatcacagatgtaaataccagtgtccaatccagcgacccataaaaggacatcacgaccggatacgctagactgcacagcactaatatgagcaacatgcccagcgacgccaaaaatttacccacgatcatttccgtcacactcacaggtgaggtaagtagcagttcatccgtaccttgcctgaattcctccgcaaccagcctcatcgtgagtaatgggacgacgaacaccagcatggacaaggtgtcaccaagtaccagccgatagtccagaatgctaggctgatacataacaaaatttgtataaaaaagtaaccccgtcagcagcatgtacactgcaagcgcaaaataggtcgttggtgtccacaaataggcttgcagctctttttgacagaccgcgaacaaacgcctcatgaccgattacctcctgtatccttatcttctttagccttatcgtcgccggacgcagcatctccatgctccaccgtgatagccgtaggggctgcattctccgaggaatgtagatcttgtactgctggatcgctgacctgaccttcttccgtctcgcgggtcgttaactgctggaagatattttccaagctaaggctttcttttttcatctccaaaatcggaagcttcgcatcagacagcacataaaatagttcttcgcgaaaatcctcaccggaggctcctgtgagtagcaatccggtcatatctggctctgcggcagtcagcttcgtgttcgctggaggctgcgtggccgccatagattcaacctctacttttccccaattacgcaggacatccagcacctgctcacgcttccctctgacctccaccttcaccttgaatccatcttccatcgaaccgccgagcgcgtcagggcgcccatccatgaccagtttcccttcatggatgatgagaacacgattgcataacgcatccacctcaggcaatatatgtgtacttagcaataccgtatgattttcgccaatctcctgaatgagctgacgaatctccaaaatctgattggggtccaaacccgaagtcggttcatccagcaccagtaaatccgggttatgaataatcgcacctgccagtcccaagcgctgtttataccctttggacaaactgcggactaattgtttttcccgcccattcagtcctagcctggaaatcatctccgaaatacgcagcttctgctctctcgcaggcacgtcccgaatactagctacaaacttcaaataggatcttacggacatatcctcatacaaagggggagtctccggcagataaccgattttggaacgggcctgtctacccttatcctgaatcgggataccatcaatcgtaatcactccctcgttgggttgaagatatcctgtaatcatgcgcatcgtcgtcgttttacccgcaccattcggccccaggaaaccaacaatttcaccgcgctgcatttcaaaatccagcttatgtacaccccggttgccctcataccacttgctcacctgctgcactttgagcacatgttccaccctttcctttatcgtattgacaaatcatttcgaactacacacacatatcaaaagaattccatagcgataagttcggaagaccaaagccttcgcgaagcgggcctcctcctacttccctcccacctaaaatgttgcatcagtcgtgggtagcagcagagcggaggatttggagctggagaagcgccagcgttcgcctttgccttgggatttttacctttacatgtcttacttaatcacaaaaaaatcccacggcaacagcgatcggaagcccaaagccttcgcgaagcggcctcctcctacttccctcccacctaaaatgttgcatcagtcgtgggtagtagcggagcggaggatttggagctggagaagcgtcagcgttcgcctttgccttgggatttttacctttacatgtcttatttaatcacagaaaaatcccacggcaacagcgatcggaagcccaaagccttcgcggagcggtctcctagcaccttatgctacacttttaaattctaataataatcccccacatataactccagcttaacgtcacttaaatagaagcttaaaataatgtgtctgaaatgtgaacacaaaattacacatctaccctcagaaacttgtacggttcgctaaggtatggattcgcatctactatcattacaacgtgtgaagggagtgtataaaagcgatgagtgtattgtttaccaatctagtttctaacggcgacttcgagatcggatcaacccttttttggagctctgtcaatgtgactgtcactaacttatctgtaaaaaagacaaacttttatagtgcgatcctgacaggaggcgcagtagatgcatctctttcccaggtcgtttttgctgcaccaggcgaaagttatacgttaagcctttcagctgcaaaaataggaagtctgtccagtcctcaagttaacatttttctgtattactatgacgcaacctttagcttccttggcacggggctaactacctatttgagtgcaggtacattaccagacgctgtgaatgggacatggcaaagcctatacgaagtaacagctcctgtaccagccaacgcagcctatgcctttttggttattagtaaaaacgccttggctaacaccgctgatgtagctattgatgccgttgctcttgttaaagcaagtgcagctggagctgtgggtccagccggacctgccggcccaactggtgctacaggcgctagtggcgctacaggtgctacggggcctgcgggtgccacaggcgctacgggcgacactggcgttaccggacctgtcgggcctacgggtgccacgggcgacacaggtgttaccggacctatcgggcctactggcgataccgggcctacggggccgactggacctactggaccatttggccttggatttactggacctgtcggacctacgggtgccacgggtgatacaggtgctaccggacctgtcggacctacaggcgctacgggtgatacaggatctgctggacctatcgggcctatcgggcctatcggcgacacaggcgctactggacctgtcggacctacgggcgacacgggacctacagggccgactggacctaccggaccgtttggatttactggcccgattggacctacaggacctacggggccgactggacctacggggcctaccggactctaagctccttttctaccacatcatgtttaagcgatgtaccataccttatggacaaagccgcacagcatgttaaaagctttgtcatccttgccctgccgcgattgtggcagggcttctataaatcaggcctcttttaaatccaactttatgtttgacctgaactcttagatggttcccaaaggagtgatgctcaattgatcagtatcagcctgtgcatgatcgtcaaaaatgatcaaaatacaattggccgttgtctggaatcggtccatcctattgtggatgaaatcaacatcgtggacacaggttcacaggatcggaccattgacatatgtcgcaactttacagatcgaatttttccatttgaatgggtagatcattttgcccttgcacgtaactattcgtttgagcaagctacgcaggagtacattctctggcttgatgccgatgatattttgaaggagcaggatgccgtcaagctgcttgagctgaagcaaacccttgattcctcagccgtaccaaccgtcgattccgtgtctatgaattatcattatggctttgatgatcatggcaatgtcaccctacattttcgccgaaaccgcttgatcagaaggtcagccggattccgttggcacggagctgtgcatgagtacctcgccgtagacgggaatattcaacatgccgatatcgccataactcataccagaacacatacagtctctccaggaagaaatctgcgaatttatgagaagttgctcgcccaaggtcataccttctctcctcgtgacctctactattacgctaacgagttaagagataatgaaagatatgagcaggccgtgcaggcttaccagaattttctggataccggacagtgctgggtagaggacgcgattagtgcatgtagcaaaatggccgactgtctgcaacaacttggcaagctggagcaaagtattaccgcggctctccatagtttgaccttcgatacgcccagggcagatctatgctgtcggataggtcattattttttgcataaaaatgagatctccaaggctatttattggtacgacatggctaccactctgaatcctcccgacacgatgggcccggtacaggacgcgtaccaaacgtggtttcctcatatccagctatgcatttgccattttcggatgaaggattacacacgtgcggattggcacaacgaacaagctgcaatgtacgttcccaacgacccgcatgtcctgcataatcggcaatttttcagctcaatcctgaatcctccccaatagagatgtctcccatactcacccctcaatctttaagtaagtcaaaggaggagcaagcggaatgcaacaatcgaatcggtacaagatagctgtctatgccattagcaaaaatgaagcccgattcgccaaacgctggatgcacaccatgcgtgaagccgatgttgtcattgtagcggacaccggctctacagacgatactgtttccctgctacgcgaagcgggtgcagaggtgcatcgtatcgaggtaaatccttggcgttttgacaaggctcgcaatgagtccctacgactggtccctgacgatatagatatttgtgtctgtacggatctggacgaagtctgggaggaaggttggcggtcgcggctggaacgtaactggaaggaaggaactacccggatgctatatgcctttacgcatggacagcctgggcaagataccgtctatacatggttctggaaagaaaaaatacacactcgtcacggttaccgctgggtacgcccggttcacgaggtgcttgaatatatcggggaaagtgaagaacgtagcattcgatccgatcagctccgcttgtatcatgatcccgatccacacaaatcccgcagccaataccttccgctgctggagcagtctgtgcgcgagtttcccgaggatgaccgcaacatgcattacttggggcgagaatatatgtatcatggccgctgggatgagtgcattactacattgcaacgacatcttaccatgccgcaggcacgctgggcagatgaacgcagcgcttcgatgcgctttatttctagagcctataaagcaagtgaacaatggcaggaggcaacacgttggttataccgggctattgcggaagcgccgtatttacgtgaaccttacacggaaatggctcagctggcttatcatacacggaactggtccgccgtctatcatatggttgaagaagcgttgcgtatttcaacacgacccgatacgtacatgcaagaagatttttgctgggacgccacactgtatgatcttggtgccctcgcttgctacgagttaggccttttacacaaagcttgtgaatttgcgagagaagcaacagagcgctccccggacgattctcgccttagccataattatgcgctaattcaatctaggcttccatagaaacccacaccccgtcctgtaggttgaataacttggtataggagcttgtgactggcaaaggaggttattgagatcaaagttctatttactttttatatacccagtggcggcgtagaaaccttgaaccgccaacgctgtaaagtgctcatgcaggacgggattgaatgtcatcttctctattatcagcaaggtacagggatgcaaaacctgaacggcgatattcctgtattcatgacttcctctgaagaagaaattcgaatgctggtaattactaaccgctatgatgcaattatcgtatcatcggattatcctatgctccccagactgcgaatgttgggttatcaggggatattaatctatgaatcgcagggctttggttctcacgaagaggctgcttgggtggtcgcggatgcagttccgtatcttcagaaacatgccaacgcggtgctcttgcccaatacaactcatctggtgcagctatttaccgacatgtgtccatggcttaatcgttatgtatttccaaacgtactggataccagcgtatttaattatgtacctaacactcctccgatcaatccgattattgcctgggttgggcggttggagcccaacaagaactggaggcattttgtcgacatttcttactggatgctgcaaaaccgtgcggatcttcgaatctggatgttttatgatgacactttgtctcagccggaggataaaatacaattcgagaacatgcttgctcagcttggcatgtcctccattatcgagcgttttaaaagcgtacctcatgcccaaatgcccctgtactactccatgattggcgactcaggcggctacctgctatcgacctcgctggtagagggcttcggctatgcggttgctgaggcgatggcctgtcgttgcccggtattaagctctgattcagacggagtacgagcattcattgaccacaacgaaaccggtaaattttatcagcagggggacatcttgcaggcgatactgcaaggactagacctgatgaacaacgtacctcaacgcgaatctatccgcaggaaagggctggagcgaatcgttagtctgttggcaccggataaatatgtgcgctccttccggcagatgatgaacacgctgggtgtgaggtaactaaaaaacagctgacgacaaccctttttatatacgggtcaccgtcagctttaacttgcctttttattatggaatattggaatctatctaatctttagtaagcggtctcctgcatgaatatccttggagccttcaactaagatatccgtgtacacggctgtattggttacaatgacggatgtggtaatatcatatccttcatcctctatagctttgggatcgaattcaaccagcttgtcccctttttgaatcgtatccccttcagacacaaaggaagtgaaatgttttcctttcaagctgaccgtattaattccaatgtgaatgagcagttcaaccccatcctcagaaataagcccgatggcatgcttggttttgaaaacggtaacaacagttccgttaaatggcgcataggctactccttctttcggaataattgcggccccccggcccatcgaaccgctggaaaaagcttcatcttttactgcggttaaaggaatcaattcaccatgtagaggactgaataccgctttttcttcttttttgttttcatctgcaattttaatctcagacgcaggttttgcatttttataaccgaaaagataggtcaaaataaatgcgactacaaaagctacaaccaaagatatgataaagccgataaagcctgcatccatgccttttggattaatgaatagaggtataccaaaaatgccacctgaggcaaatccatatgccgttgagccgagtaagcctgcagcagctcctcctatacctccagcgatcgaagctaaaataaacggttttttggcgggtagcgtaactccgtaaatagctggttcagtaacccccatcaaacccgcaattgtggcagaagtggcgatgggttttaatttagggtcccgtgatttcaaagcgatggcaaatgccgcacctgtttgcgcaaatgtcgtacagaatagcataccgttaatcggatcaaacccgttcgtgactacattattcagtagaattggaatgaatgcccaatgcagaccaaagataataatgccctgccagaatccggccagaacgaggccagctacagccggacttaactggtaaatccacatggagcctttggctaacccatcgctgattatagttgctatcggtccgacaaccagaaaaacaagcggtgatatgatgaccaaggtcagaaaaggcaccatgaacattttaatggaggcaggtgcaaacttacttatcattttttcgacctttgctgccaagaacgctccaataatgataggtataacagaagaagtataattaatcagaacgacaggtatggtcaaaaaggacaacgccgttttatccgtaaaggcggaagtaatggtcgggtacaccatcgctgctcccaaaacggcagacagatacgggtttcctccaaattttttacctgctgaaaaccctagaataaccggaaagaaataaaacatagcgtccgctgtcgcatataaaattttatacgtgcccatctgatcagtcatccagcctagggatgtgcataaggccaatagtccttttagaatccccacagcagcgagcacacctacaacgggcataaacacacctgaaattacatcgacaaatcggctgaataggctcgctttttcattcttttgatcctcttcaaccatctgatctccatgctttactcccattatatccaaaagagcttcataaactttgggaacctcattcccgatgaccacctgaaattggccaccactttccacgacggtaatgacaccgtcaatctgcttgatcttttctttatctggaaattgattatccttcagtttaaatctcaatcgagtgacacagtgaatgacactgttcacattttcatttccgcccacggcactccatacttctttggctgtttttttatgatccatcatgttcactccttcttggatgcgctttctatttttctattcgtagtagtcggatgtgcaataactgcgacaattacggcactgattccgcctgcaagtttacccacgatcatggcaatcaccatattcttgtccatccctgctacaaagccaagatgtccccccagaacgaaagatccactgacagcaaaagcaatactaatcactttgcctctgggctccatctctttgactaaagtgaacgtaggaatgttatgagcaagactagctaccagacccgcagtagtcgatggatctatgcttagtaaacgtcctgcccgttgaagcggatttttaaatatttttgtaatccaagcaaccaacggaaacgcacccgccaatacaatagcaatcgttccaaccgtttgcacaccgacagacaacggagccatattgggaatgatcacaaatccagttaaggtttcgaccccaatcgctgccaaaccgacaagggatagaagcctaatgccgttaccaaaccacttgaacaatcggatcgtaagctccgtaaatagacgtaaacccagcataatgattattgaaagaagcatgggaatgatcagattttttaaaatcatcatcacgtcaaaaccagcggttattccccctatgaaacaaccaaagggaattgtactgataccgatcaagattccttttgcaaaatatggatgatcctcttttcccaaaatgccgagggcaaccggaatcgtaaatacgagcgttgggccaaacatggtccctagaaaaacccatgaaaacaaacccgcttgctggctgtgcgccatttctgccgcaagcgcgtatcctcccatatctaccgccaatatcgtattggcaaaggatgccggatcggcacccatggccacatataatggtgaaacaataggaatcaaccatgaggcgagtacaggagccaaggaaacaattcctatcatgaccagagcaagagaacccatggtcatgagcccgttgttgaaggcttgtcccaacccccagcgatttcccaaacattgatccaacgcacccagcactaaaaaaagagcgataacatacatcacaatatcgttaatggacatcctgatgcctcttaatacacatgaactttatgattttctgcgctgtcataggtgtcgaatacaagctgaagggtcttgatattgtcgtgaccactcgtttgaaattcttttcccgtgttgagacaatctataaaatgagcctgtagccttttatggctttcctcatagtttaattcagtcttttcaaccaatactttttcgactccctgattattaatgagacataatttacctgtgttatacagttttagggtagcctcatcgccttcaatcaccagctgttctttatgatcgggaaggacctgctctggaagctgcccattgagttccctacgagtcgcccagctcatgtccataagaccgaaataatgtttataacctaacataataatgcccgtgtcttctccctgtgtgtatgggctgactcgcttggtttccgcatacaaacgctgaggttcaccgaataagaaacgccaagtatccagccaatgaactcccatttcataaaacaagagcttgggcatatctctgaaaaatggctgcggcagctctttttccggagcaaacctcggcgaataaaaatcggtatgcgtataacgtataacattcatattcccaacgatattctctgccagcaatttttttataatttgaaaaggctcaagccaacgccaattttcggtcaccataagtctgactcctgctgcttcagcaatacttacaatttgctcagcttcctccacagaacgtgcaaaaggtttttgacacatcatatgttttccggctgcggccgccagtcgaaccagttccagatgtgtctcaggaggtgtaatgatgtccacgacatcaatatccgcttcgcttagcatttcctccagactggtatagcaatattcagtagggatatggaattgagctgctttttcaaaaagtaaatcttgatttcgatcacaaaatccttggatttctacatccgagataaactgccatgcttttatatgtttttccgaccaatatcccgttccaatgacgccgattttccacatgttgcttcactccatccacattcttctctgtttttatttcgttccgataatgacaacatcactttcaaagctgtgcatatctagtaccgattgatccttttggacagacacgtcggtttgggcaaaccgcttcccggctaaatcaatcgttgtaaacttgtaatcctgcacgttgatacttagccgtaccttcgtgttaaccgggacatacaagacaatgatattctcgttccccgcagctctgatttcctctgtcttgtttaaaacaatatccaacggctttacgccaatcaggttatacatttcaaacaaatatttaataaaggaataatcccatgcgccctcaaatcgcaatgctgttctccaatcatagggactatcgaacccttccccttctacaatgccgaatttctttccttttttgtgccagctccaaatgccatgcgctccgtaggtaatgcccgcacccccgcctgcaaggaggctttgccatgctacttttctggcatccagtgctgtgtatctgccatacacattacggctataactaatttgttcataacatggctctccattaatgacaggccgtatatccggcttatggtagaaatgttgagcaatctcatggcccacatgctgaaactcggaattatgtcctgattgatacatataaaatccaagaccctggtgtttctcaaaggctggaggaatttctctcaatcttccttgaatatgcagcgtagttaagcttgcaggacttaattgttgtacaatttccagtgcttttaaataataggaattggcacgttcggtcggaaaatcactatccccgctgatcagaaaaataggatcaaatggagaaaaacggtttacgacgtacgttacatagggttcaacgcattcaaacggcattttattacccttttggaacatttcagcccatgtatccggcacatagttacaccacaatagaaccagggccggaacaaatccacgctctacagccattttcaacatgatttctgcccggtcaaaataagcttcgtttaatgtatggtagtcgaaatccccattttccagtaatgcaaacggctgtagattcagatccgattcacttgcatcccattgtcggagcatgttgatttgcaacacattgaaaccttgcatcttccgatagtcaagataatcgctccactcctctatcgtcgcgttggtaaatacactccaaaccgtatctgccaaataaaaaaaaggtttttcctcttttgtaaaacttctttgattttcagccatgtttaaactcaaatgaatcacccttcctctcttgctgtatccacaaaattctctaaacaaaactaaataaacaactaaatttatatgattatttcgcaaaataactaaattaaagcgctttacacttgaatattaacactataaatcataaacggccaacaaatttttatttttagtcatttagtttagtttagtttataagctaaactttcttgcagagtaatgatataatttatgtagtttagttcaatagggggttccacattgaaaattgatgatattgcaaggcttgcaggtgtttcgaaatctgctgtctctcttgcttttaataacaaacccggagtgagtgaagaaaccaaggagcaaattctaaaaatagcccaagagcatggatataaaccacgcaccatgaagacaagcaaggaagttattaaaaatcatcatgtgatacgctttgtggcctgtaaaaatacagacatcgtaacagaacattatgattcacttccatttttcaatgagttaattcatcatattaccaatcaggtgagagaacatggaaacaccttgattttttcgtcttttgatagccatagcctggaagaagaattatctgctttggaaaaagatcagccttcttcaggcatacttctgcttggtaccaatttaacttctgagactattcattccatacaatccattcattccaatattgtgattctggatacctgctttgaacacgtcgatgccagtttcgtatctattaacaactatcttggtgggtatcaggcaggccaatatttaattcggtcaggacacagaaagataggatacgtacaatccagtacgaggattcttaactttacaaaacgaaaggaagggtttatggcggctttagaggagcacaatctttccatagaaaatgggcttacatttgatatgcatcccatgcttgtgatgtcacaggacgcatttaaaacagctattcatgaactgaatgagctaccttcggccctattttgtgaaaatgattatatggcgatcagtgccattaaaacgtttcaagaaatgaatattcgagtgcctgagcaaatttccgtcatgggatttgataatatacatgaagccaaggtgattagcccggaactcacaaccattcatgtgaaaaaggatattttggctcgaactgctgtcaacttgcttatggagaggcttaaccatcatcaggggcatcatactcaggttcttgtgaatacggaggttattgaaagaagatcttgtttagcctcagaataacctatgatcattggtttattattgcttgctgtctctatgattttagaataaagccgccgtgttggcggccttttctattacgaactccatatgggatattcaaatttatggttattcgttgaaatcttcctctgtcaaatccatatttacgctcgcagcggttcgactgccgtcggccgcggcaaaaatcaactgggaaggcatgaagtacgatgaatccccggcagcatatacaccaggtatggaggttctccccgcttcatccgtcttgatcccacccgactccgttctttcacagcccaaacgttctccaaacggtgcactttgtacaaactggggagacacaaagccgccgatcctcgggacttgagtgccatccgtaaagcgcacatgctcaagctttccattgtgaccgatgaactccgcaacaggttgctccattacgatgattcctttagaatagagccgttctttttgctcgtccgacagggatgcctgaccattcgtacagacgatcaaatccttactccagttaaggagtagtttggctgtatgaaatatagctgccgattcagagacgaggacaagcggttgatcccgcaactcccagccgtcgcaataagggcaattaaataaacttttcccgtataacggataaaaaccttcaatctcggggaatatctcctttacgcccgtcgccaatatcaatttccgcgcttgaacgcgatggcctgacgaatcaagtacctcaaatccagattcgttttttgtaatcgaaacaacctcggtttgcagatgatggacagacggataacgcaacacttcctcataagctacacggcggaactcggccggcgttacgccgtctctcgtaataaaaccgtgcgacgcatgcgtaaccgcatttctgggccgattattatcaatcaaagccacacttcttctggccctgccaagcacgagggctgcattcaatccggcgggccctccgccaataatagcgcaatcgtacagcataacatccaactccttttaaaagatattagagactctttatatcttcaataaaacaaaaaaaagctttacataactggcaaccaccctctttctatataaagtcgcttactttgaaacttgcgtttgcttttgcgccaaatcgaccaatttcgtatttttaagatgtcgttccattttctcctctgcttccctcattacagcttgaatcaggcactcggagccgtggacaaaatcacattcaaacaaagaattcgttccttcaatggcatggataatatccaaaaaggtaatgtcctctttatgacgagaaagtcgatagcctccattggctccagaaaccgattcgatcatcccagccttcacaagccttgtcaaaattttcgaaagataagttggtgaaactttttgggattcggctagttgctgaacacctaccggcttcaccgacgaatcagtaacgagcatgagcatagtgtgcagagcataattcgttgcttttgtaaatttcataactacacctcaatcaaagacttattgtatccactatatccccgaatctgctagtgtgtcaagtcatctagcattcacgctgctgttaatccttcttttggttacgttctaaccgttgtatactgttcatcagaacagctaagaaagggggctcgttgtgcgtatttttgatattcttcgtatattggttgcagaacagatggtcaaaggagaacacttggcaaatgcattgaaggtatcttctcgaacgatacgaacggatttaaaggaattgggtgctctgttgtcaaagcatggagcagcagttaagccccttaaagggacaggctacaagttagaggttcgggacgaacaagcatttcatcatctactgaagcaattaaaggattatgatcatcatgtgccctatccattagcgagttcttctgaagctagaaaccgttttttaataaaaaagttattgcttaccaatgcatatgtcaaacttgatgatttagccgagatcctgtatgttagtcgatctactttacagaatgacctcaaagaactgcgcaagctgctggcaacttacggactatctctggagaatagaccctatcatggtattcgagtcaagggtaatgaggccaagctgcgttattgcatttccgactatttatttaacaggttagatgaaataggcgagcagcaggtgtccccccctcttctgatctctaacgaagagatggaattcataagagaagtgattctggatcgtattgagatccatgatattcagttgtcggacattgccctgaacaatctggtcattcatatcgctatagcatgtaagcgtattcgcgaagaaaggtatgtgtcgtattatccgcaagagatgaaaaaaattgaagcgcagaaagagtttagggtggcgactgagatcgtatccgccttggaacaaatcatgaagcactcctttccacttgttgaagttgcgtacattgctgttcacctgttgggtgtaaggaccgtcgttagtgcccgtatggatgaggtggagattaaaaagatcattgataaagatatctacgaactgactatcgaaatactagaccaaattgatcagcagttgaagatgaacattcataacgatcaagaattgctaattgcattttgccttcacctcaaaccggtgatcaaccgttatcaatacggaatgaatttgcgtaatcctatgctggatgaaatcaaagccaattacccgcttgcctttgaagcaggtatcattgctgcggaagtcatcaagcagcggcttcatatacacatcgaggaaaatgaaattgggtatttagccattcatatcggagtcgcgatggaaagaaagaaaatggaggacgcgcccaaaagatgtatgatcgtatgtgcttctggactcggcagcgctaagctgctgtattataagcttcaatcggttttcggttccaggttggatatcgtaggaaccactgaattttataagctgaaacaaatgccgttggatacattggactttgtcattagcacgatccccatttcagaaccgctttctatccccatgatccatgtgaatacatttttaggcggttccgatattactaaaattgagcaagccatttctgagaccagacttcctgctgtgcagtatgtacgaaaaaaattggtctttcttcagcagaagtttgagaacaaactccaagtgcttgaatttatagccgaaaaaatacacgaagcagatcttgtaaaaggccccctgctgcaatctgtaatagagcgtgaagccgtttcccccacttcatttggcaacttggtcgcaatcccgcatccgatggaacctttcgcagattctacgttttgggccatctgtacattacaaaaagctatcgactgggatggcaagccggtacagtttatttgtatgctctgtatacagcgcaccaaatcagaagatttacagactatgtatcatattttgcttgaaattttaaataatgaacagctcgtccagcagcttattcgctgcaaaacgtatacagaattcatagaagtgttgcacaaaaattgttgaacacaaggagtatgaagaacgatttatttccgttaagaagaggaaataatgtgcgttatgttgaaagcgattccaaattataatagccatacgacgaggatgattgaaaggagagaggatcacgtgaataatgatgaatctacagagcacgacgtgaacatggaggacatggatgatacagagattgtattccaaattatattatacgcagggaatgcacgcagctcggccatggaggcgattgagcttgcaaaggcggggaaatttcaggaagccaaagatgaattagccacagcaaaaaaagaactggtgtcctcccacaaaattcaaaccagaattatccgcaaggaagcaacgggtgaaaaaacagagatgtccgtcatgatggtacatgctcaagatcatctgatgaatgccatcaccattcgcgatatggcctcagagtttgtagacctgtatgaacgcattgatcaattcgtaccgaaatcgtagagggagggacgcgatcccatggcattcaaagacaaactggtcgatggcctcacatcggtagcaaatgcaatcaataattttaaatatattatagcgatcaaatcagcttttatcacattaatgcctgttattattgtcggtgcctttgctgtattgatttctaatatggtcatggacccggtcaatggtcttgcgcattttaagccgttctcattcctggctgagtacaaaccgattttctcgggcattaactatgccagcttgaatatccttaccattctggctattttcatgattggtctggagctaggaaaaattaacggtgagaaaaatctcttccccggtttgcttgctttaatctgttttatctctgtgacaccaaccacgatagagttgatggttaacggtgacatgcaaaaagtaacagacgtcttagcccgtcaatttacggataccaagagcttgtttttaggtattttcataagcatcctatccgttgagctgtacagtaagttgggcaagtccgataagctaaaaatcaaaatgcctgaaagtgttcccagcaatgtggccgtttctttttctgcactgataccaaccatcataacggtgacagtcttctcgatgctcggatttttctttcataagtttacaggtctctacctgtacgatgccgtctataatgtggtgcaaaaacctctggagactgtagtacagggactgccaggtatactggtgctgatgctggttgcgcaaatcttctgggtgatcggtattcacgggaaccaaatggtaaagcccattcgtgaacccctgctgcttggcgcgattaccgtcaacatgactgcttatgagcaaggactgcccattccgaatattattacgatgcctttctgggacgtatacatgagtatcggtggttcaggaattacgctggccctcttgatttgtattatgatcgcttccaagcgtgaagatatgaaggaaataacaaagctttcgttgggtccgggtctgtttaatattaatgagcctgtcatttttggacttccgattatgttgaatccattgatggctatccctttcattattactccgctcatcacaggaacgattggttacttctcgacgttgcttggatttgcaggtaaagccgtcgtcatggttccatggactactccgcctattattaatgcctacctgtctacaggtggaagcattggcgccgtcgtaactcagatcatttgtattgtggtagccattatcatttatttcccgttcgtcaaaattgccaacaagcgaacggctgaataatgcgttactatagaaatacatcaattaattgaaaacgtattctttatacaatgaaaaggagaaacatgtcatggctaaacatacgatacaaattccgtcgaatttcatcatgggtgcagcggcttccgcttggcagacagagggatggagcggtaaaaaagaaggtcaggactcatacctagaccaatggtacaaaaatgaccgctatgtctggcacaatggatatggacccgcggttgcaaccgacttttataatcgctataccgaagatattgcgctgatgaagcagattggcttaacccattatcgtacttctattaattggtcccgcttcttaacggattatgagaatgtagtggtggatgaagcgtatgcggattatatgggccgagtcattgatgagctgattgcaagtggagtcgagccgatgatttgtctggagcactatgaggtacccgcttatttgatggataaatatgagggctggtcctccaagcatgtagtggaactgtttgtaaaatatgcggaaaaagtgtttgaacggtacggggatcgggtcaagcactggtttacgtttaatgagcccattgttgtacaaacgcgtgtctatctagatgccctccgctatccctatgaacaaaatacgcgaaagtggatgcaatggaactataataaaacgctggctaccgcgaaatgcgtacagcttttcaaagcaaaaaactatagtcagcacggggctaaaataggcgtgattctaaatcccgaagtcacgtatgcccgatcaagcgcccctcatgaccaatacgcggcgcatgtgtatgatttattttacaatcgagtatttctggacccgcttattaaaggcgaatacccacaagaattgttcgatctcatgggcaagcatgatattgcatttgaagctacaacggaagagctgaccgtgattaagaaaaataccgttgactacgtcggaatcaatctctattatccccaccgggtcaaagcgcagagtaaagcgtggaatgaaaacacccccttccacccctcttactactatgagcattttgatcttccgggtaaaagaatgaacaagtcacggggctgggagatttatccgaaaatcatttacgatatgggaatgcgtattaagaacgaatatcacaatatcgagtggtttgtcgcagaaaatggtatgggcattgagaatgaggttgccttcaaaaatgaggaacacatcattcaggacgactatcgtattgactttataactgagcatttatactacacgttacaagctgtagaagcaggctccaactgtacaggttatatgctgtgggcctttacagacaatgtttctcccatgaatgcttttaaaaatcgttatggactggtggaaattaacctagacaatgatcgaagtcggcatttgaagaaatccggctactggtatcaagctgctatcaaggaacgctcgtttgttgctgatctggatgaagagtataagtagttaaaaatgaatttctggaggcgctcaacgatgaaaaaaattattctggcatgtgctgcgggtatgtccacatccattttggtttctaaaatgaaaaaagaagcggcagcaagatccatagagctgaacatcgaagccatccccgaaagcaccattaaggaagagctcgaaggcattacagattctgtgattgctattttgctcggacctcaagtacggatgcgtaaaaaggcagtaaccgaaattgctgctccctatagcattcctgtagatgtcattgacacgttggcttatggtagaggaaacggtgcagctgtcctggatcaagccttgaagctggctagcgagaacatctaattgctattcaaatgaaaaagaggctgagtatttcctcagtctctttcttgatatccgcgcgcttttgatcaagacataccttctttgcctgagcccatactgctcacatacgtttcctgtaaaccggcagaaatgccgtatagcggttcccaacgaagccaatgtctggcgactgcgttactaagacagctatggtgaatgtctcccgctcgcgccggtgaatatacagggcggacagacgaaccatgcagctttagtaaatcgtaggccagtcgattgatggacgtcgttcgtcccgtacttacatgtactgtgcgttgatccgctgcatgaatagccgccatattcgctcgaacgacatccttgacgtacacaaagtcgcgggtttgtgtcccatcaccgtgaatgagcaaggggcttccttttttcagccgctccataaagagagcgactacaccaccctctcccttcgcagcctgaccgggaccatacacatttccataacgcaaaatcgtgtagttcataccgtacagccgataaaaaagtcgaatatacgattctgcggtcagcttggacagtccgtagcctgaaatcggctccacgggatcgtcttcctgtatacattgcttttgtagctctccatatacaccggacgtggacgcaaatataaattttgacacaccggcttcatgacaagcctgcaacaaatgaatcgtccccagcacgttcacatccgcgtcctcatcgggttgatggatggattgctgtacatccgcctgtgcggccaagtgaaacacaatatccgggctttcccgaatcagcagcgtcctagcttcagagctgcgaatatccgcaatatgcatgactgcgcgcgggtccacatttgcgatattcccggtcgtcagattatccagcacatgcactctgatgcccgaatcagcaagcgcacgtaccagctgagaaccaataaatccggctcccccggtgaccaaagccttcactagctcaccctccttttgaaccgaagcatatgacttcccttcgcatcatgttatgcgactccctatagcttggcgcaggcacaagcacaggccgaagacaatctataatgtgtctctggaatctcagcacctcagacatgcagcctgacattttccagcatataacgccacatctcatcctgaccgttccatatatcctcaggtggcagctccactgaaaccagctgctccaatccccaatccagctccctcacaccatcagtccctgtataatccacgtataacaagcgaaaatcatgtgtaatcctctgcaataacacatcatgtagttccaccgcttgctcccgactgcccccgacacgaaccagtagcagacgggacgcaagcgtgaattgatccagtagacgtgcgatgcggcgatcaagcgtcgttttgaatgcaggataggaagtcagctgctccgatgtattctcgctaaccggaaaatggtgtgccgctgtaatcccatagtttgcatcctcgaccatgaagttatgctcgccgtaatcgtgccccgtgacacgcagactatcaacatccataaaaccggcaaaacgagcgtccagcaagcgactgacctgtgacaagttaccggaaatcatccagtccagcggacccgcatagggacgcagtccgtttttatccagctgaatggaaggcaagcaatgtccacccagactgaatacagcatcataattcccctgcaaccgctcaagcacgacgccctcccctttccgaggacaaggtcatccctttaaaaagggtacgccagtgcggatcacttttgtaattccatacatcggcaaaaggcatttccaccgcgcatacatgtggaagctgccaatccacctccgtcaattcagttacaccggaacaattcaccaccaacaaacgaaattcattcgctaccatacctgacaagatacgttccagttcctctacttcttcataggttcccagcatacggacgaacaagctgcgcttcgccatctgtgtttttgcaaaaaaacgttcgatacgacggtctatcttttccctgaactcgggataggtcaccagatctgaggacgtattgcgttcctgtggaaaatcatgcaccgagatcacattataagcgatatctctgaccatataattcagttggctcgtaccaacgacacttaaattgggcaaatccataaatccggcaaaccgattttctagcaagcggttcacatcggacagcgtgtcagacatcatccaatccagtaccccggcaaacggccgcaaacggttcttttccaattgaatggcaggtgtacagttttgtcccagactgaagaccgcttcatattccccagccagctgtgcgagtctcatagccgtgcctccttttttaatacgccccttccctcagcgacccttcttctgtagccgaaaagggacttcaggccgtagtatgttccactcttcattacatgcacagcacggcgaaaagggttggacaccaatgcgctttttgtcaaaaaggcgtacaactatccagtccaatcccggttatttttcatatcatattaaggctggtaacctaacggaattcaaggaggcatcatcatatgtccgtgtttcttttaaccgtcgatcaccatctcgcttaccacagcgcccatatagaaagctgccatgtgacctttttcaatcgtgaaaagagagccgtcgatgtgttgctggaaatgggaaatgacagtggtgttttccgacggcagctccttcgattgagcccttctcccgaagctggctccgtgctagaactcaaggatatggagactgcccaaaatcctttttacctgcgagtggtgacgagtatttacaatccggaaacgctgtttatcctggctgaatttttggaaaacgggaacattgtcgctaaacgtacagccagtcattttaccgtgacgccctaatgaacgggcagaggaggaagaaggtatgttgaaatattcagttcaaaataaagctgagccaggcacatatgcactgccttttcaggtcactgagcaggagagcgtgctcgctacattaatcattcctgcaagtgaatctgaaggacatattgtcattgaagtctctttggcatgggaaaatccgctgctcaactgggatatcggggagctagacattcgattgcgtcgcaatgatgagcggggacctatgctggattggttgcaggattcctgttatcaggagggatttgccgagttaagctatgaggaaacgggaaaacaggcagagccttatgtatactgcttgaccgtacaatcagctgaccgccgtgctgttgttacgggaccgctcataattcgaggctccgtttatgaagattgacgaaaacctagatgacaatgagctgaaataaactaaaggcaggtgggagttttaagcccgacctgcctttttatatggtctgtcccctcatggtgcggattgtctcagacgttccaaaatgtcagcgtctggcagcttataatcttccggcaatgaggtgttaattcggttccatattgcgtaatcgaccttcagatctgggtgcgactgctggatttcaaaaatacggttgtacaagtctccaacgacaggaaaagtcatgctctccctcctaactataagaatcaacgtattcaacgtacttgattcagcgcttgcccataaatattcacgagccgctcaatcataacatccagagaccaatgcgcggttccccatgctttggcacgttttcccatagctatccgcacttcatcctgagccagcaaatgctgcaaatgagctgccagtgcctccacatcgccaaccggggagaccagtccggtgtgttcatgcttcaccatttccggcagtccgcccgcatccgataccactgccggaagccccaaaatctgtgcctccatgaccgaaaatggctgattgtcctgtatgctcggatgaacaaaaaggtccgccagttgtaaaagagcaggtacatcttcacgatgccccaaaaaaaccacatcttcctccagccctagctccttcgcctgtgtttgaagctcttcccttttatctccctccccgacaatccagcaaacccaatccgtacgacttgctttcagtaggccaagagcgcttattaaataatgcagccctttgatatagaccagccgtgaaggacaaattataacttttttcccctcaggtcgtacgacgtccgttccccgggcgtggacttcccagaagtgctcggtatccaatccgtattggaaagtagcaatctgctgctcaggcacttcgaactcacgcacaagcgtctgtttcatccattctgtagacgtaatggtaatatccgcggatagagcgccatagtgctccagcgcccaataatatttccacatcagcgtctcacggtaaccctcctcatgatcccgctccagagccatcatgacttcacgagccaacgagccatgaatattcgctaccaatgcactgtccttacgtttgacccgacttagagcacgcgtcgcaataacatcttgcgtgtgaataacatcatactgctcaaccccgaaatatgccgctgccagctccatacagtatcgatccttttccaccgtctgcacccatgaatccagatgtaatacagggacagccgattcattcagcttcgtatgcagcaggggcagcagttgatccttcagcagctccctatcttcaaaaacaatatggtatttaggtgtatccggtccgttccccatcaagtctaccgtgtgacccagtagctccagtctccgtttaatttgcagcataaagggccatacgccacccaaatgaggaatcggccagtacgtagccaacaaaattttcaaaacagcctcacctcctctgtctcgtacgctgagctacattccgttacttccgtaaatttgctggaaacccgataacgcatctgtccagaccgcaaaaaatccattattcggcacgatcgttacatcaataaaattaccgatcgtaacgactggaaccggactaatcccgttgggattaaaggagctgtctgttattctgaggttcgtaaatgtattccctccgttcgctgattcggccacaaatacgtctaataaagaggtcgttatttgattggtataatatacgatcttaatcacgccggtcacaggcgaaacatcaatagccgggaaaaaatgctgtgctccggcactggctcctgtcaccgattgcggtgcagtccagcttaatccaccatccaccgaccgggcgagcagtacatccgcatatcctgcccgattatcctgccagaccgcataaagtgttccctgattcgggctagtagagcgatccaccgcaatgctggccatcggcagcacattgaagccaaagccgaccacgggcaacggactcggaaccgggacaacagaagacacaggcagcgaagaactgaatgctgtccccccattgaaggacacaatgacctgatattggttaaccggattagttacaatgtacccgacataaatcaccccagtaatactcacggtgatttccccccgcgtgatctgattagaaccagcggtgagcaccacgggtgtatcccacgtgatccctccatcctgtgagcgctggaaaaacatgacggacccgccgaaaaagttaggattgtattgatgcgtataacataaatagatgtttccggtataggagctgacctgagaagtatcaaatttcacgatgatctcaacattattgacaaatgtcccataccctcgctgggtaatcacaggcggatcaaatgtattaccgttgtctctggatacataggtagcgatagtaccgctcaaaccgtctgcggtaaatacgtgacaggctatgacaaacaagttgggaaaaccgtagctgacgctatgggattccgcccctacatagccggctggtagcggtaaaatctgctgtgtaaaggagacaccgccgttacctgaacggtataccgccgtcaacggcggccccgtcgtaaaatcgatagccgcagacacaatggtaccgtcgagcaggttgaaagctacactcggctcctgcgccagccttccgttcggcgtaagctgtacgttcggcatcagtccccacctcccggtacaccagcaaaaattgtcaaactgcctgtgcgcgtatccgtccagacggaaatgtaactattcggcggtacaatggcgacatcaatatagtcgccgatcagttctgattcttcgccaccgcccccgacattcgggttaaaggaggtcgtggtgagacgactgttcgtaaaggtgttgcctccatctaacgattgggcggcaaacacatccagattaaagccgtccaagcgattggtatagtacacgacaacgaccagtcccgtcttaggcgacaccgaaatcgcaggaaagaaattttgcgagcctggcgggctgtccgtcacgatgatcggagcactccaggtaccgccgaaatcgcttgatttggacaacaaaatattgctgtatccctgaccaaaatcctgccaaacggcatatagcgtatttgttgtggaaggcacacccgagcagtctgcaaccaagctggggaagttcaatattcgaaagtcatatccggggacgggcaaaggattgggcaccagcgttatattggatacgagaatatccccactgaaagttgcccctccatcaaaggatctccgaataaaaaaagccggtgtttgtggccccgtacgaatccaactgacatacacactgccaaatttgtcgaccgcaggttcaggtcgttctgtagaagattggatattcgaaagcaataacggtcgatcccaagttagtcctccatcggtggaacgctggtagaacgccgcagaacgagcattaaaatccacattatattgacggttatacgtgacatagacatgcccaagatagggacttgccccggcgttatccgtcgtgatattggtccagtcattattaatgtaatctccatagcccggattaatgaccactgggggatcaaaggtggctccatcgtccgtagagcgatagatcacgacagccccgttctcatttcccggaaacacatgtgcggatatgatgaaaatattcgggaacagataggctaccattcctgcctcggctcctgtatatcccggtggaattggcagtaaagtatcagtccagttcgccccggcgtccaaggaacgatacagtccaatcagcgggggcccgctgctaaagtcaacagcgacagccacaacaatattcggattcaacaaattaacggcgacactgggctcaaatttgggcaacccgctgggtgtcacctgaaaattcaaaggcatcgcgagcattcccttcattatataaatggacatgctatttctattaaaatgtacttttttcagcacagcctacagacaaccatacaagctttcttttcaatagattcatagtatagaagcatcccttcaggggttttccaatattctgttttttgagaggatgattcgattggcttttacaaccggatatatgaccaacactagagattttggtactgcctgctccaatgtcgttgtaaatttggtcaacgaggatacagtgaatgcggcaaccgtgaccatccaaatttttttctcgcttgtaccggataccaagacaccactatatgtgacatcggttaacttacctgcaaactccattgcccgccgtaccttctttatacaaggggttcttgcctatgaggtacaatacaacgtggcctccgctgctccagcgaatgttgtgctctccaactttggactggatcagtttggtaatgttgtacaggaacaccgtgttcttcagtcagagctgaccacaatcccggcgctgtctcctgttatttaaaagctgccctgttccagtgcttgatgcaatctgtgggtgtaatacacgtaattccattccggtggtacagactgaacccctcggccgctgccgatggttgagtggtcatctgtgtagtaggaaaaggcatgtgtatcctgtaatgggcgcaacaaatccgtgagatacagtagatccgtcacggcaatataaggtttgacaccgaagcatacaacaaagcgggtcgtggtttcaccaatagcctgaaccagtgcttcttggaccgaataatgctgacgtggcgttacgattaaccgaggatcgagcatcatcgacaggaaaacgctggctccctgttctggcgttaaatccagtaaccgtaccacgcaattgctgtagtgctgctccagcagattatccagcaatgattcagcttgagccatatccgtgacaggcattaaaaccgtcatttcaagtgggatgccccgacgtgctctcgcctcatgcttggcgatttggaatgcgcgccgccagcgtcggtgctccttctggctgtgcaaaccagccgatacactgaatgtggaattcacccggtaatccatcaggatctccgggatgaatttcatgctgcacgtctcggttagccgcagccagtaatcataatcctcaactggttgcagccgatagccgccaatctggcgggcatatttgcttttgtacataaatgaaaccccgacaatgctggcattcagcaattcatgatgtggctggccttggtaccggatcaaagcttgttgatgctgctcgtcatacaacgggttcccatatgcgtcaacctggcggaaggtagagaacacaagaccgagtgagtccggcccctgctccagctcctgccgcaatcgttcaataaaggaagaattataaacattgtcgctggatacccaggtcacatacttgatcgctggatctttaaacaactcatcgaatccccagttaagggcgtgggatactcctttgttctgagggagtgtaaccaactgaacgcgcgggtctcccattgctgcgtggagcgctggtcccaccatttccggcgctccgtcaataacaatgatgaagcgaaatgccctgtagctctgggctagtacggatgagatcgcggcttgcagatagccgatatcctgtttgtacagtggcataacaatccccgtatctaccatatcaatcccccctgacagactttcggcttcatgaggataaaccactcaacacctgactgaagcgatctcgataacgtgcttgggttatgttgtactcccgctccacagcgggccaatgttttttggttcccatttcatcatgccagcggtagttaaccaaggactcgttcagaaaaggaaatggatatcccgccagcatcactcggtaccacatatccagatcatgtgtatacggcagcagttcatcaaacaaaccgatatgtgcaaacagctcctttttaaacataaccgtgcatccattgaccggatttccttgctgaaaaaaacggtaaaactccgtcatagacggaaacacggcggctgcctggtagcttgtgacttggctgtattgattaatgaaattgaaattggtatgggagatgtacgcaccgttttccaccataaaagaaacttgattattaattttgtctctatgataggtatcgtcggagctgagccatgcaatatattcgccgctggcatgccggataccatgattcagggcgctggctgttccaccattggacttgcctaaataatgtatatatggaagataggcctgaagcatatcaacatgttccgtggacccgtcatcgacgacaataatctcgaggggaccataagtttgctctagtgcactttgcaaagcctgatccacatatgcacagttataaaagggaatgacgatcgttactttcggtctcatatcgttccttcctttccagctcggcggtattgaatcatatcctccagagattgccccagctgtatggtcggcttccagcccatgtcctccagctctttcgcacggtatgcctcggtggatgctgactcttccacatccccccattgtatgggaatagatgttttggccagcgcaaccatacgttccacaatattgcccagttccacaatgcggcctgtgcagaccgagtaaactcggcctggcacaccctgttccaagagcaccccgtatgcgcgaaccgcatcacgaacgtcgaggaaatcgcgttgcgcatgtcgggaagatacccggaacggggcagtttcagttacggactgcccctccatacgttccgtctgaacgatataccccgcgagtaatgcacaaaatccggtagatggacccggaccgatcaagttgcaaggctctgccagcatgacggattgttcgaacagcgcgccccacgagagcgcgactgcctcttgaaggcttttgctaaggctgtatggatgcgttggatgatacggtgcttgcaaagccgtctttagccgagaacccgccacgacaattctggctttgggaaaaggtcgcagtacatcgagcagatacagagtggacagtacattggattccatgtatagcagggggctttgccaagattcagggacagaatttttaccacctaggtgaagcacgtaatctggagcaatctgtctaaatacttcttctagacgtttcttgtcgagcaagtcacacacataaggcgtaatacagctacgggtctccgcctctgggttgttattttcatcatcgtgagccagtaagatcagttctgggacggaagcggcagtgcgagtcagcgccgctacctcccaaccgagctttgcaaaatggcggcaggcatgcatcccggtatagcccgccgctccggtaatgactatgacaggccgacgttgttccgctgtgcttccgtccattccagcagctccttcagcatgatgctgtagtgaggaacatcgtagagcagatcggcccgggtagaacgaagcgtccggtcctgcaccggctcatctttcggcacgatccgaatatcctcccttttccagatgtctttgaacagcagcagcaaatcatgcttgctgatcggttcagggtgaaccagatgaatgagtccgtccagcggctcattcatctgcacctgtatcgccttcgctaattctaacgtcgtaaccccgttccaaaagactcggcgatacccgttaacgtctccgctctgctgcaagaaccagtgcagcagaccaatgcctcccggccgaatttccggcccgataatggaggtacggatagtcagatgccctgcggcctttacttctccaagtattttcgtcaaagcataggcacttgtcccatcgggttgatccgtctccttatataaaccaggtacccgatttccttcgaatacgcaatccgtgctgatatgaatcaatcgggcaccaatactgtccgctatccgccggagaagatgtggcagcaagccattgatttggtatgctgcaatctgatcctctccggcatgctgattcagtacgcctaccgcgttaatcataacgtctggccgtacactccgtaccagttgctccaccataaagctgtcctttacatccagcagcagaccgcctttattttcgggatcacgggtggtgtagaacacgttatacccgctctggttttggaaatacttaaccagaacatggcccgccatgccgttaccacccaaaataagcagcttcatttgatgaaccccccgctttggagaatgctgcgaatctcctcttttgacatcaaattaaactccgaactaaagctgctgaatgacacgggagggcactgattatagcggtcctttaattgaggaatattcagcgttgggagaatgaccaaatattgctcgtcatagactaccgtcgtcagactttcaaagtcactcatcaaaatctcatgaattttctcgccgggacgcacacctttttctacaatttctacgttttccacacctgaatcctcaatgagcacctcagccaagtccaaaatacggcaggttggcatggtcatgataaaaatttccccgccgacactttccaccgaagctttgaacaggagactgatcgcatcacgcaaggtcaggaagaagcgggtcatgttcatatctgtgatcgaaaccttgcccttttgacgaatctgactttggaacagatgcaccacgcttccgttggtgcccaaaacattaccgccgcgcaccgtcacgaaacgtgtatcgctattcagcagattggcgtaaacaatcagtttttctccaatcgccttcgtcatgccgtaaaaattggacggattcgctgccttgtcagtcgatatataaatgactttctttacctgattggcaacagcggcctcgatcacgttttgggtgcctacgacattggttttgagtgcctcgtagggctgatcttcacagacgggaacgtgtttgagcgctgccaaatgaaatacatagtccactccttgacaagcggtggtcagtgcatccttatcccgaatatctccaatacagaagctgagccgttcatcctcaaactgcctgttcattgcaacctgactggattctccacgtgaaaagataataacctctttggggttacgcggcagtaactgggtaaccagctcatgcccccaggagccggtaccgccggtaaccaagatacgttggttttcaaacatgccgtttccctccaagcagaaatttaactaccttatccgacacatcttccgccagatagcccgcgggacattgccacttatgggtcatcccggtcattatggctaccgcgtttgctataacctcgccatcaagaccagacacgatattgctgccgcaatctaccgtttccggccgttcagtcgtccggcgcatcgtaaccgtcggcacccccatgacacagcattcttcctgtacggtaccactgtccgtcaaagcgcagcgggcatgccgctccagcagaacgaagtcaaaaaaaccgaacggttcgtgaaattccactagcggatcaagctggatcagcggatggcttgcgattcgggcggcagtgcggggatgaatactgcaaatgacccgctgtccgaactgctgggctacccggttaagaccatctaaaatagccagcaaatgcggtggatggtccacattttcagctctgtgggcagtgaccaggaaatattctcccggcgacagtcccaactttttcaaaatcccactgcccgatatctctttcttatagtgctgcatcacttcgtagatcggatttccagtcagtataattcgttggcttgggaagccttcgcgtagtaggtgctgcttgctttgctccgtataaggcatattaatggtagatatcgcatcaatgacacgccggtttttctcctccggcacatccaggtcataacagcggttccccgcctccatatgcacgaccggataacccatacgttccgcaagtaaggcacataaagcgctgttcgtatcaccgagcaatagcacatgatcggggcgttccttgtttaaaatatcctccatctgcgagtacatggcggacaactgtttgcccagtgtccccgctttctcctgaagtacataattcggggcacgcagtcccagctcgcgaaagaactgcccgctcaggctttcggtgtaattttggcccgtatgcacaagcacatgttcatctgcatggcggtccagctttggaatgatcaggctgagccgtataatctccggtcttgtgccgagcacggtcaatattttcatggttttggaacccacctttgctgtcattgtttcattgaattgtggcgttcaatgaaggatagccatccagcagactggctgtgctccagcttaacgttcatctcaacggtccggcgtaggttcacccggaccgttgttttgtatgctgtccagctttgagcgtgactcgcttctgcttgtgcgtgttgtgtcgccgtgaccggtgcttgaatttccgcttgagtttctgtctggacttggttttcggataaagtcccttcgacaacggggacccgtgaattttcttgaagcgactcttgccgccgcttctcttatacctgcgattccgcagtcgggtacgcttgcggccctttggccatctcgcccgaatactacgcttgccgcgaggcaattcgggtggtgagtcaggtaaaggggatactggttgtggcaagccttgaatagctgcatattcgattggcggcaggcccagcacaggcagttgacacaccaccgattcgggaaattctcgaatcgtgctggtatatccctccggtatagcggtgacctgacgcaacccttcgccttccctcgtccatacaggtccacccggctgctgaatcaacgggaaccaatgcggatgatgacatacccattgactgaccatgaggtgtaaactacctcggtaggaatcaggtccgtatacacgtgtagccgcactgttgttacgcacaccaatccgttccacttcttcgggatgatcgagcagatagcccactttttgcgccagcatgtcgctgttgcccggctctaccaaaaaatctgtatttccggtcgcctccatcaactccacaagtcccccctgcgcaaaggctaccacgggcttaccgtagaccagcccttccagggcggtcaggccaaagccttcctccaccatacttgggattacaacaatatccattgcgctataggccgttgatacggattcctcgaatgaattgaactggaagcggcggctataacgagattggcggattaaagagacacattttacgtaatattccgagtccaccgagctgccgatgatccagaaacgacaccgtgaattggtttcgcacagctttagagccatttggacaaaaggcaacagccctttggcttcgtaaataaaggaagaaatataaccaatacaaatatggaaatcccgcagccccagtttttcacgtttccttttccgttccagcacatgctctttgggagacggcatatccatatcccggcagggagacaacaccgtatgcggacgtgtcagtcccccaccatgcaaaggacgcattacagcttgcgaaatgccgatgacccattggctatagcgctcaatgatagaaacagaaactggcgtatacgcattctggttaatgacctcggttattttccagatcaccggaatattaagctcttgggcagccattgcaggcatgacgttcacacaggtattgaccagcaccacatcaggtcgagcatgccgaagcatctggaacaacggtgcatacgccacatgggtccgcaaattctccgcatcctgcgccaatccctcatatggggtatacatgccatgcagcatgaacaggttctgtgtcagaacggtaattccgcgcttgcgggccattgaggtcagccgcccttcaccaggcgttacgagaatacaatcgaagtacgtactcatgtctagacaaaattgcaatagcagcttctctgcccccgtaatactgcggacgttgctaacatggctgaatagcatcattttcggcttgatcggagttcacctcctttaaaatagcaaccatcggacgtgtgaatcaccttatggaaatatgaccgacaacagttggtcaatccggtgaccatacgtatgctcccgcaaggttcgttccagagcacgtagggcaatttcatggcgctctttttcatgcgtcaaataaaactcaaccttctccagcaattcctgctgagagctgtaggtctctatctcttcccccggcttataaaaacgagccagatcatctcttgtatctgtcagttgcaacgtgccactggcagaaatttcaaatgtgcgcggattgggcgaagcccccggaattttcagtgagttgttgttcaccgaatcatcctgatgggaacgatgaagattaattacgattttgctgccgttatacgaatcattggtttcgaccggagacatccagcgacccagctcaattttgtcaccatacgactgataatccgggagacgatcccaccaaattccgttgattttaatgttacgagccatgagctgcggcataatcggattaaagaaatagatgcggttccagtaggctgagcctgtaaacccaatctcacgtcgtaccgaagcgggcgagctgagtgggaaatagtgagtcagaaatgctccaaagggcaaatagtgcacagacgtgcaacccaactgacggtacagctccatgcagttcatttctaacgtgaacacataatcataattcgtaacaattttggtcgtcgtgtcggtgtaatatggatcgtccgttagccagatggcggtggggatgcccaactggcgtaccgcagtaacttgctccaacggaagatccattccatccagtgccagcatcagattcggacggagctgagcggcaatatctcctaccggctgacgtgggtctgttacggtaacctgagccgtcatgctttgcaacgtggtaatgaccgcctcatcgagcggagaatacggaaggcctttgcctgagacgacatacaatacatggatttgtcgaaaagggaaaactgctttcatccgtgcaacaattgcgttagcacgtccgcgcagatatccttcgtcgtatccgtcatgcactcccgcaattctccccctttcccaggaggctgccgccgtctggtgaacagccgggtcatacggtcctgtcgtagatatcgtcatcactttcactcctcactgtttatggtgtttactttaggccatcgccttgtccagcagttcttccatgcgattggagtacatatgcttttgcatagtcgtgtacaatgcgcgccaggccatgcgttcgcgttcccagtcatgcttgagatagtagtccagcttcactttcagttcctctgctccagagaaggtttcaatgtcatagcctggtcggtaataacggctcaaatccttccgaacatccgtcatttgaagcgtgccgcaagcagaaatttcgtatgtccgaggattgatggactccgctgaaagctggtgtgtattccgattatccagtccggggtctgtcgggcggtgcatattgatgacaattttggagccgttataatattgagcggtctcttccggctccataaaacccggacggataaagcgttccagcacatcccgccgggtcagccgatcccagtgcccacctacgatcagcactcttttgtccgccaagaagggagcaagatggtcgaacagcttcacacggttccagaaggcatttccaatgaagcaaatatcatgctgatgctcccgctctacccttcggggataaaagatacgagctgacgcagccagcggcaaatagtgaaccctcgttactccctgatcgcgataaaacggcaggcaagaaatttcgtgcgtaaatacgacatcgtaggattgacagatcaacgccgtatcctccgtaaagtaaggatcatctacaaaccatatggccgtccgaatgcctagggctcgtatttgctgcacctgctccagatgatccgccggaaaaacatgcagcccgttcatgaccagcacgaggtctggacgttgagcctcggcgtcagctagcatcgtagcaggcgtaccgatgacgcaagagctgcatatttggcctaatgcctcttgcacacctgtgtctatagctgcgaaaccttgcggaatatacaacactttcaaatgacgaacagcaggctgtattgccacgacctgtgacagagcagccgtgcaaccgcccattctgcgtccttcccgatagccgcatcggtacgcttcgcgttcatttccgctttgttgatcgttcacatccttcaccctgtcctgttgtaggataaacttctgtcactcctaaactatatgcggaggggtcaaacgcatcatggacgactgccactgcccggacaaaattggcgtttgcccgtccaactgccgaaccgcaaataaccccaaagctgttagcttcgggggtgaacagtaatagaatgatttgcccagtttactgagctttataagcgagctggtgtccatcttcataacctttggcaaaacctgaattgaaaccctcgttgtaagctgcatcatatccctgctgaaatgcctgcggatcatgctccaatgcaacagtcccgggctgtggattctccgcagaaggggctgccaccgggttagcttgaggttttttccgccgccgcaaatgaggatgtcttctacgtgcagaataaagtccccctttacggcgtcttagagcaagcagacgtcttcttctccgttttaatctgcgaatgctggaacgccgggcatctttacgtcttttgcgggctttgtcccgagtggcgcgttcccaccttgtactcatttccattcctcctttgctttctcgtggtggtttcatttttctgaacaggcacatggagccacggcttagtcggttttccatatacctgccgtcttaatggaatacccgccaacatttgcgtgatttctccctggtagttgctgagtatacgaatggtttcttccagacgggtagccgacatatccgcatggggcgtcaagtccgcaagactggtcagcatccgagcaacggcgtgctggctggcagcaatagactccatcatatccagcttgatctcacgttcacgcctcatgctcattagttcatatcccccgagcccattccccccatcatcccttccatgccgccaccctgctgctcatcctgatccagcaatgctttgagattgctgcaaagtccagtctgaagccgcgttaatccctccagcatttccaccatctgctcgtgaatttccaaaggccgtcccaactgctcttcatcggtgtcaaatgcgtggggtgccagatggttcaacgcccaattacgcactttttctgcttcgaccgccttggcctccaggatcatagacacattccgctgcattttggaggctgcgtccagcatgtgaatcattgcttgttccctactcatgtgttcactccctgccctcggttggtacgttactcctcttccgggtatgccgtctctttcacgacacgaacgagcatttcagccattgcttcctgaagatcggcaataccgttcagataggccacaatgcttttgtttacttgtcccgagctgtcgagaatgcccggaattccatcaaaacgcggctcctcatctggcagttcatgtatgatctgcgccatgcgcacaaccacctgccgttccgcatccaacaaccttgacatctgttgctgcgagtgcgaaatgtggatcagcaaatcatctaactcgttatgcataagcccctcctttatgtgctccgccgtgcggaacgcacgaattacctacgggctttccgctactacagcgtatgccgcagcgagtagtcggttccgcctaaaagcgcctattcagatcattacagatgcccgtgcagcaccggtggagcaataataggctgtttctccaccaaagccgacaaatctccgggagacaaaagctgaattcggtagtcctctgcccgccagctcatcgcagcgtacagggtaaggaacggccttttccagccgttaccgatttgatacagttgcccgccctcagcatacaatacctcgatccatcgcttgcgttgagccggtatattcagtgtgggcagcatggacatgttctccagatcgggagccgccagtacaggaatgggttcctctcgcagctcagctgtaggtgcatcaatgttgccggaaactgtagcctccggcttccctaccaagggaagcaccaacaaatccagctgagacactctaacagggcgcacattttcacctcccgcagcactgactccatgcagatatcgccttcttcccggctctaaccgaaatactgcaccggacggtccctgaacaaccgctccgatgggataaaagcttgccgttgatacgcgtgtttccttacctgttgatatctggccgtccgtctccgctgtactgaatttcagattgcggaacagcttatccgcgtccccccacttttgtacaaaaaaggatcggttccggctgctttcctccattgaaccgcttttttcggtcgtttgaggaaaaccatacaccgtatcccgatctctttcttcataatggataaaagcatctccggcaattgccattcgtatccccaacaaacgcacacgcaatagccaatctgcatgggcttcctcagtactgtggcagccttcgtcccagtagcccgttttttccaatgtctctctgcgcagcaataaacaaaatccggctaagctttcggtctcccgccatgcatccggattgggaatattgaaggtcatggcaaatggacgggctccattttcgttcatataaggaacctcaatctgctgttctttgaatggaccattcgttgcaggcccaacaacaccaatacgcggatcgctgtataaacaccctaacaaccgatccaaccagccgggggtcaccatagagttttgatccagtaccacaatagttgtgccttttgccatcatcagcccctgattcaggctacctatcatttgaacatccttttttaacagcgcataacgcacagcgatgcttttacggagcaaataggtggatgtcccgtccgtcgatccgcagtccaccacaataatttcgtgaggatggctcgtattctcctcaatacggtgaatgcatgcacggagctgctgaagctgattgcaggacggaatgataatactgacaccttcaaaaaccttgccgaacgaagcctggcccaacttgttgccctgctcctggccccttttatatcctgaccaatagcctttctttccgagccgcttgctgtgtttcctttgcatactcagacgtttcatgccgttcactcctccgggtggcattatgcctatactatatgcctggcccggccggatggtgtttcgttgagatcagggtagaagtcctttcattttcactccagcttcctgaagggaatcgaaggttcctgcgtcgctccaatagcgccgtaaaatatcatattccaacttgccttcagcggcataacagttgttaacatccgtgatctcaagctcaccgcgtgccgaaggtgtaatttgccggatcttatcgaacacggcagtatcgtacatatagatacccgtaacgcaatatttggattggggatgctgcggcttttcttcaatccgcgtaatgctctccgggcgctcaggatcaaatacaggtaccccgtaacgacgagcatctgccacctttttcaacaacactctggcgctccctgggggctgttgcttgaaccgttcgatcacaggtcccaagtcttccttgaacaaattatcacctaacaaaacagtgaatttctcttctgattgcatatagcttcttgccagttcgagtgcttccgcaatgccgcccgccttttcttgaatccggtatgtcagttggacaccataatcactgccactgcccaaaaaatcggtatacagaccggccgattgtttaccaataataataagcatatcggtgattccagcctgtcgtagcctctcgataccatatacgatcatgggatacttgccgaccggaagcagatgcttgttgagtaatgtagtcaacggatgaaggcgcgatccggttcctcctgcgagaataacccctttcatatcttccttcctccttcgacagcatgttcagtgcatgcaaccccagtgtttccagtttcaatgaacattctgggatctatgctccatttctctataaacaaacgatagttccgctcgatcagctcttcaatccaggaagtctccgagtgtgagaagctcgcattcccctcgtgatagacaaaacagtcgttgcacatgagcagcttgtagccatgcacgcgtgcgcgcagacaataatcgtcatcctcataatgtccggggctgaaccgttcatccagcaacccgatccgttccatcagatcgcgccggaacagcaaacaaaacccgaccaaccgcttgacctcctgccatctggagggattacttgcattattctgctccgaatatctcagacaactggccaaatctccttccaatccgtgtatctgctgaataccgctgacgtaattcgtcaccggtcccaccaatcccaccatgctttcgctctgcaatgcagccaacataatcgatagccatccccgcgtaaccgtcacatcattgtttaaaataacgaactgatcacccgaagccagccggagccccatattacatgctgctggaaagcccctgttttcaggaagacgtatgctgatcagccgctcggatgcacaaaaatcatccgttccgtcattcgaagcgttgtccacaacaatgatttcatacggtacatctatcgtatgtgtccgaattgcctcaatacacggctttaacagatgtaggccgttataagtcggaataatgatgctcgtcagactcattgtgcattcctccctttggcaacgtctacccgtgttggaacaggcccgagcggggaatacccggctacctgaaacaccgccgtcagtgcctctgcatgatcaccgacgatcaactgttccatagcgttccctttgccaacattgaaggtccgcttacggtttgttttaatgacgtcgacagcatgtactgccgccacgatcatgccatgcagaattgccatggcgtgggcttttggcggtacggcaagcacggctgagccaagctgatccagtaaacgccgagataatgcatgcggtacggcggtcaatgagcttgctcccaaatccggcctgcgcagtacgcgattcaggaatgctttgcaccgtgtcacgctgtcctgctgggcatagggcggcaaatgtctgcccagatcattaagcgcaacatccgttccctgatccaccgcgtggagaaaaggcagcaaatcagatgctggaatcggcaaatctccgtccacgaacagcacaatatcagcctgcgtcatacgcgcgcctaccgcccggccaacatcatgccccagtcgatccggcacgttgacaagagtcacactgggatgatgtttggctacggtggagcgcgtgccgtccgtgcagccgttcaatacgacaatgatatccgtaagtggaagtttttccagctcgcccagtacccggtcaatcgttgactcttcattacaggcgctgactacggccgctgccgttccctgtaacacaatatcccccggaacttcgcgttccacaggcggagtcacttcggtcattcctttcgcccgaggtgtgggctttctcatcctacggctatgcattgaagtcgtcgttcctcgttttcgctgaacacgtctcatgccccaactcggttcttcacgcttccctctgcgatactgtctattcacagtttcacctcgtctctgatccgtttgcgctccaaatccgtatatcccgcacgcgttcccagacgcgatgtaagccaggcaatggcatccagatgatcctgaacaattacatctgccagcgggtccttgccgttctgttttttacgtgtcgcatttatttttccgacagctattccatatacagtcaccactcgtaactcggaggcaatggacatagcttgaaataaaggaggcttctccaagggctttagacctattttatttagagccttttgacttatggcgtgtggaatgccagtcatagatgctccccctaaatcagcacgattcgacaagatattcaatacatgctttgcctccactacagggtgtacgggcgtacgattcacaggtccatggtaatcattcagcaccacatccgcccctgcacatatggcgtgtataaacggccggagtctaacgcagggaatgacgatatccccatccaggaaaagcaggatctgtccggatgccgcctccgctccaatacgacggccaacatcatgtccgagcggttccggaaaggaaagcacacgagctcccgccgctgctgccaccttcgccgttctatcgtgtgatccgttctcaacgacgataacctctgtatgtggatggacacggcgcgcttcgcgaatcacagctccgattgttttttgctcattcatggccggaataatgacagatacgaaaaactttcccactgatgacggttcagatggtcgctcttcgccgatctgtgcccctctctccgtgtctagtacctccctcatggcaggggctaccggattcttatgcatgttcggcattcgtaacggcagccacatcttagaatgatagtaagcgccggaatgccgcctccgtttgatcttgtatccagctcttccctgcttcttcatgctcccgtctcacctcccttcctgctgtatagatggacagcatgattaggacagttcaacataacctatgcggtccaaaagccgtgtgtaacggcaatcgtggagtcttttcgacacagcaattttcgactttatttttacataactcattaatcctattaaataaatgagttattagggtctaaagaatcattttggataaatttgtgacatagatcttctcgtccgtcattctctgtgctaatatcagagccagatgatgggagttcaaaaaatcaacaattgctttttttgcataagtcaatatttttccattatccaccattattctattttctttttatacgacaggaaaggaggagtttgtcacctttttaagctacatgcttcatattgcagtaccctcttttcacgtacgcttcatgaaaaacacttcggtatttctcttcatgttccattttcttctattccagacgacaacacgacctacataaatggcgcgatgccttattcaagacaggataattcatcctgacattaatcgaggagagtgaatttttaatgaaaaaagtatgggtttcgcttcttggaggagctatgttattagggtcggtcgcgtctggtgcatcagcggagagttccgtttcggggccaactcagcttacaccgacctttcacgccgagcaatggaaagccccttcctcggtatccggggacgacattgtatggagctatttgaatcggcaaaagaaatcgttactgggtgcggacaactctagtgtacgtgaacaattccgaatcgttgatcgctcaagcgacaagtccggtgtgagccattatcggctgaaacagtatgtaaacgggattcccgtatatggagctgaacagactattcatgtgggcaaatctggtgaggtcacctcttacttaggagcggtggttactgaggatcagcaagctgaagctacgcaaggtacgactccaaaaatcagcgcttctgaagcagtctacactgcatataaagaagcagctgcacggattgaagccctccctacctccgacgatacgatttctaaagatgttgaggaacaaagcagtgtaagcaaagacacttacgccgaagcagctaacaacggaaaaacgctatctactgataaggacgagctgagtcttgataaagcatctgccatgaaagatagcaaaattgaggcggtggagacagaaaaaagttccattgccaaaatcgctaatctgcagccagaagtagatcctaaagctgatctgtacttctatcctaaaggggatgacctgcagctggtttatgtaacagaagtcaatgttttagaacctgccccactgcgtactcgctacattattgatgccaatgacggcagcatcgtattccagtatgacatcattaatgaagcgacaggcacaggtaaaggtgtgcttggtgatagcaaatcattcaccacgacggcttccggtagtagctaccagttaaaagatacaacacgcggtaatggtattgtgacctacacggcctccaaccgtcaaagcatcccaggtacccttctgaccgatgccgataatgtatggaatgatccagccggcgtggatgcccatgcatatgctgccaaaacatatgattactataagtccaaatttggacgcaacagcattgacggacgcgggctgcaactccgttcgacagtccattacggtagccgctacaacaatgccttctggaatggctcccaaatgacttatggagatggggacggtagcacatttatcgcattcagtggggaccccgatgtggtaggtcatgaacttactcatggtgtcacagagtacacttcgaatttggaatattacggagagtccggtgcattgaatgaggctttctcggacgtcatcggcaatgacattcagcgtaaaaactggcttgtaggcgatgatatttatacgccaaacattgcaggcgatgctctgcgctctatgtccaatcctacgctgtatgatcaaccagatcactattccgacttgtatagaggcagctccgataacggtggcgttcatacgaacagcggcattatcaataaagcctactatctgttggcacaaggtggtactttccatggtgtagctgtaaatggaattggccgcgatgcagcggtccaaatttactatagtgcctttacgaactacctgacttcttcttccgatttctccaacgcacgcgctgctgtgatccaagcagcaaatgatctgtacggtgcaaactcggcacaagcaactgcagctgccaaatcttttgacgctgtaggcgtaaactaaatcatatacgctataatcctcatatcccgtccatagaccttcgccgttgtgcaactgtcacttaggctgctcataatggacgaaaaaataggggtgcagtgtacaagtctgcgccccttcccccttatttatggcgtcccctcaaaggggcgcccttttcttgttcattgagtctctcccgatcattttcgactagataagacaaataaacagtaaatcagggactaaagattcattttggggtattttgtaaaatcaatcttctcgttcgacaacctctctggcacaaggaggcactttccatggtgtcaaggtagatggaattggacgtgatgcagccgtatatatttattataatgccttcaccaattatctgacttccacgtctaacttctccaccgcgcgtgccgctgtgatccaagcggccaaagatagttatggtgaaaattcaatagccgtaacctctgctatgaagtcttttgacgctgtaggtgtgagataagtgaaataatataaatttccccggtattacaagtctccccccttctctcttatgtatacggcgtcccactatgggacgccttttttctagtataaagttgattattggtaattatattttcggcttcttattattgccccatcgcaatccaaaggaccaacccttcacatagcggacctgagtgtatgcgttccacagtaagtactgctgaatacctctgacgttgtgtgacggataccatcactcccggtatactcccattggcagtgattacatactgtgtatctataaaaggcttctcaaatacaacgctcacttcacccctatccgcttgtgcggggaggtgaaaaggaatgctcccatattgaggtgaaactatatgaccgtcagaagcctcgtcactggtcgctgatccgtcgtgaatgacattcaagtttaattctttctccgtatcgaaagctagatcgatatctcgctcagacaaaaccacgcgttgctttgggcgtggtcttccttcagcaatgtgaatactggttatggaacaatccagtaacgaatcttgctctgcctgatcttccgtcgtaatagacggtttgtcgttatccaacctgtattccgtatctgactcaggcactgacaacagcagtacagatgctcgattcatctgcatcgcttcctctagcgttttggggagcttatgcttcttccatgccgcttcctctatagcttgaaccgatgtgtccttctctacgggggcagggaccgttgccgttccacgctggttcgatttatgactgccggaagtcgaagccgctttctccttgttaacacggggggagggaaccgcatgggaaaggttacgccgtgctgttcttttatccttagggctatggttcgtacgatggttcatggtgaccgctcctttggcacaggagtgaaccagcggtcgctccgcttcattcacccggctgggaatcatggctaatgcctataagatagcctatgcgcgtaacagcgcctacgtcactccgctacgcagtccgttatgatttgtgcccagcgttgtgctgagtgttgccataaaaatcgtctccgtacctcgccaagcccggcttctcccatccgtcgtcgcaagcttggttgctggagcagcctgatgatggcatcggccatttcctgctcaccgtgagacggatatacaagccagcctgtctcgccgtgttgtacaacctctggaataccgccgattcgtgaagcgaccacaggcactcctgccgccatggcttccagattgaccagcccgaaggcctcatccttcattgaaggaacaacggtcacatcggctagctgatatagcgaggccaatgctggatgcggaacatagtccaggaattgcacatgcttctccaaccttagtttacgcatctgccgatgcaacgacgccgtgtacggcgtgaggcggtcatgcccgtaataggcactacctgcaatgagcagcagtacgtccgggcaggcgcggaccacatgccgcagggccttcagtagccggtgaacgcccttccctggcatcagtctgcccgcgaataacatgatttggcggcctgaccagccgaaatcgtccaatcgcgccgatctggctgcttctgctgctggagtccaccgtggcaggaaatcgccgggatggatacccagcttgtttatgacgatacgctctctgacggcctcgggacagtcagaagctacgattgcccctaaatatgcactgttcacgataatgcgatccatcgacaacagcagcctgcccatatccttccgtttgaggtaaggctcccggatgaacgtggtcgaatgcaaagtcaacacaactcggctatcgggtaaagcctcgcgaattgcattcgcaactgccgggcggttgtgtacatctactaccgctggtaaccatctctttaaatcggcaatcacatcagaaatatagcctgttccccgcgtataacgcatgcagggaattccgtcgacatcgccatgatccggtgcctctgctccctttatgccatagatctgcgcttgaagctcatgactagccagcggtaccatgcgggcaattacccgctccacagaactgctgcggggcgaaggtataacaaaggagcccggtgtaacgactgctaccttcggcctctgcatcacctcacctactttctgagcttattccaacactcttcaacactcatcctgtatcatatcgtctgcctcgctgaaatgtgcctcgcttctaactttgggcttaccgcaaggcaagcgtccatgcctggccgatctttgatacatatgatggactagaatcacagtatgatcagttggagtgactacaaggagggcggacatactcatgttgcatgtcggcgtcatgctcaacccggcaacctaccggggcatccccgccatgaggacgcgatatgaatctatcgccaattacgaggacgccgggttaagctacgagctcatcccctgctttcttcgtctggaggatattcatatagcgaccggaacatgccgggcttatgttaaacacggcaacgagtatcggcagatgattcttccgttgccgccggtcatccacaatcggactctctatcggcaaaatgaaaatgctagagatatcagcaagcttgtacaaaaggggttctatatttttaatgaacaaaaccgtttccacaaagaccatatacatgcaattctgcaggaagaccctttgctacgcatccatctccccacaacattgcaaggcaacctttcctccatccataccttgttggaagaaaccggagatgttgtaattaaacccagtagcggtagcgtgggtagaggaattatgcgtctgcggcattcccgcggaggctggactttgcaatgcgctcatccggctatacctgagcgttggtccaccctacgtttgaatgtcggagaactcccattatttctgcacaagcgactgctgcaggtgcctcatatcgtacaggaaaccataccgcttgctttgtacaacaatcgtccgtttgatgtccgtgtgtcggttcagcgcggatatggcggtatctggggtgtgacaggcatgtatgctaaaattgctccttcccacaccttcgtctccaatgtggcacagggcggtacggcccgttccttactagaagtgttatcacaaacagagacagttcagacttcgaacgcagtccggctgatgaatgaactggagcgactctcattacaaatcgtgcaccgactggcacaaacccttccccgtctcgccgacgtcggtctggatctgggaattacccatgaaggcaagattgtttttattgaatgcaacggtcgtgaccagcgctatggcttcagccaggcgggcatgcacaatgtctggaaagaaacatactctcagccgatggcttacgctcgttggcttctcgaacggatgccttcgtcagacaccgaacgttcaccaagccgtccactgtattgatttacgtcacattctgtgtcaatatagttcagagcggccggacaggttccggccaagacggctcggaaatgaacaagggggatctgtaatggcaaaacagtggctgcggctcatgacggagctatcatcgcgcaagtgggtgtgccggattgtaggctccttcgcgcaaagcggtgcaagccgactttttatccccacctttatacgtacgtaccagatccagacgcatgaggcggaacaggaatggaaggaataccgttctctaaacgcctattttacacgcaaattaaaagcgggcatgcgcccgattgatacgaacgccgaggtgatgaccagtccggtggatgcacggattactttcactggcccaattacgtccggcactcttttaaatgtcaaagggcaggactatacgctggaagagcttcttaaccgctctccgcgtcttgaaaaatacacacacggctatgcttttgtgctctatctcagcccgacggattatcatcgcattcatgcaccagtatccggtacgctggtagaaaaagagcatctgcgcggcaaggtatacccagtgaatgacttcggcttgcaacatatgcgagcagttcttagccgcaatgaacgacagattacgtacattgcccacgaatatggtgaggtggcggtcgtcaaggttggcgcaatgaatgtgagtagcatcaaatatacggatgataaggccgtctcatggacaaaaggagacgatctcgcctatttcgaatttggatcaactgtcgttttgctaactgaaaacggcacgtttgagccagaccccgcattgaagctgggggatgcggtaaaaatgggacaacgtctgggttgctttcgacatgatcccaaagcaaaagtgaatttatcgtaacaggattttagctacacatatgagcattgggatcggatgatgttaaattgctcatataaaaaaggacccggcgtaactgcccgggtccttttttggaatttatccattatattcttcacgcctaaatccgaaacagcttgaccaccgtccatagcattaccggatctcagacggacttttccccgtgtactgcttgaattggcggctgaaaaaaaagatgtcacggtaccccaaagcctctgccacctcggtcacattcattccggcatgtagtaatagatgctgtgcacgctcaatccgcatgctgataatatgagattgcgcggaaacacccagtagctccttgaatttaattgaaaaataacgcggtgacagccccgctcgtgctgccaaatcctcgacgcgatgaggaagtcccggatgctgacgcacgtagttggccgtttctcgaatgacctcggtgagctggttactggcttgttgctcctgaggctccttacggtccgcacgcagcagatgaatcatcagttgtttcaggatcagcttgccttcctcgtcagctccgtaagcacgctctaggcgtagtctaacgtatctggcaagcatatgctctacctcgaacgtttcctccagcatacggtagcttgcaggaattagctttggttgttcgataagatcaaaatgaatataggtaagtatgagcggcttttgcgggttatgtgtggcacgggtatcatcccccggcttgaacaggaagcagctccccttgctcaccggatacgacgtcccgtttaagaccactgttccttctccgctccatacataaaataaatcatagtttggcatcggcttctcgcgtacctgccacttccagcccggctcgcacacaattttggcgaaggccgacaacaggataaacgatgacgcagatgtatccagcaaaatctgcacctccttttgttaatctttggttgtcctctatcccgttaatttataatataagctcagcgccgtcattaagcaaaaaaatgcgcttttatgttccagatgcttttgcgtgacgcttaccgtgtgtaatgctataatatgtaatcaaaatgacttggaaggatgaaacgggaatgaatccactggcagcgcagttaaaccaaaacattcagacaggcaacgagcatgtatatcaaatgctttctcttttagggaaagaaatttatttcccaaaagaagggattttgagtcaatccgcagaagcagggaagcttgctaaaaagtacaacgctacgattggcattgctacagaaggcaatggtcctatgcatttggaggtcattcaggaaaagctgtccgcttacaatcccaaggatttatacccttacgctccccctgcgggcaaacctgaactacgtagtgtatggcgcgacaaaatgctgaaggaaaacccttcgttggctggaaaaagttacggccttcccgtagttacgaacgcgctgacccacggtttgagcatcgttgccgacctgttcacggatgaaggggatgctgtcatttacccagacaaaaactgggaaaactatgagctgactttcggtattcgccgtcatggacgtttggtgaatttcccgttgttcacagaggatcaacgttttaatagtgaaggattacgcgacgctctactggcacagaaagaatacggcaaagcgatcgttgtactgaacttcccgaataacccgacgggctacacaccgggagtcgaagagggtaaagcaattgttgctgccatccaggaagccgcggaagcaggcatcaatgtcgtagttgtgacggatgacgcttattttggtctgttcttcgaggactccctgcacgaatcactattcggtcagttagctggacttcatccgagaattctacccgtcaaaattgacggagctaccaaggaagaatttgtttggggcttccgtgtcggatttattacctttgcttcggaacatcaggatgtactgagcgcactagaacaaaaaacattagggattattcgggcaacgatttcgagcggtcctcacccatctcaaaccttcgtcctggatgccctcaagtcaacagactttgaacaacagaagaaagaaaagttccagattatgaagggtcgggctaataaagtcaaagcgttactcgatagtggaaaatacggagatgtatggagctactatcctttcaattcgggttattttatgtgcctcaagctgaacggcttgtccgctgaacgactgcgcacacatttgctggaacaatatggggtagggacgattgcgctgggtgaatatgatctccgaatcgcattctcatgtatcgaggaagagtatctggaagacctgtatgacattgtttaccgtggcgcacaagatttgttgaacgcctaatatgtaacagattaaatatagcatcattagcggtatgccggatgttgtggcataccgctttttaatgagctgaaccattgtaagtcacacttcgcaacaaactatccttcagcagcgagcaaagatttctgtgcgagtggcagcaggatgactacctcggttccgactcccggctcactctcatagtgtatacttccgttcatagcttcaatgattcgaaaggagacgaccgttcccagtcccgttcctacctctttggttgaaaaaaacaaagtacccactcgctccagatgctcctgactcatgccttttcccgtatccctaatatgcagacatgccttttcttcctgaatcgccagctttatgtataccctgcccccatcatccgcagcttcgatcgcatttttcgtcacatgtattaacgcctgtaacagctgattacgatccatatgtacgtatatttcattccttagctcagtatacagtcttacgccttgcttggtcgccatcggtttcaaaagcaaaacaatctgttgaaccatgccagacaaatccatcagctctgtgttcccaatctgcggtctggataagttcagatagtcgctaataattctttcagcccgatcaacctctgctagtgccaaagcaatatatctgcgatttttcccttctagccctgactgaaccatttgcaggaaccctttaaccacggtcaacggattccttacttcatgagccatagaggcagccagttcacctaaggtattcagatgctcagcatatttaatctttcttctcatttcttcccgttccaaactaaactccatccagaaagaggaggctccaatgcttaggaattgaatcacaccgaaccagagtattgcccgaatcagctcgacctcatccttatccagcctgccattggcccaggaatgtattaacagaaatataagcatggcaatattggtccatatactcattagcatattcatgcccacccgaagcaacatactattgagctgcataaactttcttctcaccaagagaggccccaaataacacaacatcatgctgggaaagctcaccaccatagactctggatctatatacatacgagccatcaccatcagcgttatattcagaagccctgcctttggaccaaaatataaaacagaaaggatcagaggaacatatcgaaggtcccaatataatccataccaaatgtacgaaaacataatgcaaagcacagaagacacacccagcacccctcccataagcaacggggtatgtttcctatgccgatgatctgacaaagcgctatataccaataacggtacaaacacaagaaatatgttcacgagcagcttatctaccagcatctcgtctttcccactttccaagtgataatgactacgtacttcttctattctcgataatacgtgtcttttcctctatcctcccctacatctgatgaaaaatataaggcgattcggcaacatacctgagcattggcccacgcaatctgaaaatccaattcataagatacgatgtatcctttatcacaatgaccgagaggagaatgagcatgggagcagaagaaacaagaggcggttacggtggttacggcgcattcacaagcacaggaacaattctggtactgttcattttattagttatcatcagcaaaacgctctttatataagcaggcggaaatctgcacccacggctacgataacagcgagcgtacaaaaaaggctaattggcagacagctcttgctgcttgcgaattagcctttactttattcacatagatacaaattacacttcttcctcatcctgaccgtccaaacgccattttttggcttgagcgcctcgtaacaagaacactactgcaactcccccaagcagcgtgagcagtgtagacagtagatcttccgttccttttgccagaaaaggaagccacagaaccacagcagccggcaacgtcaaccgaacaacaaagtcgagaaaagacgcacgacgactatgcgcaggaatcggatataactgaagccacaacgaatccttgtgatactgctttagtgaagtaacctgtacaccaatgaggaatatgaaaaataaatataccgcaatcccaatccagctagcatgggtgatatatataattaacaaccccagaattccaagccgaatgacaatacctgctggctctgtacgcaggaatgtcttaaacagcaggtaacgatacgctccccttctgttccaaggtatgttacctcccaaccaggacagccaacgacgtggcgtcactctctgcgtaagggcgggcacatcgacaaaccagcccaaagtgcgcatcacccgagcagcctgcataccctctgtacgaatcagcttttcccaagccactagcagcttgaccggaaaacgcagaacaagcacgtacaccacaccgaccaatatgataaatggcacgctgtgtagtggaggctgccatagccatgcggctaccatcagcacagccaacacccaccgaagcagacgatagcctacactcccgccaatcgataccatgcgaagctcttgccagccgccgtagctgaatagcagctttaacagcacaaacagtagcagggtcagtagcaacggcttaggcgccgcatcactgcgaatatacagcggccacacgataatagacagcaatagcaaaccgaatattttatacaccacaccccgaatccggctggccttaaaataatggtgcatcgcgtgctcctgtggacggaggaaaacaatatccgctgcgtttaaatacgtacgaaagctcgcatgagcaatcggaatagccacaataagcatgatccagcggatgggcaaatccggtggagtatgcatcagtagcgacgtgtaccatgcggcaaaggcaatcagcgcaaagccgaagaccaccgccagaccgctttgaatgacatagcccagatagggcagcacctgtccccagaacgctacacgtctttctttatgcaaacgttgcaaatccatgctcattccctgccctgtaccagctcataaaatgcatcttccagcggcatgcccggcttacccgcctgtgcagtcacttcgtccagcgtaccctgcgcaatgatggcaccctgatgaagtacaatgaaacgatcacaataattttcaatcgtggacaaaatatgagaactgagcagaatggacgaacccgaacgcttcatctctaacataaagtcaagcagggaacgaatacccagcgggtccaaacccaaaaaaggttcatctatgacatacaacggcggtcccgctaaaaatgcgcacataatcatcactttctggcgcatccctttagacaggtgcatcgacatactcccacttttatcccgcatacggaacaagtctagcatttgatcactgcgcgtgcggaaatctgcttcgctaactccgtacgctctggccgtgaattccatatgctccatcaccgtcatttcaggatacagctctggagattcaggtacaaaagcaatggctccctgatattcctcgggattctcatcctgcttatgcccctgcacacggatttctccggcctgcggtgtcatcaggcccaaaatatgcttcatggtcgtacttttcccggcaccgttcagaccgatcagtcctaccatttcacccggtttcacatccagcgaaatttgatgcagcaccgggcgcttggcgctatatccgccggtaagtccgttaatttgcaacacaggctgttgttccatggctccccctcttctcccttactcgttcggttttgatcctttttccttcagccatcttggtgcacccttgtttttgcgatcacgctcgcgctgtgcttttcctgctttggacaaggctgctcctttgctcttgcctggagctgaaccgttcgcggaatttctgccaggacgtctgttttcggcacgaacaggtgccttacggttttctgtcagtgctccgttagatgaggatctggcctcggatggtcttacaggtgcacgcttggcatccgccggacgcggcacaactactcgacctccatgcaacgcacgctctgcgatgtcaatgcccagttcacgggagaacttacgcatgatgaacgtttcacggtcggtgacaaccgatgccactaatcctttgcgtcccatccgtcctgtccgtcctgcacggtgaacataagcttgactatccgtagccgggtcaaaatgaatgaccatttcaagtccctcaatatccagaccacgagctgccacatccgaagcgaccagtactttgagcttgtcctcgcggaatttggccaacacgttgctacgcgtaactttatccgcatctccatacaaggacgccgtagtcagccccatatgcttgagcttggcttcaatctccccaatggcattggtcgtattcacgaacaccagcgcttttctcggattaaaatgacgcaccagacggcgcagcatatccaccttatcccgttcttcagatacaaagtaatagtgttccagtccactagccgtcttttggtcgggatcaatcccaatttctacgtattcacgcatctcccgttttgccagcgactgaatctcatcgttcagcgttgcggacaggaataccaattgacgatcacgttgggcggtgcccaatatgttggttacatcgcctgctccgccaagctggaacatctgatccacctcatcgatgacaatggtagtaatattgtgcattttcagctttttcgaagcgatgagttcacgtacacgtcctggtgtacccacgacaagctgtggatgatccttaagcttttcgatttgacgtttgatagccgctccaccaatcagaccgagtacacggattccgcgatgctctccgtagcgctgaccctcacgtacaatttgcatggccagttcctggcttggagccagtatcagcttttgcgtagcctttttctgtgggtcaatcgcttgcagcagcggcagcaaataagccagtgttttacctgtgccagtttgtgagcgcgccaatacatgctttcccttcattatttccggtatagcctctgcctgaactggcgaaggctgtgtaatttcatgctcagtcagtttgtccaacagatcttgttcaacgccgagcgattcaaaattcaatgtcatgaaaaggtccaacccctatacgtaaattcgttactctccattatatgcgaaaatagccctgttaccaaatcacaaaaataaaagatgtccctcaccatagctaatggcttacgggacatcttttatttcttattcatcacaccatgacccagcctatcggtcagtctgggagctaactgatacagcttgagaaaaggagatacccaccgtggcagattaacctcctccttgcgaagctccatcgctcttacgatatgccgtgctaccttatctggttgtagcataaaccagcttacatttcgaacatatcctcctgaaggatctgccagctcaaaaaagggtgtgtcaatcggccccggattaatcgtcgttacagtcactccactcccgcgcagctcttgccgaagcgcattgctgaaaccgagcaacgcatgcttcgtcgccgtgtaagaagacgatttggctgtcccgatttttccggccattgatgctacattgacaatctgtccatggccccgctctgtcatttgcggcagaaacgccttgatgcagcgaacaacacccatgtagttcacgtccatcatttgttcaaactccgtcagatcggtttcattaaaatactcaaactttccgtagcccgcattgttaagcaatatatcgacccgtccgtactgttccaatactcgtgcagcaacagcctctacctgctcctggcgggtgacgtccagttggataagctcatgtctgccgctgattcccgcagatacttgcttcagtcgctcctgcgagcgtgctgttaaaataggaatcgcgcccttttcgcttaacaactgagcgcaaagggcgccaattccactggatgcacctgtaatcacaactatcttgtcctgtagtatattcacggtcatccctccacattaaagaaacttgctcctttaatattaagagatcatcacctgaatatccagctcaccgattccttccaccgtaagcggaatataaagggcacgctgaggcacaaaagtggtcaagttttctgatttcatgacctgcggaggcgtaatatccacgacaattccctgactggacaaaatcgtactggcattcccactaatcatattgcccaattctgaaattgcgctttttcccatctcatcaatttcagtcaacacaaatccgcccatcatcgctgataccatacgtagcgccacctgttcattcaggccgaacacaatatttccgctaagctgtccggtcatcccgatcataatccagatgtggtcgtccaccagctcgacattttttacaccaagatttccgggtgaaggagatacttggatcaattgttcaatgacccgtcgcgccgactccaaaaaaggatttatcacttctgccttcacgatcaaagcgcccctttacgatgggcttttagacatacaacaaaagtcccatttaaattagaattttttaattaaatatcactgtaaaacgaatcaatcctcaataaaatgctctatatatcacttatcgacagctacccggtaattttttatagctaaatcacaaaaaatgtgaataatgtcctatatctttacttcttgccggttttagattgattatttttgaaggatataaggactttagtctttatttcccaatataccacactttaaggtactctgcttcgattcattgcccttcctgctcgaataacctataatttaatgaaataaagcataacgacggttttacatatgaacctatggattggctaaaaatattcattctatacagctgcgacaagattaagaaaagagaggaggaacttcatgaacatcagtcaacttgaaacacttatcatgatttccaaaacgatgagcttccgcaaagccggagaacttctcaatttgacgcagccggcggtgtccgctcaaattaaaagtctagaggatgagttcaaaaccattctgattgaccgcaaccagcctgtcaccctgaccgacaggggagctgtttttttggaacacgccgagcgcatattagaggttgttgaggaattaagacaaaaattatacgatctaaacgaaacaccgcagggccacattgcgttgggcaccacaacatccatcgctattcaaattttaccgcgcgtgctttcctactttcaggatcagttccctctcatcaaaacctccattcaatccatggcttcctcaatgatttatcaacaggtggagaacggacttattgatgttggcatcggttatctgattgaacgtaatcccaatttaagcacttcggttctgtactacgattcctttgagctagtcgtgtctcctactcatccactggcctcacaaccacatgctaccattgaagcccttcgggaaattccgttgattctgctctctcccgatacggtgggacgaaaattcgtggatgatgtatttaaaaagcaccaaatcgtacctcatgtcgtgatcgagttgtccagcagtgaggaagtcaaacggatggtcgaaattaatctcggtgctgccattatttccagactgtcggtcacttctgaactgcgtgcaggcacattaaaaatgatccatattcccgagctggaagttagtcatccggtaggagtgatttataaatccggccgatatctaaactcagccatgcagcaatttttaagtgatctgaaggggatgccggagacgaatttcaccagttctgaataacgtaattcgctatgaacaccatacgaaatataaaccctgattacgaaaggaagacaggctatgaaatttgatctgcacacccatcatttccgctgcggtcatgcagacggaaacattcgagattacattgaagcaggcattcagtcgggcttacaagcgattggtatttcggaccattcccctttcctgggcagcgaacaggatcaggcttttcctaaaatttatatggctaagtcacagcttgctgaatacgtagaagaggtacaacagcttaaaaaggaatacgaaggccgtattgacgtgctccttggattggaaacggattattttcctgattttgctgaattatatcgttccactctggctccttatccatttgattacctcattgggtcgattcacaatgtcgaagggaacagcatttttaaccgtaaccgttggaacaaattaagcgacgctcgtaaaatcgaggtcaaacaagcctactatgcgctcattcaggaatctgcgcgaagcggcatgttccaaattttgggtcatattgacgcaatgaagggaaactttcctgccttttcagacattcctgccgatgaagccattgatgaaaccttgcaggtaattgcggaatccaatgtggcgattgaaattaacacttcgggtaaaaccaagctgagtggcggatggtacccgtctgcttctattttagaaagagcgcaccattttggtgtggaggttacttttggttcggatgcccataagccttcgcgggtaggcgatgactgggaagaagtaaaggcaatgctgaaggatatcggcttccgggaatgggtctattttaaagaaaaacgtaaaattcctgtggcgctttaaaatttgtttaagttggggatcgccgctccgcaaatcatttgatcttacgaacgctgctgcaatgggattgttggggattataatttataaggtgataattccattgcaaaggcgaacgcttagcaagattatgacatctatgtgtgaggagaattacatatgcacttggaagatcctatgggcaagcttaaaaagctaaaacatgatatcacgcgatttatgctcatctataaatttgcgctcgacgaaatggaaaccaagattgaaatattaaagcaggaattccaagcattgcacgattacagccctattgagcataccaaatcacgccttaaatctcctgagagcatcatgaataaaatgattcgtaaaaatagcgagttatcgctgaatgctatcaaagatcatattaaggatatcgcaggtttgcgtattacttgctcttttatttctgacatttatgatgtcagtaacatgcttcagagacaaagtgacttgaaggtactggaaattaaggattacatcaagaatcccaagccgaacggttaccagagcctgcatttgctggttcaagttcctgtattcatgtcggattgtgaggagctagtctgcgtagaagtgcaaattcgaaccattgcgatggatttctgggccagcctggagcataaaatcttttataaatacaaccagtctgtgcccgaaaacctgacacgtgaattaaagaacgcagcagattccgctaatgctctcgatcttcaaatggagcgactgcatcgtgaaattaaggagattaaagacgctagaggtgaagaggactccatagaggagcttcggaagattatgattaataatcagcaaattacggtgccggccaatttcttgaagcttctaggagagtaagattaggcggtgctccaccactatgcgaatgatttgatcttatgatcgctgttgcaacgggattcactggatggtataagccctttaaagggtagaatcccattgcaaaggcgaacgtctgcgcttctccagattcaaattctccactccgcctgcaggatacaaatttatgatcaacgaatcgcgtgtttgctcaaaaattgaagaatagaatcattgattaagatcggcttctctctaagcatgtgcggtcgatgactacaacccggagcaattagataacgtgagtcttggacccttgagcataattccagaagttgctcttctgtggcgaaatcatcatgttcacccgcgataaataatgcagggcacgtaatgctgcttaactcactacgtgtcaattgcggatattggcgccaatcctgtgcgctctgacgcataaattcttgccaattcccctgatgtgcctcctcatgccgatccatcatttgatggatcatttcataacgttcgtttttgatgagccactctggttcaaattcatctgccccctcaggacatgcgactccactacagcctatggtcgtaacggtagcgaacatttgagggtgcttcaccgcacagtataaagccacattgcctccgcagctgtacccaataagatgggctttggaaatatgtagcgcctccataaaatcaattacatcttctgcgagttgaggggtgctccattccaggctatcacattttgttctgccatgacccctgtggtcgggaaaataacatgtatacttttgctgaaaatcaagtaattgagatgaaaaagctagaattcctcttgaataatgactgtgcaaaaatatgacgggttctcctgcccccattttttcataatacatttctaagttctgaatctctacgtatggcatatgatcctcctcttttcagtcgctccgtatcatttacaatcattatttcgtctatcttaatataaatgaaaaccatttcaggaggagtgatgtaagtatgaaaaagatacttgtattgggtggaacgcgtttttttggcaagagactggtggaacgtctgctggagagttccgagaactccgttaccatcctcacacggggccaagcaagcgattcgtttggtgaccgcgttcagcggatctgtgcagaccgtaccgaccggcaagcgctcgctgaggcggtaggtgagcaagtgtgggacgttgtttatgataatatttgcttttctccagatgaagccagcgaagcctgccgcatttttgatgctaaagctaagaggtatattgtgacctccagcctatccgtctatgattcgagcccggaagtgctgacagagagcatctttgaccctcaggcttatccggttcgcaagggcgggaaggacgattttacatatcaggaggctaaacggcaggcagaagcagtttttatgcagcaagctacattccctgtagttgctgttcgttttccgattgtattggggacagacgattatacgaaaagacttcattttcatatcgaacatattcgtgaagggctagaagtcggagtccctaattccgcagcacaaatctcatttattcgttccgatgaagccgcagattttctgttttggcttggtcacactcatttaactggtcccgtaaatgcttgctccgacggtacagtgaggattggagagctcatttcgatcattgagcaggtaacgggaaaacaagctgtgatgaaagaaaaaacagcagatgagcacatgtctccatttggtattacacaatcgtggtacatggatacgtccaaagcgcagtcagaggggtactcatttctctccctacatgaatggcttccagaactggtaactagcctgaaccgttcttataaatcataaaaaaaagaggacccgaagcttcgggtcccagcaatatatatataattcaaagggggtcatgtctatgttgtacccactctatgttaaagtaactttgcagttatgtttcatttttgtaacaaactgaaatacaaatgagcccagccaaggcaagaaggccactcgccaccacagagatagagaatgccctgatataatctgacaatttagcttctgaaagcgtgtgatgaagcgaggaagagaacaagaacccaatcaaagcgactcccaacgaattagccaagtacataaaggtcgtgaacaagcctgagcccgttcctgcctcttcagccgatacagcacctaggacgacatgagccagtggcgttgtggccatcccgagacccagaccatatacacctagtatcatgatattttgaatatgaaataggtggaacgcatctagatgtaacgatccaatgagcagaaagctacaaatccccatgattagcatacctgatttcagcaccttgctcccccacctcttaaccagcctggacgaccataatgaggtaagaaaaaagccaacacctagcggtaaaaagaccatacttgtggatcgaacactgtatttcaaaccggattgtacataataattcaaaataaagaagaacgaaaacatactaagatagatgacaattaccgtcaatatccctgcgccgaatgaactctttctaaatatagatagacgaataaaaggcgagcctcccttcttttcttttcccatttgcgtaactataaaagcaaccaaaaccagaatggacaacagcagacaaccccatgtccctaaagcccagccctgcttttgtccggttgtcaacggatagacaaacaacaataaaccaagaagcaacagaaaggcccctgcccaatccatgtttggcacggatctgccataggattccgaaataataggacaaaagagtaacactaacagcccaaagggaacattaaaaaagaaaataatacgccaacccagaccaaaaaggttccagtctaccaaaaatccacccagaattaaaccaagtgtaaacccaaccccaatgatagctccataaatcgcaaataccagccctttctctctgggaagaaagctgctttgcatgatagatagaacctgaggttgaatcatggcagctgatatcccttgaagcacacggatcataatgattaatgtagggtgcgatacgatccctcctaacaaagccattaatgtaaaacccaacaccccgatgcataacatgcgtcttctaccatacatatctcctagtttgccacccaatatcaaggccacagccaatcccagagaatagcccgtaaatatgagctgtgcctccgaaaagctggcgtgcaggtccgcctgcatcatcggaagggcaacctgcatcatataggtattcaatgaaatcaacaaagtgggaagtaaaataagagctaatgcgtaccagcgacgcgagtctacctgctgtactgcttgaggattagtcatggatatggcaaaacgatctttcatggtagttcctccaactctataatggttatctttgatcttttcatttctcatctcaacttgataaccattatcatctataaaggaaggaggctctacctacggaggtattttctatccctatagaaggagcacaaatgcaaaatcctccaaacatgatggatatgcttgaaggattggtttcattaagatttattcgaaaatgtatctgggttacgtattttcttgatatattcgctaggattacaaccataatactttcgaaaggttgtcgtaaaattgctggcgttgctgtacccaattgaaaaggcagtctctccaatgtttaattgttcaacttccaagtaccagagtgctttttccattctttgcttacgcaccatttcaaaaatagtcattccgaataaatgggggaatcccttctttagcttgaattcattaagcccaacctttcgggccagcgcttgaatagacaggggatgttcaaaatgaagaatgacgaattcacgagccttttggagcttggatatatcttcacgacttataaaatggcttgtaccccttatttcatgtccatccatctccccaaataatgcaataaactccattgccttgctttccatgtataaccgtttcatcgtcccattgtagttgcaatgtatcatgtcaaaaacacacttatgcatggctggcgtatccgcataagagtcgatattccccttgtaacgctgtaaccatgtttccatgctatgcttttctgcgatatctccggcataatgaaaaagctcttgtggagaacatcgtatttccagcatttgatggcgaactcctgccttcttttcctcataaaccagttcatcctctaaatataaaacattcccggtcaaacgattggtatgactttctttgccgttccattcacagtatatttcaccgtttaagcaatagctgagttcaaagagcggacaagcctcctgaatatgaagcttcatattctgttcaaaggtgagatccgtgaccacgatttccatacctgggcgaatctgtgtgcgtgtcatgcttcccttgcccatatgcgggggaagcgtgagttgttgctcccattttttatgatgaatacgaccatccacaagctccgtgaattggtcaaataaatgatgtatgtctgcactccatatattcaaagccaatatcagcccttctttcctgttcagtcctaactatagaataacaaaaaaagaggacccgaatcatcgggtcccagcaacatttattattcaaaagggggtcatgtctgtattgtacccgtcctgtgttagagttgttttgcagttatatttcatctttgtaacaaaatattccactgccatttctatgcataatctccttggttcatcgaaaataccaatacactcggcacctctcctgagggatcataagcaccaattgtacacagcaggcgcatcttatttttaataagtacgcgcatggaagcctgattatcctcttggcaacgactttcgatccgcttgagcttcaaagatccgaaaccaaaattcagcatttctcccaccacttctgtagccagcccctgtccccaaaaaggacgatccagaatatagcccagttgtgcctcacccgttctttcattccattgctgaaaagagacgataccgagcaacggtgaggaggtaagctcattggattcaccaagtagattgctttctcctgtatttctctgatgccattccaccgcaaaatgcagggaatctagtgaatcagcagatattttaatttgcgcaaccagacgccgcattcgtgtattgactggtttgcgaattcgattcacatattggatcaccaatggatcggatagaatccgttccagcgcgggataatcctccgttcttagctggcgcaatcggactcggcgggtgtaaagctccggtagcccaagacgaagcatttctctggtcagcacaatgttcccccctgcggatggattggcttttagaaatgaatgtttccatacttaatccaggtcctgaatcccgcggtaaattcctgtgcgcagctctcgaatataatacggcaaagaaggcacagcagcttcctccgcttgttttactgccagttctatatcataaggtacacgtacaaaatgaatggagaaggacgtaggctgctcctctcccatctcgccctctaaaatgcagtaggaagcctgcgtaacatccaacggattcccgacactgccgacgttaaaaagggtttttccctgaaaatgctggataaaagcattgtgcacatcaccatatcccacaacatctggagcaaaagcaacttttccattttcttctgctaatggatcgaacatggcaagccgtttttccggctcatcccatggctgcacacggtgatatacactttgcggcgaggcatgcaccagacggatacggcgtccgctcattctgaaatcataatgaaacggtaactgtgccaaatactgcactcgttctgcccccaagcgctcggcttgccagctaaaattgagatcatccgtaatactaaccagctcatcccaattcccccgcacgaccacttcacaacgttgacggacagcatccagaacctcgcacgggctaggccctttgccgatcagatcccccaaacaaaacacacggctaatgcctcgggaagcaatatcctccagcaccgcctcacaggcaggccaattgccatgaatatctgaaatgacagcaatacgatccatctgaacctcactcctttgtccgaaacgactacatctctacactacattcaagccatctttatgtagttccaacatatatgataaagatgaaaaaaagatcatggcctattggccggattttagcgtaatgacactaagctctggtctgcacagcacgcgaatcggcaaatgtgtcatgccaatgcctcggctgacatacagcggcattctctctgttcccacatgaaataatccctggatgtacttgcgtccacccggaggcggcattggtgctccaatgaccggcaagcgtacctgtcctccatgcgtatgccccgacagttgaagatcaaaggacatttgcgccgctatatctgcatagtccggctcatgcatcagcagcagcttgcacatctcatcaggtagcccgtgaatggcacgctgcggattgggcttgcccatgatgttatcctctaaaccgaccatggctacacgctgtcccgcaagctctacaatcgcatgctcgtttctcagcagtgtaaatccggttttagggtataattcctgaactccggctggtaagcctctataatcatgattgcccagaatagcaaatttgccaagtgtggcgtgcatcgaagccataactggaacagcagccttcatggatactgcatagtcatctacaatatcgcctgtaaaacagagcaaatctggcttcagacctgctatacggtccgcaagctcgcgcagatcctgctcatccatatgaaaacccaagtgcacatcactgaaatgtacgaccctgattccgtcaaaagcagacggaagacgagggagagtcaagttgaagcgtgtaatttccaaatgattaggctcccataaggaagcatatcctccagccagaagcgcggttccggctgtggctaaagccgcctttttcaaaaaatgacggcgcgaaggattagcgggttcatttgaaatggaacgccgcgaagaaccgggagggatagcggccccctgatgcgggccatcctgactctcgcggcgggtgtgcggcgtcttctccatatgcgttcccccttgcgatctattccttgatctcactttttagaaattcttactgtccagaagctttagcgatgggtggacaaccactgctccgcatagtctaccaaatcacgttgcctcgcgaaaaaacatgaagcctctccaatgttcactcgcgtaaaagctgagggacagtcccgttcaaaatcaagtcccagcttctcaaagtcatctgaggtaatattaaaatcctgaaaagatacccacgcttttgctccatccaccatcataggagcttgatgcgtgatcacttctcgtccattataggctgttcgatattccgccaaatgcaaggacgtgttgctgtcatgtccgcagcccaacagcagcacataggcatctgcctcatacagctttgccaaaggcgaatgctcacccagaccatagtcgagctgatgatctgtcagtaatcccaaagcagcaggtccacgtgccgccagagaaacatgcggatgcccgctgcgcttggttcccggcaggccacggaacgtttctacaatgatgcccatccccccggtcagcgtccaggccggatcataagcgggcatttcctcgcgtaccaattcccaccatgactcgtccagaggcgggttcatccaggtcgaaggatcagtcaagtcatgagactgtgtcggcatcaccagcgtcccttccgggccaaccgcttcggttagcgcggcaagaatggccgaggccccgcctggaataaagcgtccaaagctgcgcatcgacgagtgaacaagcaatgtcatgccgctccgaactcccagctcctttaatcccttcatgacatccgacctagtgacaggtcgattcgttatcggttgcacagtcacctgtccagcctccttttctccaaaaacgatacacaataccataattataccataactgctatccgcgctccttcctccatgttaccctccatcttttctgagcgcaaaaaaacaggctttctccagtttgagaaaaagcctgtttgggcataacctatttgctatacagtcagccagcgcttgaacatatgcttggtcgtttccttattcatttcggcaatggaagttgtcaacggaatgcctttcgggcaagagcgtacgcagttttgcgagttcccgcacccttccagcccatcgtccgtcatcaacgcctccagccgctcttcctgattcatttcccctgtcggatggctgttaaacaggcgaacctgagatatcgccgcaggtccgatgaacgtcgtcttctcgttgacgttcgggcaagcttccagacagacaccgcaggtcatgcacttggacagctcatacgcccactgacgctttttctctgccattctaggaccagggcccagatcgtaggtaccgtcaatcggaatccacgccttgaccttcttgagcgcattaaacatccggctgcggtcgatgaccaaatcccgaactaccgggaacgtgctcatcggcgcgatcgtaatcggctgctccagcttatcgacgagcgctgcacaagcctgacgcggcttgccgttaatcaccatggagcatgctccgcatacttcctccaggcaattcgactcccagcataccggggccgtctctttaccgtggctgtccaccgggttacgctgaatttccatcagcgcgctaatcacattcatccccggacgataagccaattcgaattcttccgtatagggactggctttaggatcagcttgacgggtcacaacgaacttcactgttttattcgacttcactgcttgctccgacatctaaatacactcccttccgttatttgttcttggaataatcccgtatacgcggcttgatcagcgaaacatccaccgcttcatacgagatttgtggtccttccggtgtccagtccgcaatcgttgttttcaggaaatcctcatcgttgcgatccgggaagtctggtttgtaatgggccccgcggctttcgttgcgcagtagcgcacctttggtcatcgcttcagccagctccatcatattccacagttgccgtgtaaacgccgcacccgcattgttccagcgcgaagcgtcattgatgttaatgttagagtaacgctccttcagctccttgatcttgtggatcgtagcttccagcttgtcattataacgaaccacagtcatgttgttcgtcatccactcacccagctctttatgaagaacataggcattttcttttccgtccatatgcaaaatacgctcatacttctccgtctgctgattgactgccgcatcaaatacagaggtagctatatcttgtgcagattttttcaagcctttaatgtattccacagccttaggtccagccaccatcccgccgtaaatggctgacagcaacgagttcgcacccaaacggttcgcaccgtgatattggaattcacactcaccagccgcgaacaagcccggtatattcgtcatctgattgtaatcgacccacatgccgcccattgaataatgaacagccgggaatattttcatcgggattttgcgcggatcgtcaccgacaaatttttcataaatttcaataatgccgcccagctttacatccagttctttcgggtccttgtgggacagatcgaggtagaccatgttctcgccattaatacccagtccatcatcaacgcatacactgaatatttcacgtgtcgcaatatcgcgagggaccagatttccgtaagccggatacttttcttcgaggaaataccatggcttaccgtccttatacgtccaaatacgaccgccctctccccgtgccgactcggacatgagacgcagcttgtcatcacctggtatagccgtcggatgaatctggataaactcaccgttcgcatagcgtacgccttgctgatacaccgcaccagcagctgtgcccgtattaatgacggaattcgtggttttaccgaaaataatcccggggccaccagacgccaaaataactgcatccgccgcaaaagtcttcacttccatcgtacgcaaatcctgcccgcaaatccctcgacagatgccttcatcatccagtacagcctgtaaaaactcccagttctcgtacttggtcaccaaacccgcagattcccagcgccgtacctgctcatcgagagcgtacagaagctgctgtcctgtcgtcgcaccggcaaaggcggtccgatgatgctgggtaccgccgaagcggcggaagtccagcagtccttccggtgtccggttaaacatgacgcccatgcggtccatgagatgaatgatccccggggccgcttcgcacatcgcttttaccggaggctggttggccagaaagtccccaccataaactgaatcatcaaagtgaatccagggtgagtctccctcacccttggtattaaccgcaccgttgatgccgccttgagcacaaacggagtgggaccttttgaccggaaccaaagaaaataaatgaacgtgaactcccgcctctgccgccttgatcgtagccattagacctgccagaccgccgcccacgacaataatgttggatgctgccatttctgctcactcctttttttaggattttaaccaaatccccttttacgtttgaaaatagaatctcaacacgatgtataattgatatgagtcgtttatagtagctgtttaaaagcgccgcattgcaccaaggcagttgccgtttcctgaaattccgcactgcggaatgcaagcagggaagcgatgaagccgatagacaccaccacgaacagggtcatacagatataagaagatactttttgcgcacgcggtcccacagtaatcccccaactgaccataaatgcccacagtccgttagcaaagtgaaaggatgccgaaacgacactgattaaatacaaaatgaaataaaccgggttcgtcacgatgccatgcatgacgccgcctagctcctcatgggttacattacccagagccacctgaaagcgcgtgtcgtatacgtgccagataataaatacaaacgtaatgacgccggaaatacgctggaacagaaagcgccagttacgtgaatagccgaatcttttgacattcgggtcagcctgatacgcaatatacaagccataaattccgtggaacagtaatggcaagtagatgaataacgtttctagcacaataaccagtggcaaaccattcaggaaggccacgctgcgattaaatccttccttgccgccctccaccgctgtgaagttcgtcaccaaatgctcaacaaaaaatagagccagcggaatgacgccaagaagcgaatgcagctttctggaataaaatcctctcatctaggtcatgctcccttctcccaataatagcgttttcaatagtaatataacatataaaatgacagtttccgacaggaaatgtccaacaaggtgtcccttataaggaaaaacaaaagtgtgaacatcttgtgtcgctttcatgttactccttttcggcttataatggaattgcaatatacgtattaattattatgtcttttttgcatatagagaggaagtggatgatttgtttgaggatttgaacgcttttgccgtcattgtcgagcagtccagcctgaataaagcctccaaactgctgaatctgtcccagcctgccctgtctcgcaaaattgcgaagctggaggaagagctgggtgtgaatctctttgatcgtcggggcaaacggctcgaaattacgtccactggccgatttgtttataccttcgcgctagagcaacggcaacgacagcttcgcttcttacaaaagctgtcccagcacaaaaatgaagcccagagtatgcttacactcggggctagtctcacgacactccaaacgacgctgcctaccctcgtcgaagctttcatgagcaagcatcctcaaaccgagctaaagctgctcaccggtaaaacccatgaaatcgtcgcctttgtacgtgacaaaaaagcagacgccggtattgtcgggtctgccattcatgaagccggactgcgttgcattccgctatttgatgatcatttggagctcgttgttcccattggacatgaattaaccgtcaagacaggaacggcctcgatgaaagatctgcaaggattgccgatgattattttctccaaaggaacctggtaccgcagtctgacggatgacttgttccagcgcagcggcatcatgccggatatccgcatggaaatcgactccttcgaggcaattgtacgcctgcttccaacctgtaaggcttctgccttgctacccaaatcctatttgcggagcgaactattacgggataatggactcactgcattatacttgcccgatttgaaggagacacgccgaacgacctccctcatttactcggagacgaccgatctcggtccgacagcacgacgctggattagcgagacacgggcgtcgtttgcaggctaccgtatggtgtagagggtttaatcctcttcattaacattaacaacctcatcctcaaagcgaccgatattgtcattcgagccgatgatgaccatgatatcgtctgcttttagccgatccatagccgtcggtgcgatcaggataccgttcgctgtatgaagcgccacgacgctacaaccaaagcgggtacgggcatttagctctgctagcgttttgccattcagacatgcgggtacattgagttccacaatgctgtattccttagacaactccaaataatcaagcagattaggcgtgactagctggtgagccacccggatacccatatcccgttctggataaataatccggtccacaccgagcttttctaacgcacgcccgtgcagcacagatatggctttggctacaacttttttcacacccagctccttcagcaaaatggcggtgaggatgcttacctgaatgtcatcaccaatagcaacaatgccacaatcgaaattacggatgcccagtgatcgcaacgagtcttcatcggtagcgtccgccacaacagtatgtgtcaacatctcactcatactgtccacaacatcctcattccggtcaatgcctagcacctcgcaccccatatcaaccaattgcaaagccaggcttgagccaaaccgccccaagccaataactacaaactgctgcgttttcatatctactcgaaaactcccttatctgaatcaatttcataaatgattaaaccaacgaaatgtatatgaaatgattcatcctataatcattttgccttccggatgacgatacaattctttaccctttttcggccccagtgcataagctagcgtgagtggccccagtctacctgcaaacatcgtcagggtaatcaccagcttgcctatgactgttaaatcaggtgtaagccccatcgacagccccaccgtaccaaacgcagacaccgtctcaaacaagatcatcagaaaatgatgatcttcggttgccgacaaaatcatggtcaccccgatcacgaacagcaaccccagcagtgtaatggtcaaagccttgtaaattcgtccctgcgcaagtcggtacttgaacagcacaatatcttcccgcccccgcagcatcgaaatcactgctccaatgagcagggcgaatgttgtggtcttaatcccgcctccagtggagccaggggaagccccaataaacatgagtatgatgataaaaaactgcgtagcctgccgcaagcctgcgatgtccagcgtattggcacctgcggtacggggggtaacggactggaataaagatcccagtagcttaccaccccaatcaagcgagccaagagtctttggattcgtaaactcaaatacaaaaatcacgagcgtgccgactacaatcatagcgcccgtcatgctgagtaccaccttggtatgcaaggacagtctcttgcgcttgcgatattctgccaggtctgacatcactacaaaaccaatgccgccagaaataattagaaacattgcggtaaaattaacaatcggatcatatacataacctgtcaagctgcgaaattcaccgaataaatcaaaaccagcattgttaaacatggagatggcatgccagattccaaaataaatcgccctgcctacgggcatatcaaaggaccagcgaaccgagaatatcgtagcgcatacgccttcaataaccagtgagtacagtaataccttacggattaacccgacaattccctctacagaagtctgattcatcgcttcctgcaaaatgagacgctcccgcaaggaaatccgacgtttgaacaccagcgcgatcaaggtagccatagtcataaagccgagaccgccaatctgaatgagtgcagcgatgacgacttgaccaaaggttgtgaaaaaggtccctgtatccttaacgacaagccctgttacacacgtcgcggacgcggcagtaaacaaagcgtctataaacgcaagtggctttcctgttgtattggagatcggcagcattaacaataagctacctattagaatgataatggcaaagcccgcaacgaatatctgcggtggagaaagccgaagccagcttgcattgggattcatctattcatcacttctctcctaatccttaaaactataaatcagtgatttaatacggtgtaagctcgctacgcgttccatttgatctttcgatcgtcgttgcccctgaattttttgatttttccaaaccttagttaactataattagcattccctgaatacaggaagaatgcatgtcaagcactactctgccccctgtgctattggcgggcagtagcgaagggggcagaattgttctgaagaagcgaagcgtttgcctttatctccggattttaaccattaaagggggtatacaataaaaaaatccggggataacagcaatcggaagaataatctgcacccgcagcggtctaaccaatccaaacacttttatacgcacaaaaaaagacaccggaaaaccgagtgcctgacttggttcctgctcatagcctacgaggttagctgacggattcgggcagcacagtatgccctatttacacttccgatcagcaggatcggttgtaaaattcaccccagtaacatggttcccccgttttcccatagaaattcggctcaactgtatatcattacctatgtatttcataggcattgcctcaagattataatccttctatatccagatcacaaaaccgatttcgccgaaaaaacgtgaaattggctttattttgcgaatgggcatcgtttaatcgcagcttatctaattttattggaactttaaagtgctttcactctattttcatgaatatcgcttgtctgttggcgggaacctgtgcagtatgatatctttaatggatgttcttatttacagattaaggaggaaactcatgaatcctatcgggaaaccggtcgtgctcacggccaacttcaaaaaattaggcttgctgggcgggattggcctgatttgcttttttatctttcaattgcttattccctcgcttagcaatccgagtccagaatcagtaatgaacgcaaaggtcatcagcaaacaagaagcggtcatacacgcattggacttcgcccgctccgagctgggctatactgaatcacagcctgaggagcctgtcgtgacctatcaggccgaaacagatttgtacggttatttatctagagaaaaactacttcaacagtacgaccgtacatggaaaaaaagttacccttacgaaacctttcgggtcgatctgcctgaatcctcagcgaagagtaaactgcaaattcatgtggatttatccactggcaaggtcgttagctttaaacggatcacctccagcaccaattacacacaggctgatatttctacggatgaacaagcacgtaacaggcttgtacgtgtggctgaggacggcatgacgctcgaagccaaggagcaggcggccgcagtatgggtcaagcgctttggctttaagccgtcggatttgaagcttgcgaccactgaacaagaaggcggattaaagtataccgtagacgataaaaaaatcggcgcctcggtacttacactggcttttacttttgaagacggtgatgttcgctccttcacccaaagcttttcggccccgtcgtcctataccgattatatcgaaaagcaaacattttgggcgaatttgatgacctatgcgggttatgccctatttagctttgtgctgggtgtacttgccattgtgtatgcgtcactcacccgacgacatacttcatttgttcgtggcattgttctgtccgttatatactttattgctagtatagctgggaccatgaacatgctgcctttattgcaagcagaagcaggcggtaagggcatgcttatatttcttatggttttccagattggtgttacctttttcatggctgtagcgctctacttctccttggtcggcggtgacgggcttatgcgtcaggttggactgaatgcatggccgcgtgcaaaagagccgggctacgggttgtatgtgcttcgcagtatgtatgttggctacttgtgggcctttattttactcggggtacaatccatcttattctttatactggagcgcacatttaatacattctccaccacagatgccacgcaatccccttacaatatggcttatccatggctactgccgattatggcctggatggcaggtattggtgaagagactgtctaccgtctgtttggtattccgatggtcaaaaaaatagtgaaaaacacttttgttgcttgtctgatcaccacgctgatttgggcactggggcatacactttatccgatctatccggtgatttccagacctattgagctgacttttcttggtttgctgttcagttttgtgtttctgcgttacggctttattgccgccatgttcagccacgttatttttgacagcattctaatgggacttagtgtgatgagtctgggagacactgtgaatgtgagcgctggtctattctggatcttacttccagccatcgtgggttacatcatttattggtttagtcctaaaaagccaaatcgatttatgtttgaacttataaaaaaagaggagccgtattctacgactcctcctcccgaagggcagctataatctgacgcgcaagcttatccccaatagagagaggccggaagtcttcgacactggcctctcttatttttttaagcgatccaaaatgcttaagcagtaacttacgccgtttctcgccgatgcctgggatagagtccagccgggaagttaccatagatttgccgcgttgctcgcggtggaacgtgatggcaaaacggtgaacctcgtcctgaatccgttgcagtagataaaattcttcgctattgcgtgcaagtgtcacggcctcagaggactctcccactaatagttgggaagttctatgtttggcatccttcaccagtccacacacaggaatgaacaaacccagctcattttgcaatacatcggtcgccgccttaatttgtccacgtccaccatcgacaacgatcaagtcgggacgttccaaattttccttaagcacacgttcatatctacgtcggataacctcacgcattgtttcataatcatcgggtccctgcacagaacggattttatattttcgatactccttcttggcaggcttgccatcaataaacacgatcatggcggagactggatcggaaccctggatattggagttatcaaacgcctccacccggtgcaagctatccagtccaatggcacgtccgagattgcttgcagctttggatgtccgttcctcatcccgctcgatcagcttaaacttctcatccaaagcaacacgtgcattttccgtcgccatgcctgtcatttgctttttcagtccacgctgcggtacaagtacctttacatccaaccattcagccagagcgagagccgccgtactcgggtcctccagtccaccggatagttgggtttctgtttcctttactccggtatcttggtcaccaacttggtcttgatttgttgctcctgcataagttgcccgttcttcagccaccagcaatgagtcagcagaaggctctgtctccgtttgtatcgctttctcatctgtctgtccggtagcatcggttgtagctgcactgtggagtacagtttctgccgcaaccggttgatcgacattgacctgttcggcctgcatcagcttaggagaatctggcagcaatatttcttgcggcactgccgggttgtcactataatattgcgtcacataggacataaaatcactgtaagcttcaccgtagaaaggaaaagtcgacatatggcgctcgatcattttacctttgcggacatataggatttgtacacacatccagcccttatctactgaaaaaccgaatacatctcgatccttcgcatccgatgtggtgattttctgcttttccatcatcgcgtcgatgctgataatctgatctcgcagctccttggcccgctcaaagtacaattcctctgcggcctcctgcattttacgctgaagatcctttttaatttcctcatgtcccccgctcaaaaaggaaccaatctcctgaccaatctggtcatacgtttccttctcgacctctttcacacaaggccccaaacattgatgcatgtgataatacagacacacttcttttggcatcacaccacacttgcgtaacggatacatacgatccagcagcttcttcgtctgatgtgccgcgtaggaattggggtacggtccaaaatattttgctttatctttcagaacgcgacgggtcacctccagcttggggtgtgcctcgttcgtaattttcaaatacggaaaggttttatcatccttcaatagcacgttataacgcggctggtactttttaatcaggttgcactccaatatgagcgcctccatattacttcctgtaacgatatattcaaaatcacggatatcggaaaccagtcgttgcgtcttgccgttatggctacctgtaaaataggaacggacccggtttttcaacactttggccttgccgacataaataatggtgccttcgctattcttcatcaggtaacagcctgatgcatccggcagtaacgctaatttgtgccgtatgttctccagcgccttctcctgattctgcaagtcctccgcataaggtttcattcgcccggttcctccttccattcttaatgattactcaactaactacttagaatatataggaataatacacaaaaacgcccccggtatttacaaccggaggcattgacctttcatggccgctccaccaagcccccgcgggagcatgggtcacatgcgatgattattggtgtttagtaagcatgcttttcagcgcttctttagagttcagacctaccactttatcaacaggctgtccgtctttgaagacgatcagggtaggaatactcatcacgccaaaacgggaagcagactctggattttcatccacgttcaccttcgcgattttgacgctgtcgccaacttctgtggacagatcctccagaataggagcgatcattttgcaaggaccgcaccatggcgcccaaaaatcaaccaaaacggttcctgtgccttcgacttctgcgttgaaggattgatcggacacgttaacaattgccattgtatgttcctcctttatagaaaagtcaagattattataacctgtaatgtctgtttcgacaccttttaattatatcacaatagtcttttaattgtaagatatcaaaatagcagacggaaaaacgcttaaccccgctgattttttccctttacggtaatgacatctacaaaaggacgaatccggtccatcaagcgttgtcccttatacatttcctctccgtccttactcgtaaagctgagatgcttctccagcccttgcaacgaataattggaagtataaaaggtcggtttgcgattcattcggtaattcagtatggagcccatcacatggtcccgtacccacgggcttaaattttcagcaccaatatcgtcaaatacgagcagatcacaatttttgagcatttcggtcgtttccttcagcttctgcccgtcctgaatcatggactttaagtcctccacaaaatcaggcatatacacaatcacaccattcagacccgacagggccagctcgtgcaatagatagcccatcaaaaaagttttacccgtaccaaatgtaccttccagatacagtccttttttggatagaccctgacttttcgtttcttcaatgtaacggaatagctgtgtgacggcaggcatacgttgtgaatctttgcgcgcaatttcaagagcgttatatccctccagaagggcgcgttcatccacataaaagcttttaattcgctgacgcacccgttgttcatgttgggaagcaaccaacttcgcacatggggtccgaatgtccacgatttcggctgttccattcggatattccacgcccagcttgcaaaagtggccctgaaaatcgttaggacatcgttccagccccggacaattgtcgcaatttcgacgatcccgggtatactgaaagagcatgctcatgttgagtcgcaattgtgtttcgtccacatcaggatgagcagcacaaaactcctgcacgagcggatcatttagaacttgatcggctacattgcgagtgcgctggcgaaacgaagggttctgcatctgctgtagcaaatcgcccagtgattccaagaacgctcctcctttcttaaaatgtgcaagagttatagacaccttaaaatctatctacacctttttctgttttccggattgcattcgttcggccagacgcagcagttcatccaattcttcctcagatacagactcctcggaaggatgatcctgaacgattggaatggatggcttggctggcccgttatttttggcatatgcacgggatcgaccgccggaaggagaagcagaggactgttttccttttaccttggcttgatcccttatatattgaacggctttttcgtaagtgtttacctgcttaagcagcatattggaagcaacggcctcgacaaagttgcggttaatccgctgatcgctccccgatacgagcagtgacattaaataatggatcagcacgttgatgacttcaccgggcagcttatagctgatatcaattttctcaaatatatccagcaggttaccgggaaccgtgccagggaaaaaggtttgcagcaaccggcgataaggctcgttgcgcaacatcatattatactggtgaatgtcacatttggctgtgaattgtggtggaacctctacataaaattccatttccacagccagttctgcaggcggctcttcagatgtggaagtttccctctggcgcaaggcgaccactttggcggcctgtacctgctgttcctcctgacgcttccgatcctgtctggagtgctgactagcccgaagctgaagctcgtcaagcaacaaatcgcctgcttcggtaaaaataccatcctcatccagcaagcgactaatatcctgtacagagagatcaaatttgcgaacaacgtaattgaccatgcctaactgctcgtgctcaaaccgaagacgttccacgtgcttacgattggcagattcacgcggaaaacggagaataatatctgcataattcaatgcttcctccgattctgacgctagtgctccagtctgacgactagtggacacctcggacagcgcctgctccagttcataatctataacatgggtattcagttcaaataactcgtagaaaggaatcgaaatattctctttattataggaagattgcgaccattcgctagattccctgctccacaacgattctctcagagagagcactgcaaacttaccgattttgtctctcaacaaaagggtgagatgctgtgttctgaaaaattcagcaggtgcaagcggtggctgcatctcatattcgtacatatagtcgtccgtttcgggtgcatacagcctggacgtctgtaacagaccgacggcctccagcttggaggtctgttcaatcaaatacttgcgtcccttctcactcggctccagtcccagtgtcagaaaaaggcgacgctgctgttccaacggcgaataaccgatttgtccaactggcacatgctggaacaacagtcgatacagactgaccgcaaatgcgcctaccatcggctgatagacgcttcccagcatcaattcatccagtgcgctcaagccaaattcccgataaacgcaatagcggtggttctcagtatagtgcagcaggtttttcatccgcattccaacattcttcctttcctgacataacggtctccaagatgtttttctattctatcatacttgccttctcgtgggaccaacaaaataagggcaattgttctcctttttggcagccatattcgtctgagttctacttttttcgagaatactaactattttatgactttgtgacctgcatcatggtaaaaataaaattcttcacacttctttcattggtgaaaagctttactttgagctacaatataatggtaagcatcacgtatttggatacaggaagatataaggaagtacacatatttcggctaagccgattatcatttacagatcgtaaaggagtgtagatcgtgagtcaacatcaaccacaacaaaccccagcaacacccaacgaagtagcctccacactggaaggctggtatgcgcttcacgatttccggtccatcaactggacagcatggaagaccgcagacgatgaagagcgcgccggagcactggacgagcttcaagagtttatgaaggaatggaacgttacagaggaagcgggtctgggcagctcagctgtctatactgtagtcggacaaaaggctgattttgtcatgatgcacctgcgcgaaacgctggaagacctcaataaactggaaaatgactttaacaaaacaaccttcgccaaatatacaaccaaaacctattcttatgtgagtgtggtggaactaagtaattatttgagcaaagatgaagatccaatgcaaaatccacaaatcgtcgcacgcttgaagcccgtattaaacaaggcgcgttatatttgcttctatccaatgaacaaaaaacgtgacctggacgacaactggtatatgctttcgatggacgagcgtcgcaccttgatgcgcagccacggtttaattggacgcagctatgctggcaaagtaaagcaaattatttccggttccgtcggctttgacgattgggaatggggcgtaacactgttctccgatgacgcacttcagttcaagaagctaatctacgaaatgcgttttgatgaagtcagtgcccgttacggtgaattcggctccttctatgtcggcagcgtgttgaatgaagagacatttgaagacatgttgaagctgtaagacgcagacatcaactctttactgaataaaaccgaggatttcgtgaactcccactttcgggacgacggaatcctttttttatacttcattttgccagctttcttttctccaaagcgatcagaataaagataataagcagcaaaccacttagtaagaccaaaaagcctcccaactcgggaataaaatattttaagctcccacctttgaagcccatacctctcaaaaacttgaaatgccaggtcaatggaagaatgttacttacatattgcagcgatggaggcagcatagccactggcaattgagcgccgctcagtaaaaacgaaggcagtataattagcatgaggcgtggggaagcttttccaggattggccgcattccatcctaaagccatcgcaaacaaacccaacgtaatcgtgtacaggagaaatggaatactgagctgccatacattcgcttcaaagcgtagtcccccaatttgcttaagtaaaccaatggacagataaaaggacacacatcctactaacgcatacggtaacaccctaagaatcaagctatacgaatgctgaagctcctcttttaatcttccttgctcccgcaatcgcgggacgattgtcagtacagtagcaccaatcagtgaaatcatgaccgtattaatgaatcccataaccgaggtcatcaatgtagcattggtaggattatataacagccgctgctgaagcagcatattggaagtaagccctgtaacctggacgtcactcattcccatgccctttaatccaccaccagctagcatcgcattttccgtcgccataatctctgtgactgccgagcgtagatttccagtagcctgacctaccgtattatccacataaaaaccgatattgctctgaactcctttgatcctattttcctccaacccagctggaaggtaaatcaccgcaaaaaacttttcattatataaaagtaaattcggatcggcttcattctcttgcacatggcgtacatcaatatactgcgatgcatctaatttattaataagctgtcggctataactgctatgatctaaatcgactacagctacagaggcatcgttaagctgattatttttaaaaacaaatccaaaggctacagctactacgataggaacgagcagcataacaaaaaccatcttaccgctgatcaacagcttccattcttctataaaagccttcatttcgtcacaacctctaccgtcattccaggtaataattcagatgtgcgttgaacatccacccgtacttggaaggagcttatatccgacagtcctttgtcccgactcattctcatgttggtatactgaggagcagaagtgatgtacctcaccttgccttggacatctctatctaaagctacaacgtgcgaagtcacatttcccccagctttaaactgtgacatggagtcctcacccacataaatatcgtagtatagctgattggtttcgataacggcgcccgttgcccctgtagaaacgatctctcccattttaggtacaatgcgcgacaccttaccatctgtggatgccttcagcaccatacgtccgcgctgcaattccaaagttttgagttgaacacttaatgcctgcttttgttgagccagaagatccacattgtattcgctattcttaacatcttttcgtgtttgcgaggtttgagtcaaggcttccttcgctttttctgttttgatacgagcctgctggcgttcctcagcagttgcgccagcctccattttatccaaagcggtttgctgctgagcgatcccatttctagcaatgtccgattgtttgctagccgctgtaatctggttattagaaatttcaacctgatccttagctgtatctaacgcgatttgggcattatccagttggtttttggcgttatccagttctgctttggttccagctccggcatcatataacgctttgacacggttgtaattcactttagccaagtccagagccttttgtctggatgatactgttttttgcgcgatttccgcattccttttggctgtctctactcctgtcagagctgcgtccaacgattgctgtgctgcttcaatagccagcttttgtcttagaatatcctccgcacgtgttccttgatttaataaggactctcctgcttgcgcggcttgaatgtccaattgtccttgtttttctgaagttgaaattttctccgactgattttgcagcccgtctttagcctgttttattttcacatcagcctgtgcgatatccgtttttaatttctcaatttgtaaatcaaggtctacaggatcaagggtcatgattacgtccccttttttcacctgttgttcttccttcacctcaatcgtgtttactcttccccctacaccctgaaaagcaacattcacggtatctgccgtaagcagtgtgtttttttgttgggctgccatactcacagcatccttgccgctcattgccatcagcgtacctccagtacctaatgcgacaacaagtagcacgtacacaataatctttttattcattgcaacaaactctccttcatgatgatgatttagccaatgatagttaaaaaataatagtcaaaaacaaataagggacctgatagtacgacgtctaactatttaacgggaaaatttgattattcccgttttatccgttcaagtcctaaggaaagcttatttaataacgtagcaaatagaatatgatcctcctgcgtaaattcattcattaaatccgaaaaaagctggatgaacatcggaattttttccgtcattaactgttttccttcatcagtcaaggagattgcggtcatacgtcgatccgtcagcgtacttcttcggatgatgccgtcccgttccagcttatcaattacgctggttactgttgaacgagtaacccctgaatattcagccaactctgatggagtcaatgcacgttcatgtaaaaacaacggcattaaaattttcaggttgcctacagatagtccatattccgagagtctggaagacactccattgtacacttcatgtgctgcctgcacgaaaagtacccacgtattcaacgattgggagtccacatttggaaacttttctgccaataaatttattttcttggaatcagcattgattttaaaatcagaattcaatccgaaggcccccctctataattagtaatcatactatacgtcgtcaaatagttatgagtcaatacccttttttgttcatctaaataaaaaaggcctccaagctcctgtataagagtcttggaaacctttttctgctcgtattgtttttgcatgttgactactcgtctgaggttagaaaaaccgcccttttttcagtaccagtggaattccgccaatgatgaacagatagcggagatccacaatttttttcaattgtgcggccacccaaccttttattttacgtttgcccaccacggcgacggcttcgccttttccaagcgaagcaaccgtccctttgttagaaaatacgaacttgtgcagctcctttttgcgaagagtagcggccagattcttggcacaaaggaccccttgctgcatcgcaatttgggcagtcggtgggtaggggcgcccttcgggattaaacatcagggagctgtccccgataataaaaatatcatcgtggcccggtgcacgcagaaaatcgtcgattttcacccttccgcgcatcacttcgaatccggctttctcaattaatccgttcccacgaatccctcccgtccagaccaccgtacaggcttcgattttctcaccctcaccaacgattacaccatcctgcaagcattccttaatcggaattccaatgcggaaggtgacccctttacgcttaaggacatccatcgcatactccaccagttcaggatcgaaccctggcagtgccgtaggagctgcctcgacgttaatgatttgaatccggttaaaatcgatatcatacgctctagcgagctgtggcaaacgatccgccaactccgctacaaactcaatcccgctgaaaccagcgcccccaacgacaaaattgaggcgacctggcttaccgtcatttttatacagggccagttggtattcaatatgctcacgaatcaggcgaaccgagttaatactgcgaatcgtcagcgcgaacttatccattcccggaataccgaatgtttcgggctccccgcctagcccgatgaccaaataatcgtaggacagcgagccatcctccagcacgatttttttctcctttggtatgatttccttaaccgttcctttgactaaatccaccttgaactcatcgattagctgcgcaatcggaatccttgaatgttcaatcgtatctgtacctgccgcaggcatatgaagatgtgtcgtaatatagtggtaatcatgacggttgatcagcgtgacatccgcctcattgtgcttgagctccttttgcaattgctgagccgtcaatataccgccatatccggcgcccacaatgacaattttgggaatactgctcatgcttctaccccttccgatatacataatcataatcattaattgttcacagctgttctctcaaaacggtgaattgatactcacagaaaagtcttcatcaaatattaatcgctttaactttgcaagcggaacccagcagtttataatgataaacagtgaatcatgcgttcggcggctatctgaacctctatgcggctgattcaatatctacaaatcccatactatccctttcggaggtgtttttagagtgacagctcaatccacaggtgcggagatccgcgatctgattattatcggaggcggtccagccggtattttcgccgctttttacggaggaatgcgtcaggcatccgtcaccttaattgaaagtatgccccaactgggcggccagcttgcagccctttatcctgaaaaatatatttatgacgttgctggctttcctaaagtgactgcacaagaactggttaacaatttggttcaacaaatgaaccactttaatccagaggtgcagctagaagagaaagtcgtatcgttagagaagaaggaagaacgccacttcatcataaaaacagacaaaggtggcgagtatcatggtaaagcggttattattaccgctggtgttggtgctttcgagccgcgcagactggagcttccaggtgccgaacgttttgaaaaaacgaatctgcattactttgtcagcgacctgagcaaatttgcaggccgaaaagtgctaatcagcggtggtggtgattctgctgtagactgggcacttatgctggaaccgattgcagaacaggttacattgattcaccgccgtgacaaattccgtgcgcatgaacacagtgtcgaaaacctcctcgcttccaaagtaaacgttattacaccaacggaaattacagaattgcatggagatgacacgattacaaaagtcactcttgctcatgtaaaaaccaaagaaacacaggaaattgaagtggacgatgtgatcgttaactttggatttgtatccacacttggcccgattgctgaatggggaattgaaatcgaaagtaactctatcgtggtcgactctcgccaggaaacaaatattcccggcattttcgccgcaggggacattacgacctatccaggcaagctcaagctgattgcggtcggctttggtgaagctcctacggcagtcaacaacgccaaggtctatgtagatccagatgccaagttgtctcccggccacagcagtaacatgaaattgtagtctagtttagactatgacaaaaaagggtattttactccaaatttgaatctttggagtgaaatacccttttttacggtgtgcctattcgttgcagtgattgtctgtaaagtcatccgaaccctgaatgactttacagtcgcagtacgagagcttgtccggtctaatgaaggactacggctgtattcatctctagatttcttttgtgaatctcagccagcaacagtgcaatgaagtcacattcaagtttaagctcgattgccatctgataggaatccaaaagcatttcatccgtcagcatagccatcctcgacacaacctttccttttatttcaaaatctattctatcaaaataccaaaatcggaacaagcgttctgttatccacagtcaattgtggaaatcctgtgtataaattgttggtaagtgtcgttaacccatatatgtgacaggggataatgtggacaatatttatacacagaattttgacgctcgaacacacaaaaaatatttttattatttatacaaatatattatatttagcgtcttgttaatagattaaattggaattttattgaagaaaacagaaattattgaggtcttgtattaacctctaaaatccatacccgtccattctgatcaagcccgtaatcaaatcccagttgtccgatcccgggaaatctcctttccagtacaggaatacagcgttgtgtaagttcaatgatctctcgccgcttttgaatagcaagccgccggggatatatcatccgaagtgcctctgttcccttcagcaaagtgccccccttgcacagattcgtaatgaccagcccaggccgagcatgacgtgcaaccaccgcacgaaaatcccacctctgcccttccttcacaactttgactcgatagtcgacaggtctaccttgaatacttgccagttggatgccttgttgaatgagatatggacgttggattcggagcttatggattccgattacaagcgctctaaaatgactgaaccggtgcgtgtgctccatacgcgtacaggtgtatcccctacgctcctttgccacacgcatgactccgactcctccgcctcctttcacaggttttataaatacaaaagcatgccgccgcagcatcatgcgcaattgttcttcactatatagacaggtttccggtatataaacggcggtatgtggatggtggagcagcgccttcgtctttagccatttgcttgcaagttgtctcatctaaccctctcctttcgccgtcagttatacttatacatactcaacaggaatgttctattcttggatgattgtccgcggcatgtgcctatttcgacaagatcatggcgaacggtagcatgcaccgaacatcactggtacaatgacaataatctactaccatttgcacggagcaacggaaattaccggcaaatcgttttttcaacaaggaggtcaactcatgaatagcaaaattggcatcatggacattggctcaaactccattcgtctggtgatctatgaaatgacagagacaggggcctatcgaattgtgcaggaatgcaaagaagctgcccgactgagcgaaaaggttggggccaacggccgtatggaacgggaggcgattcgaagcatcgctccattgctgcgccaatttatggcggtatgccatatgcacggggttgtccgtatgcgtgcagcagcaacagcagccatccgcaatgccacgaattcggacgaaatcgtccaatggatcgcggaggagacaaatttaacactggaaatactgagcggggagcaagaaggctatgccggttttctgggcgtagtgaacactatgaatgtgagtgacggaatcattattgacatcgggggtggcagtaccgaaattacgctgttccgcgatcgagagcgactgcatacggtgtcatttccctttggcgccgtcaatatgaattggcgctttggacgtgaggttaagaatggcgaatggtctcctcagcagattgaggaaatggagagctttgtccgttcttcactgcaaaatcatgattggatcttctccaatccgggtctgccattcatcgggctgggcggaaccctgcgtactttggctaaaatcaatcagaagcgacaggattactcacttcctgtaacgcaccattacgaaatgacgatagaagatgtcgattacttctatggcagtctgccccatcttccctatgaaaaacgcaaaaaaacagccggcctgtccaaggacagagccgacatcattgtaccgggtcttattatattgaaaaggatatttgaagctgctcaaggctccgcgtatttggtcagtggagcgggtctgcgagacggcctatttcatgagctggtcaacgctgaacagcccgtggtagctaatccgcttatcacatccattcgcaatatcctttcgtttgctgtcccagttagcgaagcgcatgtcaagcgggttaacgagtacgccgtccggctctatgacacattggctagcggaacctcagctgctatggacaaacgcttgttactgaccgcagcaactctttacaaaacgggggctgccttgaattattatcatttccgccagaattccgtgttctggattttacatgcaggcattggcggtctgtcccatagggaaacggtactagccgcgttgatcgcggattaccatcccaagaaccggactccccgtttgctacgcacacatgccgatattttggagccttccgacgaggaacgtgtacatcggctcggctcgctgcttcagctcgcgattggcatggatcggagtgagtcgggaatgattaccagcatcaatcccactacaggggatgacgcactgcatcttcgtctggaaagcaagagtgaacccatattagaacaacgggagctagaatcggttgccaaggattttcaaaaggcgtggaaccttacattgtcgtggtccattctaccttcttccaatttctaaccttcatcgcttcagattggctcctaatgggagcctctttgtcgtttctggacacaaattgatagctgccgttaggcaaaagctggcgtgccttcacattatcccttaacgataaatgcagaatatctgccagcatttctttgatcccgtcatcataaatcgggcacatcagttcaattcggcgggtcaaattgcgcgtcatccaatccgcactggacaaaaataactcggagttccctccattttcaaaataaaacaatctggaatgctccaggaagcggtctacaatactgatgacacgtatgttctcgctgaatccttccacaccgggacgcaaacaacaaacccctctgatgataagatcaatcttcacacctgcctgggaagctgcatatagttcatcgatcatctcttgattggataaggagttgatcttggcaataatccgggcgggcttacctgccaatgcttgctcagcttccctacggatgagttcaaacagcttgttcttcattcccgttggagccaccgtaaaagcttgcaaagtcttgagcgcagagaatcccgtgatttcattaaacagttcggaggcatcctcgccaagtaccggatccgatgtaaacaatccgatatccgtatacacgcgcgccgtgctttcattataattgcctgtacctacatgcacatatcgtttgagtgcgttacgctcatgacgtatgacaaggatgattttggcgtgcgtcttcaagccaaccaacccatacactacatgacagcctgctttttcaagcttacgcgcccaggcaatattacgttcctcgtcaaaacgggctttcagctccaccaccaccgttacctgcttgcccgattcggccgcacgtgccaatgccggaatcagcttcgattccccgttgacacggtacagggtcattttgattgccatcacatccgggtcttctgatgcctcaatgataaaatcagttaccgcatcgaatgattcatatggatggtacacgagcacgtcccgtttgcgaagtacgttgaaaatatcctcttgtgggggcaattcttccggatacagtggtttgattgccggaaatttcaaatgcgaatatccctccaaatgatcggcaaaagacgacaaaaatgtcagatcgagcggcccgtccatctcaaacacatgatcgaacagcttgaattcgcgttgaagctccatcaaggcatagggatgaatccctttttctacttccagtcttaccggcgccccccggcgtcttcgacgcagctctttttcaatctcttcgagcaaatcttcgatctcttcttcattaatggataaatcggagttacgcgtaacacgaaaggcatgaaccgcctccggaacatatccggtgaacagcgtttggatgtgatgcttgattagttcctcaattaaaataaatgatttcttcttgctgttcgaccgcaaaggcaccgtaacaacacgtggaatattcgaaggcacctgcacaatggcaaaaagcggtttatcctcctccgtatccccgggacgtctcaagacgaccgctaaatatacgtatttattgtgaacgagtggaaaaggacggctctgatcgaccgccatcggcgtgagtaccggaaatataatttcatgaaaatatgcatccagcgacttgcgctgtgttgtatttaagtcttcatattcgagcagtaaaagaccttttttcgtcaagaggcgagaaatatcacgataggtccggtattgttctgataccatcgagacggtacgcttgatcagccgtttgtacaaaccggagggggtatatcccgtaaaatccttttgcataaaacccgccttgatcttctcgcgcgtctctgcaacacgaacagccataaactcatccaaattgctagatacaatcgccagaaatttggctctctccagcaacggtgtatctgcatcctgagcttcctgaagcacacggcgattaaattcaatccagcttaaatctcggttaaagtaacgttctgacccggctttatccttattctgactctctatcaacatatggcctccatcaattcatgcagtatagtatccctttattgtactattagatgaaacgcactagcatcacagcagtgtaaacgcaatgtaaaatgtgtgtaaacacaaactggaatgtatgaaaaggtcaatcggacgctttacaaaaatagcattaagcggtacagtgtttacgtctgtttcatagagtagattgacgaaccgttccttttttagttgtttatgttcattatgatgtgtagtaaccacttagtagctacattcaattgctgattttcaaatggcatgatatagggaggatttacgttatggaacccaagaaaacgccacgcgtactgcaaaaaaacatcgaatttttcaccgcagcgctgtcacaacacctcgtttcggtctggcaagaggaccctacaggtgtatactgtgagattggctgtggatatatcgagttattcagtagcgagatgattcgggtgcgcaatcaagatggaaccccaagccattatgaccgcaatatcaccatgtttcagttaatcacgaaggatcagccgatataattattatatgctatgcctgcgctgttcttccagattagaattgttttatattacaattaccgattttgatatctgctgaatcttgcagattttccaaaaagcgcctcagagcgctttttttgtcgactttttttgaacatcgtttcgaaaagcagtatgataagggagcatattacctaaatttaaaggggaatcaaccgatggagcatacaacatcagatgggcgcatcttggttatgaccgcggttgaagctgaacgggaagctgtactgcggggcctgaaaggcgatacccgttttgtggtcgagctggctggcgtgggcgcaccgtccgcagcggcttcaaccgcgctagcactggcggcaactggtgactaccatctggtcatcagcgccggaattggtggcggcttcgtggaggtcgctgcactggagagcgtcgttgttgctgacgcgatcattgccgccgacctgggagcagaaacggcagagggcttcagcagcgtggacgagctgggtttcggctcaagccgaattgccgtgaacgttgccaccgcgcagcgattcgttcaggcgttgcgtgccgctggacagacggctgtcgcggggccgatcctgaccgtttccacagccaccggtacggcggcaacagcggaacggctggccaagcgcgttcccggagctgctgccgaagcgatggaaggctacggcgtagccgtggcggcaaatagactggaactgccgacgatggaaatccgcacgatttccaatgctgtcggtccacgtgaccgtgcagcctggcggatcaaagaggctttgcaagcgttggaagccgcattttctacattaacggaggttatatagatgcaaattgctttttcaccttgtcccaacgacacttttgtcttccatgccctgacgcatggattgattccgggcgcacccgcgctggacattacatttgccgatatcgacatcaccaacaatctggcgatcacaccagacggactggatatcatgaaaatttcgtatgctgcacttccttgggtgctggatgaatacgccctgctgccttgcggaggcgcactgggtcgggggtgtggtccgctcgtgctgaccaaggaaggttccaccgtcgaaggcccggaggccctgtccggcaagcgtgtagccgttccgagtgaacgttccactgcctatctgctgttccgcctgtgggcagccaagcatgtgcctgggggtgtcggcgagatcgtcgtgatgccgttcgaccaaatcatgcctgctgtccgtgacggggagatagatgccggactggttattcatgaagcacggttcacgtatccgtcctacggacttagtaagcaagtcgatctggggaactggtgggaagaagatacagggctcccaatcccgctcggagccattattgcccgacgtacgctggatttggatgcgatcacaaactggatacgcgcctctgtcgaatacgcttggaagcatccagaagcttcgcgtgaatatgtattgtctcatgcgcaggagctttcacccgatgtcgcccaatctcatatcgacctgtatgttaacgattttaccgccaatttgggcgacagcggatatgccgccatcgaagctttgcttggtcgcgctgcgcaggaagggctggtaccttcgtttgatttagcccaactgcgccctacttccacaacaacacgttaaaagggacagacatgccatgcatgtttttctgctgaatagagtagtttaaacatataaaacctcccgaacgagcacatggcctagccgtgcgccccattcgggaggttttatcatttcatatggcgaatcctcattcggactcgcttgttccttattcttagttagttctgttcttgctccacaacctcggtcttaaatacgttatccagtttggtacccaatcttttgaccagcggcaccttgatatcccggctcagctccttgaaaaaagcgtccatgtcacaattaatcttatccaacacgaccttcacggtgccctctgccaagatctgctcattcagatcctccggtacggtaaccgagatatcatacttcttgcttaacgttttaatgtagcgggtaaagatttcgataagctcctcattgttgaacttctcaactgcaacttgccctttgttagtaaatttcaaattcactctcacgttagcatttccccttttccttttgaccatttattttggataaacgttgaacctttcagaggctcttcaaagaaagggccttaccggtcgttttagactcttgtcctttgatatactaagtataacacattaaggccgttttcatttcccaacttgtcgttttatgataaaaaatgatacaatttgcgcattttcagcataaattctttcttttcatgccaataattagaaatagtttatacacaaatacacaaaaaaacgcctatctcgcaaaagaaagacgtttccgtatagatgcccaagtggtatcatttacagaggcttcgtacattcccaaccatgtgaacgatactcacgcacagcgtctcgtatatcctcaatatcatcagaatgcagcaaaacggcaggtagaattacccaatattcattctccgctagatcaataaatacgtcctcgacatcgtaatattgcatatcgccaaatgccgtatccctgattttctgtccaaccaaaggtgtaaactgggaatcaaatgttttcatcaccttcgtatattccttcacgcccgttgccgagatctgctgtgaaataatgacgctcaatgctgttacctccctgacctaataatgctcattatacccttctctcagaccctctacaaaaccttgcgcaaaaaaaatcataaaaatcaatagtccaataccaatagctacggagctgattacgataatgaagataccctgcgtgtttctttgttccattcgtttcgttaaaattccgaaaaccaaacctaagacacccaacaatcctccaaagacaaaaaaactaaatatgaaccccaaacctgcaaaaatccagccaaagaaagcgagcaaccatccctgctgctgtggctcactctgcttcatctgccagcgttccctcgctgtaggtgtatatctgtccattccttctcccccgcatcatctgtaaaacccaacatcggaataacatctgatatagcatctaatggagaaataaaatacgccaaggctccgaatgctacgtagattcctcctattgccctgatgagtttaaaagtaccaccttcccgcttaccaagcggataattttgaaccgtcatttccactaactcaacagacttatagtcatattttactatgacctcctttgatatcctagtatatttatactaatccttgctcctatgtatttgtacaggcttttgcttgattccagacaaactaaacgaccttccccattagaatttcgagaaaaggccgttactacaacaatatgaatcttttactgtttaccgctactataaaccgtgcttaacttggatgttgctctgatgccattcggaccttcaataatagcacgtccttgttcagtatagctcgatcctccccagtcgtttgacatatccaaatattctagacccgatccatttcctttccaagaccacccgagataacctacacctttttgttgggcgtaactcataatggtggcctcgtcaacatcaccatttgtatgcttgattccgaattctccaatgatgacagctagatttttgtttaatacattgtcaatattgctttttactgtttcggcatttcctccagcgtattcgtacatatgaatggagaacatcgtatttttaagcggatcggcatcaaacacttgcgttccgtagtcaaaaatcgacttcggatattgaccccaaccagcggcgtcaaccataatggtatttttgatgccagcatttcttagctttggaataactgatttatacccctgtgcccagccgtttccatcccaagtaccaaaccattcattcgcaatgttgagaatgactgtattttcttttccaatcagtgcgctcttcatttcaatccagtaatctgcgattttattcaacacagcagcattatcacttcccgtaccatcgtgtacttcaaggataacaaccaatttgttttgttctgataaagtgatcaggttttgcaacgctgacaaatcatctttcgtccattgctgaccgtctgacagcacgattctaatcgtgttcgctcctgttttggcaattgcaggtatcgcaaccgactcttgacctttgtaccaagtgtacgcgtgattaattcctctcatgacaaagggatttcccttgccatcataaagcgtcgtacctttaacataaaatcctgtattttgagaggagtcggaacttgttgttacttttaagacattacttggttccgaaacattgcctgctgcatctttcgcttttacagtgaaattgtaggatgtgttcgcagtgagacccgtcactgtataacttgttgtggtgctcgtgcctaccagatctgttccgttataaataacgtagccagttacacctacattgtcttttgaggtcgtccatgtaagagtgacagatgtgctcgtcttggatgagctttggaggtttgttggggcggttggtggtgtcgtatctgctgtcgtatcaatctgcgtgaatctccacctttgctgagcgctaccgttgtcggcccattgttgaacgtttgcaccgtcatgggtataaccaccgacaacatccaatgctttaccactagattgcgagatcagcttataatatccaccaccagcgtcaatgattttccacttctgctgagcgttcccgttgtcggtccattgttgaacgttcgctccgtcatgggtattaccaccggctacatctaatgttttaccactagattgcgagatcagcttataatatccatcaccaacgtcgaccactctccacttctgttgctcctttccgttatcggtccattgttgaacattcgctccgtcatcctttgatcccccttcaacttccaagttttttccgctatgctgtgccgtaattttgtaaacagcatctgaaataatatccgattgggcagacgatgttggatcaagcgctagattagtaactccatcattgttagcgcttacaatcatggtcggcaatatatacacaagcatactcaacgagaccaaacacgacaataacttcttcattttgtaacctccaggtaaccagcattaccattcaccgtttgctcgaagtttccaacatttctatttaaccgcatctcaacatacacctctcccttagcttatatattcaaattcccatcccttaggcacgtactatgatctctccctcccggccataattcggaaaagaaaaaagaaccaaaaagagctctatcctaatattaggtaaacgctttcaatagttccaaactaattatgtgattgggaaatgaattcttacacattctagtttacgttatacgaaatgtcaattgttagcataacaaaagtctgtaaaatacaatgattattaaaaaaacaaacatcctatttaaataataaattagtgatattgaataacacttttcttttattatctctatttttgctataaaacaattatattcattcattttttacataaggacgaaaaacataaaaaacacaaaaatatttaaaaatattttgttattctaatgttttttataacatcatatcttgttagctaattttgtacgacaacctctaccataaatttaagttttttcaatgatcttgaatagcatagcaaatgagttctttgaaaatcatagttaaaaaaagcacgctatattggtgcttccaatatgcgtgcgtaaaagaagttattgaagttcttcttgatccatcgctcccgttaatcctcaaatgtctcaccgttctgatacttagtgggataactctattctttctttaatatttaccagatacacactgcctgcaatcagcaccagccccacaacaaacgtcaaagtaagtgattccttgagcattaccatactaaagaccgtggacaacaccggtatcataaacgtataggagccgacggttcccgcatctccgttgtcgattagtttaaaataaatcatccagcccatcgcaatcacgaatatcgaaataaacaataaaattgcgataaaggaggtcgtccagtgaatgtcactccatttctcggtcgtaaatccaatgccattgagtatgatccccccaaaaatgagttgcatcgtcaccgcccaaatggagtctaattgcttgcttttcttcttcatataaattgttccgagcgcccagcatagtcctgaagctagccccaacacaatgcccagtacagacaaatgtcctgccattccaccagagctaatcacgatcactccgccaaaacccagtaccagtccaaccaccttcaggggaaacatacgctcccctagccacatccaggagaataatcccaacaggatcggctgaaggaatactaaagtggaaaataacccagcaggcaaataacgcagccctaccgtctgtaagccatagtagcctgcaatattaaatatggccagcaccagataagtccacccattctgtctaaggcgtaaggtttcccggttacgcatagcgaacaacagcagaatcacaccacccagtagggtacggattcctgaaaaaaatatcggcggcgtatctggcaaagccagcttggtcaacggccagttgatcccccataccattactaatatcaagacaagccacagcgtagctttaggtgttaattttttcatagatgtcttctctcccttagattttcatcgctcattgcttacgactaaaatctgaatagccgtttgcaaagttttgctttactagcttatactgtggtcactaataaataaaatgaatgttttcaatatgggagataacttttcacttatgaccattactcaaattatgatcttcgttcgcgtagctgaaacgctaaacttcacccaaactgcccatgagctacatatgacgcagcccgcggtcagccatgccatcgccagcatcgaaaacgaactggatgtccagctattgctgcgcgaccgaaaaaaaggagtgctgctgaccgatatcgggcacaaagtactgctggaattccgtatgatgctgcaaagcatggaaaaggtacagcagcaggtggctgctgaaaaaggtctagacgtgggcacaatcacgatcggtgcctttccttctgcttcagcctattttctgcccccgattattcatcatattcgtcagcattatccgaaccttgttttcgatctacatgaaggctccacgaatgaagtcaaggagtgggtgcataccagagaaatcgaggcgggtatcatcctgttgccagaccctcaggtagatgtcatccctttatgtcaggatgacatggttattctcctgccagacggtcaccctttgcaatcgcacaataaaatcgccattcgagacttgaatcagcaggatatgatcttttgtaaaggtggacatgaggtcgccattatggaaggttttgaacgcgagcaaagtcagttgcaggcacagttcattactcataatatcagcaccttggtcagcatggttcgacagggactaggtatgggtattgtctcttcactcgccttgtccacgttcccccatgatctgaccgtcaaggagacttcacctctgatcacacgtcaaatcggtatagctgtaccgtccctgcacaatgcttcacttgctgtacagttatttgtgcggaccgcgcaggagctgtttacagatgtgaagcagtagaagcattggtaacttgaatcatcatcctaaggggggtctattcatatacaggaaactcaattcattggaccggatagctaagttcctaacctattcccggtgatttttcttgttataatatggtgtacttaaaaaataaaaaggagttttccataaacggaaaactccttcgcacgttaagctatttactgctacagcttgttcaatgtcggaccaccaattctccggctacatcatcccagcgccaagaaacctcatgtccatggagatgcagccccccaaaccactcgtcgattccttgaactgcaatgcggtccgctgatccattcagtacttctttacccaactctgtcagaattacctttcggttcagaaaatctggaatttgtctgaaatccaagccgacctcatccccgtcaatgatcagcaaaggatgttcgccttgcgccaaagcacgaataaatttccagtattcgagatcacccatgccgagcacatgcaggatgtcagttacctgacgaaataatttcaatggtgtatccactccattatgaacggtctgaagcgtggtctgttccacaatgcccagaccattccgctccgagggcaaccgcttgagatgcgctgtgaaggcttcataggcaaaaggcaggccggaggctgccaattctgccttcttgtcttccagcagattagccatttgagcaggatcaggagaagcatacgcctgccaaagctcgcttccgagctccatttcttgccgttcaatagttcgccaggtcccggataatgtctgaagctgtgccggagtgagctgtcccagaccatgaaaccgttcgattcccggaaactccccaatacagagtaggctcagcttcgtgcggcccagtttctgtctcttgaaccagtggagcagataggcgagcatgctctgatcaaacaggtcatgctcaaaccacaatacgacttcatcatacttgataaattcacgaagtttctgctcttgttcctcacatgccgtaatatattcgctggccggaatacccatcgtttcttccaacaccctggcccgcagtgcccgttcttcagctcccgctggatttgcaaatatcggtcctgccggatatacctctctccatacaagcacgtcaccttgtacaacaccctgcttcaacatgtcacctacaacatcaccgttaacaatatgtagcatgttttgccctccctcatacaaatgattgaacacggagacgaggtcggccaccgggagtgtacctttcaattttcggcgggcatcgtgcagccgcttcttaagcgtcgggaccggagtgcccagataatcggaaatttcctgaagagagtaaccgtaaaaataaaacagccgcagaggcacgcgcagcttggcagacagtgccttcaccgattgttgcagaacttggctctcctctctacgctccgcaatttctgccaaacccggtactcctcccgatacctgcacagcttcatccagaggaagcatcgaatgatgcttgcgccgcagcgtccgctggcactgtcttacgacaatggtcttgaaccagcctggaaaagcggacgggttctgtagcttctccagattctgataagcctctatgaacgcatcctgcacggcatcttccgcgagatggacatccttcagcatgtcataggacacggcatatgccattccgcaaaaatgcaggatcagctgcccaaacgcttccgcatcccctagccgcgccttttcaacccactccctcatacgtccctagcctcttttctttcgtgttcttattcttaagtgccaactccgtgggggaaggttacaaatcatgttgatggaaaaatgaaatgattgataaatagcgtcactgatcacagctgtacacagcaaccatattaacagattctttctcaaaagaagcataatgtagctacaggttgttggttttcaatagaaatatatcatcctttattttttacgaggttaagttcaatatgacttcgaccatgtagccatagcagttcatccagtaaaaacgccagtccatccttactatgcaaacgctcgatcagttctgtaacgacttccataatctcacgctgtatattcttcgctagttggaggcccccactttccccatccacataaagatatggatgatccggttgatctatctttcgtacatgccgcaggcacaatatcccatgttcaagataaaagaaatagctacgatcatacagaactccctcaaataattcatacatatgaggatcatcatcaggtccatatgtcatagtaactctttttaagccaactggattgctcatatatactttcaccccctcagaattcaattctaagttcctatacttgaaattttagtgaagtaaaactctaatttaaataatgtgaattatttatttgataagtcctgaatgtttgtatgcaatactgtaatttatgtataagaagtcgttaaactatatgttttgaatttttataatcaaattggagagtgatacaatgaattttataaaatctatttatacaaaacaaaacgtaaatagctcagtactcttttttgcatttttagttttatatagtgttttttctgaggttgagattaaacccgtagctcttttactttttacagttgcgtttgccttttttaatgccctgagtaaattggtccaatccacacgtagtgagtgataatgatcttaattaaagttgttattaacagactaaaaagacctccacaacgatatagtacttgactataccgctatggagatcaaattataagataccttgctcccctgcatcatcatgtgtcttgaagcttgaatcgcagccacatgtagcagcgatattcggaattaatcgtgaatctgatgtcaggctcatgttcggccataaccgtcttagattaacatttttgagcgttggatgagattgcaaacacgcatgactatactccatatacctactaattgaattaataatcaaatattgtagtttgtacttgttcatattgtaatgactgtttaactgtatttttagggggatcacttaataatagcgattttatcggttcaattatgcggtctacttcttctgaaaaagcaagtgcccacacatgaaagaatgcgcttctcacaagtgcttctgggattaatcctaacttccttccaacctgagaatacaacaagtgtccgtctctatttaaacgccgtacctctgttacaacattacatattttttcatgatcttcatattttttgtgaagagcaaccgctaatatccccgccatttctccatcttctagggcatccagcactttatcataaacataggtttctggtagttctcccggtagtctataaaccctatccacactattttcgctttgttttgaatctccatctataaaacaaaccgatggatacttacaacttgggtcaatattgtgcattttattaacatttaccgccgtaccatctccagccatcgggtgcacctctaaagtatcaattggaatattaccattgaagtcaagaatcgaacgcatccattcagcagtaaaaacatcttccgtgaatataactaacttcgcctctacttgacctgtaatggctctaagagaatgtacatctaattttccctgaaccgtttttccattgaatgttgcccatattgccttagaaggcaacggagctattgcatcatttgaatgagtagtaaatattacttgagacttctttctctctgcaacttcaattaaatattccaccatccttctagttgcaacaggatgtagtccattttcaatttcttctataagtattaaagagttgtcttccaatgactcaattttcataaccattcttatgatacttgattctccggcaccgaaatgaaattcagaatattgaactccagaatctgttagccccgtcaataacgttagttttccatctttacctatactcatataattgtacccagaaacatctttacctagtattttttcgatagcggaagaaatatcttggtgtaatttaattgctgaactatcctcaaaaacaaatgctttagaagcaaatctcaaaagttctagtctttcaagcgcaggaaccgttcttgatacgccaaacgttgctacctgacgatttaaagcatcacgagaccacttcgaatttccaaacgtcgcgcttcttcttaaagtttcatttttgttcaatattttatcaatcatttcatattcaattttccactgccgcatattcaaatccagttgaccatttcttgcaaaatactgtcgtggttttatatctttatatataatgcctgcggctccaagtatagtggttttcccacctccatttggccctattaaagccgtaactgggaaatcgaatcttatgacctgattcacaaaacctctaactttatgaagacgcaaacgaaataagtattttccataattttggttagataccttctctaagagtctctctatctgtgaacttctaatctcaccttgatacatataaacccctccctgtaaactttttgtttaaaaaatatgaaatcagtaattgatcctaaccgtttatgcaatataggtgcagtgaaattctatttaatagcccacttgattaaatacaaaactatatcaagcagctagagtcccgtttatgtttcacttcactgctcgccaactagctgaaactcaccgtcagcataactaccaatattgtagttttgaaccgataggttgacatctgtggaatccgtccatttcgtcataccagacgcctcaccataaaacttattggctgccgcgataaggaatatcacaccttcgctctcaattcacgatccccaacggtgcatgcaccttttcttttgtacactaaagccatttgtggttgattagtaacgtccatagttacgttatcagatcgtcctccccgtttagttgaagtaaatccgatctactcgaaattataggttactacgaaccccccgataatgtgggctgcttcaatcttataagcgacggacttattatgtagctaattctgggcattggtttcctgcatcactttaacgtcgttcaccgattttgtcagctctgcattctccgtttttaacgaagctacctccatctttaaactgtaatttacatcgaacattagatcgctgcaataaccgccacttccggccaatatcatcgcgactaacgcaattttatttagtggcgcggtctgttttcactctgcgacttcataactactttaatacttcataaaatacatcctctcgtctaatatagacatattttactatgtaaccctattacaatctagtataattttcctataggaataaaaagcggacccattcacgtccttaccccgcgcaaatgagtccgttattactgttacattactttggtatccatacgtcgatttacacaaccgattggttcccctctgtaatggcccttaccgattgttaaaactccggaataacgcaccttatcaaatttcacatacgcgacatggtcacgtatgatctctgtcttgatatcctcgacgtattgaatctccggggtgtttctcgcgtaaaccagttaacgaaataaccgttgtgcttcgcgtagtcttgagagaacactcacgtaagccctctgacttcttcgcacttataacgaattcgattgcctgatcaagtgataattgcggatattcgatcgctaaccttccgccagccagaacccgtccttcacgtttctttaacgccataataaagaagacctctacagcggtatagtacgtgactataccgctgtagaggtcgtaattcacaaccctaaatcgcatgttttgggggttgttaacgttcatcatacgggattgttaacgctgaaaatcccgtcgtaatccgtatccacgaatgatttaacgcagtttaacaaggctcttcgttcggttttccggcatccgtagccgtacggaagcttgaaccgcaaccgcatgtagctacagcatttggattatgaatcgtgaagccacctgacattccagactcttcaaagtcgatttccagaccgtccaggtagcggatgctttccttttccactacaatcttcatatcctgtacgttcatatatatatcctgatccgtctcgttgtcgtcaaagcccattgcatacgaaaatccggtgcaaccgcccggcgtaacacccagacgtaaaaacattttcggcgtttcctgctgctccagcatatccttcaaacgctcagcagcggaatcggtgatgttaatcatagctccatcctcctcttttacttcatgttccccttcagtatactccactatttgcaggtgctcaagtcatggaatgtccttcccttacaggcttaaagacctgtttttctattcgtttgtattgaacaccggtggtgtgaggtttataataggtgaagagtgtgtaaaagaaactgtcggaaatttgtcatttcaaaggcgatattttgagatattcatcattgtagcctggcattgtaacatttttcacatatcgtatatccgcgctgccggattcttaccgacggaacgggacatcctgtgcgcacttagcgcttgtgccgctgatttggcggacagcctcgcacagagcaacttgaaggaggaataggcatgtccacattagttacaccttttacagaccgcagaatggcggaaattgtagaaaaggtacagaacggtattcgtttgaaccttgaagacggtatatatttgtatgaaactgacgatatcctcacactgggtcagttggctaacgaagctaatttacgcaagaacggaaaaaaggtttattttatcgaaaacatgagcctgtacttcaccaatgtatgcgaagcgcgctgcgcgttctgcaatttccgcaaggatcagggggaggacggctcttatacgttgtccgggcaggaaatgattgattatgtagagcaacacatccatccgggagtaagagaattccatatcgtcggtggtcataataatcatgtgcctttccaatactatgtagactcattgaaggctctgaatgaaaaatatccgcacgttacactgaaagcttacacagcagcggaaattgactttttcacacgcataagcggcttgagtattaaagaagtgcttcaggagctgcaaaaggctggacttcaatccctgactggtggtggcgcagaaatcttgtccgacgaatatcggaagaagatgcgtgttacgaaagccaacgtggaccgctatctcgaagtacatcgcacggcccacaatctcggcatgaaaactcatacgaccatgctgtacggttcggtcgaatcgtatcaggatcgtattgaacatatgctgcaaattcgtgaattgcaggacgaaacgaacggatttatggtatttattccactgtccatgcagccgaaaagcaaaaacgccaacatcatgcgccggaactccgcttacgaggatcttaaaaccattgcgatcagccgcctgatgctggacaatatcgaccatgtcaaagcttacttcattaatattggcccgcaattgacgcaggtcgctctcacctttggcgcatcagacgtccatggtacgattgtgcgcgagcagatcagccacgccgcaggtgcgttgacccctgccggattgacccgtaaagagctgatctggctggtcaaaggtgccggacgcatacctgtagaacgggacaccttctataacgaaatcgaagttttcgaataaatgtaatatcggattcagatttcccgcgagcatttcatccccattactcacaccatgcagcatcatgctgcctcggaatacgctggtctgcctgccaaaggcaggcccgattctcgggttttataacaacaaaaacttgtgttagatcaacgagacaccagaccatttgccggggacacggtagcgaaaggaaggcggattttgatgaaaaatttcgttattctgggaggcggctatggcggccttaccattgccaaagaattgctggataaacacattcccgacgatgttcaagttattttagtggatcggatgccctttcaggggttgaaaacagaatactatgccctcgcggcaggtacggtatctgattttgatttgcgggtgcattttccagatgaacaacgtcttattcgcaaatatggagaagtcacctcgatggatctggagaataaaatggtccattttcaagacggtgaacccttgccctatgatcagcttgtcattgcgttgggttgtaccgaccgctttcacaatacacccggggctgaagaatacagctgtacaatccagtcgtttaaccatacccgccaaacctatctgcgcttgaacgaaatcaagccatatggacatgttcatattgtaggcggtggtcttagcggtgttgagattgctgcggagttacgcgaaagccgtacggatttgaatattaccattatggatcggggcgagcgggtgctgtcggcattcccgcaacgtttgtctgcctatgtacatgcttggttcaaggagcatcaggttaatgccctgaatcatgttgcggtttcccgtattgagccgggggctatttataaccgtgacgagcaaattgtaacggatgcagtagtatggacagcggggattcagccggtaaaaattgtgcaggatttagccgtccctaaagaccctcagggccgcatcgtgctcaacgaatattatcaaataccggaccatcctgaggtgtatgtggtcggagactgtgcgagccttccctactctccaagcgctcaagcggcagaagtgcaaggggaacagatcgcacacattgtacgcgacctgtggaaaggtcaaacgcctcatccgcatcctttaaagctgcgcggtacattaggcgcacttggcaagaaggccgggttcggctatggctttatgggcagtacctcattgcgcggacgagtaccacgcctgcttaaaagcggtgtgctctggaagtccaaacgccattttggataaacgtatgctaaacaaacaaaggagacccgctctcagagcaggtcttctttgtttcttgagtgtttgcaccatgtatattctctacaaaaaggagctggctaacagagcctttcaatccaaatctaggttatcccatgcttcagcttccttaattttgttcataatcacatcgtacagaagctctgctgaatctgcggatacaatctcgccgttgaccatcgcatagggttcggcgttgcactgaccgcaattgcttaggcagccgtattcaatcacatcataatctggattctgttccagcttggacatgatctcatcggtaccccaatgcatattactggtgcaaaactcaataataggtcttaacattttttcacctgctttggatgacgggcattttaatttggcccgctttgtaatataataataaaggtataggaaaggagttgaattctaatgagcgaaacacaaagcgttcaaatgtatgatgaagtagctgatgtactggataagctccgtccgttcctgcaacgcgatggtggcgacgttgagctggttgacgttgaagacggcatcgttaagctgaagctggtaggcgcttgcggcagttgcccaagttccacgatcacgctgaaagcagggattgaacgtgctcttctcgaagaagtcgacggcgtccaagaagtggtacaagtattctaatgcttgatgcataatgatcatgagagtcttgacttcggtaacgaagctcaagactcttttttgtgttacagcgtctgagggatcactcaagcttatatggttggccgaatggggtccaatcctcccgatacatccataatattacctgttataaaatccgaatgctcctcacacaaataggcgatcactcgcgcaatgtcctctccgctccccggacgtccacgcggtgtctctttatcctgcataccgatgacatcggcaattgacatttccttatttgctcctcgaatgtcccctggacagatcatattgaccgtaatgccattaggagcttcctccacagccagtgacttcgtaaaagacaccagccccaccttagcggctgcgtagacggcgcgatgcggccaagcccttgcttctccagcatgaccaaagccaaaatgaataatacgtccccattgctggctccgcatgtgaggcaataccaaatgatccagcaacatggtaccgaccagattcccttgtatcatggcatgaatctcagctacactgtaatccgcaaatagacggcgttcccggatgaacggtccggcattgttcaccataatatcgactccgcctagccgatcctgtacttcaccaatcagcctcgtaatatcttcctgaacagagatatccccttgtaaagacaagcagcgtactcccttagactcaatcacccgcttaagcgcttcagcttctgcttggctatgcacataattcagtgcaatattacagccttcatccgccagacgcagagcggtcgttttacctagacctttggcactgcccgttatgaatgcgactttatctctcaacaattttcctcctgttcacagagaacggtcacccccaagtataaaatatttaagcttcccctacaactccatccaaaaagaaacccccagtcctcttgttcaagagaatctgggggttgcgtgcaatgcgttctcgttccctacttaaaatgccgggataattgcgccttggtatttatcttcaatgaattttttagtttctggagattgcaaagctttaagcaacttctgaatcgcttcggaatctttattatcagggcgtgctaccagaacgttagcatatggagaatccttgtcttccagtgccagtgcatccttcgtagggttcagcttcgcttccaaagcgtagttcgtgttgatcaacgcaatatccacttcaggcaactgacgtggcagcatagccgcctccagctccttgaattccaggtttttcttattttcagtaatatcttttaccgtagcttcaatgttgcttgcgtctttcagcttgatcagaccttgtttttccaacaacagcaaagcacggcctccgtttgtcgcatcgttcggaatggctacagttgcgccatctggaagttcatcaagctttttatatttttgggagtagatgccgaaaggctccaggtgaaccgcgcccacagaaaccaaatccattttgcgctctttgttcatcacattcaagtaaggtacatgttgatagaagttagcatccagctgcttgtcaaacaattgaacgttcggctgtacgtagtcgttaaactgaacgacttggagacgaaccccttctttttccaactgaggcttgatcgcttccaaaatttccgcatgcggcacaggagaagctccaactttcagttccacttcacgtggtgatccgcctgtattctcgttcgcattgtttgtatccgatgttgtgctctttgtgccgcaagcagccagcaccgcaattaatgtcaagcttaatacagccaatacccatttcttcatgttattacccctccaataatttgtaatattcaggagcagacgtcctgatcaataaggatatctatatgttttccctattttcgagtataatgccgcacgagccgatctcccgccatttgcagcaattgtaccaatacaaccatcagcacgaccgcaacgatcatgacagccgtttcataacgataatagccgtagttgatagccagtgtacccagtccaccgcccccgatcatcccggacattgccgtgtaggatacgagtgtaacgacggtaatggttaatgcggcgagcagacccggaagtgcctcacgtaacagcacacgccggataatttgtcctgtcgaggcacccatcgcttgtgcggcttcaatgacgcccttgtccacttcacgcagagacgtttcgacaagacgtgcaaagaatggggcagccccgataaccaatggcggaatggttcccagcaccccggtcgaggtacctaccagcgatcgtgtaaaaggaataagtgcaacgatcaaaatgataaagggtacggaacgtaaaatgttaacgataaatgataatacaatgtatatcaccttcatcagagtcaacgaggagcggctcgccagaaacaataatataccaagcggcaaaccaataacgagggtgaacaatgcagatgccccaagcatctgaagggtttccagcgtagaattccctagctcttcccaactcacttgtgaaaaatcaagttcgctcattgtccaatcacctccacatcaagcccttgcccagacacttcgcgcaacgtatgctctatatcctcatgatttccttcaaaacgaacgattagctgtccatagggtacatttttaatcgtagatatagttccctgcaagatcgcaaaatcaacaccagtatttcgagccgtacgcgacagaatcgcatcatatgttttgctgcccaagaaggagatacgcaccacctgcgccgactcgccgccacccgctgccgcaatcgctgcttgcagctcctcgggatgttctgactcccgttgaataaagtccttggttacctggtgctgcggcttcaaaaatacttccgctaccggaccttgctccacgatgtcgccctgatgaataacaccaactcgatcacaaatgctttgaatgacatgcatttcatgtgtaatcagcacgatggttaaattaaaacgttgattaatatccagcagcaatttcaggatagaccccgtcgtctgcggatcaagcgcagaagtcgcttcgtcacacagcaatacatgaggatcactagccagtgcccgtgcaattcctacccgctgtttctgtccacctgagagctgtgacggatactttccactgtgttcttccagacccaccagttccagcagctcacgaaccttcttgtccagcttctgcttgggcgtgtttaccagccgcaatggaaatgcaatattgtcatacaccgtcgccgaggacaacaaattaaaatgctgaaaaatcattccgatttttcggcgctgcatttgtaattgggattgactcacagtggtgaggtttaccccgtctacccatacttcacctgaagtagggcgttccaataaattaatacagcggatcaatgtacttttccccgccccggagtgaccaatcactccgaatatttctccacgctttatagaaagattcaacccagacagcgcattaacgcgtcggttgcctttgccataatgcttggttaactgcttaagctctatcaacgtgctgcgacccccttcacttcttccttacccttttaaccagttgtcatctctcaggattgtataaaatcgctatttatttatacaaaaaagagcccctttcacagaatgaaaagggccccaccttgcgaaccttttctcatctgccaaaatcgctataactctagcggttttgtaggaattagcaccatcatgttccctcccagtgtattacaccgggaaagaacgggttgccgggcttcatcgggccagtccctccacctctctggataagaaaaatatgttaaactccagctttagctgtccgttaagtttatataaaaaaatataattcaagcatttttctgaaactaggtttcagtatagatagtttacatagctttgtcaaaggatattttctatcatatttttgggcgtactgcccggttctcccattgtttcgcagtataagtaaaggcgtttgacagcgaccgacacaccatttccaagccctgctgcaaatctgccaaatggtgatcgaggtcctccagttggatttttccatacaaagctcggtgtcgttgccagagatcatcctgcatttccgtattcatatagtgtatctccgtattccgacgcttacgcagccgattgatggcatcgttgtatgtgtccttgatatcaattaaattatcggtcaatacagaatgcattttgagatacttgagctgccgcaacacggtaaaatacgaataatgagccttatactgccctgtttttaaatcacacagatcatttagccagttgcccagcttatctaaaatggagaataccctcacaaacccatctttataaaagaaaacatataatgcatagtcggatttttcatcctcgctcatatcttcagcatatccggctttcacattcatacggaaaaaggcggcagcatgatggctctgctccagttcatccagagatgacattagaccgcgtgtcaaaatatccgccttccgaaaatcgtgggtcggatctccaccagcctgaatttgccgctccagcaggttcaacatatctgacatgctattcatggcatccagcaagatgcccttgttcacacgtggcggctcacccagtagcttgcgtatcatgcttacgcctccttataaatgtaaaatccggctgtaggttttattagggcgtcaagcgaaataactcgtccatcgttgatctacaagcttaacaatatcctcacgcggtaacacctcatccggataccccggcttcatacgcgcatccactacaatcggcagcttatagttcagatgatgcaaacgcacttcgctgtccgcgtacatatccgtagccgggttaaagcgcgtgaacactgtccacaggaacgaggcttgagagcgaacaacttctttggcatcgtcaacaatgaagacgagcggccactcttgctcacccgctgctagtcgctccaaaacacgtgccgccagctcaggttcctgctcaaaagacgcacccgatacgacgaggcaacctccgcaatagggcttaatttcacgaattcccggcagatcgcctccctcataagcacgaggcaattcacgtacaggctcacctatccccatcaagatcgccttactaccatgattcagcttgcggcctgtgtaatcgagtgtatcgtgtgacgtgtgattgaaaataaataaatccgttgctggattaaatcgctccagaatggtttccagcagcaggttaaagtcagataaatcaattactcgatccgtcagcatcaggaacttggtcaacgacaattgaccttgacccaaaatggtaaaaccggatacaagcgcttcacgggagtagctttcacgtacgactgccgctgccagcgcatgtacgcccgtttccgcatacgcccacagggacttgacggaaggcatcacaagcggataggcaggcgacagcagacgttgcaaaaactcaccgagatagtagtcttcttgccgaggcttacctacaatggttgccggataaatggcatccttgcggtgatgcatatgtttgacatgaaatacaggaaaatcatgctgtaatgaataatatccaaaatgatcgccaaacggcccttccggacggcgttcatgaggcggcacataaccgctgattgcaaattctgcttctgctggaatccggtgacccccaagcggatcttctgtcatgggcagcttgcctcccataataagcgaagccagcagcagctcaggtaagttttccggtgctggagcaatggcagacgcaatcagggcaggcgggccaccaatgataatcgtcgtaggcaatggctcattacgcagctccgcttcatgataatggaaaccgccgcctttatgaatttgccagtgaatgcccgtcgtctgatcatcataaatctgaatgcggtacatccccagattatgatccttgggctgacctggcttctcggtatacacaagtggaagcgtaataaacggccccccgtcctcatgccaactggtcactttaggcagtggcgctaacggagcctctgtacggcgaactcccaatacaggggcctcgctatgagatactgtttttagccctacttttagcatgtccttaatcaggccacgttcattccacaatgctttgggtgtaggtggaaacaatgttttggtggctccgacaatcgcatccatcagttgctctggtcgcgggccaaaagccatatccacacggcgattcgtgccaaacagattactggctacaggaaacggggttccttttacattcgtgaacagcagtgccggcccttcttcctcaatgactcttcgatgaatctcagccagctccaagtaaggatcgacaggtgcctctataattttaagatgattttctttacgcagcgcttcaataaattggcgcaaattctggtagatcaactggacgactcctcctaagcaaatcaagccctcgagaaactcgtgggcctggtttgtttcttatatgctattatacgtgtttaaacgcctcttgggcaaaaatccgcttcactatgatctatgaaatgcttaggtacgttgtgcttgggtcggaacaagcttgcggtctggtgacaattgccatacacgatagctcagataagccaaaatggagaacaacgatgcaatcaccagcatatgtcccagcacgataaacatatagatttcaggtctgttgacgtacaacaagataattccaatcaccacttgaagcaaaattaacaagaccgatacgacacccaatatacggatatctcggtgattagggtgataacggtatgagtagtgacccacagccaagataatgacgaacagcagaccggctgaaatctgatgaagcagcagtggagatatgaagcccccaatatttacaaccttctggatgaccgagtgactaagcaacgcccctgaataaacagcaatataggtatagatcgtcgatagccatataaagttgcgatagccccgactgacacgcccaggaatcagacgcggagtgtggcgtgagtccgcgtgctcctgccaggcccccagcgtcatcatagttgcactggcaaaggcgataagcgcaaagccaaaatgcagtcccatgacagcagccgattgggagaagatgacagccaacgcccccatggcaccttgtatgatgacaaacaagagcgtgagcagcgagaatagctgtaaatccttccgatgcttcataaacagcaaaaagccaacaaatgaggcgatagaaagaatcccggccatggcactgacagagcgatgagagaactcaataagggatgcaatcgtgtgtgccggaaccagcttgccattgcaaagcggaaattcccggccacagccaagacccgaatccgtccgcgtcacgacacctccaccgaaggtagccaaaaacatgacaatacatgttacgagtgccagccattttaatattctaattttgttattcaaattcacccgtatccttccaaatataatatttattcactttatatgttgtgaaatgatcacttaaagtaattataactgatatatcgttccttgacatacgagctttgttgacaaaatgtgaacgtgtccgtgagaaagccgcccccttagaaggaagcggctttctgaatgtcttgatgtttaaaattcactttgtaaccttcatgcatgcatgcacagcattcattattttgccaagctcgcatggacttcaacagcccgatccaaaaattgctcaatctcctcgcgggatttgcgcagtctgttcaccagacgtaccagttccctgccttcactgtaagcgataaagctaggaatacccaatacattctgctcttgactgacgctttcggcctgttctacatcaatctcaattaatgtaagcttatctgcatattgttgttccacatcaggcatgaacggatcaatgaaatgacaatccccacaccagtccgccttaaatacagccaccgttacgccggaagtagatattgccttattaaagtcttcatgagagacgattttttgcatggatgattcctccttaaattctttttatgctgtagagattgcactttctattgtaacgccaagtgaagcttttgcacactcccccattctgctcacatgccgattggaagccctctcattgaggcatactaaagatatacttaagaatccacataagcgacgacatcctaacagcatacccaacatacttggcaggatacggggatgcttgcaattggaaaggaggttatttagtcatgtctcttaccgaatggctccatacagcatcccgacagcttcaaggagggctaaagctactgggttccgttcctcgtgttgcagaggaagcttgggagggcaaacgggcggcttggaccgaatcccgcaaattacgctaccccttgcgtgagctagcgtgggattatcatacagcacaggccgctatgaatgaagctgaagcgttaatgctggtgaacggacctgctacgcgtccctcttctctgaatatgcccttatgcgaaacagactgcgagctactggagcggatcaaaaatgatacagcacaggagaatcgcagcaacgtcacccgcacggccgcttaccttgaatgctatcgtggctacccggagttacactgggcattactggcccacctggtttctcgtaatggcggctataatatgaccgatctgaaaggaggactgattggcaacctgtttggcgaacaggaaaaggaatggctgtatcggctactggagcgctgtaatgcccttatttttcaagacgcttatccgcagttgcaactttacatgcacagccgtcatttgggtcgaagttgctttcatttgttgccttattttcacatttcgccattcatgaagcccttttgggaacgcttctgggcttggcgggatagctctctgttgactgtggcgctcatcattaatgaacaaaactatattgaaggacgtgtggtaaaagatccgtattttcaaaaatttgtgacacacaagccgggcatttatttgcatgactggctccagcttaatcaggttatatttccacttgggctgaacggtggacttgctggactagtgatggagcgtttcggccatttagacgagcggatcggctttggcaaaagtctctatgctatgctcttcggccatcagcaggtgctggaccaggtatcagcattcgctaacagtgtgccgcatacgggttcacgcagcgactattggcccggattgttcaccccgaatgaacaaaaagcgctgcactctccagatgaaagtgcaacgcttttagcccatgaatggctaccgccaggacaacgtctgtacagcccggagctgaacgccgtctggtccgacacagcttatgatccaatcccccgttatgactggtttcaggacggctccacacttgggcatctcagcgaaccaaggcgaccgctgttatttgccatgcgccatgagcatcgccacggcatccaaaaaacagcaatggcccacgttgcccataacaacttgcaacctttccactgatagactggaggactctttagccttgttgtcctgtggactcacgctgtagacgcattaacgggcgcagtaccttttgcaacatacgtgggtagttgcccagctcgtccctgcgcaatacgcgcagtacaaccagcaacaccaaatagcataccagtacagtcgcaccggcaatgcagcacgcgatgaagaaggctacacgcgcaggcatcagatgcaccagcaggatactggcttcatttacaccgtatccgatagctcccgagacgatgactgcggttaagaaacctgcccagcgacggcccatgatggaaaaggagacgatccctttaagcacacgcaaattcagcaacgtgatcacgaggaaacataatccggttgcggcaatgatcccgtaaattccaagccaaccagccagcagccagctcgctgcaaacttgacgacgataccgaccatgacattaaccattgaaatacgcggcttgcccataccgatcagtattgaattagaagtcatcatcgtaatctgaaatatcgttccgagtgtcagaacagcgatgataccactgcctccaagcgagctgaacagtaaaccattaatagaataggcggttacacataaagctagcacaattggcattccagtcaaaatagagatacgcaaggccagcgtcatctgattttgtaaatgctgctcatccttacgggcaaatgccgctgaaatgatcggaatgagcgattggctgagcgcaatggccaaaatcggcggaattcccgccacactctgtgcccgagagcctagataacccaactgagtagtcgcctgatccaatcccacttgaccagatagcagtctcaccacaatcgacgtatcaataaagttgaccgccggaaccgtcagagacgacaatacaatgggaatggaaagcttgaaaatatttttgtaaatgcgcatcatcggtagcgcggagctttcctcttggaattgatcttggcggtcctgtcgatcctggcggcgcaatttcaccgtgtagtacaacatgaccgctagagcgccaagacttcccatgacacctccaaaggaggccccggccgcaacctcgcgatctccataacccagcttcaaaataataaaagcgagtacaatagcagtcgctacacgtgcaacctgctccacaatttgtgaaataccgcctgcggtcatattaccgcgcccttggaagtatccacgcatcatggcaatggcagggaacagcagtaatgctggtgccaaagcctgaatggccaaagcggattgtggaacccctgctacatgctcggcaaagtaaggtgctccaaaatacagtagcgctgtaatgataatgcctgctgcggccgcgaatatcaaagccgcacgatacacacgtcgtgcttccgaaggccgatccagtgcataacgttctgaaaccattttgctcaatgtacttggaataccggccgtagccactgtgagcagcatcaaataagcgttgttcgcaatggtaaacgaggcgttcccaacggaaccaagcagatgctccaatggaacacgctgtaccagaccaagcactctggccaccaaggcagcagcggctaaaataagcgtacctttaaggaatgtttctttattggacaaaatgcgttcccttctttcttgctgttcacacgcatgcaaaagccccgcacaaacagtcatggcctgagccatcaccggtgcggagccgcatatcgattctgtctctgcaaatcataataaacgaaaacgaatctcgggtcataacacccaaatcaagaatacaataatcatggcaagctgcaagatcactttcatcacggtgctggtaaaaaggcctaatacggagccaaagcccactttaatagctcggtccagcggggctttgccaattaactcacccagcacagcgccgataaatggtcccaaaatcagaccaaatgccggaataacgaagggaccaataataatcccgacagtgctgaggatcgccgacagacgcgagccgccaaatcgcttgactccccaggcattcacagcataatctgcaacaaaaagcgcaacaacgattagtgtttgtataatccaaaacaatgcattgtatggagcaaacgagaaaaaccagccgtatacaaaaaatgcaaaatagatggcgagcgcccccggcaatacgggatataccgccccagccatgcccacaatgaacagcacaatgacaacaatccagcctacaacgtccatgggcctcctccttctcgttcattcatcttgcttgctgcatcattcgtttcattacacaagcacataatcacggatcacttctacaatgccgtcgtcattgtttgaagccacgaccacatcagcggcttctttaaccgtatcctgagcattccccatcgctacgcccagtccaaccgcttgaatcactgccagatcattcagactgtcgccaacggcaaccacctgctccagagtaatgccaagcagattgcacacttcagcgattccactggctttggatataccagccgggttaatttccagatttgtcatcgaagaattggaaatttcaagtccacccatgtcccgaagcttaagcaaaatttggtggcgaatttcgtcattttccgtattataaccgaatttgagccactcctgtgtgtccaatgtatccggccaacgatccctgttatataattcctctgttgagtacgcccagaaccaggagcctgtttctacagcaatctggtgcatcttgcgaacgagctccttatcaagtaaataacggcgccacaactcgtggggtgatttccacacctcactgccgtttacggttaccattggcgtctccaggccgagttgctgaccgtacggcagagcatgcatcgctgcacgtccagtagacaagcatacatggatcccttcctgaatcgccttgttaatccagttaatcgtttccaaggaaatttcatgattatcattcagtaaggttccatccatgtcgagcgcaagcagtttgtatttatattggttttctcccatagtctctcttcctcctgtatgtcccttatgtccaacgacattttaccatgaaaaagagaagcccacaaaaaaattcaagtcctcactttgctgccagaggctttttaggagtaccatctagcccatatacttcgtcatacgcatcaaatattttacgcgcaaccggtcccgcgctcgttgcaccaaagcccccttcaggaatgatgaccgctactgccaacttcggattttgacggggagcaaaagcgatgaacaccccgttatctttaaccgtacgtcccaccacctgctcggaagtccccgttttacgggcataatcataaggaaatccattaaaggctttaacatccgtagccatacctcgaatcactgtattccagtgcgtatctgaaaaagcgacctcattcagcaccttcggcttaaattcacgtacaagattcccctgatcatctacaattttgctgaccaaatgaggctgcatacgcttgccctttgttgccagcacagttgtatactgggctaactgcatcgccgtatactttccctgctgaccaaaggatgcctgcaccaaacgtgtcagcgcactttcatgcttgctcgtatactcaagtctgcctgcccactcgcccggcagatctacttctgtcggtacgcctaatccaaattccttcatatacttgtcccatacgtcaattccctgatgcacccctgcattacttccgtatttgtcatacaatggcttgccgatcatatctaccataaacgtattcgacgagacctcaattgccctgctaggtgtcaaagaaccatacacatgtccgctagaattcccgacccggctggagcgatttttgccgtagtacgcacttcccgtatccagataagtttgtccgggagaaaacaggttttccttcaacccgatcagcacggttagcggtttaatggttgaacccaaaagcaccgaggattctggatgtggacctgctttaccgctagggacggatttaatggttccatttcccattttatgctgaatttcatcatatatcgaaggtgaggtacttccacttttccatacattagagtcataatccggcatactggccattgccacgatatttccggtctctacctccatcgctacagcgaagccagtggttgcgtcttgatgaagcttccccgatacggcatgagtatgaagccagcgaagctgatccataatggcctgttcggttttctgctgaatttccttgttgatggtggaatataaatgatgtcctttttcaggaggagtaatggattcaatgccctccggcatgctgcgaggattgacctctaccgttttatatccgtttttccctctcagctcgtcctggtactgaagctccaagccatcatatccgaccgtttcactttccgaataaacctgtgccggttttaaaacctccgaattcgcttcatagagctctttatatttgggccggttcgttcgagctcctttgaacttgtacatatatccaatcgtttgtaccgccacccgatccgggtcataatggcgtacactttcttctacaacctctacaccagggaactctgtccgatgttccagaaaataagcgatttcctcccgactcaggtcggatttgaccaaacgtggggtaaatcccctatattgattatagtccgggtccagtctcttttttatttcctctgcattaagctgctctccttcggtacgacccagttcgtttaatttggcagcaagcttggcagcaaatgcattgagctcagggagcagcttttcccccggcttgcgatctttctccgtacgcttgctataatccttagataaagttacatacaaggactgtactgaagtcgaatacgccagcttaaccgtacctgtagaatcataaatcgtgccgcgactcggggctaatgggacatttttcgtatttacggattgctgctggcccttcagctcctccgattgtacaaactgcaatacagctagtctggtaatgatcagggcaaacagcacaaaagcactaaaaaacagtaggttggttcgtaaaaccgtccgtttttttcgtgactcttcattctcttcaacatttttctttttaaatgaaaactttttatccaaactacctctgtccatattagctggtcattactccttccgattagggttccatattcctgatcctaccatatcgaaagcaataaacgatgaattctaagatgacaattttgtaagaaaacgtagaaaaaacataaaaaagcttccctcagcccaaaggctaagggaagctttcatgaaatgacatcgtataaaatgattatggctgtttgattgcgttaggatcggttgtcgtggcatcctttttcttaggcaccccgtccaatccataaacttcgtcgtaggcatcaaagattttacgcgcaactggtcctgcactcgtcgcaccaaagcctccttcaggaataacaacggctactgcaagtttggggttctgacgtggagcaaaggcaataaataccccgttatccttcagtttaccgcctacgctttgctgagatgtccccgttttgcgagcaaagtcataagggaaaccattaaatgcactgacatctgttgccatcccgcgtatgacttcattccagtatgcatctgggaatttcacttcattcagcaccttcggcttaattgtttgaactacattgccgttggtatctttaatctgactgaccaaatgcggctccatccgtttgcccttggtagccagcacagtggtatattgtgcaagctggagcgttgtatacttaccctgctgcccaaaagaagcatacgctaatttggacaaggccgattccttgcttttaggtccatattctctcaaaccaggatattccgtaggtaaatctacacctgtagacacacctaatccaaattccttcatatagcggtcccatacattcacaccttgatcttccttggcattattaatgtacttgttgtacaatcttttacccaccatatctaccatgaatgcattggaggaatgccgaatggcagaagcggggtccaacccgccgtacacatgacccgaagagtttcgaactcgtgacgaattgttacgcccaaagtaagccgctcctgtatcctggtagtaggatgaggtgctgaatagattttcctccagacctatcaacacagaaagaggtttaatggtggagcccaaaagaacaactgactctggatgttgacccgattggcccgatccgaacgaacgaatagtaccatttaagtatacattttgtattttcttataattatcactggatatatttccagtctgccagtaatttgcatcataatccggcatgctagccatcgctaccacatttcctgtatctacttccatcgctacagcaaagcctgttttcgcataaggatgagtcttgccagatacagcatgtgaatggagccatctcaattgatccataatggcattttcagtcttcacctgaatttctttgttaatcgtagaatagacattatttcctttttgcggaggagtaacagaatctacaccctccggcatattgcgcggatcaatgggaactgttttatagccatttttcccccgtaattgttcctgatattgatattccagtccatcaaagccaaccgattcgttatccatataaatgaggcccggatcattttcagctgacatagatttttgaatattcttatatttatccaacgtttcacgcgcacttttataacttttaatataaccaaccgtttgaacagctaccgtatctggatcgtaatgacgtaccgtttcctctacgacatctacgcccgggaactcactcttatgctgcataaaataggcaacttcatctttattaagattggttttaatcagacgcggcgtaaaaccgctaaatcgctggtagttccggtccatagcatccataatttgttctgccgtcatttttggctcatctttattaccatattgggcaaatcgatttgccagcttttgtgtcatgttttccagctcaggcaacagctttttatcaggcttacgcaactgctccatgccgtcactatagttcttggagagcgtgatatacagcgattgtacaggtgtagaatacgccagtctattctgcccggtggaatcataaatcgttccgcgaatcggcgtaagtggtacatttttggtaacattactggcctcctgctgcttaagctgaggtccatctacaaattgaagtatcgccaatcttacaatgatgaccgtaaatataatgaacgagctgaaaaagaacaaattgatccgaaagctgaatctttttcgatcagacgtctcgttgtcttttccctgctcgttgtctatctttctcatgtgccctcttccactccttattaaatcactttatccttgatatgtgtttgggcaaaaccaggcggattaaaccagtccccactttgcgcccaggtcgggtctagcggtacccactgatcctgtgcgctcaaatacacttcattccatgcatgtgaaccgtagcctccctgtccgttataaccaagccctgtcaccaccttgacctgtagtccctgcgaccgagccatcatcgcatacaggcgggcataatcaatgcagactcctttacgtgtatcaaacgtatttctaggggtctgttcatgccagtcaccacgctgctcataggcctctaccttactgaaatcatagctaatacgagtacctacccattcatacaacgctctggctttttgctcatcaccgctcatcccttgcgtaatcttggctgacgcctgaccgatatcgttcggaatttcccggtcaatcatttcgtatttacgctgcaggataccgtttaattccttggtaacggcctgcgtaaatacgggcaatttatccttaatcagtgtaccggataacggctcaatgaccgattgcgctccctgcttataaatcggtgaagcttggacgtagctgctaaacccgctatctggatacagacttacgccgatgaatagcagggctataaccatgatagcgcgtgctccaccaataagagtacctattccagcccctgccaccctgctgaaaaagcctgattttttttcatgctcatggaaagaagaatctgacttgccccctaccatcaacacataaattgcacgtagtacaaattgggcgatcgcataactgagcatgaacaatacggcaaaccgcagcagcggaaaaccttctaaccccgccaccaacgtataataaaattgctcaatcccacttagttctcgctgaggcaaatgttccatgtaagccgccagccattgttgtaccttcggtgaaagccacatggctaatccgagcgagcacaaaatacccgccacagtcagtatgccatccacaataagactgaacagcgcccctacagatctggaagctcctcgtctccagccctgaatcaacgacagcagtacaatgacaatcaaaaacaccgtcacgccattccaatgaagaataggctccagccaggatggtttcattgtgttcctcctgtctctacggcgactgtggcgactgtgttacagccgagcctttcgcaccttcgatatatttcttgacggtatcgcccatactccactcgcccagcgacatcccctgaaaccataccttgaccttgtcaccatcaaatggacctttcacttccaggttggagctggttaccgaaaacataccatccgcgttggatgtgtattgggcatcccgtccctctttgatcatcatgttcaaagcctcgctctgaaccttgttaatcgcatcatcctttgcctgagtaacgaccttgccgacctgttcaaaggaaatgccactgtagataagcaagcctgcaatgacgacaatgacaatcagccattttacgagagttcttacaatcttcaatatgactaacagtaggacaagcccaattaatatatacatccagttatcctgaacgatctgccaattatgttccaaaaactctgtccagacgcccttatccatttcgctacactcccgttttcaactacatcatttaaatcacaaaattgtctctgtaattatacatgattacgtgatgccctgtcagcttagctcttgtacataccttgttattcaattcttatccatacaaagtggtctatgttcgtccactccagcgtacaacttaggaagggccgatacgtagtgcaacatgaaagtttacattagggaagggggtcatcccatgaaaacagccctctggctgtatctctttttattcattgcttttttcgatctgcatgcacagtatcctattttgacaccattcgctatctccttgggtgcggcacctacttttattggctggatgatggggatttactccctaactcatctgccgggtaatttgatggccggccccaaggtcgacaaacacggcagccgccgatatattatgttcagcctaacagccgcaggcatcattcttgtcattcaatcatacatccacacaccgtgggaattactttttcttcgggcgattagcggttttgtgttagcctttttatctccggcctgtctagccatgttggcacagctatccgatcatccagttacgcagggcaaatatatgtcgggacatggtgtcgttcatacgttggcctctgtcctgtctccagccgctggcgcttttatcgtagccagtttcggctttagtgagacgtttagttcccttggcatcattctcgtagtcacggggcttatggcttatttcaccttgcccaaaacagcacccgctccacaggcccaattatctgatggtcatgcgacacctgctccgctacccggggcacagaagacgcgcttaccattcaattggcgttacctgctcctgccttttgttttggcgtgtgcacaaggcattttattttacgaaattccattacggaataacggttctgcgtccatgatgtccaccggattgctcttttccatcatcagtttgggagcactttgtacgctcagcctgctgtttctgaacaaatattcaccaatggtgcgactactttgtggcattattttgatgtctctaagtttttacgcactcgccaccacgcccgaagcggcgattggcattatactttttattttgggaactgccaaaggtatcattttcccagcgctagcctcccttttcatacgaattggaggtgcgcgactgggcaaaacctttgcactacagtctattgcaacatctatcggctcctttgccgggcctgtactggcaggtcagctacccgatcacatttctccttttttcatcgcatttctaattcttatggctggcctgctattcgttcctattaagcgattatctccgacgccgccactgtctgcctcaggaccttatcattcctagctagtctgagggcagtggtatgctaatatgctatctttaaagcccaaaatgtcgttttagagggcaaatgcacagtacactatccccctatccacatagactattttgactgaacattcactaacaaagggaggtgcagcctgtgagccactgtcatcctgtaagcccttgccctgtttttggaacttcaactggcaccattcttgttctttatattttgctcgtcatcattctccgtacttgctggatttaatgtctgaattgccctaacatgttgtcccttgtacccatgcctgccacttctggcaggctgttttgttattttttgcatgagaaccctatttggagctacactatacacatattcttcatttcccggggaatttcgagcatatgtatcatacaaggggtgagcttaaatggcgataaccgtgattgttgaagggaaaaatgaccgcagcaaacttcgccgattacttgacccggaggtccacattttatgcaccttcggtacactcaactctataaaactggaatccctccacaagcgggccaagcacgacgaaatatttttatttatggacaatgacagctcagggaagaaaataaggggtgtgcttgcagactcttttccggatgcctgccatatgtatacccgcaaaggatacgctggcgtagaaggcactccagacgaatatgtgatcgctcaattggaaaaagcagggttggaagaatacattatatacccgccacctgttctttagtcttgaaaataacaaaaaagctgtcctcaggctgctttcatgcctgttggacagctatatggtgcactataaaatgcctctaaaatgacattagaacttatgaaccgtatcgacgatcatcagcaagaagctgagtgtcagatggttaatggaaaagaaaaatactttttttgcccaggaatccgtttcttcttccttaatcgtaaaacctttaaaggcgtagaatgcccacagcacggacagtaacacggacacgatcataaaaatcataccggcatatccataagcatacataaggatgggtaccggaatcagcaatacaatataaggaatcatctggatcttggtccgatggataccttttacgactggcaacaacggaaatcctgctgcgcgatattcctcaactctgcgaatagcaagtgcccaaaagtgaggcggctgccataagaacaggagagcgaataagagacaagcgcccatatcaatacgacctgaagcggccacataaccaatcacaggaggcattgcaccagaaataccgccgatggatgtgctccatgtagacgaacgttttaaccaaagtgtataaataccgacgtaaacgaacataccaagtaatcccagtaatcctgcctttacaccagagaagaagaatagaacagctaacccgacaacacccaaaataatagcgtatgacaacaccgttgtaggggtcagacgccctgttggcagtgagcgattacgtgtacgttccattttcaaatccagctcacggtcaaaatagttgttaaaaacacaagaagacgccataaccagcattgtacctaaaagtgtaagaattagctttatataatcaacgtcccattgcgatgctaaccaaaaaccaccaaaggctgcaaccagattggtacgaaggatgcctggcttggtaactgtaataaaatctttccaagtgcccgctttgccgggtggtttagattttacagaataggtagccgcatccgaagaagtcttataacttatattatccattgtgagtaactcccccttagagatgtatgaattcgggagtaagttgaactccgatataaattttatcatatacctaccccaaaaagtttgacagaaaacgcacaaaacgttcacaattccgatggcaaatcgcccctgttgatcgtttacagtaaatttgggtagtaataagtacaggaaacaatacaaaaggagcgacagatatggatacagccacacactttgtcatgggaatcggattggccgggctggcctacactgatcctgtcgtcgccggagatccaaagttggccgcagtcgtactgctcgctacagtcgtaggatcacaagctccggattttgacaccttgcttcggttgaaaaataatgcagcctacattcgcaatcaccgtggactgtcgcattcaattcccttctggttgatatggatcttgtccataacgggtctgatttgcctaattttcagggatgtgcccccgggtcatgtagcactatgggtaacaattgccgtctgcctgcatgtatttacagatttatttaatacgtacggaacacaggcattccggccatttacaagcaagtggatatcttggaatatcatccatattttcgatccctttatttttggcacccatgttgctgcgattatgctgtgggtcaccggattgattccacccgctcccttatttattacgctgtacattattattggtctatattacatttggcgaacctggagtcatttcatgaccaaaaaagcggtacgtgatatggacgacgagcgccaggaaggcgatacctattatatcattcccaccgtatcatggaaccggtggcatgtggtaaaagcccaccagaatggaagttatgacattggcggattaaatggcaaacatttattttggactaaacatgcgattccatccacacatcctgccgtagaagcatccaaatcctatcgcgatgtgcaggcatttcgctatttttcctcctttgccgttgccgaggtggaggaactggaatggggctacattgtgcgatggggagacgtcaggtatcgacaccggagacaatatccattcgtggctgtggtcgcgatggataagcagttcggactgatcaacagctatattggatggctcagtgacgaaaagatgcaaaaacgcctttccctgcatacgaattaaaacctgcctacaagctaacaacaagccgtatgaacaacagacagcaagtctcccttcatctggagcttgctgtttttttggccactcgcgtaaaaaatcacttctcatgaaagcgccctcttgacgaagcggacttgcgtgattcacaatggtgataagccatgcgtaaaaaaatccggagcatgatcgctccggattttcttcatcacagttgctcataatacagcttccaagatggagtgtttatgtgtattactgcaaacggctgctgcccgacaaggattgttctgcttgttggaccagctttttcgtgatatatcccccaagagaacctgtttcgcgggaaacgacattaccgaagtaaccgtcctgagggatcgtgatgccaagttcttgagctgcctcatattttaattgttgtaaagcggcgttggcctgcggtacttgcaggttgtttgaacgacgtctgctcatatttgaatctcctttcagttctttgtgagtgaggttcattgcaagcttgcaagattattatggctcgcttacaactacttattcctgaaattcaacattcgaacactggaggtttttaccaatgagcaaaggtttatccctatggttcgccgtttcatccattgtcctgctgaccgcagccgctatatccatcagttattccgcatggcttgccattctactggggctattatctgtcggcaatatcggctggggtttcgtggtcaaagcccgacaacgccgcttttaatccaatcctttaaaaggcctaatccgtttcgtctcaatatgctttagcgtacacgtggcagaaagcccatgcgctctttgaccgcagacagcgtgacttcagccgcttcttgtgcacgctctgcggattgggctaaaatacgtccaatctcaccggattcccggatgtcgcgatagcgttgctgaatcggttcaagcatagctacaacggtctctgccagttcttttttaaatgttccgtacatttgaccttcatagcgatcctgcacttcttggagtgacaaaccggaacattggctgtagatgcccatcagattactaatttccggtttattggccggatcatatctaacctcactaccggaatcggtagtagcgcggctgattttcttgcgtatgactttcggttcgtctagtagcgcaataaagctgcctgcattcggattgctcttgctcatttttttggatacatcatccagggacataattctcgcccctacttcagggatatacggttcaggaacagtaaaataatctccataacggtgattaaagcgacccgccaaatcgcgtgtcagctccagatgctgtttctgatcgtcgcctaccgggacgagatccgcgttgtagagcaaaatgtcagctgccatcaacgatggatatacgaacagccctgctcctacagagtccttgcctgccgctttgtccttaaactgagtcatacgttccaactcgcccatattcgtcagtgttgtcatcaaccatcccaactcagcgtgctgaggaacatgggattgtaaaaagacattggatttctccgggttaatacctgctgcgataaataatgctgctaccgcctccgactgctcacgtaattgagccggttcctgcggtacggtaattgcatgaaggtctacgaccataaagtaacattgatgatcctcttgcaatttgacaaagtttttcatggcaccaatgtaattgcccaaagtaagttgtccgctaggctgaatacctgaaagtacagttttcatattcttcctcctcagtatttcaaaattagaacgcaaaaaggccccgcatcctcaagggacgcgagaccgtggtaccacccttattcattgccgtcagcctattacttgtcggagctatgctccgtggcagcctgcaatcttaaggctccgttaacggggagcaatcggccgtcatactgaggacagtaaattcctgttctgtacggcactccaaggtccattcagcagtgcaggctcaccggttcccatccaccaccggctttctgaagagcttatgcgaaagcttacttgtcctcatcatcgcgttatccatgtcattactttctaaactacattaatgataattccgcataatgttattgtcaaatgacaattgtgccctacgaccaaaaatctgttatcataatgacacgaagcttcaaccgattatagtggacaaaggagcatggatatgaaacaagtgaccaaagaacactggaacggttacgacacgtatgtcttacatagtggtgaactggaagttacgatgatccctcgcctcgggaataatattatttcagtgcgtgatctgaagctcgaccgggatatcgtacgtcggcccggtgaggaagaattggctttctatttacaaaagccttatcattttggcttgcccattttgattcctccaggccgaattcgcaagggacaatttgagtttgacggtgttccatatcagttcgaccgaaatacagccaatgacaatcatatacacggtctgcatcgtaatcagtcctggcgctgcagtgatattgaagaggatgaagaaggttgcagtgttactaccgagcttttaacagaaagtgatccgcattggatggaacaattccccattcctttacgtttggagatgacgtatcgcttgcagggtgctgtattaagtcaaacgctgcgcgtaacgaatttgggtgaaaaagcagccccatttggcttgggatatcacacttggtttatggtggacggagaacctgagcgctggcgcctaaagctacctgtgaacggcgtatatgagcaggatgctgaacagctacctacaggtatcatttcttcgttagatgacttggaacagctctcttcgggactttctctgaaaggaacaaatctagacactctgctgcgggcaacggaaggccctgctgaagctcttttgactcgtgacgacggttatcaaatccgctacacagcagatgagcaatattataagtattgggttttatataccaaaggtgaatgcgaccagtatctttgcattgagccttatacatgtctgcctgatgcgcccaattcacctgatcctgtcggggaagccggactgatccgtttggagcctcagcaatccatcgatctcaaaactcagattcatatcatatatccgtaattttcctctagtcacttttcttccttcggcgcatattttcataactctgtcgcatactaacctcatcacagccgaaggaggtgactacacatgaatgaagctaatcaaggcagaagccgtcgcagtaacaacctagttgttcctcaagccaacaacgcattgcaacaattgaaatatgaagctgcacaagagctgggcatcaccattccggcagatggttactacggtgacatgccatcccgtgaagctggttctctgggaggctatatcactaaacgcttggtacagctggccgaacagcaattatcaggtcgttcaggtcaataagcgtcattattccacatgagcattccgttcatcgtaatttaccaaaatgcgttataacgggtatataacaaaggcggtcttccctaggaaggccgccttttctttacttttttttaattgaattattcggaattagccgctcggtatgtaggcttgttgtagcggatcatgagattcgccatgttgtagttggactccagtgttgcatctaccaagatcgttccttgtctaatggcaaaatcgaaagcaatctcaccatgagtccagctacgcttatgatttagcgtttctagagccatacgccgaaaatcctcccgatgctttgctgataaccccggttctactgcagcaaatgtgccacctttacctgcaagcggattatgacgaatcccaaatttcccaactacattgttacgtatttgtacaaatacgatacctgacgacaaacccgccagttcattatccagttcttttaaaacgatatccatctgccttgctaacgacaattgacctacttcgtccatcacaaaaaccctcctatataccttatcaagaaataattaataggccttacggctcaattatatgccaagatttttaaccttacaatcaaaaccaacataattgggtatttataactattttctaagtatatccatcattttaaatttcgccaacaggtaatgttaattacacttcgacattttgcgactttgttcatcatcttctgcaaaaatcacaaaaaaggcctcccttatgggagacctttcaaaagtgtaaatccgttattttgtcatttgtaaaaattgctcaatatcctgaacagtaacttgcgcagcattacgccagaagtcagcctgtgttaaatcggtacctaagtgcttggaagccaattcttcgactgtcatgcgacccgtatcacgcagcaaggcatcatattggtcggcgaagccgtcaggattttccttcgcaaaagcgtaaattcctgcactgaacatatacccgaatgtgtacgggaagttgtagaaaggagtgttcgtaatatagaaatgtagcttggatgcccaaaaatgaggatgagcctcatccaggacaccactaaacgcttcacgctgcgcttgttccatcaactcgcttaattgttgtgctcccacaactccttttttccgcagctcgtaaaaacgggtttcaaataggaaacgagcatgaatgttcataaagaaggctacaccacgctgaattttatcctccagcaaagcgaccttctcctgaccctcggcagcttccagcaaagcatctgatacaattagttctgccagcgtcgatgccgtctcagctacgttcatggcatagttttgattcaatgggtgcaattcattcatcacatgttgatgataaccgtgcccgagctcatgggccagtgtcgaaacgttggatggtgatccggcataggtcataaaaatacgggtctctttgctcagacgcagagatgtacagaaaccacccggacgtttgcctggacgatcctctgcttcgatccagcttttctcaaaagccatttgggcaaagtcagccattctcgagctaaatttaccaaattgctcaacaatcgttacagcagcatcgtcgtaagggattttagtagttgacgtccccagcggagcttcaatgtcatgccaggatagcttctctaagcccagcagttttgctttccgctccaagtatttgactacaataggctttgtttcattaataacctgccacatcgtatctagcgtttgtgcagacatacggctgatttccaacggttccttaagcacatctgtccagcctcgtttttcatatagcttcagacgaaagcctgccaaatgattcaatgtatccgcgcaatagtcctctacctgagtccatgcctcttcccaacgtgcaaacacgtctttacgtacgctgcgatctgcttcatccagcttattagcagcctgacctacagacaggtttacgatctcgccattttccggcacggggatcgtcatatttttgacaatagtatcataaaagtcgccccagccatggtagccatccactgcgagatccaatgcaaggctttccagctcaggagccattttttcacgtgcttcgttccgatattcagtcaggacaaaagaaatcggctggatagcttcacgctccatccatttctgccaaatgtcttcactggtttgtgccagcaagttctggaaagatactaaagcacttttcccttgggcatacagcgtgttgacacgcgcccccaattgaacagccagcttgtcgtgctggttttgagcagttagacaagagacaaaggaacccgcctgcgacgcaccattaaacagctcctgtatgctattcagtacactatccagacgctcggtatccaataccgtttgtggtactttggctgctttaagctgggattgcagctgttggaccttgctctccatttcttccaaaaatgcatgaaatgaggcagaggaagatcctccgctaaaaatagattccagatcccatgtttgctttaacggtgttttcataatagttccacctttcttttttggcgaattcatgtggtttcatatacaataaagctacatcgtgatagtaaatcactacaattgggaggaaaacaggatgagacccttacaaatttcgccggaaacggctgtgaaattatccgaaaagctcggcattccgctggaacaccttatgcatacaccccagcacattttgatgcaaaagctggccgaactggctaaagaagaaaccgctgacccgaacggcggagaatcggacaaatcatgatcccttttcataaaacctggccttatgacatcgtcatgggagacgtttatgtacagtcttgtccattttgcgaccatgataatgttttgctgcccctgaagccaaaagaacttaagctcatacacgaaggtatgaaaaagttgcttgtgttcccatgctgccataacaaggttactttggtggattgtgatgacgattatttgctgtcagataccacattgcgtcatcattaattcatgaggcagttgtaagataagataacccgttttacaaacaaggtgtgaaccatgagcctaaattggccatagtgcacacctttatttcttcaagaggagcttgcgtcttgcatttcctccggcagttggaaatttttagccaacatttgttctcgcagtacagaccactgttcacgggaagcccgaatcatggctgcatccataatctttttgtcattaatgacacgcgaaaaccagcgtactgcttcgtgaaagttgcctgtacgtcgatgcagttcaccaatcagataaagcagtttggcattattcgccccgacaccctccagctcatagacccgaacatacgaatccagactaaatttgagaaagcgaagctcctgctcctcatttccctggtatctgtacatccatgcgatatgctgtaatagactggctactacgcgttctttttctccgatgacctgggcacagagtaaacccagtttatacgtttctaatgcctcttcccagctacgatgccctccatattcgcgagactgccagcggttaccgattttatccttaaatatcttggtttgctgatcgcttaactgaacggtagagtgctctgtcgaggtaaatccacaatgaggacagacccttacgacataaaaatccggattttcattcttataataagcacaaaaatctgaatccgtacgaatggccttctttaggcttggtctgacacgggatgtctgaaattcttcttcgcaatgtgggcaagcgattttgatctgatataacggttcaagttccaatgtttttacaaccctctccaaaattcggcaatccccgaaagcttacggggtatttacaaaatgatgcgcaggaccagacaaacggttaagtatgattgaacgaagcggctcctcaatgcccgtatccgttaacgcacctgccatacaagacaaccatgcctctgctcgctcctccgttacgggaaacttcatatgtctggcacgtaacatcggatgaccatatgcatcagaaaaaagagacggtcctccaaaaaactggctcaggaacatatactgcttttccttaaccggttccatgtctttaggaaacaggggacttaacaacggatctttataaactctcgggtagaaggcctcaataatagcacgaacaccttccgcacccccaaggttgtcataaatgctcaggctaggattcacttttctccaactttctgtgctatggtaataaatatacacccgtattataacaaaaaacaaaaaatgacgctaaaaataagcgtcattttatcaatttaacatatgaagagggtgtacttcgttacacacagcttcgtcattctataaacacaactaataactccgccaatcctcttcaccgggatggacgagagaggcacgaataacatacacaaaagcacatacgaacagaccggcaacgatactcatcctgatcactccatccttaaggttatggatcgttgttttcctattttaacatactatttacaaaaatacagcattagatgtaatcgttttctttgatttttttgtactctttgtccatccccgacataggtatattagtacaactccaaaggaggggcctctatgtcgctataccgtcgttactcgcttcctctgctcatccttacactgcttttcctatttatgcttatggctgtatacccgcagtcttctctgaatgccgggcttcgggggcttgccatctggtgggacgtgctgtttccgtctttattcccgtttttcgttatttccgagcttctcctcggtttcggaattgttcatttcataggtgcgctgttggatccgctgatgcagcctctattccgtgtacctggctgtgggggttttgtcgctgcggtcagctgcgcatccggttacccgattggagctaaactaacagccaagctgtgggagcaaaaatggatcacacgcattgaaggagagcgtttggtcgcgtttaccacttcctctgatccgatatttttaatcggtgcggtttccgttggcttcttccatcaaccagaaattgcactcgtactgggcgcggcccattatggtggcgtgctcatcatcgggctgcttatgcgcttccacggttcccgttcaggggaaacagatactcgcagcgaccgccctcaacctactcaaaaagcctggtcgaagtccacgaatacaaaagcagcaggtcgcaataggcagcctggccccctacgccaagcattatatgccatgcatacagctcgtttggaagatggtcgcccattgggtgagttacttcgtcaggcgattacttcctccctacgccttattattgtcgtaggagggctagttgtattcttctgcgtcattttagaagctttgacgaactccggtttaatgagcgggcttcatctgcttacggcaagcctattgactgcatgtggtcttcctcctacgttaacggagtccatcgtgggtggtattttcgaagtcactttaggagcgcaagccgcaggtgaagccacggcagcagcgttaccattcaaggtagccgcagccgcttttgttctctcctggggcgggctgtcggttcatgcgcaggttgcaagtattttaaatatgacaaatctccgctatatgccatttttgttggcccgggctgcacatggcatcatctcagcactgctagctctcgtgttatggcggcctctgatgggacagggaagctctccagtcttttctccaatatacgacatcgcgtggtctcctggcttctcgtccgccatgctgttgcaaagtctgctagttcttgcctttatactggctggaatgcttagtctctcatggttgagtgtgggtacaagtcgcttatacgtacgtttgagaagaacacacaggcaatgaacgattgtgttcttgctcataattgattatgatcgatatatacccatgacaaaggagcttttcatcttgagatattatgttctggatcgcggggatcagcactccatggacttgagtcagcaatttcaccgtcttgcccaagaaaagaatttcaagctggatgccgaatcgccggaaatcgtcgtgtctattggaggcgatggtacgatgcttcatgcgtttcataccttcatcgaccgcattccggatattgcctttgttggtgtacataccggtcatctgggcttttatgctgattggcgtgcggacgagctggaggagctaatccacctgatgagccaaagcggatctgagggaccgcttaacccgagaatcgttaagtatccactgattgagttggaaattcacaagaagtcaggcaatgcttcttttattgccttgaatgagtttacgttaaaaggggtggatggcactgtcgttgcccaagtagatattaacgatatcacctttgaaatgtttcgcggtgacggtatatgtgtttctaccccctcaggaacgaccgcctataataaagcacttggcggagctatggttcaccccaccattgaagcattgcaattgactgagatcgcttccattaataaccgcgtgtatcggacactgggatcgccattgctactgcccaaacaccatcattgtgatattttttcacggaaagatcagcgtcttttattgacagtagatcacctgaactttcctgtcgatgacttaatctctgttcgatgtcaggtcgcaagtcagaagatcagcttcgctcgttaccgtcctttcccattttgggatcgagtacgcaacgcttttcttaattagaacctataaaagagccgactctggctctttttttacaaacaaaacggttcctgaaaattcaggaaccgttttgttgtggagctgtaaatgttttattctttttactaccctcagctctttcggctttagcagctggctgggtctgacgctggccctcaggctcacgagagacacgaacttgccgtccctcccgattttcctttgattggcgctcatagcgtggtccacgcgattcctttttatcgaaacttccctgctgattgcgctgtctacgtggttcacgggtttgctgcccttcacccggattccgtccatcctttgcttcacgtctttctctggatggacgactttcgcgagcttcacgtggctgtcgttcacgtacttcctgggcatccttcggttcccgacgttgcaactcacgtggttctcgggattctcgaggctgctccactcgcgattcctctgtagctgaggagtcctgctgtggttgcggccactcctgttctccagctgtatgttgcaatacttcttgctgctcttcgggttctaacgttcccgcttgttccctttgagcatctaccaactgctgaatatctggagcaatgatttcatcattgacgccgtttttattaaccacttcacggcttttttgcaacacaaaataggcacagccaaaattgcagtattcattaatgtaatcgtccagtaccactatagatgtatccttatttgctttgggatgaccgtctcgataaaagcccttcagacgtagctgattgtaaccccaatcaccaataatgtaatcatagcgatccagcacttcactataccgatcacgaaacgcttcgggattccacccgttcttgtgatcctgcaacaattcatagtttttaccaccgatttgaaacaagctattctgaccgcctttcccggatcaagcctgcgaaagggcgccttcttccttatgctgagcggctgacttcacctgctcatgcgcttggtaggagctgcggaccaacggtccagattcaacgtggctgaatccccgctgtaatccctcttcctttaacttcgcaaaatcttccggtggataatatttttgcacatataaatgtttctcggacggctgcaaatattgaccaattgtcagaatgtcacaatcgactttacgcagatcatccatggcttgtaagatctcgtcccactcttctccgacacctagcatgatgcttgatttcgttggaatagccggatttaattgcttcgcatgttgaagcagctccagagagcgacggtatttcgctttagcccgaaccttgtcggacatacgctccaccgtttcaatattatgattcagaatatctggtttggcatccatgacgattcgcagcgattcaatatcgcccataaaatcgggaatcaatacttctacactgcaaagaggtaatcggcggcgaatcgcacgaaccgtttctgcaaatatagtagcgcccccatctttcaaatcgtcgcgagccacactggtaacgacacagtgcttcaaattcatgttttcagccgcttccgcgacgcgttcaggctcctgcaagtccagttccgtaggcattcccgtatttactgcgcaaaaacgacacgcacgcgtacaaatatcacccaaaatcataaatgtagctgtcctattggcccagcattcatatatattagggcatcgtgcctcctcacatacggtatgtaatgtcttggaacgcatcatgctcttgatttcctgatagttatcgcctgtcgtaagtttaatacgaatccagtcgggcttagcttcctttacttttctagacaatggcatagaccttctttctgataagcttaagctgtcattgccatacattataacatgaaagccatggaaaaacctccattcattgttccctttttgatatgacattgatgccggaaaaagtaaactctttacatggataaaagcggcggatatggctcaatctaaacaaaagcgccctattcacgctattgtatacgggcctagaatttatcgggcgatcaagcccttctataggaggtcggttcacgtgccttaccctacgcggacagcccgagctgttcgtttgttatcgctgctgttatgtgctactacactgacaacggcctgtccgcttcctgcccatgcctttgccaatcacttacagtcctcgtccgccgaaagcagcctgaccgcaaatgtagatgcttcacatgctcagtcttcgttgtatacgtccaggctggctttatatcattccatcgaagccctgactggagttccttggtacaggctggccgccatcgaccagtatgaacgcacacttacagtggcccatcccagggatcggaagcatgcggaacgaatcataggtattttcatcacgggaccagtctggtccggcatgttgaaccctgattcggaggatcaaaatccgcgttccattgaactattttccgggctgggacaagacggttcgggtgatggaatcgctgaccgtaataatgacaaggatctgctgttcagcatcgcatcttatctcggaaagtatggaaacaacgaggatgaatttggtattgccgtttgggaatattaccataacagccgcgcagttcaaagagttcagcagtttgctaagctgtatcgaacgtatggcaagctggatctggtcagtcaagctttcccccttcctttaggcagcatttatagctaccgcagcacatggggaagccgtcgcagctggggcggctaccggatacatgaaggaactgatctgtttgctggctatggagttccagttcgcagtacctgctacggtgtagttgaaatgaagggctggaatcccttcggcggatggcgaatcggaatccgagatctcaacaaccgctatcactactatgcgcatctttccggctttgacaaaaccgtccacaacggagacatcgttacacccggccagacggttggctgggtcggaagctcgggctatggaaaacccggtacccaaggcaagtttccaccgcatctacactatggtatatatcgggacaatggttgggcagattggtcctttgacccgtatccgttattaagacagtgggagcagtccgaacgcaaagcgctcaaaacaggaaaaacaaaagggacctcctcataggggtcctttttcctaggcagctcgcgtcattcccctccgctctatggcgttggggactggctagaggtgttttggttttcctgtgcctctggaacactttctatggtgggatctatagcgccgctactctctatggaatggggaggcaacgccaactgcggagcggctgcaccatttttgcctactggtttaccctgattgtcatagtagtacatcggaacgttgcctaccactaataaataagaaaccggaatttccgtctccacaatctggggttgcatctcaaacggtataaccacggacacttccgtcgtaatccgaatgtacacttccaccaagatcatgtttatgcccgcatcctgttgacgggtatttaaatccaccttgattgctccatgcggctccacctttagggggaccgttggtccataagctgccaacagtggactgcccaatgcctgaccaatcggaacactctcatcaaaatggctcatgctgtccatcgttgccttgactgctttgagcgtgtctgacgtaattctcatatgttccgcataattcagaacaaaaccggaggttctcccttgtgcatccgttctccattcgatcaaattatcagctgtcttcccctgctctacctgtgctgtaattgctgaattaatagcctccgtcgccatttgtttaacccgcacttttgccaggtgcatcatgggcggcttcaaatgctgctccacataagcagccatttgtatgatccctaccagcagcgccagtgccacaataaaaaaaaacctacgtctgccgcgtcgccttctgttgggtgcgctgtgccattgcggtcttctcatcatccgatccccccgcagcgttgaacttaccctacaaggatatgcgagttgtacacgaaaaagaagccgcccgtccggcagcttctctagatggaacaaatatataattgcaaatataaggtgcactcattatttgaaaatatggtcaattttttcgatatcagcctgactcaattggacatttagcgtcttcagattcgccagcacctgctccggccccttcgcgcctggaatgagggcatcaatcgaatcacgggtcaaataccatgcgagtacaacatgagcaacctctgcattcaacgcattggcaatctcccgtacctgctccactttgtccaaattacgagcaaatgcatcgccctgaaacaatggatttttcgctctgatgtccgagaaggtcatgtctttcgtatacttaccccccagcaatcccgaagctaacgggaaataaggcacaaacgaaatgccattttccttggtataaggcagcagatccttctcagcttcccgttgaaacaaattatattgggattgaagcacatctacataaccgtcactattcgcatccttaagttgttcaatggagaagttagatacaccaatggccttgattttgccttcgtccttgagcttcttcagttctccgactgcctctgcctttggtgtagtttcgtccgggaaatggatataaaacagatcaatataatcggtctgcaatcttttcagactggattcgacggattcacgcaaaaaagcaggcgagttgtcaaaaacgacctctccgtttacgaatttgtgtgcacccttcgtggcaataacagctttatcacgctgaccacgctctttcaatacctcaccaatcaaccgttccgagtgctcaggtccataaataaaagccgtatccagaaaattgatgccgttatccaaagctgtgcgaacgacttctttgcccgtttcatcattcaaatcggaaaagagattatgtcctcccactttatttgcacccaaaccgattggttttacatataaatctgttttaccaagacgcacttgctctgccaattcacgtcatctccttttcgaaagttacttccattttattattagattccaaaaaaagcaaagtgcgtacctggctgctgagcccgatcctattttctttttcgcttcatactgcggatggtcgtttttgtggcctgatccacccgatatgattccgtgattttttgcagtgctttgttgaaggtaaaatcatctaatgtattatgacttaaatacgccatggttacctcaggtagcttgatataacagatcgatatcgcccatgctaccgccatttgtacataataatcctcgcgatgggtctgatccagtaaagtaaacacccgcttcatatactgttcctcaatataaaaattaagaagcataaccacaccaaaccgaatttcatattctttcttggagaatagatagggctgaataaactcccacacccgttctttatgatgtttcgtgattttcaatccggcacagaaactatcacatacggaccaattatcaattttaggaacaaacttggcggtataactcaaaacttcctctatatccgtttttacagaaccaatcaccataccttgcagcattacttcttcgaagtgttcactttcagcggtctccaggtagaggcgccaatcccctttggcaatatcttgagcaagcttacgcagcactggcagacgtacacccagcacattattaatcgtcggaagcaatgcagccgtaaatttctgaaaatctgcatccacatatgacagtatctgttctctaattgttttctccatcatttccactccctgattcttaacgaaatgaaatactccacaaataaatggaggccaccgaaccataaggcgaatagactcggcggtactcctcaaattgctgcttggtcaaggtatctaaatggtacaacttcatcattccccgtcgaatagccatatcaccccaactgacgacatccggacgctccatacaattaatcagcatcatttcagccgtccaaggtcctattccttgcagcgaggacaatttctgaatcacctgtgcatcggaaagctcatataattcctgtaaatccaacaggccctgctcgatcgtttgggctatattaagaatacatgtggcctttttcatggtgatgccacagctttgaatatctaaagccgactgaacagctatattttgtggagtgatcacgcctaacttctcctgcatccttgcccatatggtctgaaccgccttggccgatataagctgtcccacaatcgcatgaacgagcgccgcaaacaggtcgggaatgaccacacgttctaccttgcccatttgcgtcatcgctgcaccaagtacggtgtctacgttttttagataattgatttccttttccccatagtcaaagtttttggtcattacggtttgcattcgttctcccgctgccccttatatggttcactcttgattcaatggcatggactgcttttacatcaaggttcgaaaccttctttgctcacgtagagctgttccttcggaaaaacatgaagaaaacgttcataaaccgccttataggcagcaggatgataccattcttccagccccaatgactcgtacagcacaccaattttcaagctacgcgttcgtctccccccactgccatctcccataaaataatcatcaatacagacacggttgaccagaggcaaaagcttgtctgcaaaatgttcactgcttggaagcatcggagcaatcgtagcttgcgtcggtacacctgcctcctttaaaagatgcagcgtttggagacgagcctggatgggaggagcttccggggtaaaatgtttgcgtatatcttcacgatctgtttctatagtcatactcacacgtacacgatcccccaatcggagcagtaaatcagtatcccgccgtaccagtggactgcgcgtctgtaaaaagagaaaatccgggggatcctccaccatcacctccagcagagaccgggtcacctcttccttgtactcggcaggctgataaggatctgtgcttgacgacatgaaaatcgtgactttacctttggatttggctctacgaagctccttgcaaagaatatctgcagcctgatttttaatatcaacccatgtcccccacgcttccttccgaaatgtggagactggcaattggcgtacatagcaatacgagcaaccaaaggtacaacctgtatacgggttcaacgaatgtgtatatcctgacaagaagccggtccctttattcaaaagagtcttgggggatttgtaatactcatttttcatactgaaccgatgccacactttccttttcgagctgcaaaagcttcaccttcatgtccaaaccaccacgatatccggtcatagctccatttttaccgatgacccgatgacaagggaccgtgaccaaaatcggattagcaccgatggcagcccccaccgcacgaacagaggctggcttttgaatagcgttggcaatgtctgaataggatagtgtttccccatacggaatatcacacaacgcattccaaaccgccatctggaacgcagtcccatgaaaatcaaagggcaatgtaaattgggcgcgcttcccttggagatattcaatcaactccttggcatagggctgtaaagcagcatcctcttcaactaaaggactgccgggaaatcgtcttcccgcccatgaaaacaattcctctacaggttgattggacgaacctacataacatagtccttccgatgtagctgcaatatataaattccaatcctcatgtgtcaacaatgaccaatagatcgttttatgtatttgctgtgccatgctgtgtacctccattttgtattgctttcaatttgagttggcgatattgcaatggggtgtagcctgtattctttttaaataacgtaataaagtaaggtgcattgcacagacctacgttctcccccacttccgcaacagatatatctgaacaaatgagcagcttcttcgcttgttccaacctggtctgctgtatatattccattggagttagatgcgtaatccgcttgaaggtacgatgtaaatgatacggacttccatggcttatttcagccaagatgtgcaatgttaaatccttcatatagttagaactcacgtattctataaccagtgcgatccattcatgatcaggcaatcgttgtcctgtcggtttacatcttttgcatggacgaaaatgctgggccaatgcctgctctgctgttttaaatatacggatgttctctcttttgggaggtcgggatttgcaggaggggcgacaaaatattcccgttgtcttcacagcgtacaaaaataccccatcatatgacttgtcgttttctacaatagctctccactcgtcgtcagttatggataaatcggatatactcattcaaatcacctctctaatgcaaatgtggcctccccacatatccatggcaggatttattcaaaatcttctgtctaaattatagcctaaatagtgaacatatgtacccttcttggaatgtaaaggcaagataacgaaaaaaagatgactccccgcggagccacctttgatcttacttatctatcttatttaggcttgaagcttgctcgatttggcggtgattgtcaactcatctgaaggaggctgatattcctttgaccagtactcggtatttgaaatacctgctttctccgggtcgaacaccgggtccagcccttgcctccgttgctgttcgtaatccttaagcacaagaagagcaggcttggccaacagaatcatagcaatcagattcacccaaagcataatgccgacacccatatcccccagtgtccacgccagagccgattccttgacgaccgttccatagaacgtcgaacccagaataaccagctttaagacgaacatgggccactttgctttataatctgcaaccagataggccatatttgtttctgcgatgtaataataagagataatggtcgtaaatgcgaaaaagaacaaggtaatggacagcagactcgatccaaaaccgggaaataccgattcaatagcagcctgtgtatattgggttccctcttcaacacccggaagatgttgcacaataaaatcgccaccaggtcccttcacattatacataccagtaaacagaaccataaaagccgtagacgtacagaccaaaaaggtatctacgtacacggaaaatgcctggaccagcccttgcttcgccggatgagatacttccgcagcggctgccggatgcgcaccagagccttgtccggcttcgttggaataaatcccccgctttacaccccaagcaatcgccgtccctgccataccgccgaacacagaatccacgccaaaggcactacgaaagatcagcgaaaatacatcgggaagtgcagtaatgttcgtcatcataatgtagaaagaaacgaggatgtaaccgagtgccataaacggaatgacaacctgagccacattggcaatcctttttacaccaccaaaaatgataagcgccagcaacacgactactaaaatccccgaaaccttcatttccatgccaaacgaactgtgaaaagctacagcaatggagttcgattgagttcccggcatcagtaaacacattgcgaccaacgcagtaaccgcaaaaatgacggcaaaccattttaagcctgtccctttttcaatataaaaggctggaccgccccggtactgaccatcgcgctttaccttatacacctgagccagtgtggattctacaaaagctgtagccgacccgataaaggccatcacccacatccaaaatatcgccccaggtccacccataccaaccgccaaagcaatcccagcaatattccccgtccctacacgccccgatagtgccatcgtaaaggcctgaaaggaggatacacctgcctcggaacttttccctttaaatactaggcggatcatctctttgaaatgcctgatttgtaggaatcgagtcatgattgaaaataacagccccacacccaaacagacatataccacaggattgctccaaatgacgccgtttactgcctctgcccactgctctaacattccttgtatttccccctgattaatccattgattttctagtctatgttttcagaaaatttgcataattacaaaaaattatagattagtttttacccccatacaagttaatttaattgacatattgtcaattacaagtaggcttaccagctacataaaatgacgacaaaaaagctctgatgatccgggaatatggatcatcagagccttgtccttaagacatttaggcaatgctttctttctcattcagagcactagacagtttcaacagtggggcctgctccgttacctctccttgagcgattggaaggacttcagtatattcggaagaattcgtaatgataactggcgtaatcgtaggataaccctctgccctgatttgctcaacatcaaactcaagcagtaggtccccagctttcacctgatcgccttctttgatatgggacgtaaaatgtttaccatccagcttgaccgtatctactcctacgtgaatcagaacttctgcgccatgatgcgaaacaactgcaagcgcatgttttttcttgaacgccacggtgatggttccatcgaacggggccacgactctgcccgttgtcggttggatggcgatccctttgcccatagcttccgaagcaaatgcaggatcgggaacctccgacaaagcgaccacagttccttcaattgggctgagtacctcttcattagaaacaacaactgtagaggtcgattctttagccgaattgttagtagtttcctcttcttcaactggatcttcaaaacctaaaatataagtcaagatggccgacaccaggaatgaaacggtaatccctaaaatcaatcccgggaatccttgtccaccagggccgtaaaagattggcaaggtcagtaatccaggtgcgccggaggcaaatgcttgcgttcccgcttgaccgataatagcaccaccaacggcaccgccgataatacctgcaataaacggacgtttcagcggtagcgtaaccccataaactgctggctccgtgatgccgaataaagcggtaagtgtagcggaacccgccaaagttttcagcttcttatttttggttttcagcataacaccgaacgcagcgccggtttgagcaaagatggaagccgcagcggaaggcttgattccgtctctgccattaacagcaatattattaatgaatacaggtacaagaccccagtgaacaccgaaaataacgagcaactgccagcaagcaccaaggattgctccagctagcaatggactaaagctaaatgcagcaacgagtgcagtagcgatcgcgttgccgacatacaccccgactggaccaaacacgatcagggttagaggaagcataattacaagtaaaatcaaaggtgtaataaagtttttgacgctctcgtggatcactcgattgcaccatttttccagcttactcatgacgatgacggctaaaatgatcggaataacggtagatgaataactcatcataacaataggaataccgaaaaagtccgtaggtgtagcttccgtttttagcgtgacaatggtcgggtaaagcaaccctccggcaatggtcagggcaacgaagatattacctccaaatttccttgccgttgtaaccgctaacaagagagggaggaaataaaacaagctgtcggccgcagcatacaaaatcatataggtagtgtctttcggtagcaaccagccaaggttactcgcaatcagcagcagacctttcaaaataccggaccccgccataactccgagcaaaggtgcaaaaatgctggaaatcacgtcgattacggcaccaaatcctttgttgcctttagctgaatgatcttcttttccagtttcattcaagatattggatacattgccgattgcattatatacctctggtactttgttgccgactacaacctggaactgaccaccgctctgcttcacagtgataattccgtcggttttttccaactttcccttgtctgcttttgcctcatcttttagcacaaaacgcaggcgtgtggcgcagtgaacgagcgatactacatttttttcgccacctaccaggtgtacaatttccttagccagtttttcataactcatgatggacacctccatgttctaaggggctttttacatatttaggcatacaaaaaacctaagccttgaaaaatggtgggcacttgagtcccgcgatttttcatgacttaggttttgcctgcataaccagtaacaatcccagttaaaacttattaaattcctgttactctcataatataatcattctaccatatttgtcaacaaaaacttttaatcgtctattcttggtcctttttcgttgaaaacgttcgacttatctgttcacaacccgttcaatatgcacggtcagatacaatttttcttcgttcgtcaattcgtggttgtattctttttgcacaaaagttccgattttctctgtacaagcagccgcttccttatgcttttccttaatcatgtcatacaaatgatcatagttattttcgtagtgatttcccttaaatacgcgctgggcgaaaaatttcagatgcgtaataaaacggaaatagctcagagagtcctcgtcgaactccaccttaaaatgatattttgcgatattgataatttgctggataaacttcgtgatactcatggtcgtaatgacttcctcgttcatttcagcattcacgatgtgaatcgcaatataagccgcttcgtccacaggcagttcaataccgagcctttgtttaatttgttccaacgttttcagacccatcgcgaattcttctttgtacagttgcttgacttcccacaataacgcgtttttgatttccaatccttcccggtatctttcaacagcgaaattgatatgatcggtcagtgaaacataaatattttcgttcagctttctattcagattatgcttggcgtcattaatgacttcctccacaatcacaatcaaatcaagcggtacctcacgcaacagcattttaaagttatcggacgtctgcttgtttttcagagcaaataccttctgaattctggtttcgtctactttgtctccaggctttttcttaaaagcaatcccccgacccatcaccacgagttcggtgccgtccgtctggtagacgctgattacattgttgttaatgacctttgctatgttcatctcgatcccccgttccatatgccagcaagagccacacatgctccatcctctttattgtaaacagaaaaaaaccgaagcacgccaaataaacaagactgtaacatccgcttattcgtggcttaggttttgcctgctacgcagtaacaatcctaaaaatgatggaattgcgtcaagtatagcccgtagaggaacgattgtcaacgctttcaatgaagaaacggagatcggaaatccccgtgggcccgggacgtccgatcctatttacttgtggtacgattattcgcccagattttcgccgtcggaatgaattacatttttgtaccagtggaagcttttctttttaatacgtttcaacgaaccgttgccttcgttgtcacggtccacataaatataaccatagcgctttttcatctctcctgaggaagcgctgacaatgtcaataggtccccaacttgtgtaaccgataatttcgactccgtcttgaagagcctcacccatttcggcaatatgccgcttgagatagtcgatccggtaatcgtcgttaacttctccttcaggcgaaaccacatcattggcaccaaaaccgttttccactacgaacagtggcttttggtaacggtcatgcaattggttggctgtgatgcggaaacctttgggatcgatcgtccagccccattcggacttgtccagatatggattggctacggaaccaaatacattaccactggtcatgttcttgacgatttccgggtctgtgctggtcgtccggctcgaataatagctgaatccgatatagtcaacggtatgatctttcagaatggctgcgtcgcctgattccatctcaatgtttaatccatggtccttgaagaagcgcttcgcataaccaggatattcgccgcgtgactgtacatcaataaagaagtaggactcgcggtctttttccatgccctgatatacatcttcgggattacatgtatacggatagaagctgccggcagcaagcatacagccaatctgggcatccgggataatctcgtgacacgctttaacagccagcgcacttgcgacaagctgatgatgtgcagcctggtactgaatttgtttaacgttttcaccttctttaaaaacaagcccggcaccgagaaacggcaaatggagaagcatgttaatctcgttgaatgtcatccagtatttcactttatccttatagcgggtgaatactgttttggcataggtttcaaacaggcctaccagcttccggctccgccagcttccatatttctcgaccagatctaccggcacgtcaaaatgagcgagggtaacgactggctgaatgccatgtttatgcaactcgtcgaacaaatcatcgtagaattgcaaacctgcttcattaggagctgcgtcttctcccgttggaaaaatacgagcccaggcaatggaaacacgcagcgccttgaagcccatttctgcaaatagcgcaatatcctcgcgatagtgatgatagaaatcaatggcttcgtgggaaggatagaattcgctttcaagtggagtcagcgagggaacatttcctttcattatgcttcttctcttctctccggtaggcagcagatccaccagactcaatcctttaccgtcttccaaataagcaccctcagcctgattggcagcaagagcaccgccccataaaaagtctttaggaaaaatataactggacataaacattctccttccaaatgtgtgataaaaggggtagcgaagggtgatagacaataaaaaaacccaaaccagcctgtatacacttacagtgtaaacaagccaattcaggttatgccctatcggtaacatcccatgaaaaggttatacgtatttgattgaaactctaacaaagatttgggaacctgtcaaattcattttgataaataacacgcaattaacaaaccaacaacattacttcaatcgcctattgggtaatgaaaagaaccatgaaagagacctcagataaacgactttacgaaagatacctggctgttcgtcttcgtctggaagggcacatgttttcgaagatcggcgatctactcagtcgctaatttaaaatattttgttgcaagaaatttagaaaatccctttgcatagagccaagaggtataatttttttgattatcttgaacctccaatgctgtcctttactgttaaatgaccatattgcagaagacagatatatggaatgatatttttgttcttgtaaatcagctacttcaaattcaactttttgtactactttagtggaaaatagattcaggaaaaggataataattttatcattatttaggagtaatatagctcgacttgtccaagccgaaaggctttgaggagttgaatagcagataagcatgttaggttctctatgcgattcagttagcttattaatagtttttttgttaatgaatatcataatcaaatacctttctatttggaattcaaatgaaatagctttttagaatatttattcaaaattccaattgtttatgataagagaatatattatataagcgtagatgttcctaatctcatttgacaatataatagtctcaattgatgttataaaccgcacacatgcacccgtgttcttctcttagtttcgttgtctcatcgcctcaaataatagcaccgtagaagccatcgctgcgtttagtgattccgcttgcccctgcatcggaatgaataccgactcatccaccatgcgcgcggtagcagcagaaatcccttggccttcgtttccgatcacaagccaagtggaagcgcgcaaatctatggtatagcatgacaagctcgcatccagcgaggtgctgagcaagcgggcacctttacttttggcctgcggtaaaagctcctccaggctgccttcaatcaccggcaggtgaaacaacgatcccattgtggagcggatcgttttgggattgtacaggtcggcgcagccatgacccaatattacgcctgcggctccagcagcgtccgcgctgcggatgatggtgcctacattgccggggtcctgcaccccgtccagcaccatcaccagtgcatccggctgctccagcaatgccgggaatgcactgcgctcctccttacgcacgatggcaaagaccgactgcggcgtcttcgtatcggtgcattttgcaatgaccgccgctgacacgggaacccattccaccggctggtcggcttgatctaggccattcagctcagcgggaatgcccttgtccaaatcataggcgacggtttcgacagccacgtccgaacgcagcgcttcctgcaccagatgaataccttcgacaatatatttatgctgccgtgtgcgatgctttttctccagcagttgcgcccactcttttacacgcgcattattcggtgaaatgatttccattcgtttaaccttccgtttctttggtccttttctttaaacataaatgatatatcacttttgctttaacaccaagcctcattaggctgcaaaagccagctccagcttggtcagatcatccttgtggcctacaatgaccagcacatcacccgactccagacgatcttcggcataaggtgaaatgttcatttcctgatttctgcgaatcgccatcacattacagccgaagcgtgcgcgtatgtcgagctctttgagattttttccaatcatggaatcggcggctctcatctccaaaatactgtagtccttggacagctcgatataatccaaaatgttgggagatgtcaaatgatgggctacccgcaaccccatatcccgttcaggataaacgactttatccgcacctattttttgcagcaccttcccatgcagttcattttgtgccttgaccacaagagcaggtacgcccatgtccttgagaatcaatgtcgtcagaatactggcctgtatatcttcaccaatcgcaactacgattacgtcaaaattacggatacccagcgctcgcagcgcttcctcatccgtcgagtcggcagacaccgcatgcgtcacaatattcgacatttcctgtgtacgctgctcgtccgagtcaatagccagcacatcaaaacccatctcactcagcgcactggcaacactggaaccaaaacggcccataccaatgaccgcatactgtttttttgccattccttctttacctcccgatcaccatactgtccgtcatagtatagcatatcatgctacaaacataaattttgacatacttatgccaaatgcttctccatgtatactggacaacagcccaagccataatacattcgaccactactacaacatacgggaggtacacatgcccattacaatggatttacgacaagcaattgttcacaaagtacacggcaaatcagaagctgatcttacggacatgattattgggtcagtggacggaccggaggccgctttgcctgggttgggtgtcattcttgaaattgcttggaagcatatgagtccaaaccagcagcacgatttcgtccatttggcacatgaacaaatcgataaaatcaaacccgtacccttaacctagctctagctatttaacatttggttccgatttaattgtgctcattattttacccgtattcgaaaatgagaatagtccactcgcattaacatcgagtggactattcgttgtatacactaaatgactgagatcaaactgttctgcttattcaatcttatggagccatttctaagaacttagctgtcggatttttctccatagccgtacgcatcgcatactcgttttcgaacaaggcgacataattgcctttcttatcctttaccagcgtagagttaatacggaacttgcttgggtcaatctgatcatccacaatccaacgtgcaaattggaatggcatacgctgaagctgtacatcaactccatattcacccttcatgcggtactcaaatacttcaaattgcagttggccgacaacacccaataacgtatcgtcaaagcttaccgtacggaacacctgaatcataccttcctcggtcaactgatcaatacccttcagatactgtttgtgcttcaaggcatttttcaccgttaccttggcaaaaatctcaggcgagaaggtcggcaattcatcaaatacaacctcgctaccttggctgagtgaatcaccaatacggaaaatacccgggtcaaataatcctataatatcgccaggaaaagcctcctcgacaatatcacggtcctgtgccaggaactgctgtggctgagacagcttaatctccttacccatccgtacatgcttaacactcatcccgcgttgaaacttaccggagacaatacgcaaaaatgcaatacggtcacggtgagcggggttcatgttcgcttggattttaaatacatagcctgtaaacttttcatttgttggctcaatttccccagctgtactacggcgcggctccggtttaggagcaagctgaaggaagttttccaaaaatgtttgtacaccaaaattattaatcgcactgccgaagaatacaggtgtcaattctccgcgctgtactttctccatgtcaaaagggtcacccgcgacgtcaagcaactccaagtcttggcataattggtcatgcaaatattcgcccgccatctcacgaatgatcggatcattgtaatcttccactttctgtactttgatcgtggaatggtcatctccctgaaacagctcgacctgatttttgacgcggtcatagacaccacacagctcgcgtcctgtaccaatcggccaattcataggcaccgaacggatgccaagcacctgctccagctcctccatcaaatcaaaaggactgcgtccctcacgatccagtttgttaatgaaggtgaaaatcggaattccacgcttcgcacaaacttgaaacagcttaatcgtttgcgcttccacacctttcgctacgtcaatcagcatgactgcgctatctgctgctgttaatgtacgatacgtgtcttcactgaagtcctggtgacctggggtgtccagaatgttgatgcggtgaccattataatcaaattgcattactgaggatgttacagagatcccccgctgtttttcaatctccatccagtcactcgtggcgtgtttgcttgctttacgcgctttaactgaacccgcaagacgaatcgcgcccccgaacagaagcagcttttccgtcagtgtcgttttacccgcatccgggtgagaaataatcgcaaacgtacgccgtttgtcgacttcctgttgaagtatatctgtagttttactcatttcacatatcccttcatgatcaaatccattgcattactgctcaagctattcataaaaaggccatgatgcacgcctgttttcataagttcatcggctctatcggctatattaccgttagctccagtattcggcgtactccgttaccatattcattataaatacgatctatttacatgttttagcctgcctttaacttataatcagttgcaaactgaaaacctgagactaagctattatagcacactccgaacgcaaagcatccccttacgtcctgaacaggacatagggggatgcaggacaaatcgggattactgaacgccgcctactcgccagatgacattatcttcatcctgaccgctaacaggccaccacttgaagccatcctgctccaatagcttgtgagcaccttccggtccccatgagcctgcagcataggtttccagcgtatccggggtctgctgccatgctttggcgattcgatcgacgaatccccatgccgtggcaacctcatcccaacgcgtgaagtacgtcgaatcaccctcaattgcatccatcagcaaccgttcataagcctccggtgagttaatacccaccatacagctttggcaaaaatccatagccagtggctcaatatctgattcggaaccaggtttcttggcattgattttaatgtaaatgccctccattggattgacccgaatcacgagcaagttcggttccagcttatgcttttgaccgaggtacacgttcgttggcatgctcttaaattccacaacaatctccgttgtttttacagggagacgtttgcccgtacggatatagaacggtacgccagcccatcggaaattatcaacaaacacgcgtgaagcaaaataagtctctgtgttcgactgtggatcaaccttgtcttcttggcgataccccggcaactgctgaccgcgataactgccttcggtgtattgaccacgcaccacattggttttcacatcctcagacgtttcaaaagggcgcagcgaacgcagcacttttaccttttcatcacggatatcctcaggcaacaaacgactaggtggctccatcgcaatcatcgttagcatttgcaacatatggttctgtcccatatcccgcaaggcgccggaatgatcgtagtaacctccgcgttcctccacccctaccgtttcactaagcgtaatttgcacattggcaatatgcttattattccacagtggttcaaagaaggcattcgcgaagcggatcacctcaatattttgtaccatttccttgccaagatagtgatcaatccgataaatttcttcttcggcaaatacttctcgtatttcaacgttcaattcttgtgcagattcgaggttataaccgaatggcttctcaattacaagacgattccagcccttgccatccatcatgccgccatctttcaagctcttcgacacgcttccgaataactcaggagccaaggccaaataaaacaaccgatttcccggtatgttaaacttgctttctatagactccgtctgctgtctcagctcatggaacccttcgacattgttgatatccagcgatttatattcaaaatgctcggcaaatgcctgccattcttgatcattttctgctttgtagcgactaaactcctgtatggaagcgtacaggtcattacggaattcttcctctgtgcgaggacgccttgctacaccaataacggcaaaatcgtcagcaagcttaccttcgcggtacaagctgtaaatagcaggaaaaagcttgcgacgagccaaatcgcccgtagcgccaaaaataaacagaactgcgccttgcgtcacaacagattctttaacaggtatgtcagccatgaagtacctcattcttcccatgtcaagattccgcaatccacaatccccgaaatccgcatgtagtattgtgtatatttatacaagatcatacttgattttcgaaaaacatggaactaaagatttgatgatattttatcatatcctacatggataagctatccgatgaatcataaatttaccttataagtcagtattcaatcgtgatgagcgggaaaccgagtgttatacgtgtatcctgctgctccctatcttcatgtacagccatctgcatctggacctgatgctcaccgctttgaaccattaacggcagctctggagcttcataggatatagccacagtagtcgcatccgtatatctttctttggcctgcatagagatgtttcctgctaagctcgcctctgtcagtttcaacagttgatctttggattcctttgtatgcagcgaacgctgaagggccgtgttccactgtgcttgaattcccatagactttaattgctcagcacaaagcttatgaagctgaatcaaccgctcacgtcctgcatcattgctctccagttgaacaactacataccattgtccagtttgacgttccatcacatttaagcggattcttagatcctcactatcacgaacagaacgataaaccgtgtgtccattttctacgagtttgtttactgtgggtatattcagctgatcagctatctgtgccgccacatctgctggctcttcatggttagaaatccaatctccttgccacttcacaaccagcttatccaacgtacccggggtctgatccgagatgattaacaatgagcgtaaagccgtttctgcctcgcgggagtcatttcggtttgtctgaagggctccgtaacgccagccagctagtaccagcaccgttcctaataccaaaattgcaataatcccctttttaatcagctctgcttttaacattatcgttcctcccgctccacaaccatccgattcccacacctacgctctggatactttctttttcggctggattgaaatctatgaatctatcaatagcattcccattgtcagaggttttatacacacagcactacggcaaagcccttctaaaatattcaactgactactgggtgttcgaccatacatcgtaggcaccgtaagaatagactatgatcacaatgcatcttacaccaaaagaggtgaaatcatgtttccgatttatcctgtaaatgaagccaatgtggcacctcatggtggacgtctggtctgtgccgttatgcgtgatggtacacgacacatcggcatcttaagtgggtgtagcaaaggcaagctgatgttgaacggatatccaccttcttttcctggcagtctctatgccgggagctacagtaacaaaggaaaacaaacccccaaaaagatttcccctacaaagaaaaaaaagaatcctaaaaacaaagctcgtacctcggccaaactaaatgccttaattaagccgcccaacgcaccactgagcccctccgttccttatgacgcaggcggatttgctggaaatggctatagtaattatggaaatggcagaacaggctatcgcggtgggtacggcggatatggatacggggcagggcttgcattagatctggctttaatcgcctttttattccttctgatctaaacaccttgttatggaacacaaaaaaaccggaggactattgtcgtctccggttctttgtattcgtttattctacttctactctgctaatccgttcttataggcatagatcgccgcctgtgtacggtcttccactcctaatttagcgagaaggtttgtgacatggaattttaccgtcttaattccgataatcagttcgtctgcgatatcctggttagacttcccttgtgccaacaggcgaagcacctccatctcacgatcagtcagctccgtatgcgcgggtgcctcagcctgtggctggcggaatcgattcatcatcttggaggccacctgtgactctagtacggactgtccgcgtgcagctgcacggatcgcatccgctatctcggaagcacgagacgttttgagcaagtagctgaatgcccctgcctcaatgaccggatacattttctcatcgtccaaataactcgtcagcacaatcaccttggtctctggaagcaggcgagttacttggcgtgtcgtttctatgccatccatgccatccatgaccagatccatcaaaatcacatttggcttgtattcggaagccaaccgtatgccttcttctccgcttccggcctcgccgaccacttcaataccttcttccgtccccagcaccgccgcaagaccaatccgtaccatttcatggtcgtctaccagcagtacgctaatcggtaattccgtttccatgatcatcgttccttccactttcatcattaataactggcacggacacctcgatccgtgttccttttcccggagccgttatatactgaatagctcccccaatctcactgacccgctcctgcattgtggataatccatatgaagtctgctttttctcatccagttcaaaaccaataccgttatcccgaatcgtcagcctgatggaatccgggcgttgcacgatacgaatttccatgcgggttgctttggcatggcgcaatgtattagacatcgcttcctgaacaatgcgaaacaagtggttctcaatgcctttaaccaactgtactccgctttccatctcaaaatcaatctccatcggtacctttgcctgcaactcttgtaccaaatcacgcaaaccctgctcaagccgtttcccttccagatagacaggccgcagatgaagtagtaacgcccgcatttcggattgtgccacggaagacatttcttcaattagcgcaacttgccgctgcgctttatcaaaatccttatccagcgtcctccccacagccgtcgccgtcattgaaatagcaaataattgctgtgatacggcgtcatgcaactctctggccagccgctgtcgctcctccacaatcgcagtcatccgtgcctgttctgccagctgagcattatccgtggataagcgttgtaaagacgtaacttgttcctgccatttacgcccaatccgttccagctgctctcccagcctgccaagctcatcatgccctaggggcggcaactcacgtgcaggggttcccttttcccacatcagcaacgtctctctcaacatttccagtctgcttttaaagcggtagctttcataaaatccgtacattgcccctgtaccaatcaacaccagtataacggctcctgcaactttcaatatcattccccaggttgggaacgacttcacatatccatatgtatacagcatataaaagacaactacgcccacaacaacacacaggaggataccttcacccatactgcgggttaccatgttggacgtttttttatgattcatcccggctcctcctgattcaataaaatcggacgcggacatcgcccgccaagtacgaaacgacaaacttcactttatactcactctgctcaaaatggggagacttccaaaccagtcgattgagcatccccgcctcatgatcccggtcaaactgaatctgtccgaacaatatgaacatctccacctctacaccgtaattatccggtagggtgatgtcaatgtcaccgaagatcccctgcaaaaatatgacgggctcacgttcctctgggagagccaacgtcaggtcggcatccacgtccccaaccacatgccatatgcttgtgctgcgcaggctccaaggcacttcatcccatttatgattggatataaaattgtgcttgaatatggagctttgacctttatgcagcttccttgaacgtgaatagaatacagctaatgatgctagtgtaactacaacaaacaggaacaaatgatccagcactaacaatccagcaccaatcgcgagcatcgtgtagccctttttgattttggaattgcggatcttatatattccggccaacattaggatcagtgcaaccacggagaggaacccaatccactgaccgaataaaatgataatcccgatgccaatccctgccagtgccaaggctgattttcttctctccatgctgcaccccctttttgtttatacaggacggaaaagccatagtggcgcaacattccgccatatggctttcctgaaccatacagattaggcacgatcatcgaccaatgtccattccatacagcatatcataatgtcttgtttccgagtagtcagtccttcttcatatcgactggtttagcacctgtctgaattttggacttaagctgttgaagctgctcatccactttaaactgtttttcagcctcagccggattaacatatgcttctcctggagcttgacggtaaggagcacgcagtacgtcagcttcagcttccatttgcatgattttttcttccatacggtggaagcccaatgaagcagacccactttcaatcgtgtgcaaactattgatttgagacatttgctttttggctttcgccatttgagcacgggataccaactcattgcgcttgttgcgcattttatagaattcatctttcatgtcgtgaagctgctgtaccaattcttttgcttgaagctcagcttgtgtatgcaagtcgcggtattcgttctgcttctgcacaaaataaatcttctctcccaacaacttgcgcgctacttcttcctgaccatttcgcaatgcggattcagcttgtttctcacgctcattggatacacgtaccgcttcctccaaacgctgtttcatacgtcgttcattcgccatttgcttggcaaccgttacctcagcctcgtgaatttccgcctccatatcgcgcagatattgattcaacataataatcggatcttccactttatccaacacttcattcaccgatgctcttgtcatatccttcattcttttaaagatccccattatttacgatctcccttctcaaattgctctacttttttgcgtaactctgccaattcttttttcattgcctttttctcgatatcttccatcatggaatccaggtcactgttctgacctgtgttaaatttagatgagttgcgggcatcttgaccaaaaaacgggttcgaatttccatatgcaccgccctggttgtaaccagttccctgcccatactgcgatcttgtattgttactgccataatagcgtggatcctgttgattgtagggaccgctgtcagggccaaatcctccatcgaaaggagatctcggctccttggagataactagggccgcaatcacataaatcataaatgtggttcctgctgtaataaagaaactgatcacaaccagaatacgaatccatgttgagtccattcctgttgcgtcagaaagaccgccacatacacctgttattactctatcccggcttgatctgtaaattcgggtcattatcaaattactccttcccgctgttgttcagcttgcttttcagtctcgcccactcttgttcgagcagcgatccaccgccttgggcatcctgtgcatggtcgccctcaccccgacgtaaatcacgtagactcatcgtctctgcttccatatcggctacccggtcttccaagcggttgaacattcggggaacattccgtccaccgtatgtaccagcccgttcgttcatttgctgctggagtctcaacgtctgtacacgtgccgcataatactgacgcttgctgtgtaccgtttgatattctgtctttaatgtatctagctgttgttctagctcacgtagtgattcacggctctgctcccacagttctctatactgctcttctttttctgcatatagcattttctcctgaagggccagcttcgcgatatgttcttcatcagccttcaaagccagtagcgcctgttcctcccgtttggtctgcatggacaatgcatgatccaactgctgcttcatctgtcttgtatgcatcgcatactgttgatggagtttttccgcttcggcaatttcctggcgggtattatacaagaactggtcaatcagttgcactgggtcttggctttgttccaaatgctcattgaaggtcgctaccgtgatatcgcgcattcttcgaaaaacactcatttgcgtctgctcctttcacaattcgtatcccataattcaacaattcaacacttcgttactgcaatctttcttcattcgccaaactgctaaaatcagtaacgtcttctgcggtcactcagcagggaaacaccaaatatgattaacccgattgccagtagcggtcccagaagccaggacagtttgccaagcaaaatcagtaccccaagtacaagtacgatccagccgaagagcgcatttccttttttcacaccgtagtagcctagcatgaccatagcaatcggaattaagtaaccaatcagatgtcctaaaaagtgaccgaaaaacggagtaaacttaccgagcagcataatcgaacccaacacgatcagtacaatggctaacccattccctttgttaactctcatcatctctcaccgcctttcactgtgtcttgcttatgtccttattgtacgctgaacaagcgtttgacaaaacggaccccagacggtttttgaacctagacctaagtcggggatgagtatagacctgcggctatcctcctctatgctgttctgctgcatgggctatcgagtgttgctcacccgcttgcttggaacgtagtgaaaggacgagacaagccagtaacgctatagctgcaaccatataaggcagattaatatgaacatcgaatagcaatcccgcaacaagcggtccaatcacattacccaagctggtataggacgagttcatgcctgccacaaagccttgctcatctccagcctgccgcgatagagaagtgcttactgccggacgaaggatatccatagccagaaaaatgatgaaggtcgtcagcataatcatcacgtactgttcagcaaatagggttagaaaaatgaacaggcccccaatagccaaacagaggtgaattatttttttctctccaaaacgattaatgatccatccaaatatagtcgcttggacaattgctcccaaaatggagcctgtcgttatgatgatggcaatatccatcggtgtaaaaccatatttatggtcaacaaacagtccgaatactgtttcaaagttcgctaacccaaaagcaacgacaaacacaatgagtaaacccatgaaatatggagattgatatgacttggcaaattgctgcaacagattttctttttgacgtggaagctctctattatattgttgcttttccttgcttaaagactcaggcagcactaacagagacaagatagctgctattcccgcagctcctgctgccgcaaaaaagggaatgcgtattccatatgtggcaagcaatccgccaatccctggcccgattatgaagcctgtgttgatcgctgcattgatcatgcccattcccttgcctctttcctcaaacgaggtcacgtcagcaacataggccataatagaaggagtaagcaacgctgcccctgctccacccatgattcgtgctatgaacagagtaggaatggaattcgccagtccaaaaacaagctctgataacatgaagatgaacatcccagaaacaatcaactttttacgtccataacgatcagacaactttcctgacaatggtgataacaaaagctgtgtcaacgcaaaagctgcaaccatcagtcccatcgaggaaccattcatccctagctcacttataaacttaggtaacacagggacaaccaatccaatccccatgaatgccaaaaaaatgttaagcatcaataacagcattgctcctcgatttcttgtgagtatagacatatttccacccttccttttccgtatctctttattcaacattaggtaaacttcattattctttttcaaaaacaattgaaactaaaattgttttcttagttttcatataaaaaaatggcctcttcaaatatgcagcatattgatgaggctattttttatttttcgaccaatccgaacaacagaatatctacaatagaataagttgcttcctctaccgtcacactgttatccagaaagaaacgctgatcaagcgttaaatttacagattcaataataagcttcatgatcagagcctcatttttgttcacaataattccttcttggatgccttcctgaattaatgttctaatcggagaccagtcatttaaatcggcatgtacccttttccattgctcaggataatactttttcatctggtccaatattcttaaatcgtaaaacttataatacagaggcatgaccctaatcgactgcttaatcttgtctaacaaagataactcattattttcgataatttgctcagtttttcgaatcatatcatcatttgtacgctcaataagtgtttctaaaataagcgtcttagacgaaaaattttcatacaatgtacgcttactaatagcgagtcttttcgccagatcatccatcgtaaatttcaatccattttcatgaacttcatctacaaaagcctccaaaattctttcctgcatattcgccctcatttctctcgtacttaataaaccgaaaatgttttttcagtaccaccatcttactataagatcaaagaccgggtcaaatttaaatctattgggaaaacctaagcaaagttcttccctcaactaatctaaatccaagttagttttgttccttaaatcatgagtatgaataataaaaaggatgataaaatgcttttaagcattttaccatccttttgtgtataccggcgagaggactcgaacctccacggtttcccactcgatatcgaatttattcttgataacaccttgtttgatgaagtaggaattttagaatacttgtacaacttctttaatatcatcaatttcctcaagaattgcgcgctcaatagcaacctttaacgtaatcgtagcacttgggcaaccattgcaagctcccaaaaatcttaattttgctataccgttctcaacctcgaccagttcagcatctccaccgtcacgcagtaagaaaggacgtagtttgagaagaacttccgatacttcatcgaataaaactccattttcatccattatgtcaactcctcccattgttttaccaaccgtcaattcagaccttttttcaccctagatcgtctgagtgatcctttgctttttgcctaagagtggcctcttgatccgaaagttcccttataagcgtataaatagagtctaaaggtatcatcacaccacaacttgcgctcaatcctgacagcatatagaagcagaactgaagttttcgtatctctcgggtaatttgagctagttctgaatcgtccgaattatttttcttcattactagcacctcgcacttctttaaagaatgataaaggtttgatctattaaattaatgaatcaaccgatgcttccttccatctcaaattgaatcaaccgattcatttcaacggcatattccattggcaattctttggtaaacggttcaataaagcccattacaatcatttgtgtagcatcttgttctgtaagcccgcggctcattaagtaaaacaattgttcctcggacactttggatactgttgcctcgtgctccaaagtaatctgatcgtttttaatttcattgtacggaatcgtatctgaggttgacatgttgtccaatatcaacgtatcgcacttaatattggacttggaccctgcggaatcgcggctgaagctggacaaccctcggtagtttacttttccgccctgcttgctgatggatttggatataatcgtagatgttgtctcgggagcaaggtgaattaccttcgcgccagcatcttgatgctgatctttaccggctacggcaatagacaggatggaccccttggctccccgtcctttcaataatattgccggatacttcattgttaccttggagccgatgttgccgtccacccattccattgtggcattttcttctgccacagccctttgggttaccaagttgtagatattaggagcccaattctgaatggtcgtgtaacggacacgggaatctttccggcaaataatttcaataactccactatgcagagaactggtactataaataggtgctgtacatccttcaacataatggacaaagctgccctcttcggcaataattaatgtccgctcgaattgacccatattttcagaattaatacggaaataaccttgtataggaacctcgcactgaacacccttcggaatgtatacaaagctaccgcctgaccaaaccgcactattaagtgccgcaaatttattgtcggcgggagggatgatcgtcccaaaatgttgcttaaacacttcggggtattgctttaatgcactatccgtatcaaggaaaataacgccctgatcctccagttccttccgcatgctgtgataaactacttccgactcatattgagcggatacgcccgccaggaacttttgctccgcttcagggattcccagcttgtcaaaggttgctttgatctcggaaggaacctcctcccaggtctttccctgtttttcagaagggcgaacgtaatactggatgtcatcaagatttagcccggtcaaatccgctccccattcaggcatcggcattttgtagaattgattcaaagctttcaaccgaaaattaagcatccactccggctcttccttgatccgggaaatttcccggacaatctcttccgtcagaccttttccagattgaaaaatagactggtgcttgtcgcgaaacccatatttatattcgcccatatctggtgcttttttagccattagtatcactcctttttaacctttcaagattcattttgatttgctatgatctgccgagcttgctttccactaaatcttttaggcgactgcgaacaccttccagcgggatctccgaaatgacaggagcgagaaatccgaaaataacaagatgttcggcttcactccgtgatatcccgcgcgacatcagataatagatttgctctgcatttacttgccccacggatgcagcatgacccgcggttacatcatcctcatctatcagcaggatcggattggcatcgccgcgagctttaggacttagcataagcacgcgttctgtttgctgaccatcacaatgggttgcacctttttcaatctttgtaaggccgttgataatggccgtagcttcttcaagcatgactgcacgcgtaatcatctggcttaccgagcttctgccaaaatgctgagcttgagttgtatagctcgatttttgattgcccgtgccaatagcaatcaccttattgtcggagaccgccccgttgccttgtagcaaagtcttggtatcgctggcggtataaccattgttcatctcaccgataatccattccacacccccatcagcaagaacgaccgcccgtcgctgggtgaaatctgttgtagttgcagcaagctgatgaaccgaagctacttgcacctttgagcccgcccccgcgaagacctccgtcacaccgttatgcaataccttgacatcatcaccactcgatacacaattatccacataagtgatcttgctgttgctccctgccacaattaagacgtgaggagcaaaacacacaccgcttgtatcgttaagaaagatcgcttgaataggtgcttcaacctctacaccgtctgggacatatagaaaaacgccaccactccataaggcactgtgtgcagcagataaacgatgttcttctggctttactgcctgaaagagataacgttgaaccagctcctcatgctcttttgccgcagtatgcagatccgttaaaatgactccctgggcggctaagctctcggacaatttcgtatacactacatccgagttgaactgaacgattagcccgcctttcaccggagaagcaaccaaacctcgaacaacctccggcgcttcctccaaactagaccacgcattctcagctttgtaatctccactttcgtagatatcccatttttcgagattgattttctccactttaggcaactccagcgtccctgccagttcgagtgcgtgaacgcggcgttcaatcagccaacgaggttcattcttagcgcttgaccatgcgcgtaaatcgtccacattcattgaaactctagcttgtatatccacgtgctgttcctcctctccggcttttaagcttcccttaccgtctcatccgtaatcccaagttcctccttcacccaatcgtacccttcagcctccaaacggtgggcaagctccggaccgccagatttaactatccggccttgcatcatgacatgcacaaaatccggggtaatataattcaacagtcgttgataatgggtgatgattaaaaagcctctatccgggctgcgcatctcatttacgccattggccacaatacgcagtgcatcaatatcaagccctgagtccacttcatccaggatcacaaacttgggttcaagtagcatcatttgcaaaatctcattccgctttttttcaccgccagagaatccctcattcaaataacgatgcacaaattccgggttcatctccagccccttcattttgctctccatttcacggataaaacggattaaggatatctcatcgccttcttcacgccgtgcattgatggcacttctgagaaagtccgagttggtcacgccagcaatttcacttgggtattgcatagcgaggaacaagcctgcctgggcacgttcatccacctccatctccagaaggtcttcattgtccaatgtcaccttaccgccagtaacctcatatttgggatggcccattaaagctgaagccaatgtactttttcccgtcccattaggccccataatcgcatgaatctctccgccatgaatctccagtgtgagcccttttaaaatttcttttccttcaatcttggatcttaattcctcaatctttaatgtcgtcatttatcgtaaacttcccttcggagtattcttcggcacgcgccaccaaatcactcataaattttccaatagtctgcagctcaacctctgaataggattcaatgaattggtaaaacctttcttctttttctttgtgcagttctttatgcaaatgataaacgtgtcttcccttatccgttaaactaaagtaaatctccttacgattgctgttcagttgacttctcataatgaagcccatttccagcagctttgcactaattttagtaatgctagctttggacaaccccatcttctccacaatcccggtatgatttatcggttcataatcaccaatgcaatcaataacgtgtacactagtaatattgttggagagcatgtcaatctcgtactttctggcctgttgccgaaacgagttaaattcttgttcagtatacagctcattcagatgtagcattttaatatattgctcgtaaagatgacctttaaaatgattttgaaactccaatttcccaatctcccctctcttgtagtagttgcagaccaagttcagtgtcaccattagattattttttgttcactagtgaacaaaatcatattaacacaattgatattgataatcaatatcaattgtgttaaatgtgacgcaattttggaggcgcttttcatgggtttgttgtcattgtcatcggctcatgctgtgttttgactagggcacgtcccggaaatggttttgcctacctctgatcaatcctgctttgcgggggttgaacaatggaaccaattcggcagcacccggatggatctggtaaccgaagccaagtccaataccgttgcctatgaacgtcatggtacagctgccacagaccgggggcgctaccgtaaaaagaggacaaaggtggtgcttggccgagctgttttaaagccgtatcgccgcgtttgagtacgctatcgtgagcatgtatggcaaagaataatccgtcagttacctgtgtctggatatgttatgggccaaagagtataccaaaaactgtggtttttgctggtgaatccgaacaggcgatgctccattctagccagcaccgatctgacactggaggcgacctagatcatcgaactttataccgcccggttcaaaatcaaatgcaccttctgggcgctaaagcaatccatcggcggattcagctaccactttgtagcaaatctattccgaagctcaaccggtatttgaaaaaggatcgggttcaccctctggagttattggaagaggagaaagcgcaacgggacgtccgcctaactgtaaagatgagaatggtaaacgataaccaaaatggatccctacggggcttaagataaaaggaaccaagaaaagagccgaaatcttgcttcaggaagccagggagaattatcatatggaaggacaagcactcgcggttgaaaacgaagatatgctgtaagagtaaaagcggctacttcatccggtaatagcaaaaggctgttcgcagactttatgcttcaatggctagagatgatgaaaaacagtatcgggcttatctcctatatctcctattccgacactgtaaaaggccgcgtagatcctttttccgagagaaagggatgtattgcttgatgatttaactacagaggattttcagaccttgtatacccatgaaatgaatgtgcaaggtgtcagcgccaataccgttattcattaccacgcgaacatttgcagagcccttcagtatgccgtgaaaataaagccgattgtggcgaatctccctgacttagttgaaagcccaaaaaagaacaattacgtcgtgagcttctacaatgccgaggagctgaatcaactcctcgcagtaatccgaggcgaaagaattgagctttccgttatcctggctgccttttatgggctaagccgaagcgaggtcttaggattaaaatggtcggctattgatttattgaattggactattaatattaaacataccgccacatcgggcaatttgaatggtagatatattgaaattgaaaaggaccgaaccaagaataaagccagtcgccgtatactgccactggtggacacgttctatgagcttctgatccgtatgaaggaataacaggaatcctatcgcttatcttctgacaattcttattgtcttgaatacctggattatatttatgtagatgtattaggggtaagcatgaaagaagttcaggaatggccgggtctcagtgattacgcaataataaccaatatttattcgcatttggaatacaactcgaaagtatcttcagctcaaacaatgagtggggtactaaagctcaaataaaaaaagcccactagagactatctctaatgaactcttttagttaataccggcgagaggactcgaacctccacggtttcccactcgattttgagtcgagcgcgtctgccattccgccacgccggcatatttaattatggaggcgccacccagatttgaactggggaataaagcttttgcagagctttgccttaccacttggctatggcgccagagtataacaaagcggacgacgggaatcgaacccgcgaccctcgccttggcaaggcgatgctctaccgctgagccacgtccgcataaagatggctggggatataggatttgaacctatgcatgacggagtcaaagtccgttgccttaccgcttggctaatccccaataagtaaagggcggccgatggggcttgaacccacgaatgccggagtcacagtccggtgcgttaaccacttcgccacgaccgccgcaagtaatgaatgattggcaggggcagcaggaattgaacccacaccaacggttttggagaccgttgttctacctttaaactatgcccctataaaactggtggaggatgatggattcgaaccaccgaacccgtaagggagcagatttacagtctgatgcgtttggccacttcgctaatcctccaaaaatggtgccggcgagaggacttgaacccccaacctactgattacaagtcagttgctctaccagttgagctacaccggcacataaaatattcaattaaaagtggctcgggacggaatcgaaccgccgacacgaggattttcagtcctctgctctaccgactgagctaccgagccttagaataaggctcttcattacactttataatactaatggcggaactgacgggattcgaacccgcgatctcctgcgtgacaggcaggcatgttaggcctctacaccacagttccataataatttttaattggttgcgggggcaggatttgaacctgcgaccttcgggttatgagcccgacgagctaccgaactgctccaccccgcgacagtaataaatatttacttttcaaatggtggaggctgaggggctcgaacccccgaccctctgcttgtaaggcagatgctctcccagctgagctaagcctccacaattaagcacttctcatattataccacaatgaactttttattgcaagccctttatgatatttttatgacccgtaggggattcgaacccctgttacctccgtgaaagggaggtgtcttaaccccttgaccaacgggccatgcaataaaataattctggcggagagagagggattc

SEQ ID NO: 2621 - DNA, 30441 bp, Unknown
  Kingdom: Bacteria, Phylum: Firmicutes, Class: Bacilli, Order: Bacillales, Family: Paenibacillaceae, Genus: Paenibacillus
actagaaggggataataccaggaagcacatacgcttctcctgtgtctttttttatagggtcgtaatactttcaccatgttcgtgagttccaggttgagcgataatgataaaggctgatacagaaagatattaccgaggcgtggatttccaaaggtcccgcagtgcctaccctgattgggtcaggtatcctgtaaatctgatgtatctatcaacaattagggttcaattcccaatcgccttccacgcgacttctggtagagtattcgaatgatcgaataaaaacagtgaaaagacccggatgagagcatcccatgtctggtctcgatgacagataccgggacgatggctatgcggccagcggataccggagagagcaagcgccgacaggctccgaagcttcgggagatgcgagttcacagtcgaagtcggactgctggacaccatcttaggaacacgggaacaggcggtatcttcctttttcctcaagcttggccccgccgtccacaccggagggatgctctgcaagggtcactaaccctactacaacaaataaaaataaaaaatcctctttttaaaagtgtgttgattttaaggcgggcagcagcggagcggaccatttgaatctgaagaagcgaagcgttcgcctttgccactgaatttttaccctataacgggttcatccattctaaaaattcagtggcaacagcgatcggaagatcaaatggaccgcggagccgccacacatagaaagaagcatacttttaagtggaggattttaaatactaggagtgatacgatgtttaagaagataacgattaaatctgatgagcgcgggctgctgttcaaaaaaggaagctaccacaagttgttgcacccaggaacttacctattaaagacatttcagcaggaagcagttgaaattttgaatgtagccgaaccattttttgtaccgggtcatgatattcgtttgtttttggcagatcccctattgcttgaacaattgaatgtcatcgatgtagaggaccatgaatatgtattgcattatgaggataatcggtttgtggggcttctgacggctgggaaatatgctttttggaacatgcttaaggagcatcgttttgttcgtgcagatactcggcagcctgcaattgataaggcattgttggggcaagcattcttgtccaagacaccgggcttctggaaggcacttcaggtggccagctatgaaatgggctttttgtattacgatcatgtgttgcagggtgagctgaaaccgggcaaatattatttctggatgtccacagtgaatacagagatcaaaacgatagatatgcgacagcagcagttggacctgatgggacaggaaatcatgacagaggacaaaatcacgctgcgcctcaactttgtctgtcagtaccgtatcatcgacccgttgcgggcgttggaattccgagcatacgaggaacaaatgtacattatgcttcaactgctgctgcgtgagtacgttggcacgatgaagctggatgatttgctgaaaatgaagcaggagattgcggaatatgttttgactcgactaaatgagcagagcggcgaatatggagtgacttttacgtcagcaggggtgaaggatattattttgccaggggatatcaaggatattctgaataccgtgctgttggcagagaagaaggcacaggccaaccttatcacacgacgtgaagagacggcatccactcgtagtctgctcaatacggccaagctgatggacgagaatgccaccctctatcgtcttaaagaactggaattcatggaaaaaatctgcgagaagattggcacgatttcgctgactggcgggaatacgttgctggagcagctgaacacgctggttcacatgaaagaggggcagggactccaataacggaaaatactcccgaacgatgagtgcaagccagctcaaggttcgggagtattttgcgttttagttcgtcttggtggatgcaagaaaagcgtccatatcgatcaccggaatgagggtcccctgatgctccatcacagtagggaacaactcgcgctgccactcttcctcattgctttgtagctgactgtcctcggcagaagctgtgtcctctacctgatcgacaagcagagcaatcttcgcacggctgagcaaaatcattttgtcctcggaggaatcgcttgatgcaggaagaagcagctttttgcgtaagttaaggattgtaaagacaccaccgcgaatagtcaccattccttcatgccacgcttcggaaaagggaagtggggtcccttttttggcattcatgacttcttctacttccacaaagtttaaagcgaactttttgtccgccagactgcacacaataaattcagacatagcaattctccttacatattcagataagccatcacaggttgtgaatgagcggtaaaatgggttagctattgcgttttgacagatggaacgataaagttgaggatgcggtaaagtagttgtagttaatcacagaatatcacaaacgagcagttaaatcttccaaaataacaaccatacggccaaggcgtggcttcaagtttcccttcatatataatgttggggactaaagctgtgtccgatggcactacattttaagataagcgggttgaggtagaatggatcatgaaaagcagcgattaagtatcgaggcagccagattatactatctaaacgactacagtcagcaagatatcgcggtcagactcggggtttcgcgtcctacggtatcgcggttacttcaggctgccaaggaacagggatacgtgcggatcagtattgtggacccgatggaggatatggacgcgctcggagagcaggtgaagaagaaattcggactggataccgtgttagtctgttattcgccgttaaatgaatatcaggagattaagaagcatattagcaaaaaagcagccgattatttgcatgaaacggtacaggatgctgatattattggagtgacatggggaacaacaatgcatgccgtggcgcttcatctccagcaaaagcaggtcaagggtgttgaggtggttcagctcaaaggaggcgtgagccattcacatgtcaacacatatgccgtggaaaccgtgaatttgttcgcagaagcctttcataccatagcaaggtatttaccgctgcctgtgattttcgacagtcacgccgttaagaaaatggtcgaggaggatcggcatatccagcgcatcatcgaacttggcaagcaggcgaacatcgctgtgtttacggtggggacggtcaaggaggatgcgttgctgttccgattgggttattttaacggggaagagcagaagctactgcaaagaattggcaagggtgatatttgctcgcgcttttttgacgctgagggcaatatatgcagtcaggaaatcaatagccgtaccgtcgggattgatttgcctgatttgcgaaagaaggagaagtccattctcgtcgctggaggccagcgtaaagtggaggccattcgggcatcgctgcgtggcaagtatgcgaatattttggtgacggatcagtttacggcacaagcacttttacaatagagcaagtcgtctcaacccagcaaaatatacggttatggcgtgtccctacagggtaatatgatatgtaggtgacgacttgtgcacaagcttgaacataatttcaaaatgtgttttacatatgttcaaagccgtgctatgatggtctcatcacagagaaataaatgacttttgtcttcacactatttatctaatgaaggagcttttagatatgaacattgcagcattaatcgaccatacattgttgcgtgcagatgcgacgaaggatgaaattacgaaattgactgccgaggccaaaaaatatcagtttgcttctgtatgtgtgaacccggcgtgggtagcttatgcagcagaacagctcgcaggcacaggtgtagccatctgtacagttatcggtttcccgctgggagcgagcacgtcggcaacgaaagcatttgaaacgaaagatgctattgctaacggcgcgactgaaattgatatggttattaacataggcgctttgaaggcacgtgatgtacagctcgtcgagcaggacatccgtgcggtcgtggaggcagctgccggtacactggtaaaagtgattatcgaaacttgcttgctgacagacgaagagaaggtactggcatgtgagctgtccgtcaaagcgggagcgaattttgtgaaaacctcgacaggcttctcaacaggtggagctactgcggaagatgtggctttgatgcgcaaaacggtaggacctgagattggtgttaaggcttcaggcggcgtacgcagtctggaagacgtgcaaaaattagtagaagctggcgcaagtcggatcggtgcaagttccggtgtgaagatcatcgagggcgagcagtctacatcttcctactaagtttattttaaagtcatggagggattcgcgatgaaggatcaattgattcagaaagcgcttgaggcgcgtaaacaggcatacgttccgtattcgaattttcaggtgggtgctgcggttctcggaagcgatggcacgatttatcacggatgtaatgtggaaaatgcctcctacggcttatgcaattgtgcagagcggacagcgatttttaaaatggtatccgaaggctgccgtaaaattgattcgattgcggttgtagctgatacggaagggcctgtgtctccatgtggggcatgccgtcaggtcatttcagaatttgctcatcaagataccaaaatttatctgacaaaccttcatggcaacacggaagagtggacggtagatcaattactgccgggtgcttttcgacctgcggatctgggcaaataaaaaaaagaatgcctctttggagcgcattctttttatagggaatgtaagcgcttaatgtaatgagggggaaattaaatgaaatatgtaatcgctctggtgggactgctcgttgtatttgcacttacttacgttgccagcagtgacaagcgtaaaatcaggtatcgtccgctgatagttatggttgttctgcaagcagcgcttgctttcgtattactgcatacaggaattggcgaatttttggtcaaaggctttgcagaaggttttaatagtcttttggcatatgcaactgaagggattaacttcgtttttggcggaattgcgaatgaaggggcagcaccgttctttatcggtgtactgctgccaatcgtgttcatatccgcgctgattggtatcttgcaatatgtaaaagtgttaccttttattattaaatatatcgggcttgtcttgagcaaagtaaacggaatgggtaaactggaatcctacaacgctgtagcttcggctatcttgggtcaatccgaggtgtttatttccgttaagaagcaaattggtctgctgccaaaacatcggttgtatacgctgtgtgcgtctgcgatgtctacagtgtccatgtcgattgtgggagcttacatgcaaatgttaaatcccaaatatgtggtcacagctttggtattgaacctgttcggcggctttattatcgcttccattattaatccgtacaagattgagaaggaagacgatttactggaggttcaggaggaagagaagcagtccttcttcgaaatgctcggggagtatattatggacggtttcaaggttgctattacggtagctgcgatgctgatcggttttgtggcgctgattgccatggttaacgggattttctcctggttgtttggaatcagctttcaggcgttgcttggatatgtgtttgcgcctttcgcttttgtcatgggtattccgtggaacgaagccgttcaggcgggcagcattatggctaccaaactcgtatccaacgaattcgtggccatgctggatctgaccaagcaaacaggcttgtcggagcgcacggtcgggatcgtatcggtattcctcgtatcctttgctaacttctcatccatcggtatcatttccggggctgtgaagggtctgcatgaaaaacagggaaatgtggtggcccgctttggtctgaagctgttgtacggggcaacgctggttagcgtgctgtcggcaacgattgcagggttgtttttgtaaaaaaaacagcgaatcaggaaaggatttttatgatgtctaaattcaaacggattcacttggtggttatggactcggttggtatcggcgaagcgccggatgctgcccagtttgatgattacgatgtagatacgctcggtcatattgcccgcgaacgcggtggcctgaagatgccgaatatgggtaagctcggtctgtccaatattcgttccatagaaggagtagcagcggccgacaagccgctcgcgtattacactaaaatgcaggaagcatccaatggcaaggatacgatgacaggccattgggaaatcatgggattgaatattgctgttccttttcgtgtatttcccgatgggtttccagatgagctgattcaacgcattgaggagcacacaggtcgcaaagttattggcaataagcctgcgagcggaacggaaatcattgatgaactgggcgaagaacacgtgaaaactggagcgctcatcatttatacctcggcggactctgtgctgcaaattgcggcgcacgaggaagttgtacctttgaaggagctctatgagatttgcgagttctgccgtaaaatcacgctggaagatccgtacatgctgggtcgcattattgcacgtccgttcgtaggcgaggcagggaacttctcccgtacctccaatcgacatgattatgcgctcaagccgtttggtcgcaccaccatgaacgagctgaaggatgcaggcctggatgtgatcgccctaggtaaaatctccgacatttatgacggtgagggtgtgacgaaggcggtgcgtacggtgtctaatatggacggcatggataagctggtggctacgctcgatgagaatttcaccggattaagctttctgaatttggtggactttgacgctgtatacggtcaccgtcgtgatccgcagggatatggtcaagctttggacgattacgatgcgcgtttgccagaagtttttgccaaaatgaccgatgacgatctgctgatcattactgcagatcatgggaatgacccgacgtatcggggaacggatcacacccgcgaatacgtacctttgctggcatattccccgcgttttacagctgggggcaaggagcttgcggttcgtaaaacctttgctgatattggagcgactgtagcagataactttggtgtaaaactgcctgaacacggaacgagctttttggcagagcttcagtaatcaaggaccagcaagagtaagcaagattactagtaacgatataaataacgatacaagcatggacaaatgggacggaggaataaaaaacatgagtgtacacattggagccaaacccggagaaattgcagaaacgattttgctgccaggagacccgctacgggcaaaatttattgctgaaacgtatctggaggacgtgacctgttacaacgaggttcgcggaatgctcggattcacgggtacgtaccaaggcaaacgcctatctgtgcagggaactgggatggggctgccttccatcagtatttatgtcaacgaactgattagcgaatacggtgtgaaaaacctgttccgcgtaggtacatgcggcggaatgaaggagcatgtgcacgttcgtgacgtcattttggcacaagcatcctgtacggattccggtatgaaccgccatatctttggcggctacgactactcgccgattgccagcttcgatctattgaagggcgcttatgatcgtggtgttgccaaaggcctgaacatgcatgtcggtaatgtattcagctcagacagcttctaccgtgatgacaaatcagtggtacaaaagctgatggaatacggcgtgctgggtgtagagatggaaacttcggctttatatacgttggcagccaagtttggcgtaaacgcactgacgattctgacggtaagcgatcatttgctgacaggtgaagaaacgacggcggaagaacggcaaacgacctttaaagaaatgatggaagttgcactggatacagcagtatctctgtaaacgatcatacgcacagtgaggagaaatgacatatgagaatggtagacttgattgagaaaaaacgtgacggaaaagaactgagtacggaggaaattaattttattatccaaggctacactcagggtgaaattcccgattatcaagtcagtgcattggcgatgtccattttcttcaaagatatgactgaacgcgaacgcgctgatctgacgatggcgatggttcattcgggtgataccattgatctgtccgcgattgaaggtgtaaaggtcgataagcattccactggcggtgtgggtgatacaacaacgctggtactggctccgctcgtagcggccttggacattccggtagccaaaatgtcaggccgcggccttgggcataccggaggaacaatcgacaagctggaggctattgcaggcttccacgtcgaaatcagcaaggacgaattcgtggatctggtgaatcgcagcaaaattgcggtcatcggacaaagcggcaacctgacacctgcggacaaaaagctgtatgccttgcgtgacgttacggcgacagtcaactcgattccgctgattgccagctcgattatgagtaagaaaatcgctgccggctccgatgccatcgtgctcgatgtaaaaacaggtgcaggcgcatttatgaaaaccgtagatgatgccaaagcactggcacatgccatggtgagcatcggtaacaatgtgggtcgcaaaacgatggcagtcatttccgatatgagtcaaccgctgggtgtggccatcggtaactcgctggaagtaaaagaagcgattgatacgctacgcggccaaggaccgaaagatctggaagagctgtgtatgactttgggcagtcagatggtatttttggcagggaaagcagattccctcgaaaacgctgaagaaaagctcaaagaagtcattcgcaatggcaaagcactggagaaattcaaagagtttattgcgaatcagggcggcgacgcttctgtggtggatcatcctgaacgcttgccacaagcacagtatcttattgaggtgcctgcgaagcaggatggtgtggtagctgaaatcgtggctgacgaaatcggtacggctgcgatgttgcttggagcaggacgtgcgaccaaagaatccgagattgatctggctgtcggcttgatgctgaacaaaaaggtcggggatgctgttcaaaaaggcgattcgctagttactatccatgcgaaccgtgaagatgtagcccaagtgctggagaaaatctacgcgaacatccgtattgcggatcatgcggaagcaccagtgctgatctatggaacagtgacagagtaagcggtaagccctattcaaaaagtcgtattgggtgtctttgatcaagtttgaaaaatatgacagctggactcataatagatatgagttcggctttttttattgtaaggccgagggtacaggggggggagacatgttcaaggaattgttacagcaattgaatccttttatgctgtccacacactcatatgaggaaattaggggtatcactccattgcctacacacaaggaacattttaccgataccagtgtacgcccgaagtttggcttgagggagataccggaacggattagaaaactgcattctctgaagcatctgaccattttcgagcaggatatacgaacactaccgcatgctttgttcgaattggaatcgttggagtcactgacgatacaagtagcggatttggaagagctaccggctgacattgccaagctgacccggctcaaaagcctgaggatcagctgtggatgctatgatcgcccggcacccgactttatatataaaatgacttggcttgatcgcttccttatagaagataagccgttccatctgtgcaatcacggtgacgactgaaggatagatgagaaaaggagggaatcaaatgatggagaaatgggtttggatgggggttgcaggggcaattgtgggttatgccacttttgctaatatgagcgttcctacatcaactattacagaagtaaatcagagtcattcgactgttccgcttagtaagcagagcaagcaaggaagtgcagtgaaacgcattgtacatgaccaggagatgcaatttggaggacaaggacaaacgagctttagatttgaagaggggcgcaagttgtacatcagtattaagaatacaggcaagcaacccgtacaatacaagctcaatagtgcaaatggattagacttgcaagggtcaacgagcgggttttccagccaaacgttgcagccgggagaacgccacgatctgctgtttgtaaagccagaggggcaggatgaagctgtaagtgactccttgaaagagatgattttgaaagtaagtacggacgatggatcgcaaggaagcgttaaaaccttcgcatatattacactgtaatctccttccaaaaagggggcgacatgcggtcattagtctacttatgttacaatagaacggttgaagacttaatgaacagaataggtcagagcagaaagcagaaaggatgacccgttgtgcccaaaaaccatgaattcggtaatcaaaagatgtcacggaggctgtcactcacagccattttacttacacttacttttgtagcacttactggctgtggtcaggataagaatgctgaaaccattgatactggaagcagtacaagcgtgatcgagaacggaaccggtggtaatcgtagcggttcagcccaaagtgacaaagcagcgaaagagagcgagagtgcagaaaacagcggtacggatgcacaaaagtcagctccttcggctccagctgcttcatcggatacatcttcttctccggcagtctccaatccatcgcaaaatccgtttgaggtagcaggtattcaagatcctaaagcgtttttgaacacgttcaaagcgctgcagaaggcagttgccgacaatgacaaggagaaagtggccgattatattttgtaccctctgcgtgttaatgatagtgaaaagtcgctaacgattccgaataagaaagattttatggccaagtatgatcagatttttacggacgcaattcgcgaggcgctggtgaatcaaaagacagatgatttgtttgttaattatcagggagtcatggtgggttccggtgaactgtggttgagaagagctacggacaatcccaagctttttggagtcttttcgattaatcttgaaacggttgccaactaagtcgtactccgtgtgtaaatgacctctaaacggtcggaaacatatatcatgtttctgactgcccccctttaaagaaagaaaagtacagatgatacataccaaaaaaaggtttgacatcactcctaaactctcgtattatatccatataactcattaaacaggtaggaattaaagaattaaagtatgatctcgccattttggcggagaacctctaggaacagcaggcagacactgtccacgcgacaggtttgacctatcagagctgcatcagggaattctccgctctttttttgattatgcctgtaaataacaggcgtaaatgaatacaaattacatagaatgcggggtgtcttgatgaaaaggcaatggaaaagtggacttattctcggactatctttggttttaacgattatgctgagcgcttgcggggcaagcaagggagggacgcaggcggatggtagttctgctgccggttccaaggaagtggagttgctcaatgtttcttatgatccgacccgtgagctgtatgaggcatataataaagcgtttgccgcccattgggagaaggagaaaggacagaaggttacgatcaagcaatctcatggaggatctggcaagcaaagtcgttctgtgcaggacgggctggatgcggacgtggtaactctggccctgggctacgatattgatgcgctacaggaaaaaggacttgttaaagaggggtggcaaagtaaatatgagcataacagcgccccgtacacttcaaccatcgtgttactggtgcgcaaagggaacccgaaagggatcaaggactgggacgatttaatccgtggcgatgtgcaagttattacaccgaatcctaaaacttcgggcggggcacgttggaactatcttgcagcctgggcctatgcgctcaagaagaacaataacgatgaagctaaagcccagcagtttgtacaggacctgtataagcatgtacccgtactggatagcggagcacgtggagcgacaacgactttcgtagagcgtggaattggcgatgtgctgattgcatgggaaaatgaagcattgctctccgtgaaggagctgggtgcggataaattcgatatcgtatatccatcgatcagtatattggctgaacctccggtagcagtagtcgataaggtggtagataaaaaaggtacacgcgaggtggcggacgcgtacctgaaatatttgtacagtgaagaaggacagaccattgctgccgaaaattattatcgcccaacactggagagtgtgacggcaaagttcaaggaccaatttcctaacttggagctcgtaaccttgaaggatgtattcgggacatggaaggagacgcagcagaagcatttcagcgacaaaggcatttttgaccagatttatgtacccggcagttcataaaataggtggactgtgtaggcgattgatcggtagccgcgagtgtcatagtgaatggattcagagagggatgaacagagcatgagtcaagtgcaagccacccgaaaacgcgtacttcccgggttcgggttaacaatgggttatagtgtgctgtatctcagtctggtggtgctggtgcctttatcggcactgcttctgaattcaactggactgacgtgggaaaaattttgggacgtggcgactgatgtcagggtgctggcttcctacaaggtaagctttttgtgtgccgcggctgcggcgctgatcgacctgtttctcggtttattgatagcctgggtgctggtgcgttatgagtttccggggaaacgaatttttgatgcggtgattgatctgccctttgctttgcctactgccgtagcgggggttgctttgactgctctgtatgcgcagaacggctggatcggttcattgtttgaaccgcttggatggaggctggcatactcacagacgggaattacgctagcattgatgtttattggcattccgttcgtcgtacggacagttcagccggttttggaggagctggacaaggacgaggaggaggtcgctgctacgctgggagctggcagatggcgtatcttctgcagcgttattgtgccggagctggtgccaccgctgctgacgggttttgcgctcgcctttgcccgtggtattggcgagtacggttctgtcgtcttcatctctggcaatatgccgatgaaaacggaaattgctccactgctcatcatgtccaagctggagcaaaatgactatgcaggagctacggcggtagcgttgatgctgttggtgatttcattcgtgctgttactcgtgattaacagcattcagcgctggtcacggcgccgtgcagtttaacgtaactgcctaaacgcaactgtctaatgtaattatctaacgttaacatgcagggctgcgcatgatacccgcattctaaggagggatacaccatgtcacaagcaataactgggcaggagcttgcttctgcaccagtgccttcatccgcaccgcccaacagggtcacaaccgaggccgcttgggtgaagtggacgctgattggtgctgcttttttagctttgctctgggtgctggtattgccgctaatcgtcgtgcttaccgaagcgctcaagcaaggatggggcgtctacgtcgaagcgttacgggacccagatgccatgtctgcattgcggttaacgctgctggtggcagcgataacggtaccgctgaatacggtatttggtgtagctgccgcttggctgatcacgaaatttcaatttcgcggcaaaggcttgctggtcaccttgattgatttaccctttgccatctctcctgtcgtcggagggctgatgtatgtattagtgttcggcgcacagggctggcttggaccgtggttggacgagcatgatattaaaattatatttgctctgcctggtattattttagcgacgctgttcatcacctttccatttgtggcgcgagaactcattccaatgatggaagatcagggacagcaggaggaagaagcggcggtcacgctgggcgcgcgcggctggcgcattttctggaaagtgacgctgccgaatatcaagtggggtctgctgtatggcatcattttgtgtaatgcgcgagccatgggtgagttcggtgcagtgtccgtcgtctctggacatatccggggagagacgaatacactgccgctgcatgtagaaattttgtataacgaatatcagttctcggcatcttttgcggtggcctcgttgttattgttactagctctggctactttggtgcttaaaagctggtttggacgcaaacgcgtgcattaatttatgattttgtatatgatccctcagggcctctctttgcgtctagcgtctgttaacggcgagaagatgggaagagaggcccttgttctaaggtggcttatatggataataaaatgatcatatcaaggcacgttggtgtgcccaggaggagcgaagggaaaaatgaaacatccgtttcagtcctaccgtcagctgtttccagtgctgtcctcacatatccatgtagggagctgttcccagggagccgtatcaaggccggtttccgctgccattgaggaatatcatcgaagtttactgcaacacggtcataacggcgatctgtctatggcacgtttggaggaggctagagggcattttgccaagctcattggggcggagcctgacgaaattgcggtcctgtcctcagcctctgaggcgattgccggggtggccacagcccttccttatgtaccgggaaaagaaggcattgtgtatgcgtacaccgactttccgacggtgggacacatctggcaggcacaggagatgttccgggatcacatctgctgtatcccctccatcgagggagaagtgacgatagagcagtatgaggagcatgttacggagaaaactgcgctcgttatggtgtcacaagtgaactataccaacggatttcagcaggatttaaaatccattgccgatatagcccaccgaaatcaggcgttgctatttgtggatgcttatcagtctgcagggatcgttccagtggatgtaaaggcaatgggcgtagatattttggtcgcgggagcacgcaaatatatgcttggaattccgggcgtggcttttctttatgtaagcaaggaccgaatagaccgcttcaagccccgtcttacaggctggcttgggcaggagcccgcttcccggtttgatattgctcacccggttccggcggcgggagcccgacgctttgagacgggattgccttctttcattagcatttttgccgccaatgcggccttaaagctgctgctggagattggagtcacgagtattcaggcctatatgagtgaattgttggatttttccgttgaatatggacggcgcaaagggttacacatacgtgtaccttacaggggaggcacattaccaagcctgctcgctgttgaagtagccgacgtgtcggctgtggaaaggaatttgagaagccaaaatatgatcgtttcagcacgaaaggatgttatccgtgtggctccgcatttttacaatacggctgaggaagtccgacgggtcatagatgaattggcagggagatgttgaacgaacggcaaaagcctcttccgagtgaatgggagtataacatccctttttacacaggagaggctttttggacgtttagaattttaattatacgatccgtttgcgcagccagccggaaatcagatccgtcaaaatgatcaggactacaataccgagcaagataacgcctacacggttccagttgcgcatttggagtgcaaatagtagtggagtaccgataccgcctgcaccgaccagaccgagcgtggtagcggaacggatgttaatttcaaaacgataaagcgaatacgaaagaaactgtggaatcacctgcggtagcacggcgaagaaaatcacctgccaacggtttgcaccgcacgcgatcaaagcttcctggggcccgtgatcgacactttcgatcgtttccgagaaaagcttcgccagcatgccgatggagtgaatgccgagggcaagcacacccgcaaatgaaccgggtccaacggctttgataaacaagatggcgacgatcatttcgggaaatacccggatgacactaagcacaaatttcccgctacccgataagggacgcagacgggccatattactggacgcccaaaaggcgaacggaaggcagacaaatgcggacacgaaggttccaagcactgaaatgaccagcgtatccagcaatccgcgcagcaaatcctctccctcagggatgtagacgaacgaccagtcgggatgaaggaagccgtccaatatagcgacagagacgcttttggccgttccctgtaatccttcaaactgcatcccgcgaaaagcccaaatgtaaatgatgattagcagaatagctatcgcccataggcgcaggcgggagccaataggtctgcgaagcgtaggatcattcataataatttcctccgtagcaggttactgccgtaatcaatcgcaaggacgatgacgagggtcagtagaataatgatgcttgcccgatcatatcggaacagccccagagaacggtcaagcaacagaccgataccgccagcgccaaccaggcccagaacggaagccgcgcgcacattgacctcaaaggtatacagcaagtacgacacaaaataaggcagagcctgcggaaccacaccaaaggcgatgacttggatgcggctcgcgccaacagcagtcatggcctccagtggtccgggatcaatggcttcaatcgcctcaaaggtcagcttggctataatgccaaaggagaagaagagcagggcgagcatccctgcaaacggcccgatgccgaacaccgccacaaagattgaggcaaacagcaaatcaggaatcgtccgtactaggttcaggatcgtgcgcatcggcagcgaaatcagtttgcgcggcatcacattataggcacacagcaacgcgacagggatcgccaatatggctcccagtgtcgtgccgacaatggcgatctggatcgtttccagcatgggtttccagatggtaggcaggtagctccagtcgggtggaaacatttcgcccaacaatttgcccatctccggcaagccgacgatcaactggtaaggtgtggcatccgtatgaatggagcaggctaccagcaccacgataaaaatcatccaggtggcataacgcttgtaacgtcctggcaaaggtggccctgggggcggcttgcttggctgtggcggtccagcatgcggtgacggttgcgtcgaagagagcggctgggcagtagagtcgggcttcatgatcccactcccagcagctcatcatgcttgatggcccggccgtagatctccgcaaaggcctcatccgtagcttcctccggtgtgccgtcaaagaccacttctccggcgcgcaatccgatgatccgcgttgcatattcgcgcgcgagatcaatgaaatgcagattgacgatggtcgtaatctgcatttcacggttgatgcgctggaggtcatccatgacctggcgggtggtcagcgggtccagcgatgcgacaggctcgtccgccagaatgatcttagcctcctgcgccagggcgcgggcgatggatacgcgctgctgttggccaccggacagttcatctgcccggctgtaagctttttcgcggatgttcacgcgctccagcgctgttagtgccagttcgatatcctccttcgggaagagaccgagaatggtccgcagcgttgaatgatagccgacgcggccggaaagtacattgcggagcactgtcgaacgcttaaccagattgaagctttgaaagatcatgccgatatcacggcgaatgcgccgcaactcgctgcttccagcagacgtgacggacctgccacccacgacaatgtcgccggacgtaatgtcatgcagtcggttaatggaacgcagcagggtagacttacctgcaccggataagccgacgatgacgaccatttctccctcctgaatcgtcaaattaatatggttcaaccctttggtgccgttcgggtatgttttcgatacgttacggaattcgatcatatgctcccaactttctcccccgatggggtggaatgaaaacaacaccgccatgaatacatggacggtgctgccctgtcattcgtaaagcctgtttcgtagctgttacttcattaaagtaccttgtttgctccgattacttaaccgcttggccaacggcttcggcgtattcacgcacggagtcgaagtttttatcgtcacccttttcataacctacatgggtgtaaatttctttaatgatctcgccgcctgcagggtctttggcaatgtcaataaaggcttggctgatcttgtctctccacgcttgatccatatcagaacgtacgctgacggtgtcatttggaattttagctgtgtaatgaatgacgcgagttttttcaaatacatccgggatttccttcttcaccgtgttacgtgcatcctggaaaacagctaccgcatcaacttgaccgttcagcaacgccagaatagcagcatcgtggcctttgattgtcacaccctgcacatccgtgtccgggtccacgccagcttttttcagctctgctgcagggtacacgtagcctgcggaggaggttacattttgccagccaaccttcttgcctttcagatcagctaggctttgaatcggagaatcctttttcaccacgatcattgctttataaaagtttactttttcagttgtgtccttgcctgtagcatcttcaatgccgtagcgttgagcttgcaacagcaaatcggctgctttacggttatcgtgggccagtacataagcattcggcggaaggaatcctacatctacctgcttggaagacatggcttccacaattgtattgtagtcaggagatacggttactttcaccgggattccaagcttgtcacccagtagattttcgagcggtttggctttggcttcgagcgtatctgcattttgagaaggaacgaactgtacctttaactccttaggaacataggctgtgctttcgtttttagatccatctgtacccggagtagacgcgctgttgttattgcttgcattggagccacaagcggctagacccgctgccagtgtgaaggtcatgcacaaggtcagtgcttttttgaacaaaataatttccccctaaacatcgtaataacgaaaataaaattaaaaacctgtaaatgctgtgacaaaccaaatcttaacagctagtcccacagctagggtaaaaaccactcctgactttggtaaaaatgatgtaaaatttatcatatggtaaaaaccgttttctggatttatgcgaaatgcttattttaacattctcttaacagtgctctgttagacttgttcaagctctatgaccgaagctgagggagagaacaagattggatattttggatattaacaaaaaggcagaccaagacaatgtaagtcttgtgagagtgaaatttcgcattatggttacaaccgatttgcatgtcagtttgtggaattacgattattatacggatcaggaaacgctgcattacggtctggcgcaaacagccagcttgattcaaatagcccgggcggaggtgcccaatcacctgctgctggataacggagatgtgattcaggggaatccaatgggagattatgctgtacagcgaatccaacaggactcaagcgcggtgcatcccgcctataaagccatgaatctgcttggatatgaggcaggtaatatcgggaatcatgaatttaactatggactggaatacttgcagacttgccttcaaggagcgcaatttccttatgtgaatgccaacatttatatagcaggagaacaagaacgaaattactttacaccttatctattgctggataaggcggtagaggatgaagcaggcggtaagcatctgttgaaggtgggggtcatcggctttgtccctccgcaaattatgcaatgggacaaggcgtggctggagggaaaaatcattgtcaaagatatgctggaaacggcaagacgctttattccacaaatgaaggcggcgggagccgatctgatcattgccatgccccatgcaggcttagaggatattcccgaaacgcttgatatggaaaatgcggtgctgcatctgagcagggtggaagggatcgatgccattgtgtttggtcatgcacataaagtatttcccggaccttcgtttatagggaaaacaggtgttgatgtagagcgaggtaccatccacgatatcccagcagtggagccgggcttttggggggatcatctgggtatcattgatctggagctggcttttagtggagggaagtggcaagtggctgcatctgctgccgaggtacgcccggtgtatgatccgatacgcaaggaggcgctggtacaaccggatactgccattcagctggcggtagcagaagagcacgccggaacattggagtatattcgtgcacctgtaggtcagacgacggtggcggtgaacagcttttttgctcaggtgatggatgatgcttcggttcagctggtgaatgatgcgcaaatgtggtatgtgaagcagcagatgcaagggagcgagtacgaaggattgcccgttctgtcggcagcagctccttttaaaacaggcggcagatatggcccatcatactatacccatattccggcggggacgttggcgatcaagcatatcgctgatctgtacaattttccgaatacgctgcatgtcgtccgactgagtggaacggaaatccgggaatggctggagtggtctgctggacaattccggcaaattgatccttcagcagaacaagagcaagagctgattaattctgattttccaagctttaatttcgatatcatcgacggcatcaggtatcaaattgatgtaacacagccagccagatatgatgctgacgggggcctaaaggacccagatgcacacagaatcattcagatgtcttttgatggcgaaccgatggatatgcagcgaaattatctgattgttacgaataactatcgtgcgttttcctctgcgctggtcaatccgggtggagagcgaattatacttgcttcaccggatgagaaccgtcatgtgctgaccgaatacgtgcggcatatggagacgttgacgccaaaagctgacggccattggtccctcgccccatggtcagggcgtccgcatgtgacgttcctgacctcgccgcaagctacggatgccgctaatgcctattcggagttgctttatgaagggttaacgctagagggatacgctaagtttgccatcgatttcggacgttcacggtagaactgctaactagtttttgtcctataagtccacagcatcaaaataatagaaatagactgtcccgcagaggacggtcttttttcataaaacagttttaaaatcgtacaaaattcgtgattttatatgtcctgagtcgtgtttaaagttattgacctctcgtataaatagacatatactttgattaaacaaattttggtttaaaaggtaatgaaaaagtcaccatcattcgtttgagggggtgtccctttggaaaaaaacaccacgatccgcgcagaaatagaaaagtatattcaaagtgaaggcatttcaatgcaatgttttgcagatgcttcaaaggtaaatccgggtacacttagcggtatacttaatcggaacccgccacggcctatctcagtcaatcagcttgatctgattacagaggccatgggattggaagaaggatctttgttcgagatgtatgtggatgaatgttttattcattccttaccacactggaggaggttgcgtccgtttctcctgcgttgctcagagttgaataagctggagtgtatacgcagtgtacttggctatttgatggacgatttatcgaatgttcctgctatttttgagaccgcagaagcgatgtttgaggatggcagacatgaagcttccatgcttctgtatgattgtgtcatcgagagtgagaagtatacccactctgaacggttggcgatcagctatttccgtatattccagattcagattaaggataaccaacggaacttgaaggctgctgtacaattccatttgtaccgtagtcgtctaccggaaatttacgcactggaaggcttacatatgctatctcaagtgtttgctttaaaaatgcaatggtccgagatggaaatgtatgcggacgaactaagagagctggcgcaggcattgtatcgcaatcggaaccgttttggagatgagcacctggagctgcttaaaccgctcgtttattactatgctcaggggcatctgctcaaggccagctgctatgagtttcagggcagatatgaggaatccaagcaatggattgagggttatgcagatttgagctggtttgagggtttagacgaagaaggctggaaagtggtcaacctacatcgtgtatatgcacagggcaaccgactttgtattgaaattaaaatgggcaacacttctgcaatctatgaatatattacttacctgcgtgagcatccggatgagacactggaaggcttgaacaccttgctcgaatcggcgaaccggttcggttatttcgtggatgccgaactgggactgtttagtcagcaactcaagagcttctgggagcttgcaccggaacgatgggacactcattatcgcaagcactttaatgcatttcgctttgcatccttttgtaaggtgtatgcggaatattatttccgaaaaggtgattaccccgagggagtgggacaaatactgcattgcttgcaactgtctgtcgataatagctataccgaacatatcattggttgtatggctttatttgagcagcatcggaattttgctacaccggaacagcagcagctgtatcagagcctgtgcctgggcgtacgtgcaaatgaaaagaatcatgcctatgatcacagtaccggtggatatctataattccaaatttctttcgaattcttcatataacacgttattgcgaggatgttcctgtttcaaaaggggatgttctcgttttttagctgctgctgtcgcttgtgacttttaacatagagaggaccgttttgcgcgttgacaagtttcgcaagcgggattaggataaatgcagcacagaaagtgaaggagagcatgtacaaatgacgattcccaaaacattaacgatagcgggctccgacacaagcggtggagcgggtattcaggcagacctgaaaacctttcaggagcttggcgtatatggtatgaccgtattgacaaccgtagtagcgatgggtcctaaaacctgggatcatcttgtatatcctgttgcgttggatgtggtagaagcgcagctgcgtactgtattggaaggtatcggttttgatgcgatgaaaaccggtatgcttggttccgttgaaattatcgagctggtagccagccatttgaaaaagcatgatctgaagcggatcgtaattgacccggttatggtctgcaaaggcacggatgaagtgcttcagccggaaaatacagaggcgatgctggaattgttgattcctggcgctgacctggtaacaccgaacttgttcgaggcttcgcaactggcgaagaatggaccgatcacgacactggagcagatgcaggaagcggctgcgattatccatgagcgtggagctaagcatgtactgatcaaggaccgtggcaaaattcgcgcaggtaaagcgatggatctgctatatgacggaatcacttttgactggtttgaagccgattttgtaaaaacaaactttacccacggtgcaggctgcaccacttcggcagcggtaacggctggtttggcacaagggctgactgtacgcgaagcagtggatcaggccaagagatttattacacaggccattgaaggtagcttcaagctgaatgaattcgtcggtccgaccctgcatgcggcacatcgtttgcaaaatcaataaagcatgaaggtctgcgatcttagaaagacttataaatctccatcaggctgaatatatattagattgttttagatcatgacttttttgatatatagagttagatgaggcttaaaagccgcaatacatagtattgcggcttttgaggttgtatttttttggaattgcagcttccagtttggtctaatcgtactgtataataggcatcagatttattacatttaaggaggaaccgaggcaatgacattattcagccaaatggcttacagtcgaccagagcaacctgaaattgaacagcggtttaaaacgctgttgcagcagtttcgtgaagcagacagcgtagaacgtcaaaatgaagtgattcatgcgattaacaagctgcgcagtaatgtggaaacacaattgcaattggtggaagttcggcactccattaatacggaggatgccttttacaaagcggagcaagagtacgctgatgatttcatgccggttattcaggagtatgtaaccgattactaccgggcattggtggattctccattccgaaccgagttggagagtcaatggggcagccagcttttcagtattgccgaggtagcactcaaatcgttccatccggatattattgaggatttacagcaggaaaataagctgacctcggaatatgctcaattgattgcttcagcgaagatcccgttcgagggagaagaacgcacattgtcgcagctcctgccttttgaaatggctaccaaccgggagacgcgcaaacaggcctccgaggctaaatatcaatttatgagtgagcatgaggacgagctggaccggatttatgatgaactggtgaaggtacgcacgcgcatggcacacaagttgggctatgacaacttcgtagaattgggctatgcccgcttgggacgtacagattacaatgccgaaatggtagccaatttccgcgagcaggtgctgaagcacatcgttcctctggcaaccaagctgaaggagcgccagcgcgaacggatcggagtagatcagcttcgctattatgacgagggcttcaacttcctgtcaggcaatcctacgcctaaaggtgacccggagtggatcattcgtaatggagcacgtatgtatgaggaactttcagcggaaacacatgaatttttcagctttatgatcgaacgtggattgatggatttgatcagcaaaaagggcaagcaaagcggaggctattgtacatttttgagtgaatatggcacgccgtttattttctctaatttcaatggtacatccggtgatatcgacgtattgacgcatgaagcaggtcatgccttccaggtctatgaaagccgacattttgaaattcctgagtaccattggccaactatggaggcggctgagatccactctatgagcatggagtttttcgcatggccttggatgaatctgttcttcgaagaagatacggacaaatatcactttgaacatctatcctcatcgttgctgttcgtaccttacggcgtagccgtggacgaattccagcatgccgtatacgaacatccagactggaccccagccgaacgtaaaagcgcatggcgctccattgaacgtaagtataaaccgcatctggattatgaaggcaacgagtatctggagcagggcggattttggcacaaacagggtcatatttttcaatccccgttctactatattgactatacactcgcgcaactgtgcgcgttccaattctggaaacgcatgagtatcgaccggacagctgcgtgggaagattatttgaagctatgccgtgccggaggaagtcgatcttttaccgggttggttgagttggctggactcatctcgccgttccaagatggctgtatcgcctctgtaatcggagaaatcgaagcatggctgaacagtgtggatgataaaaagctgtaagcataactaaaaagggcatttcgcttacctgtcaaagctgaaaagcttgtagatgagatgctttttttaatgaaagcagagcagttgcacgagaaaagccgggaacctctacatgatgtagaagtcccggctttgtgtttattttagattaaatataacttcaattaatgtttggtgttaagcggtttgagattggcttcaatagatgcgcggcgcgattccaaaaatggcggtaacgccagcgattcacccagaaactcgagttcttcatccgtatcaaagccgggtccatcggttgctaattcaaacagaatgccgttcggctcacggaaatacaaggaacggaagtaaaagcgatctacaaaaccagagttggaaatttgcagctgcccaatacggtctacccactgtttgagctcttcctcagtttcaacacggaaggctacgtgatgcacactgccgcgtcctggtcgctcttgtggcagatcgttgcgctcctccagatgaacttcggttcctgtaccgccttcacccgtttcatagataaccacatccggttgtccagcaacaggagaagggtaggagcctttttttcggaagcccataacctgttcaagaataagaatggtattctccgctttgggaatagtcagatgaaccggtccaagtcctacaatgccgtattcggcagggacagggcttttctcccaaggcgtgccgccccgcattccgtgatcatgctcatctgaaacgaggaagaagcgttgtccttcaaaatcctcaaacgaaagtgccaggcgtcccgcttgatccgtaatttcgccatgttttacatccagctgctcgaagcggtttttccagtaatccagtgccttgtcatttggtacccgtagggagagagctgaaatgctgttatttcctgtacgagtttgtcccgcatgtggaatttcaaagaaagtgacttccgtacccgcagttccacgctcatctccgtaaaaaaggtgatacacactaacatcatcttggttcaccgttttcttgatcaaccgaagtcccattacctgtgtataaaaatcaacatttttagccgctgccgctgtaatcgccgaaacgtgatgcaatcctaatagtttcatgtcattatcctccttggtttttatatgattaggtttttctaaacaaaataaacagtcgaaaaacttttctttatatttattatcttgatattaagatatatgttttttgattgtttgtcaacttgaatttgcactggctccaaagacggataaaaatagaaattcgaaataatacaaaagcagatacaataaagcccgatatagcccattatagatagaacaaattttattataaaaggagtatactcgatgtatacggataaggatttaacgattaggcctgttagagaagaagacctgccggctctgtggacgttaacttttaaggaagaagcaccggaatggaagcagtgggatgcaccttactatgaacataagccactttcttttgatgattatttaaaagagaaggaaaagcgaatcggacaagatgacttttggatcattgaagtggaaggcaagatcattggatcggtgagctactattgggagcatcagccttctcaatggcttgaaatgggaattggtatctatgattcgcggtattggagcggtgggtatggtacgagggtgcttcgactatggatcacacatttgtttaatacattacctctagtaagagtaggttttacaacctggtcaggaaaccatcggatgatgaaggtgggagagaagctgggcatgaccctggaagccaggcttcgcaagtgcagatattatgatggagagtattatgattcgatccgaatggggcttctacgggaagagtgggaattgtgattaaattttaaagtatagaagactcgcaagagggacgcctttttcaaagaactccatcttgcgagtcaaagtttcaatgatttggatcgatcattttgaaatgcgaaaggttactgagggcaatcagcgaaaatagtttgcaattcatccgcatttggtcctgtgcccacttgttgggcaacaacttttccatctttaatatatgctaatgttggagtcccttgtaaatcgatatgatctctaagaaattgtccgataatcggtccccagtctccaccatccatattatagtagtaaatgggctgtgatatatgtgtagaaaattcttttaaaataggagaaaattcacgacaatgggagcagctaggtctaccaatataaaagtaaaaaccttctcccgagttgaatttgtccatggtttcattcgcattcagtctaggcagatcttttacattattctcgtattcttcaacagtcggattattgtcattttgctctatcgccgtagaattcttatattctgcgttatatttattgtcattttgctctatcgccgtaaaattcttatgttctgcagcatagttagtatcattggcaatgaaaaagcttgtcaaacacatacagaatataaaagctattttgaacggtagaaattttcggttttttatcataagaaacctccaaattaattttttgcctgatactaattttacggacatataatattattttgattatcaccttcttaaaatatttatacggagccttaacagactattgagattaattacttccagatagcctgtattcttaagttgtagttaatctatgaataaggttactatagttgatctatctagaaatattactgtaataatcagcgcatattgtgtcattttgcgtcttgctgaatactctagtaactcgtaattataaatggtcagcattgaatttttgatacatttttatcgaaaatttgctttttatagcattaaattggttattttatcacttacacattctatatcaaactaaagtgctaatttatatatagcattctacaaatttgataggataggtgaagactatgtttaacaacaaacaagtagtcataattgatactggaatggacatgacgaatcgtagtttaagtaaacatgttatagatggagtgagaattcaattttcaggaaacgaaattatcgaggataatgattttcaggatgaccatgggcatggaacatctgtggcagatacgattatgcaagtttttagtgaggctcaattttacatcataaaaatagcaaatgaagaagggaaaacaagtactagactcttgaagatggcgttggaaaaatgccttaatctgaatattaagtatatatgcataagcatttcggtcacttcagaaggatatcatcagcaacttagtgaaattacacaccaattagtgaatcaaaataaacttatttttgtatctgtaaaaaatggtagtcacagtagctatccggctaatctgccaactgtaattggtgtcgatggtcaaaccttttgttcaaatgattcatttttattttcgaagaatagagaggtccaggccatattcgatgattctcctatttttgtttatacacttgctgagcggtttaccttttttaaaggtacttctaaagccaacgctctttgtgtcggatggagtatgcgaattctatctttcaatagtcataaagataaaatcacatttgctgattataatcatgtacttgaacagtatacgttactacataaagtggagatacctatagtcaaagatatgtcagaaaataaaattgattgtaatttggtgaaaaaatttggaaagtctattgaaaaagcaatttatgaagctactaatcataaaattgacatctcttccttatatgaagggccatttatctctcggttatcaggaataaccttttataattttgtggatttttggagtaacctagaaaaagagttgaagtataacttaatcgattatcacagtataaatatattaaatgtatgttctctttctacgctattgaattatttggaagaagttgttgtttactcaagtactaagatagaggattagctaataacataatcttctgtcttagtacttgcttgatatttagttttaagt

SEQ ID NO: 2622 - DNA, 202913 bp, Unknown
  Kingdom: Bacteria, Phylum: Firmicutes, Class: Bacilli, Order: Bacillales, Family: Paenibacillaceae, Genus: Paenibacillus
ttatcttaatgacattgcccattcgggggctttttttcttgaagagctatacagctgctgcatccaattctattcgtattgggcaacaagctcgctatatgcggcttctacacgtttccactcatcttcgtcctcaatattgtaaagcaccatttcttcgttttcttcttccatacgaagaataatgccatccgcttcaggattgcctcgctcaagcagaagagcataaatgtgatcttctacgtcaaaggtctctaccagcaccatttctacatctttaccattttcatcagttagcgtaagaaccatttcttcatgttcgtggtcatgatcgtggttgcaggcttcaccgtgttcatgtttgtgatcactcatggaaatacctaccttcaaattgttttattttcccccgtatcgtaacatgatcaagggtgcaggtcaatttgtggtatgcctaatttatcgctgtaatgactttttcggacaccaaggtatagctgccgtctttgctctctttaatatagaaaccaacccggtaattccctgctgttttgaaatcatacgtaaagtcgttcgtacggaaccagaagttatccttttgcgctcctttgatatcttgagactgaatatccttcacgttgcccgaagggtcggtgatcgctaccttcactccggagatatctgttttcaaggtatcaatttgactaaatacattaaatttcactttattgcctttattcacgttaccaaacacagtatctcccttgaacaggaacatatgcacattaggctggtcgaaaacaacttttccaccggatggatcaaaattgacaagtccgttaaaatcacggatgggcacataagttttcccatcaatgacaactgcaccatcttttgacacttctccattaataatcaactgcacttggtccttggcggattccgccgaaatggcggtccctcccattattgaaaaggccatcatcagggccatcactcttctccatttcataactactaatccctccatcgtcatctgtttaaaaccttctgtcgtacatttatacctagctcagccgcacaagttgcgctgtgtttcacaaattgtccaaagtttttacataaggagccaaatctttagttccggtagcataggtgataaaatacgactgtagaagtcctagtacacaaagtctggaggataaattcataatgagcctaacgatacaaatgcttggcacaggcagtgcctttgccaagcattattacaacaacaacgcactgctggacagcggagaaggcaaactgctgatcgattgcggtacaaccgcttctttagcattacaccaaatggacgtccctttgcctgatattgacgcaattttaatcacacatattcacgcagatcatgtcggaggtttggaggaattcggttttcaaatgaacattcttcatcgtcgcaagcctctactttatatcgccgaaccactaatctaccctttatgggagcatacactcaagggcggaatgtcacagcagggtatgattgacaagctcgaagatgtattcgaggtaaacgtaataacgcctggtgtacccactacattagtatccggtattcaggtggagctaatccctacaaggcatattcctggtaaaaacagttattccatattcattaatgaccgccttttttatagtgcagatatggtttttgaccctgatttgcttcatcatctggtgcatgaacgaggatgtcggagtattctccatgaggttcaattacaaggcgctggagaagtccatacgacattggacgagctgctaagcttggcgccatctcttcaagaacggattcatctaatgcactatagtgatgatatggaacagttcagggagaaggcaggggtcatgtcctttctggagcagcaacgagtatatcaacttacagagttggaacgtgcagagtagcatgctaaatacagcttgaacaattaacaaaagccgcctggctttcctacaaaggatagccaggcggcttgctgttcttgaatataatgatgaacttgcattctaatgttgcgagttaaggtcagaacaatggcagttggtccaggttattagaaggatctccatcggcatctccccgaattcgtttgcttccatccttggccttgaacacgttaacgcctgcaattgagcctgtctcaatctcattcaatgcttggctataatctaaaatccggccggtagatgtctgaaaagacgtaaggtcgccatccccgtttttacgtactgctgtaatttgctcccgttctgtattagccatgctgtatcgctccttatccatagtatagtggaggaacttttactagcatgcacattgtacagatttgtatgcaccttacgctgtcgactacaactttttacgcatacgtacatgcggtattcccgcatcgtcaaaaggctcatcggagatcgtctcataaccgagcttttcgtaaaacttctcggcttgacattgggcatctagcagcgagtatcttagccccaattcacgtgcacgttcctccagtgctagtagtaatacacgtccatagcctgcggcacgatgctccttgagaacggcaatacgttgcattttagctgtatcttcctcatagtatgtcaaccgaccagtggccaccatttcaccatgttcacaaattagcaaatgatgggccgtatctcccagcttgtcataatgatcaacttctaaatcgagaggaactttttgctcttcgacaaacactttggtacggatcgatattgcctgctgtagctgctcctctgttgttacacttataatttctgcggccatcatctgttccccctatcattaattccaaattgcaaactcgctaaattcgaattatatatataaatgctcatgaagtacaggctgacttctatttttccactttacatatatggttaatacatgatattatctagtaaccgcaggacggtagctcagcgggagagcattatcttgacagggtaagggtcatgggttcgatccccatccgtcctattcgtcaaaagccttgatactcaaggcttttttgtttgtgtcgagataaatccagttatcctgtgaaaagaaaataggttattgactaagatttagtcaataacctatttttcaatcaaaatgatgcctacttcttcaacaaagcctttcacattgatccttctattatatagaagaaaaaaagcaaacctccagcacaatacgcatagaactcttagattacgatataaacctccccgctctcactgtcaatctccgtggggtaagcagtcacacatccagtatccggctcttgcacctggccagtggaaaggtcaactttccagtcatggagcggacaatggatcgctgagccacatatcattccttcagataaccgtccccctttgtgcggacaacgattctcaagcgcatgcacgctgccatcgctcagacggaatacagctatctctgtattatgaatgcgaactgtccttgctccacgtcggtcaatttcgttcagatcagctattctgattctgttggttgtcgtattagtctccattttgtcagccccctattccattactggcttaagttccggcagttgcacaaaatttttgcgcagctcttcgttgtgaataatttcgtgccacggatcagtcgtcgtgcttaacgtctcctcaattctggtcaccagttgcttcctcgtctctgcattcgcgagtgcctgtttgatggattccactccgacccgttccacccaatgggctgtgcgttcgttccaattggcctgctcgcgataatactgcagataggcaccggtccattccatcacttcatcctcagttttaacggtacaaagcagttcagctgcccgaaccttaataccgccgttacctccaacgtagatcccccatccaccgtcaatagcaacgacgcccaaatccttgatcgtcgcttcagcgcagttacgcgggcaaccagatacagccagtttgactttggatggcgcattcagacgttcaaatgccttttccaaccggatacccatacccatagcatcctgagtgccaaagcgacaaaaggtgttacctacgcacgtcttaaccgttcgcagcgtctttccataggcatatccagacggcatatccaactcggcccagatccccggcaaatcctccttcttcacaccaagcaagtcaagacgttggccacccgtaaatttcaccagaggcacattgtatttctctgcgacagcagcaattttcttcaagtcggcaggtgaagtaactcctccataaatgcggggcacgacagaataggtgccatctttctgtatattggcatggtatcgttcattcgtgaatctggattccttctcatcctcataatccagcggccatagcatacctagataataattgagggccggccggcatttggtacatccttctggctcgttccagcccagcacattcatcacttctttgacgctcttcaatcccatctcccgaatgccatcaatgatcgcttcccggtcaagcgtcgtacaactacaaattccctctttcatcgtttctccggcttctgcgcctgcgtataactgtaagagtccctccactaatggcttgcagccgccacatgatgccgatgcctttgtgcatgccttaatctccccgacactccggcagccagccgcaaccgcctctccaatgtcacccttggatacaccattacatccgcatacaatttcgtcatcaggcatctgctctagcatcatggcgccactagcttcaggttgaccgggattaaagccaagtaataactctttctctcggccaaccaccgactcgccacttttgatcaaagaaaatagcatggctccgtcagacgtatccccaaacagaacagctccgatcagtttttcttccttgatcacgatttttttgtagacgccgccaatatcatcctgataccgaagggaacgtgttcccggttcatccttgtaatcccctgctgaaaacacgtcgacacccgataccttcaaccttgtcgaggtaacagaaccactgtagccgggagtctccattcccgcgagccgctgagccagtacaccaccttgctcatataatggagcaaccagcccgtaagtgattccccggtgttctgcgcattctccaacggcgtagattccggggatattcgtttccatgtaatcatttacgatgatgccgcggtttacagggattcccgccgacagcgccagttcaatgtctggtttgatgcctaccgccataacgatcagatctgcttccagctcgctgccatcggcaaatttcaacccttccacgcggcgacgccccgtaatagccgccgtccgcttattgaccagaaaagtcattccctgctcctccagctcgcgccgtagcataagggaagcagcctcatccagctgccgatccataatatatccgttaatatgaataaccgtgacgtccatccccaagttaagcagccccctagctgcctccagcccaagcaatccgccgccgatgacggctgcttttttgtgcgtctttgcggtctccatcatcgtttcacagtcacgaatatcccggaaaccgataacaccttccttgtcggctcctggaagcggcagaataaaggctttagaacccgttgccaacaacaacaaatcataagagatgcatacgccggagcgcgacgtcacctgctgcttttccgtatcgatagctgtgacaggatcatcggtatacaatcgaatattgttgtcttcataccaactccagtcgttgatgacaatatcctgcaaaccagcccctcccgccagaacggaggacagcatgatccggttatagtttggatggggctcggccccgaataccgtaatttcatagctacctggtgcaagcttcagcaaatgttcgagagtgcgtattcccgccattccgttgccgatcaacactaacttttggatattgttcatcaggtcactccccttccatttgtatccttaaaacataaaaagcctgcttcacatatggggattcaaaatatccctcacatgagaaaacaggctccattgccgtttcatcgaatacgccgttgtatccatcagagtatggaattaaaaagtactgtagctaatatataatggttcaaatgatatgtcaacattccttacgcaatatcttataaaaaattatattttatcaccatgtaacatatctatgacgtataaaatatcactctcctacaaaattaggattgattttcagaccaaaacacgccaaaatggtttaaaagtccgttttaatttgatgatggtgaaaaaaataagcaaacagataaaatttcatgtcatatttgttatcaatgaataccatccccatccctaactacccttcatgttacagagaggaggagcccgcttgcgttccttgttggtaattcacttacattctgaccatgtatctgagcagacacacgccgtttcctcatggcaggcaggacctgagtaccttttagagtccaacggatacctaactctgccctgccgcaatgaatccgaaatcaaacagctaatccttaatgcagatgcggcggtactaaacatacctgtcggcactatcagcatatggagtgacaggctggagcaagccaaagcggtcccattgctctggtggtgcagcgcagaatcagcgctatcatcaacagaggcttgtgaagctgatgtcactgtcgatggcattctaaccccttcaatggcagcccatgagctgaattgggctcttcattttagtgccaaacgcttttttgaacgccagcattggcaaagtgaacgcaagcaactgactgctcgactggaagaacgcaaatggattgatatggccaaaggaatactgggggaagtaaacggtatcccggaagctgaagcatatgatgtgctacgcaaaaaagcaatgaacgaacgcaaacgtatcgttgatgtggccatctccatcgtcaaagcacagcaaatgctaaaagcataaatctgaaaggggcctgaacatgaatatcattgaaatattaaaagaagtgggtcgcggcaaaagaggcgcccgagatctgaattatgccgaagccgaagctgctgccgagcttattatgacccagtcggcaacccctgctcaaatcggagctttctttgccgcggagcgcattaaaatggagagcgttgccgagctggaagcattcgtaaacgtttgccgtaaatatacccatcgcttcccgatgcaggaaggtattgattttgccggtccgtacgatggcaggaagtcatcgtttatcgccaccttcacaacagccttcgtactcgcctcatgcggaatacctgtaacgatgcatggcagcgcacctctccctcccaaatggggggttacgctaccgcttttactgcaggaaatgggggttacgtccgggaacatgacacgcgaaaccgccattcatgccgcgaagctgactggtgtactattcatagcctccgaacagtggtgcgcgcccctgcgagatctgcggtccattcgcgaagaactggggcttcgcacggtgctgaatactgccgagaaactggttgattacggttcttccccctatattgtattcggcgttttccacaatactgtgttcgagaagacggcgaaactcatgcaaaatctcaattaccgcagggctctgatcgtccaggggagcgaaggatcggaggacctgttcatcgatcggccgacccggacttacctgcttgctaacggcgaggtgtcactacaggttattgatccagaaatgtacgggctggattcggtggtaccagagcataactggacccccgctgaacagctgcgcattacggaggaagtgctacaaggtacagcttctatagccttttcgaatcaagtgttactcaacagtgcggtccgactgttcgttgcaggacgagtcgactccatagaggaaggtttgtatacctgcaaaccgctgctagaaaacggggacgccttgaatttgtataaacaatggcgggaagctatgctcagaacagaaataaaaacgggagcaaacatatccgaaacccgattgcaattataatatcggcctcacgcagtctgtgattgcaggccattaactgtccaatccaaaaaggccagccctcattcatacaatgagggctggtcttttatgcaatgaaaaagtcacttactccgtcctactctagaactcagaccattccccattatctgcacttgttgcaactgcagccagatgaaggggacgaatacgtacagctgccgttttgaagccaggcatccggcagaacggatcaagatcgggtcgggtcgcccgatttacattttgtatcccgccccaatgcatgggtacgaagagcgtgtcttcgcggatatgtggtttgattcggctgcggacagtgaagttgccgcgctgtgatgctatttctacccactccccgtccctgatatgccagcgtcgcgctgtccgcggatgaatttccacataattttcaatctctcgcgcggccagcgacggacttctgcgcgtttgtgcaccggtcaaataatgagccagtacacggccgttcgtcaaaataagcgggtactcctctgatatctcctctcctgctccacagctttcaaccaccgtaaaaacagccttttgatcggaatgggcaaaggtttcccgaaacatcatatccataccggctctgtccgtagacgggcatggccaatatactccttcttcacgacgcagcctgtcatatgtgatcccataataatcggcaggaccgccccggctggcaagccgcagttcttcaaagatatgctcagcatccctgtaagagaaatagctgcccttgtttagctttgcagccaactgacacaaaatgttccagtcatctctagcctcgcccggtgcgggcctcgccgcttcccgtagcagaacgcggccctccagattggtcatcgtccccgtattctccaaataagacgtcacaggtaaaacaacgtcggccatccgcgcggtttcagtgagaaacatatccgccacaaccagcagattcagctttttgagggcttcctccaccagccggacattcgggttagatacaacaggattagagcccatcacgaacagagcttggatttctcgctgatgaacaagctccatcatttcatatgcggacaccccttttcccggcaaaccgcttggttcaactccccacacggacgccacatagaatcgatcttcttcattctcaatcgatctgtagccaggaagctggtcagccttttggccgtgctctctccccccttgcccgtttccttgtcctgtgatagccccataaccgcatccttcccttcctatcttgccagtggccagcaccagattaagaaatgcacgcaccgccatatgtccatctgtctgctgttcgacacctctggccgtaaaaacgatgccagtctccacactgccaaaggcacgtgctgcctgccggatcatttctacctcaattccgcacaacgcagccgattcgttcagatccacacccttcaaatgaatcaacagctggtcatagccgttggtccgcttgcggataaactcttcattcgcaaatccttcatccacgatgacctttagcatggcattgaccaacactgcatccgtacccggcttgatttgcaggtgcaaatcggcggccgccgccgttggtgtcgcgcgcgggtcaatcacgatgataaacgcgccgttttccttcgcctcgtgaaaataaggcattaacgtcggctggcattcagcgatatttgtacctgcgagtacaatacaacgagctaatggaatatcagccagtctgcaggtcagtccgcgatcaacgccaaacactttactaccagcggatgccgctgccgacatgcagaagcgcccgttataatcgatatatcgcgtacctacagccactcttgcaaatttaccgagtaaataggccgtttcattggagagtgaacctccaccgtaaattccgattgcatcggcaccctgtgtggacagtagcgtagagaaactgctagctatagtatccaatgcctcctcccacttgacgggaacaagtttgccctctttgcgtatgagaggctgtaccagcctttccgcatgagtcgcatgctgatgcgcattcattcccttgatgcacagcctaccctgcgaggctgcattaggcttcccttccgcgttatacactgtacggatgatacccgcgagtgtctctgtacccgtgctaacggtcatcttacattgcacgctgcaaaacgggcactgcgtatccattactgacgatacatgtagcccagcttccggtttgctttctcctgactgacacatcaaagtcacctccccttcgccatttttcgtaattttattgtctgcacacgctagatatatcgccacaactccaactcaacccgtcatcctgtcagcattgtggtccgtaggctgcccgccagttcacttcgaagagcagcatcaagcacactttcccgtagcaccataacgccagtcctttcaatccactcccacattttctccccgtaccgggcactatgtcggtatattcgcaagcaaactgcagccagcaggaccgcttctgtcgggtcctcctccaatccaagcagctgcccctggcgaaccggatgctcagcatgaccaccggcataaacctcccagcctgctggagatcgggatattccaatatcgtggacaagtacacctccgggatactccgatccaggacaaacagaaactgtaaccaacgagggcaatgcaagacttccccataaagttgccaaccgctctcttagccaggctacttctacaaaagtctgatccatcaggtccgacttaacaaaagcctgattctcggcatttaggttcgtaaagcgcaggcccgcagagggagcttctcctccacactgcggtgtgacctgaaccgtaacaccagaacttaatggatttgtcgcagatctgtcgcgcaacccgagagattccaagtaataaagtacagccggacgacataattcacacccctgctgtctggtccaaccgagacgggacactacttcatctggagtctgacatgctgtgtccaccatagctgttttaagcgaatcatgatcgtaatgcgtacatccacatacagggacaacttcttgggcggtgggagtaactacaggtccggaagctgtcgatcgggacaaactatttttgaccagtgcagccaccagcggccgacagcccccacaggaaccggatgctttggtccggcttttcacttcttccaccgtcttcagcttatccgtggcaatcgctcgcaaaatagcccccttactcacgctattgcacgcacataccgtttcctcttccgggagtgcggctgccgcatcctctgctctgctcacgctgttatcccgggatgtaagctctgtagcgggcgcgctgcgccgtaccattccgagtagcgaggtactttcagatgtatctccgaacaaaatggcgccagtgacagcaccgccgtgcatcattacttttttgtaaacctccagcatcccgttatattccatgactgctgtctcgtttccctcttcgcgaatgtctcctacggaaaatagatgaattcccgctaccttgagctgcgcatacggaaccgtcccttcatagggagccgcttcacgcccacaaataacttttgccagcactttgccctgctcatatagtggcgccactagcccgtatgaaatcccgcgatgctcagcacattcgccgacggcataaataccgggaatactcgtgcgcatataatcatccacgacaatggcacggtttacggtcagaccgctgtcctgagctaattcgatattcggtcggataccaaccgccagcacaaccaaatccgtttccaacctgttcccgtccgaaaacatcaatccttgcgccctgtttcggcctatgatgttgaccgtttccttcgccaaatgaaacctcatgccctgttgttccagctttcgctgcagaagcatagccgccgtccgatcaagctgacggttcataagatactgcgcattatgaacaacctcagtttccatccctagattcaacaggccttgagcggcttcaagtcctaacagcccccctccgataactatggccttacggtatgctttggcatatgtttccatggtttcgcaatcattcacatcacgaaaagcgattaccccctgttttcgagctccgggaatgggcggcatgaaaggcaatgagcccgttgccaatatgagcatgtcataaggttctttgatgccggattccgtttccaccatcccggctgcaacatcaatacgacagacgcgttcacccgcgtacaactttaccccgttctcttcataccagtcccagtcatgggtaacgatgtgcttaaatgagctctcctcctgaagcattttggacaggagcactcggttgtacccgggacggggctctgcaccaaatatcgtgatttggaaccgctctggctccagatcaagtatttcctccacacatttgatgcctgccataccgttaccgacgacgaccagttttttcatcatattaaaccagccccattctccgaataaaatgacagaaaaaacccttctccattcaatggaaaagggcgccgttgccattaatgtcggcacatcgttgtgccgatatgtacctaagattactgaattgtgaatgtcatgtcaatattcaatacatgaaagttatatttttacctgatatttaatttttttacgattttgtgttatgtatattgacataaaacagttccttttttataatttgattaaaatcactccaacgtgatcataccaagtcgactcacaatgaggtgtgtcaaccacggcaatgaggccgcaaaccgtttcctagataccatgtaggggcgatttgcggctttttcatgttcaaattacatttttcagacaaagaacaacaattagaacaggagagatggagaatgaacaaaaaaagtttctggaaaagcggacacaagcccaccctatttggctcctttctgtattttgatatcagttttatgatatggggaatgatcggaccattggccgttgtaattgctaatgattatccaatggaccctgtacaaaaagccaatcttgtcgccctacccatacttggtggttccctgctgcggctcgtgctcggattcatgtctgattatatcggtccgaagctcacgggacagattggtatgcttgtcacgataatccctctcttgctcggctggctgtgggttgattcgctagagcacatgtacgttgttgccctgctcctgggcgtagccggagcatcatttgcagctgcgctgccgttggccagtcaatggtaccccaaagagcatcaaggcttggctatgggaattgccggtgccgggaatagcggtaccgtccttgcgacattgttcgccaaccgcattgctcaacattttggcagttgggaagccgttttcggattggccatcctccccatcttaaccgtcttcgttctgttcagtatttttgcccgcaatagccctcaccgcccagcaccaaaaagtctgtcgcaatatgcttcggtgctcaaacagagggatgcctgggtattctgtgccttttactgcgtgacgtttggcggattcgttggcctttctaattatttgactattttctttaatacccaatatggcctctccgcggtacatgccgccgattttgcgaccatttgtgtgattgccggaagcttctttcgtcctgtaggtggctttttgtccgaccggattggtggttcacgcatgttaatgtacttgtatgcaggagccgggattatgctcgccggcattgcgtttttaccgccacttgccgtggtagtcgtgctgctgttcgtaggcatgatgtgccttggcgctggcaacggctccgtattccagctcgttccgcagcggttcggcaacgaaatcgggctcatgaccggtatcgtcggcgctgctggtggcataggcgggtactttcttccccttatactgggtcatctatacaaatcaacaggttcctatatgccaggcttcatctgtctgagcctgatcacgttctgtgcctttaccctcgtcatcatcatgcaattgaaatggcgtaacagctggatgcgacgctctgctacagttactgatgaagccgtcaagcgcatcggagaattaaatgcctgatgttcattaaacatagagctgcgaagcattgaattgtccctcaaccatccctatagtcaaaaaaatagcttaacttcgtttatataaaatgaagttaagctatttttcatgcccactcagtcgaatcacacctataaaaactatgataattatcacattgaatcaatattttccgaaaatattatgaaaattaaatgaaattttcattcgaaaaacattgaaaatcgctttcattttcataatttttcttatgtaaacacttatataaccatttttcacacaacatacttcttcacttggtttaaaataaggcgtatacttgttcacgaattgttcaaggattaactaaatgtaattttttagaaagaaggaattgaaaatgcgtgcttttcattttacggaagacggatctatcgaaactaaattaaccggaaaagatctacttgccaaccccctgctaaataaaggagtggcttttaccctggaagaacggaaacagcttggacttgatggtctccttcctcctacgatattaactattgaggagcaggttcagcgggtttacgagcaatttcagagccaaccggataatttgcgtaaaaatgttgcgttaaatgatctttttaatcggaataccgttctttattatcgtttgctctctgagcacctaagcgaaatgctcccgattgtttatacaccaacagtaggccaggctatacaggaatacagtcatgaatatcacaagcctggtggtatgtatttatctatcgataatcttgcgggtattggagaggcttttaagaatttgaacctagaccctgatgatatcgacctgatcgtagccacagattccgagagtattttgggaatcggggactggggagtcggaggtattaatatctctattggtaagcttgctgtgtatacagctgctgctggtatagatcctagccgggtgctggcagttgttcttgatgcaggtacaaacaacgagaagctattggaagatcctttatatatggggaatcgtcataaacgtgtacgtggagaacaatatgaccaatttattgatacttatgttcaagcggcactgtcctttttcccgaatgccctgctgcactgggaagatctgggcaatgtcaacgcacggaacattatcaataaatacggaaatagtattctgacttttaatgatgatattcaaggtactggagcggttacgctcgcgggtgtgatgtctggtgtccaattgtccggaatcccactgagcaagcatcgggtgctagtctttggtccaggagctgccggaatcggcaatgcagaccaaattagcgccgccatgatgctggaaggactgtcagaagcagaagcaagacgtaacttctgggcatatgattaccgcggtctgctcaccaacgaaacagaaggactttttccattccaggtcccttatgtgcgtgatgttgcagaatgccgtgactgggaacatgctgaggatggcaaaatccctttgcttgaagtcattcgccgcgtgaaaccgacgattatgatcggtacttccggtgttactggggcatttagtgaggaaatcgttaaagaaatggccaagcatacagaacgtcctattattatgcctatgtccaacccgactccactgacagaagcaactccgcaagatttgatccactggaccgaaggaaaagccctcattgcaacaggaagtcctttcgagccagtgatctataacaatattaagtttgaaattgggcaatccaacaatgctttcgtattcccgggtctgggtctcggcgcaatcgtggtaaaatccaaaattataacagatagcatgtttgcagcagctgcccatgcagtagctcaaatggttgatttgtcgcagcctggtgcttccctgctgccaaaaatcagcgagctacgagaagtatctgaagcggtagccgtggctgtagctaaggcagcagttcaggatggagtagcgcgtcatcaaccggacgatatcgcacaagcggttcgagatgcgatgtgggactgcaaatataaacccatcaaacaatatggtcaggaagccgtcctggtttaaaaaatagcgaacaacatcaaatgtgtacttgcatatgcaaagtgattatttaactgatgtccgccatttttggcggacatcttcattggaggcgacatcatggctacaggtcatatttttattatcttaattcctattttctttgtcattttaattggttatttcgcaggattgttcaaggcctttaaccctgcttcttctaagggattaaatacacttgtgacgaagtttgctctacctgcacacttgtttattggtatcacgacgacacccagagagacgttgattcaaaagtggccctttcttgtggctttgctacttggtgtaatcggcttttatattgtattgctcattgtttatcgcttaattgccaaaaaaggcctgactgaatcctccatgttcgcattgaattcgacacagccttcttttgcattcatgggaattccggttctgggcagcttgttcggaagtgcggcagtcgccatcccgattgcgattactgggatcgtcgttaatgccattcttgatccgcttgcaagtattttgggaacggtcggtcagcgcaaaacaacagaatccgacggcactagaggcaacttatttaaagtcactatgaaatcagtccttcatggactcagcgagccgcttgcctgcgtacccttgtttggtgtcgtattgactctatgtggattccacgctccgaaacttttgcaatccatgtttgatcaaatcggcaatattactgctggtacagccctatttgccatcggggtaaccattggtatcaaaaagattacgttcagtccaaaagcacttagcatcgctgtgctgaaagccatcgtgatgcctattgttatgctcggtattgctgttctaataggactatcccatgaagatgtaaccaaagccgtactgcttgtagcttttcccggctcggctgtggccgctatgattgctacccgttatgaaacactggaaacggaagctgcatctgcatttgttattagctcagtcttatcgctcatttcactacccttactcatttcacttctttcatagggatagaaacttaagaaccctcaatgcaatccaggtatttataggtataaagcatacccgtttgctctcatttatcttattttttaaatattgtttgaacaataaagtgatttagtaagaattgagtttggaaaaacaacataaaatccagttttgccgacaagcggcggtcccatcgtttcattcactaggggccgccgttctttttgaataaccttctactctcccttttaataaatacctaacatttagaaagcaaattgtcgaaatatatatggggtaggttgtatatgaaactaaattgctaattcaaaggagaagaaaacgtgaaaaacttgaagtggagaactatgtccttttttggtaaaaatctattaatctcttttcttaacatcgtattaataggtgctattctcatcacatccagctatatacttcaaaagaacattctcaccacgcagctgcaagaccaagttaaagtattgactaaaaaatgggcagaagatgttgacaaaacaaaagtacaacaagcattaagcgaaaaagattataacggttctgctcaacaggatttacgcaaattcctagattctatccacacattttatcctaatgttgcccaagcttacatatttggcacagaactaacagaaggaaatcaaacctccattattggcgttcctacaaatttagtccaagctttccaagactcgaagatgaatattggggatatgtacactcttccagacgaaaatgtacaaggtgtaaataaaatgcttcaatctaaagactcagcgtttagcagcttttatactgacgattttggtacatggacgaccattgtttacccaattacagatgaaagcggtaaaatcacaagtgcgatatactttgacgtagacgcaagctctgtacctaacggacttcataaattgcttgtatatggtgtttcattgctcattctgttccttgcgatcttcttaacggtccaatatttactggtaaaacgtaccctctccccgattcgtagcctgatgaagggcattgaagaagtcagcgaggggaatctgaatgtacaaatcaagacaggcgaggacgaccttggcattatcaatcaaaaatttaattctatgatcaaacgccttaacgataccatggtgaaagtacaggatacgacgcaagaagttacgggatctgcccaggaattgttaagcattagcgagaaaaacagtacgaatacgaacgtcattaacagcaatattcaggaaataacccaggggcttgaagctcaggatcacgcagcacttgaaagctccagagctatgaatgaaatgtcgacagttatccaaacgattgccgaaagctcctcttccgtagcggatcaagcttattctatggaaaaacgctccgttgaaggcaaccaggtagcccaaaagctttccgctcaaatggactccatctccactacaatggaaagtacagctgattccgttaatgcgctgcagaaccgttctaacgaaatcagcaatatcgtcagcatcattacaggcattgccagtcaaacgaatctgcttgcactgaacgcttctattgaagctgccagagtcggtgaagagggcaaaggttttgcagtagtagcgggagaagtgcgtaatttggctgaacagtctcaagagtctgccaaacagattgcagagcttattggagaaatccaaaaagaaattgagcagactgtaaaaggcatcagccttggtacaaaagaagttcacattgggctagaagttacgaagcaaacaggcaaaatgttctctgaaattttagatgcgtctaataaagtgtcgtcacaaattcaagaggtatccagcgcaacggagcagatttcagccagcacgcaggaaatgtcagctacctctgacgagctgtcttcgacagttagcaaaacagtcgatagtagcaaacaaatcgagcataccattggagaacaggctgagtctatggcttctattgtccaagcttctgacaagcttacattgatgtccggtgagctggaagagctcatttcgttcttcaaggtgaaccgggaagcctaattttataacttccaagtaactcaagataacaataaagaacctctagtctgcatagaagcgaactagaggttctttgatatactcttacatacttcttaatttataaatccttccaaagctgaggttggtttaccgtcagcctgccaagcacctttgttataaccttgattgtaacctggagttgcagccggctcccaataaaatacccctgtacccttgccgcctccaatgttccgaacctttgttttgattgcagaaataaatgccttggaagcagcaggttcgttatattccattccgatttcactgatgacaatgcctttgccgtatttggcaatgaggttattggcattggtaatcgtctggtccaccttaccctgccagtcagaaggagacggatacagagacagcccgatgagatcaaactgagctccattatcaattagtccgccgatattccagttcaacacggaaccgttatccccgttggctaaatgtacgatcgttttagtactgctgctaaccgattttacagcattattacctgtattgacgagccaggcatagtttttcatgttcaccgaagctttgccgtcttcccagagcattccattgttcgtctcattaccgatctgcacccagtccggtgttacccccttgcttttcatcgtgttcataacatagaccgtatgagaccagactgcatccataagttgtgtaaatgtgaaattgcgccacgcataaggtttgttctgttgccctggatctgcccaggaatcactataatgtagagtcagcataacactcatgcccaattttttagctcgctgtgccagttctgctgccttttcggcattcatgtatccgcttgcataatctttcatgtcagggtttacccacacacggatacgtaccgagttgatctgatagtcatctcgcaaaatttgcagtatatctcgacgaacaccctttttatccttccaagtcataccttgcgcttccattcctgctacccagcttatatctgctcctttggcgaaagcaggggcggccgaagccgcacctaaccccacagagcccaacggatacaataagctggataacaagatcaacatcgcaaataccataatgcggttacctgttttcataagtacatcctccattcaaattgtatactcctcattgcctctgaccaatctaccagctccctcactcgggaaaacgatagagatcacactttaatatcatgttctatttattgcgctctgtctttaaaaccttaacagcgtaggcatccaattgaacgctaccgtcttctatcgcatgattttcaagcatatccgcataagttcgtccatccaacgtaatcttttgcggctcatgcgtgaaattcagtataaaaatataatcatgaaccccatcggtacgaatcgccgtattcactccatgaggcaacttcacattgagcgctttactgattcctgcatcatcaattaaacttctgtaaaaatgactgtggaatagtccgatgttgcgtgatgcgatgtaataagcctttccctgtcccaaacggttcactgtcaaagccggacgtcctgcataaaagtctgagccgtacacagccagtacctctgcaccctccgtatgaatgagatcacacaattctacagcttcatactccccttgcagatccagctcattgccttcaaccggcaaaatgtgattacgatcatgatcatgcaatccgtcaatctcttccgaccagatccccagcgtcttacgaagcgggcccggaaagcctccaaggaagcacaaatcatgttcatctacgataccagaccaataggttgctacgaaaacgccgccattttcaacaaatttctgtatacgctcccccacaccactgcggaccatatacaacatcggagctaccaaaagtttatatttggagaaatctgcatccatatgaatgacatctacaggcacaccctgctcccaaagtgccaaataatgcgcttcagctgtctcctcatatttcacacctttgttccgcggtccctgtgaatcgttgattccccaacggttctcccagtcaaaaatgactgcggcctccgccggtacagatgtcccgataacctcctccagtttttccagcgcattaccgacatgggtcacatccccgaatacccgagtgtgctcatgtccgacatgatcgacaaccgcaccatgcagcttttcactcgaaccgcggcttttccgccactgaaagtattgaacggtgtctgacccgtgtgccacagcctgtaaagacgatagcagatgcattcccggccgcttcagcttgctaacgtcttgccagttcgtcaaacttggcgtgctctccatgagcatccaaggctttcctcccttaattgagcgaataatatcatgcatcatggccactttagcagcctgacggctatcatccccctcacagtcatgccacgtcgggtaactatcccaggatataacatcgagcagatcagcaaacttccagtaattcaatccttcaaaaaactccattaaattggttgtgactggaatggctggattggcagccttgagcggcataatctcatgcttgataaaatctgcggtctgatcggtcacaaaccgtctccagtccaaattcatggcatggacctgtgtttcaccgtgaggtgccggggactcaacttggctccagtccgtaatcgtatgactccaaaaggtcgtccaccatgcgtgattaagcttgtgcagcgtaccgtatttatcctggacccaagcgcgaaatgcctcctgacaataatcacagtggcaatctccaccaaattcatttgaaatatgccagccaataacagcaggatggttagcataacgctcggctagcttcgtattcatgatacgtactttttcccgataaacaggcgacgtagcacagtgattatggcgaaacccatgcagattacggacacggttagcctccacacgcagcacctcaggatatttttgtgacatccaggctggtcttgctccactcggagtggccaaaaatgcatagattccgttctcagcaaacgaatccagaatacgatccagccattcgaacgtaaatacgccttcctcaggctccaatgaaacccatgagaaaataccgacagacatcacgttacatttggctagtttcattagacggatatcctccgctaacacctcagggtaatgctgccattgctccgggttatagtccgctccatgcagcatacgtggaactcgctcactaatgggagggtacttgattatgttttgattcgtcactacaaatcatctccttctataaattctattactctttgacagaacctagcgtcatacctttaacaaaatacttttgtaaaaatggatatacaatgagaataggcgctgcaccaatgaaaatttgcgctgcattaaccgtcgtttgagaaagtaattccatctctttgggactcatgctcatggaactcatgtccttctgaataattacagtttgcaggaacgtcgccagcggataatcctttgcattgctcaaatagagcagaccgtcaaaccaggagttccaatgaaataccatactaaacagcgcaatcgtcgcaatggaaggcatggatatcggtaaaaaaatactaaacaatgtccgaaaatgtcctgctccgtcgatcaatgcggcctcttccatctctttgggaattcctctaaaaaagttcaacataaggatgaccagaaatgtgttgaccgctcctggcaaaacaagtacccagaagctgtccatgaggtggatcttttgaataaccatatagaatggaaccagaccaccgttaaaaatcatgctgaatacaaacaaccatgaatatacgtttcggctacggaacacagatgtttcctttgaaagtggataagcagctaaaaaggtaataagcagtgttaagccggttcccaatacagtccgacagacagaaatccagatggagtgcagaaaaatcgggttattcatcgtcttcttataggcttctaatgaaaattgtaccggccacagtccaaccagattggcatctgcagctgatttagcactaaatgatacagctaacacatgaatcagcggaacgatacacatgatggacaaaatcacaagcaagcaaatattaaacacattaaagatgcggtatggcgttgttttatgatacatgactctccctctttcagcctcgtggaatcaaaatatgcggtaacctgcccatttgtaagcaagtcgataagatatcagaatgagaatcatactgataacggatttgaacaacccgatagcagtggcatagcccatttccccattgattaacgctgtccggtagacgaatgtatcaataatatcgcctttttggtaaactagcggattataaaggttgaaaatctggtcaaaaccggcgttcagtacattgccaagtgcaagcgttccaacaacgactaccatcggaattaacgaaggtacagtgatgtgtagcgtctgtctccagcggcttgctccatccatttcagaagcctcatacaacgaaggattaatacccgccagtgcagcaagaaatacaatggtgttgtatccgaactccttccatatatccgatacaatgacagtaaaccgaaaccagttattatctcctagaaaaaagataggctgaatcccgaaactaccgagaatacggttcataaatccatctgtagccaacaggtcaatcagaattccgcccaagatgacccacgacagaaagtgtggcagataaaccagtgtttgaatggatcgctgaagtccaaccttgcgaatttcattcagcagtatagcaaaaacaaacggaaccaccagattgaaaaacatctttaacacagcaataattagcgtattccagacgacttgaagactgtcctcccgttgaaacaaaaagcggaagttatccagtccaacccactcggaacccgttatgcctagccaaggtttgtaattttgaaaggccatcacgatgccgcccatcggaatgtagctgaatacaattaagaaaatgatggctggcagcagcatgatatgaaatggccacgtacgttgcagacttctcattgcagttcctcctgtaactctcatggtatacttcaattataaaagcgttttcgctgtcccaacagttcaaaaaaccaacatacatggcacaaaagcaatcatttttttaagctcgccaaacgaataaaactttttttcaaatacaccatgatagcgcattcatttctactcgatacgggtaaagctgtagtaaaaaggctgcccacctcgggacagccctcctactctgttacaacatcattggtttttactttcgacgcttttataccattcgtttacttcatttgtaatttgttcgccaccagctgttttccacgtctgcacaaaggtatcaaaagcagagatcggctgcttgccataaataatttcattgaaggtctgactttcaatcttatccagatagtcctttttagccttcatggttggcgtagtagggcccgtgaactgatctttcatggagatatctttctgttccataagcactttggcagctgcgggagtatctttcccgtagttcaccattacatctttctccagacgggtcttcggttctgcgccgttagccaaacttagcaaagccttcatttgggcatcaggtatacgcgcaccatcacgaaccagcaaataacgaatagagtttacataaccgcctggtattttatcgatagacattagctttccgcccgcatccaaatcataatcgtagcccttaaacagcccattcgacaaatcgccgtccggtttggcattagcataatggtcaaacaaataattttgataagtgaaaaaggcttcaggatgctgcatttgtttgttgattaatacaacaccattggtgtattgcgttccgtgacgcatggctttgttgtcaggacccgctggaatcttgatcggcttccacacggcacccggcgcatttttgactgtatcctgaagcggccagccgctcatccaatatggtccaggaatcataccggctgttcctgcgactgtaggttctgccgttttattttcatcccacaatgctgcttcctgaggaatatatccctttttgagccactcgctcagcttttgcaaacccggcttcatgccaggctgcacggagccatattccaaactgccatttgtacctttgttccactgctgaggtagagtgccatatgccccgaaaatccaagatgggtcacccatccaagtgttcatggatgttttgaaaccgatgctgagcggaatcactttgttcggagccagtccgtccggatttttatttttaaaggcatccatcactttttccagatcatccatcgtctcaggagccttcatacccagcttatccaaccaatcttgtcgtacccacaatacataatcatgattataggcgaaatcaagcacaggaatacccatttttttgccatctcggctatactgattccatacgtttgtatcctgattcatcgcctgcttccaggaatccgaagcgtacttgtcaaacaacggacccacctctgcaaacataccagaatcgatcatgtcttgtgccagttgctcattctccgtccccagtacaacaacgtccggcatctcctgaccggaggacatagccaaacgcagctttgtagcaaatgcgccattcgtatccgtgacggaccagagtgatttgatattaataccgaatttctctttagcccatttggtcgcaatgttattttcgatagattcaccatttttaaattttaaggcgggatctacaccccataccgtggaaattgtgacttctggattgtatttttctttgtatacgttttcagttttagctgtgctgtccgcatttccatcattccccgtacctgagcagcccacaaggcccactcctaataccatagttgcggcgagcaacgacaacagctttttcttcgaatgaactcgcatattgttccccctctaaaaatcattttctactcttttattataagagggcttttcttcacagcctatgtcacaaaataaatatttctgcacctttcccaactgatctttgctggtttcgtccttactggtcccatctttactggtcccgaaattcatgcggagtcattccgtaatgctttttgaacatcttactgaaatattggggattctggtagcctagttccgtcgtaatttcgtatatttttttgttggaatatttgagcaaataaagagcccgctccattctcattcggataatatagtcacccagaccttctccggtttcagctttataaattttagacagatagactggatgaagataaacctgatcagcaatcgtcttaacagacagctcctggcctttatcctgggagatgagctcctgaacctgcttgaccacatagcttttagcgctttgctcgcttgcggaccattcagatttaagtttgttcatcatggaaaatatccactctttgaggtgggggaacgaatgaaccattttctgcgcatgtaacggatcgaagcctacttgatccatctgcgtaatgaaacgtccttgtttgtgcgctgtatacataaaggcactcgtcaccgagataaacagctcatataaatgctcgcgtgtatatcccacctcttccatttttccaaatacacggctcactttcgcttcggcctcgtcccattgtctggattcaagcagatgagtaagcgtagggggcatatatagcccctccagtgacttaactgagctgtgtggctgttctgtctgttcttctatgaatagcagtgtatccgtctcctcctgatggttccagtataaggatctaatcgctgtctgatatagcttaggcagttcctctggaaacttaaaccatccggttaatgcaacgtaaatttcccctttcaagtaattgctcacattttttcgaaaggtctcaatcgccgcactcaaaaaacgattctgctcatccacactccgttcaggaaatgaattccaattcccttctattaatacaattaagcagtcatgcggcgctttgcaatgccaaacgtgaaaatcaggtgcgaacacttcttcggcaatatttccaatcgcatactcaattaaggagactgaatgatagtccatatcagaaaaatgctttcctagctgaataagcagcatactggcaggatgtcccgtgcgtagcttgatttcgtactcagacattttgctctctattttgggtactggtaaatcacgcccgagtagcaaatcatgcatcaaatgggtccgcagtacaccaaaatcgtttctgcggctatattgtaattgatgaaccttgtcaaatgcttcccattcttcctttagcgaatccatagcggctgacacacatttgataaactcatcatcatctaccggctttaaaatgtaatcaaaagccttaagctggagcgcttttttagcatattcaaaatcggcatagcctgtcagtaacaaacttcggatatgcggccatcgctcgtttacttcaacaatcaactccagtcccgtcataccaggcatacgaatatccgtaaccagaatatcaatatcgtacgcttccagcacatccactgctgctaatgcggaagccgcttgatgaaccctctcgatgcctagcgtctcccacggaatggtagctgccagactttctgttacataactctcatcatctactagtaatatctgaatcatctgttccctccgttttaactatattcgaatttggcgaaggctcaattaaaccattcgcatgctctccttctgttgagagcgaccattttaaaactgcacgcaatcctcccattggagacaaagagaattccagtcctgcatcttctccaaaatgtaatcgcatacgttgatgcacattccacaaaccgtatccatgatcctctcccacaggcttgtcaagcgttgatgtcagggcagttatagcctctctactcaaaccgagtccgttatcatccacaatcaggtacatatacgagccaacacgctcggttaaaatatggattacaccatcctccgcttgaggctctatcccatgcagcaccgcattttccaccagtggctgcactacaagcggcggaatcagcagactgctagcctgtgaagaaacatgaattaagaacgttagccttggcatacgcatctgctgtatgttcaaataatattgaacaaattcgacttcctctgacaatggaaccaaatcccgctcctgtctggttgtatatcgataatacctggataaattatgggccatggccacgaccgcctcatgattgcgcaacttcgccatacttgtaataaacgaaaaacaattataaaaaaaatgcggattgatttgtgactggagctgctttagtcgcgcttccttgacatgtagctgctcaacatacaccttctcaaacagctcctgaatctgttcgaccatcagattaaattgactagacaggaaagcaaactcgtgactcccccttagacttaatcgaacagcatagtctccatcctttagtctccgaaatgcccgcacaagctgaagaatcggcacttgtacctgtgaatgaagcaaataagcgccaatcaagcctaccagcagcgagccaacaacagttatataaaacaggcgattcgatgagtaaatcggagacatcatatcggacaaaggcatataatcaatcaaataccaccccgtcgtttgcgaaagaacggcatgaaccaggtagctttcttctccaattttcacggtcagattgtcaacttcatggagtcccattttttctaattttgaaatcagctgtccagacagctcttcattggcagtacgattatagatcgctcctacgccttttttataataaaaaggctcctttcgaccatcacctttgaagcggtcaagcatatcctgaatattactgctgtcaaattcaactttaataatcgtgttagcggtttctggattaccaagcgaagaaaacggggataatgtatacaatgaaaatataaattggtctttcccgtatgatctttttttggatacctgccagccgtcttttatcagctgatttagttttttctggtcatataaacctgctccattctccgatacaacccgtccaagcgaaggagaatagatactcagcccggttctccaattagaagagctttcctgaagcccaagcttggtttgaatccgtttgaccaggttaattccatccagattgagaaccttgtccttcaaaaaaatcgcttgaaaactggctacatcaggatcatgaatcagcagatgcggccaggaggaaatcatttcaatattcgtattcacctggttttgaaaaaaagtcagctgattataattagattgattcagctcctcacgtaatacacctgtcgttgtctgattagaatagacatacaggatcagcacaggtataagcaatacgataacgatggagacgattttagtataaaaattaaatttaaacatgcgttctacacatcctctgcacaaaaaacaggcatacttaaatggtatgccagagccctgaccttcgttgccgtcagtacatactatacattatcaatggttggcggtgataatatgtttgatgctaagcaaatggaatggtttgaccaactatccgctgaagacttggccattttaggtgccggcttcaatacactaggtgatttttttgattttctggcgttgattaaggccagacaggaaacagcccaaggtaataaaaagtaatagcactatttcacaacaaatttcacacgagttccatcctcatactcatccaattggtgactgacccatgatcctgccccacgattatccttaggggctatgtatttgatatttgcacctttaccaccttctgagcacatagccatcggccattcgtcacgatcgtatcctttacgagtgggaacacctgcaagcgaatgcttgcgattttgctcggctccttcacggtcaattgtgcataccggtgattttcccgcctgaatggcttccttaatatgctgcgccgtttcagggtaacgacctgacgggaattgcagcgtaacctgagccgatgaaggcgggttctctcctgtcattttcgtaagaagattgcctccttcaaaccagtacgcgcccaaagctagcagcactaaagctataaaacttagcaattttttcttcaatttccctcttcccttcaagctattccagtagataccttcaactaaggtaatccccggattttatttttttgtaaccccttactgactataaacaaaggttgaatattcgacgacaaatagtatagagaggaggttgtacgaatgaacgatgagatcaaactggccgtgagccaaatgcaagccgttataatccggttactgaatggaagtaccttaattggctggcctaagttcctatctgaccaagaaactcagcaattcaagctctacgatgacgaacacgtatatacgatttccgttaatgacgtggatacggtcgcaagagttattgtataagatacagggagcgacttaatgagacatccagtggacaagcccgaacaaagcacaccacaggagaagactgatcagaatcccccaaaataaacctttaaaaagcttcataccttactgacaacctttccgactgggctttttccccattataacatgtcagaaagacagctgtcgcagcttgctcttatatcatcttcgtatcatatatattaaattttaaaatcacgacacaaaggaaataacgaaataattccgaaaattatgcctaatcaccagtgaaaatgcaatcatgacataataaaagtcacattttaatcaaaatttaatgaaagttttccgaaaatgatgtataattattgacataataaaacgcacgaggtgatcatcatggcattattaaacagagttcatgaattaaaattgcaactgcctaacgagcatcatagcatttcccaatacgtggagcatgcattgcattcgattgacagttttgtggagcaacatcgtcaatttgtagccgctcaggctctatatggtgaaaaaatcaatggtacagaagaaagactgttccgagacacaatttctgagattaaagcccaactggtagctactttggaaaagacagttgaagacttcgcacacaaaggcgataagcactggaaaaatcattatcaggacggcgtagaataagctgaaaataacccccggtctttggaccgggggttattttgtataagtggatgtggcaatatgcgtagactattttaacactctagccgatgtcgctacagtcttaccaccatagactactttgatactggaacttccggtatcaatcgccttcacctgaccgccagtaacctgtacgatcgacggtttggaagatgtccataccgctgagcttgtcacattggtagttgggcctgaatcataaactgcattcacactaagcacttgagaggaacctttaggcagcttcaggtttttattgctcaataccagtttgagcagcttaggtgtgaccttgatctcaacgttaaacgacttatcctgatatgtgcccgtaatcgttgcgtttccaattccaacggctttaatggaagagccttttacgatcgctacggaagcattcgatgttgtccattttactttactgctcagcgtagcttttttaccttctgtatatatgccgatgactttgatggacttacttcctttcaaattcatatcagcactcgaaaagcttggtgtcaatgtagaaatggctccttccacaatgacaggtactttcacatatttgttcatatacatagccttaattccagagttaccgccattcaccgcttttactttaccatttgctactgtaactgcggctgttgtacctacccagcttacctgattggtaacatcaaggattccgccaccagccatgtgtgcttttactgtcggaatacttgcttcttggcctgcaaccaatacgtattttttctctgaagcggttagtttaagtactttgtattgcacagtcactggaatatccagtttgagtgcacctaccgttgctgtcaatgttgcactgcctgggttcactgcaactagcttaccatttgctattttaactgcactttcactgcttaagctccattttacatcggattgaactgctttttttgctccattgaccaaataagcagatatactcggaagagaagttttgcctcctgtttcgagagtcagactggctttgctcgaaaccagtttttcaaccgttggaagtacattaatcttcagagtcttgctcaaaccgtgataggacgctgtaatcgtcgaattgcctgcatccattggtgtgattttaccttgctcgactgtggcaaccagcggattggaggaagtccattctgccgtgttggttacatctgttttgccgccagtcaggttgacatcggttgcactaacctgaattggggagctacccagaaagaccgatttggccccagttgcactcaatactaacgcctgagaagaagaacgcacatacaccatcgtttgtgctttaagttcatctttgcttgctttaatgtaagtcacgcctttggcaagtggacgaacaagaccatcttcaacggtagcaacagccgcattcgaagaagtccattcgacaccggatacattttccgtcccacctccagtaagtacaccttgagcagtcaattgctttgattctccgccaatcgtcaaattaatgggattagacggatttaattgcagcttgctgtaaggcgattttactgtaatcgttgtacttaccgtttgcttctcatatgtggcaacaatcttaatctgcccttttgacacaggagtaatgagccccttatcaacctttaaaatgcttgaatccccagagatccattctgccttttgggtaacatcttctttgcccttttcagtcaatgaccacacttttaattgagcggggcttccacccagattcaatgtagtcggattttgactgtcccactgtaccgtggaggtcgtgctctcctcagcccggatcaaacccgctggccatgctgcaaatacaaacatcagcaaagcaagtaagaaggtactccgtttgctcatacgtttcatacgctccattcgtttctctcccttagtttcatctctataaaataggatagaattaacaatcccattacttttatcggttagcagctgactaaattgaacccttcatcaaaaaaaggtgaataattacagttaaagttctccacgcagtgaccttaccacaaacaaatgctcttctttagataaggtttgtccatcttcaaggattacattgtgtgccgagtgactaaccagctttacattataagcaatcagctgatcttctctccaaatcgtcaccgccgactgaaaatgaatggcattatcaaactgtaacggaacactcattacataaccgatagcgttgagcttcgccggatggcggcttctacgctcacgccccggaggaagcatggtaatatacgtaatattttcaaaaggaatagccagcattttcgggcctaaaataacgcactttcgtatatcatcccatttttcaagcgtgccgcgcaccttctgggtatgatcgttgttgccgtgatataaaatgacctgacgtcccttccattgacgcatgtcctcacctccagtgctagcggttaggaatctcccaccgaatcggctccattccatgctcctgcaaaaatgcattggtacgcgaaaaaggcttgctgccaaaaaagcctctgtgagccgccaatggactcggatgaacggatttcagcaccaaatgcttgctggtattcacgaagcttgcttttttctgagcatggctcccccacaaaataaacactgctggctgctcgcgctcattaatcgcttcaatgacagcatccgtgaaacgttcccaacctattccctggtgagattgcggttgtccttcacgtacggttaacacgttgtttagcagcagcacaccttgctcagcccaaggaacgaggtatccctgattcggaatgggagtaccgatatcatcgcgaagctccttatatatatttagtagagatggcggtgttcgcacaccaggtctaacagaaaagctcaaaccgtgagcttgtccctctccatgatatggatcctgtcccaatataaccgctttggtcagatgaaatggcgttaatttaagtgcggaaaacaagtcttcttttggaggatataccttatgtaacttgtactctcgggctaacgtatactttaattcattaaagtatggcttttcgacctcttctcgtagtacatcatcccagtcattcccaaacatacccctgtctcctctcaatatgtagatctgtgaaaacggtaagctttttgatccaaaaaaataagctgaactcctcatccggagccagcttatttattcgttacctgtgttatatgccgaaggaccaggaaaatatccttacggtaatcagctaccgcaggtctaaattcgatttccttattataacattaacgataatgatgtcaagtaactgaaagcttaattccctcagaagaaaagctctttattgctgtatttattacgattttgtatgagcattcaggtattccaatgcattatataacataacagcagcttcggcacgtgtaatctctttttttggatgaaacttttcatttgcatccaaggtattgaccttgtagactagcgagcgttgaatgctaccttggtaagaaggctccagttcgctgtcatccgcaatattcgcaggtgcaattttaatcatgggaagaacgcctgctttttccatgccctgaatcagcatgtgggtgaactcttccttggtcagcgctttggcaggatcgatatcttttggaatgtctacgccattataatgcgcgttgataaaggcttcggcataccatgcagtatccttaacatgggtaaacagtccgctggcctgtggtgccttattaaaatcaatcgcggccaaactgagctggagtccgccggagatcaactgaatgccttgggcagcggtcactttagatgacgggagaaactgcgtgtcagagacacctttgagtagaccctgatctttaagggatatgattttttctttgccgcttacgttgttcaaatccttgaattgactgtctgccgcagacaattgacttccaaaggagaaggacaaaatggctacggttgtaatggctgcgaatgcactttttctcatactcatgttaagttccaccttgtagttgaattaggccgcttggccattaacaacttcattgacgtagtataagttggaaaggttgcaggcagacgctgttgcctcttacgctgtatgccttcaattttaatataatactttctctagacagcgtgccaattcatcatcgggaaggggcttgcgatgcgtattctctaggtagatatatttctctgtttctggcatcaaatattgtttggaccacaggaacatatccggactgtctccctgaagacgaagaaatctccgcacagtgtccgcatgagaaatagtgttatctagattggttaaccaatctgcccggtagaaatgctcccatcttccagttcctgcgagcgataaagcttctttacccattcggtagctccaaacggcatgagaagcttgtataaatgctcgtggataatctttttcaaggaacagcccataagcgctacataagcttgccagtccacgtgagccacttagatgcagttcaatctgcacaagcagttgattatacagcctgcgacattcatcttttgacaactgcttcatgattcgtagacaccgctctcgcaattcaacccagtccgggattgccgactcggctttttccttgaaccagcgtacctgttcaggaaaaggcctttctccagtagcccagtacagccgttcatcactgctttctttgccttgcagccaataccccataatttgccgagctggatggtgatagaattcctcccctgctcgatcatccttgtgcgggccataaacgatcgtacaacgggaataatcccggtataattgggaaatctcttgaagctgactactgtacagccgcccgacaaaatcagtaagctgatcttcagcatccacttcacccttcgtccataaatttgctactaaatccagcgtatatacatgtggcaaaatattacctgaattgaccagcaggtactcgtccgcccctgaagtaaacgctgctgttaattcctctacaatcaagctggctgaggagggaaattgggtaagatggttcgacgcttgcaagtcgtggaaggtcacatggtaatatactccattcttgcccccatcctgcgcctcaggcaatgctggtacacgataattaagattcccatggcgtcgagataccattttaccgtaaccattgtccgcccatattttgatcaccccttcgggtacttcaatatgcccctgcttgtataactcggcaatctcaccatacatcgccatgcagcacacgggatgctccacaaattcacagatcatattgtactgcttgcgaaccacatatgagattaattgtccacgtttgtccggcgtattaaaggaaggatcatcttcccaaaaaggcttgtcaccctgcccgcgaaaagataatacccatacaatcttctcttccttttgccgttcaatcgcttcctgccacagctgttcaaacaactcgggatgctctctgtagctagcttgtttacccggaaaggcgcgcaaaaacatctccgcccccaacggttcagcatgatgatgtgtgatccataagcccatgtctgctgcaagcttatgatggatacctgtgcgtggtaaatcggttccgggaatcaccatatttccaccacagcgcagtaacgcttcaaaaacgggctgccacacctgctcagtcggtggataatcattcttccagccaatcaagcatacctcatcattgacaaaccatccccgatatcggaccttggacggtatactgtcaacattctgactcggcaaaactatggtatcccgcttaggcggtagaatctccgcccagaaccagaacggctccacacctagagcgaaacggctgtaatgaagcagtccataaataatccctaattcatcacggccaataatatggagtaccgttcccttgctaccagcaacaaaacgcagacaatagccctctggccaatgcgggcagctatctccttcctgcgcataacggataatgatcgagggctctacttctgttagcaatggctcgcagccaaacacttgcttatgatctcgcgcaatcatattccaagcgtgggcaatgggcacacttctatcagcttgaagattgtatccgctttcagatgaaatagtcagaggttcacaggctttcatttattgtcatctcctattttttcagctatgaggattcttcttgtctttattttataagttgtcaacatacatataaagctttaccaacgtaaatatagctttttttcggtaaatcatttgagagttgaagcttcatttgagaaagaaaaaagtaaggaacaggagagaaataagaaagacttgactgctacactaaaaatgttccaaaaaacagactgctcttaaagattcaagcgcagcaaaaaggagacttaatatgaaattgaaaaaacgatttgcctctttgttcctgttggcattgatggcatttatcccggtccaggcatatgcttctgggtccgtcccaaccactccctctggaattccgatttccgaaatcgaaaacagaacagatcaaattatgaaaaaatatataggaacagcgattcctggtgctgcggtttccatagtaaaggacggaaaaattgttttttcaaaaggttacggatacgcaaacatcgagaaacaaacacccatgagtacggaaacaacctatatggaggccggttccgtatcgaaattgttcacctggacggcagtaatgcaattggttgagcaaggaaagctggatttgaatacggacatccgcacatacttgcctaacggctttctcaagccttcttttgataagcctattaccctgaaatcactgatgagccacacggcaggttttgaggagcgcctggaaaaacttttggttcatgatcctgctgatcttaggcctctcaaggagcatatcgcacccggaaatcagcctcagcagatttatgagcctggaacagtgattgcttattccaactatgggaccaacctggccggttatattatagaacgtgtatctggaatgccttttgaaacctatattcagagacatatatttgagcctctagacatgaaacattcttactttacacaacggtatgatcttatcccagaggttatcgaacataaagcaacaggctactccaagaaggatggaaactgggtggcaaagccgaatgttttctttaatgatgtgccggctggtgcgttaaacattacttcggaagacatggctcattttatgcttgctcatctgaacatggaccattccttaaaatattcgctgttcaacatgaatgaaaccttgcgagaaatgcatgaggcttcgtatacccactatcccgagcttccggggaatgcccacggcttttgggaacggtttgcgggaggctatcgtgttatcgagcacggtggaaatacagattcattctcctctctggtctctatcgtgccagatcaaaactttgggatcagtattctgactaatgtggaaaatgaaatgtccggggcgagaagcgaactcattgacctgtttgtcggggggtcccacgctactccgcaagcggacagcacgttgaagcatagcgcggatgtggagggaaaataccgttctgctcgcgcagtatcatctggtatattgaagcttatacccgtattatccaatgcggaagaagtggtcacagccaacggccatggcggaatcactctgagtattccatccatgaatattaatgttgattatgtagaaaccaaaccctatttttttgaacgtgtgactcccgggagcactccttatgatcatgcgggcctaaatatcagccgtctttttttcttaaccaatgccgatggtaaagtgacgcagttgtcatatggagtgatcgatgaccaattgccgatatccttcctgcaaacatccattttcagttatattctggtcgggggatgtggtatttggtttgcgcttgggtctattttcggtattattggatggctgcggaagctcaaggacgcaagaaagcagaagagtacttcgcggcttcccttgcctgacagtgtaaccgtaatccccttgctgggtctgcttgtgatcgtcaatctcattgcttcaagcatccaattgatagacgacccctatcagcctatgtccaatttcaatttgaatattatctttttctgggtactggggcttgcctttgtatcggccgcctatcttgctgtaagaagatgcagtgttacccaaactacattgttaagaaaggtatacaccgcgacgctgattctttcgtttctagctatttcgattttcctgtattcctataatttctactttttggtatagctccactcgataagcctgcataccttccagtgtaccgataaagattgtcatcgtgaacaaccctaatctgagctaaataaaaaaactctcctctgcatctagcagggagagtttttaacacactcaatgagatttaaatacgtgccggattgagcctttgctttcagtatgttgttgaatctgtttattctgtttctggctgagtatttaccaattttatatgaacatctctcaattgtttctcagtaacctccgaaggtgctcccattaatatatcctgcgctttgctattcattggaaaagcaataacctcgcggatattcgattcatttgcaatgatcataacaatcctatcaattccaggtgctatacctgcatgaggcggcggcccaaattgaaaagcattaaagagtgcaggaaatttactcttgatgtctccatatgtataacctgcaatctcaaaggcttttaccataatctccgtatcatgattccggacagcacccgaggacagttcaatcccattacatacaatatcatattggtacgcaaggatatcaagaggattcatattcagcagcgcatccataccaccttgtggcatcgaaaaaggattatggctaaatccaattttatgagtatcaggatccaattcaaacataggaaaatcaactacccagcaaaatttatatatatccttttccagcaaatccagtctttttcctaattgatttctgacagcaccggctattttttctacatttttaagttggtcagcagcaaaaaacagtgcatatcctgaactagcttgcgtaacatgtattaattggtttttcacctcttcagagatgaattttgcaatagagccactaagagacatatcatcattgaacttaatccatgagaggcctttcgctccagcctcaacagcaaagtttactatatcgtcataaaagcttcttggctgtgctccacaaccaggaacagcaataactcttatcgttttattttcaaatactttaaaatcagtctctgtaaacagctctgtaacatcatggataattaatggattccttaaatcaggtttatcgctcccgtatttgagcatggcttcttgatatggaatcctgctaaaaggctttgagattttaaaatttgtaaattcagagaaaacttcatatagcatattttcaactacattaaagacatcttcctgtgttgcgaaagccatttccaaatccagctgataaaactcgcctggtgatctgtctgcccttgcatcctcatctctaaagcaaggagcaatttgaaaatatttatcaaagcccgaaaccattaataattgtttaaattgttgaggtgcttgaggcaaggcataaaattgacctggatgcactctactaggaactaaatagtccctggcgccttctggagatgaacttgtcaggataggtgtctgaatctctaaaaaattcaaatcgatcatctttcttctgatactttgaattactttagaacgaagtataatattattgtgtagtttttcattccgcagatccaagaaacgatactttaatcttaaatcctcccgagcttcatttgctaaagttacttcaaaaggtaatggattcactaccttccctaaaacttttatctcattggcagctaactcaatatgcccggttttcatagtgggactaatcgtattttcagatctgttacatacagtacctgtaacagaaatggttgactccctgctgagctttgatacaaaatctttcaattcgttattatcagaaacaacaacctgcgttactccataatggtccctaaggtcaataaaaataaccccgccatggtcacgcatattttttatccatcctgcaattctcactacttcgccgacatgtttttgatccagttctccacagttatgagtcctataactatgcatgaaaaacctcactttcttttatcccctattatcttaataatttctatttttctccacacttatactcacattatcgttaaagctttatacctttcattcaggtattccgcagtttcaaccattattttttgtcctatttcatcaacatgcctgttcttccaattttcaaagactgttcccttgacccattggttaaaagcgccaagggctggtccgcagtgtacttgataatcaaccttactgtgtttgtctccattcattgcaagtcgtgtagaataagtaaagtaccatctaaatatcaacgccatcttacgtttaggaattctttcagctttttcaatgatctcagccgggtaataagctttaatatcttcatatacttgttcaatactcttcttaaaatacttttcttcaatatattttttggttccgctatcaatttcatctatggagttataattacggtaaagatcatataatttattcgccctggccgggaaaaaaactccttttttcataacctgaattttcgctcctatttcaaacatatcccctgcgggagcgtagtctgtatcctgtatatttaactgctggagcaaatcttttacatcatcacttgtccctgcttcaaccgtacattggttgattgatcctgtcatgataaaatccgcacccagtataaacgctgccgcagctgcttgtggagtccctatccccccggctgcccctacccttatacttttattgtatttatacttaagtaacgcttcatccctcattttaagcatcaacggaaccagtacatatgcaaccgcatgatccgtatgcccgcctgaatcagcctcgacgcacagatcgtctaccacagggatttccatggccatccgggcctcatcccggcttatcctactttcctctagcagtttattcacgatattctgaggcgcaggactcaagaatgcctccacaacctcgggtcttgatactttcgctataatcctgttctgcgctgttacgatccccttttcatctcgtttcaaacctttcaatctgtaccttaccaaagaaggcgttatactcataaacgcagaggcttcaatagttctaacaccgtattttatgtataaatcaacgatgttattttctatttccaggtgatcgggaacatgaataagattcattccataggcttcgccttggttcaattctttctgaatatactttatagcttcttcaagggcccccattttgactccccctgccccaaagaatcccatcattcctgccttacctgcctttacgaccatctcttttgaagatattcccttatacatcgaacccataagatacgcgtatttaagtccataatattgtttgaattcgctatgaccaagagactctgccgtaaatcgttggccggatatactattcttcgactttacttcctgtacctgctcgctacgttcttcaccctccctcacaatcagcggttctgcttctcgttgtattgcgttaaccaaccctgttatgacttttccaggtccaacctggatgaattgggttacatttttacccattagatatcttatactttccgaccatttgaccggacttacgatctggttgatcagcgtacttcttacatcttgctgcctgtagggtctggcatagatatttgaaatgactggtatttttaattttgagaattcgaactgtgacgcataggcctcaaatctctgtctggcatcttccaaatacctggagtgaaatgctccgcttacatttaaaatcacatagtttgtggctcctgcatcctcaaaaattggctgcgcccgttcaatcatttccttcggtcctgagatgacaatctgacttggcgaattaaaattggcaacatcaatctcccttaaattatttttctcgataacttctctaaatacttcctccttcaagcctatgaccgctgccataccaccaccggtagccttgaccatcagctctcctctttttttaaccagcttcaagcccgtttcaaagtcaaatgcctctgcggcaaataaggcattgtattcacccaggctatgtcctgcaacataatcgggttttcttccagtctcttttaatgtattaagataactcaaagcgtttacgacaaatagcgccggttgggtaaaatccgtttgtcctagttgattggcaggatcttcaagacacagttttttaatagaataaccaagaatagcatccgcttttgcaaccaattcctgaaattcgtcaaatagttctactcccatgcctttggcttgagccccttgtccagggaacagatatgcgatcatttgtgtcctcctttttgctagtgaatgcatattagtcgaatatttcaaatagacgatccaaatttttcatatcgttttgaaaaggcgaaagaatagaacaaatacttgccattttcttgctaccaaaattgtacttcacaaaattagcaagagtgcctgagggtccaaggtcaatatagataatcccgtccccgtctcccagacattttaaagcgttccgaaaacggataggttttctagcaacatcccaaagaaaacggttgtcaagggatgttgccttgcctccgtacatagatgagaccaaatttatggtcggattccttagagttttaagctttaaaaacgctgtatattccaaggctatagggtccattaaggaagagtgaaaagcaaactggaccggcagtctttgacaaataatctcattagctatcaagtagcgttcaattttttccagttcctcacatctgcccgaaatgacaaaatgcgagtcataattgattgatgctaactctgagttggcattcaatacggatatttggtcatacagactgaggtcgccaattacggccagcatgccaccctttggacagtagttttctaccatttgtgcttgcttgacaaggctttgaagagtatcttcataactcatacagccagccacagcaacagatgcaaactcaccgaggctggaacccaaaacataatcaggataaatccccttttccagtaatacctgtgtgagggcatactccaccatgaaaattgcagggtgagtatataagaggctatcaaacacgtcccccctcccacggttgtcgtcgtacagcatttttaatacggacctgcctgtaatatccgtatgaatctcatccagcttggtcatccatttccgaaaaactgaatttaacctatataattctcttcccatgccgtagtattgtgagccttggcctgaaaacataaaaatcacagatctgtccattctaacctcccacaacatactcattaataaaatcctaataaaaccatttaaaataaatatttcacagtaaattgcgaactaattgcatttgggaaggtgtaggattgctttcgttaagaacattctccatatgttgtcttattgcaggtttgaatttcggctctgttatgatatatagctgcccttttttgattccctcaaacatctgatttgctacatcctctggaagtattccattctggacagccttacgggccaattgattaatgacttgtctttccgggggaagatttcctagtccggtctgcttactcagctccgtcggtcggttccgttccgcatccataatttgggtacgtacgaacccagggcagacaactgaaactcctacattggaacctatcaatctgagttcttggtgtagcgtttcagacaagcttaaaacggcatgttttgacgcgctatatattccattaccggggccggacaatagtccggcgatggatgctgtattcacaatatgacatgcggttttctgtttcagcataataggaacaaaaacttcagttgcaaagagaatcccccatatgtttacgtttattacccactgccaatctgccaccgtattttcccacaataagcagcccgtgccggcgtccacccctgcattgttgaacaaaagatgcacagctccaaatgtctgaaccgttttttgcgctaatgcacgtatatcagcttctttggaaatatccgtcactacggataacgtttctgcgcccatgtctttcaattgtttttcggcccttagaagggcctcctcctcaatgtccgcgaggacgaccttcatgccctcatttacacatcggtccgcaatagcgcggccaatcccactggcagctcctgtaactacggctatcttatctttaaattccctcatgatttacctccagaataatttgtaatttctatctgatagtgatcggtttcctgtttatgtttaaaactgggttatcggtaggggaatcctgcggacatctttatcctcatggagtgcctcccatgaaatcctgcccccctgggtccaatacatcgctatattttccatgtttttctcctctagcagcaattgagaaacggtctctcctattttccctgagagaagcgcactcgtgtttgagtcttctacgctttctcctataaataaaggaatagattccccttcggatccgttgccgctatcagctatttcgagaagttccctaagacccgtgagtagatcctgccgcgtactcgctacgattgccgcccgccatgtcatcgcttcgcgacctgtctgaagtgtaaaggcaatatcttgtaaggcatcatcgctctgctgctccagatatcccagtaattgattggcaagcgccatcagtctctcccggtttatgtccgagagaatcaccacttcgggctgatctgccactcgtaaatgaatgttgtctttttctgaagggatatattcttccagaatgaaatgcacattagagcctcccgcaccaaaggagcttacggttgcccgcaacgggaattcccgtttttctccctgcatctcaattacaggccgctcccattcctgaacttcccgctgcaaataaaatggagtattactgaaattaatattagggttaagcttctcggccttaatggtaggaaccagttttcgatgccataattgcaatatgaccttggttagctgtgatatccccgaagccgcttctgcatgccctatattggatttgactgagccaatggcacaaaattgctgctcggtcgtgaatttctggaatgctttattcaaagcagcgagttcaatagggtctcccaatgtagacccatttgcggctgcctctacataactgatcgtccgggggtctataccggctttcaaaaagttttcttcgactagttgcgcctgcgcattggggttagggattgtatatccattgctatgtcccccatgattggttgccgtggatttaataaccgctaaaatgcaatctccatcctgtacagccttatgaagcggttttaagagtaccgctccaactccttccgctggaaggtacccatccccatctgcaaagcttctgctatcttcatgacttccaatcaactgattttgactggattcaatatattttttgggactggtcaatagattccccccgccagctaccgctatttgacactctcccctgatcaggctttcacatgccatatggacagctacagctgaggaagagctcatcgtatcaatggatatgctcggtccctggaaattgaaataatgcgacatggggtttgcgactgcaacagacccaaatgatgttacccgttgagcagagtccggttcgatatcacaggagcagtatttgtgatacgtagcgcccacatagacgccaaccttgttctggtgtttcttctgtaatgcctctcgcgtatatcctgcactttcaagcaaattccatattatccccaggaagagttgctccatcgggtccattaaactgatctcatagggggtgagatgaaagaatgctggctctgacaggcttattcgttccatgaaaccgccccacttgcagtaggtttttcccgccttgtttctctccttgtcaaaataaagatcatgctcccaacgatcttttggaacttcggtaatgcagtccttgctttcttggagattgctccagaactcctgaagattttccgcacctggatatttcccggacatcccgataacagcaatgtccatcgctcctgtttcttgtttcttctcctccggaggctctacctcggttgccgaaaattggagatgacggaatatcggagaaggggcttttacctgctccataccaaaccattcaatcaattcgcctcgatgcgattccaggaaatattctattaaactctggatattcggatattcaaaaagtaaggtcctcgatagaggtccgaagtttttttccaactcatcggttaattccattgactttatggagtcaacaccatagttttccagatttttgtcctcttcaatgcgatgttccggcagtccagtggacgaagagagcaggcgctttaggtaacttgtcattttttcacgcagtagctcttcttcctggctggacactgccttatttgttatagaagttgtgtcggcttttgcacccgcagctgctgcctgatctatgccaaacaaagcgatcaattggtctcgataggcttccataaaatattccgtcaaactccgaatatctggatattcaaaaaatagagtcctcgacacctgatcgaatgttttctccagttggtcggtcaactccatagactttatagagtcaaccccataattctcaaaaggtgtattctcttcgattcgatatattggcagttcgatggacgatgaaagcagggtcttcaagtaatgaaccgtcttttcacgcagcaggtcctctgcactgccggacacttccttgtttgctgcaaaagttgtgtcagctttcgcgcctgccaccgctacctgatctatgccaaacaaagcaatcaattggtctcgataggcttctacaaaatattccgttaaactccggatatccggatattcaaaaaatagagtcctcgatacctgatcgaatgttttctccagctggtcggtcaactccatagactttatagaatcaaccccataattatcaaaaggtgcatcctcttcgattcgatatacgggcaggccgatggacgatgaaagcagggtcttcaagtaatggaccgtcttttcacgcaacacgtctccttcacggccggactctgtcttgtttgctgtggaggaaacgatgtatgcttcagcttctgatccgagcgcctgatcccgggatgctttgccgctttcttcaagctgtccctccatgatcatcatgttgctgattagctctacgtctccttcgatcaccatgacctgatccgaaatacaggctatgctttggtacagggcgctcattcctgtctctgtcctcatcgcatacatacccaccttctgcatggccttctccgtctcttggtcagggcgcattccgccatctttccataacggccaattgatggacagcgttttgcctgtacgctccatggaggataccaaggtattgcggtaccaggcatatgcgtccataaaagcattcgcggcagcatagtcagactgacctgcattaccacccactcccgtacctgacgaaaacaggataaagaagtcaagagcaatgtccttactggcttggtccagatttaccagtcccgcaaccttgggcgccagtactgtcctgaattccaggctagtctttttaataatgtagttatcctggattattccagcactgtgtaggatgccgttgattccgccgtatgtctgtttgatatcttcaattaagccaaccacagcttccttccgcgtgacatccacctgtctgtattccacccgggcgtccaataccttcaattcctccaatgaggtctgcttgtcctggtccagtagggaacgtccactaagaatcaaaatcgcttccttggcctgacgcgcaatctctttagcaaaaataagacctaaaccctttgctcctccagtaatcaaataaaccccgcggtctttccatggaatatccggtgtctctgacggcatttctgctttactccagacaggaatccaacgtttgccttctgcaaaccggatacggctatccgcaggatgtcggctgcttgtctttagtatttcgatgagccctgccattttttctgtaccctcaacttcaattaactgaccatggatctttggattttccttttgcgcagttttgagtatgccgcacagcccagcgaagagcagcttttcatgttgaggcatcgttacaatctgcaccagcaccttgcctttgggtttatcattcaggatactttttattttttcaaaaacctggacagcatacatttcgaagcggcgatcgatctcttccataccggattgcagagtgatacattccactcctgccaaggagaactcgatatctcctgcagcaatggtatctatttcgcaaagcattactacatgtcgttcgtaaatgggaaccatcgggtcctccgcaacaaccgcctgttctttccagaagggttggagcatcattgcaccatgtgttttcacacatgcgcccactaccttgtaggaacatccttttatgcgcacgcagacctggcctgcctcatcacacaaatcaatgtcatacttctgcgtattatgaccagccccgcttcctctgctataccggatcaacgcccacatttcacagggacattcccgaaatatttcgattccctcaatcgcagtcggccgtattttctgtagaggatcaatgcctgaaggccgcatgatattttcatcattcgaaaacaagtatgccggcggcatttgcaaagcagcgtttattataaagggatgcaaaacaaataagccctcagtattcctaataccggaaggcaacgatagcttggccagcactaacccctgtcctatatgcacttgttcattgccctgatgtcccagactgtcgccggctcccatgtcccacactgcttcgtcgtctatcccaggcgaaacatgctgaaagcattccttctgcaaagcttgcatatcccacgtttccgcttcatttaacatctccaattcggcactaccctggctgtgtaagacagggtccccggcttctgttaatctgctgtagattttgaagccaatcgttccttgatctcccggaaagagccctatatgtatttctaacggctgatctcctatagcgggagcatgtgtccatacaatatctttaataatgatgtttgcctgtcccttctcctgtactgttaacgactgctcaaccgctgcccgcaccatttcaaggcatgccgcttctgacaggacaagctttccgtcaattacggagtttttcagataaaactcctggccgctaaaggttgaactaaatctttgctcagaaagtacggaggtgttttgatgcagtaatggatgtagatgtgcaaccgcattgacgacaggcttttcttcatctaaatgtatccaatagcgttctctggcaaaaggatatgtgggtaaagggatacggcggggctggacattaccgtaaagtctgctccagtcaatacggacacccttgacccacaagtctgagattctgccatacttttctgctagaatctgtaaatcaatcgttttatcgagcgttttctcctctgaggccatgtacaagctctccttgtctcgcttggcctgtccccggtaaagctgtgcaatactctgtcttcctccaataaagccccgcaacttgcttctaagttcctccactgaatcaacgaccacagcgaggcgttcttccatcgcctcacgtcctgtctgcaaggtataagccacattcaccagatcgtgatcggaaaactcattccgatccattgcagcaaccaattggcttacctgctccttcaatgctccatcactttttgccgacagaactacgacgactggtcttggaggagtaaaggcattttgaaagtcatcctgttccgcagggaggtattcctcaaggacgatatgggcattagccccaccggctccaaaggaagatatcccggcgatcctcgggtattcccgttgctcgccgtcctcctccactatcggacgctcccattcagaaagcccctgttggactacaaatggcgttttggaaaagtttatattagggttcagtttttgggaatgcagactaggggcaattttccggtttttcatttgcaagatgattttagcgatgcctgcaatccctgcggccgcctctaaatggcctatgtttgattttaccgagccaatagcgcaaaaccccgtgtcctgcgtatctttcttaaatgcctgggtaagcccggtgatttcaataggatcgccgagctccgttccagtaccgtgggcctcaatataactgactgcccgggcatttacgcctgctttatcaaaagcctctctaatcagttcaccctgtgctaccgggttaggcacggtatacccgtttgtttttcctccatggttgatacgggttccccgaataaccgcatagatatggtccttgtctgcaatggctcgtgataaaggtttgagcagcacgacccctgcaccttcgccagggacaaatccattcccgccttccccaaagcttttacaccgtccctcaggcgatagcattctcatcgtactgagaaagatatagcttgaaggatgaagatataagttgactcctccagcaacagccatttcgcattcaccgttaaagatatgctcacaggcctcgtggattgcagttaatgaggaagagcacatggtatcaaccgggatactgggcccctttaagttcaagaaataggatattctgttggctaccgagctgaaggaggttcgcggaaagacgggttgtccttgttcccacagctttggtccatatagattgaaccccgttccggtaattcctgcaaagacgccaatccggccattatactgttcggcgagctgttctctgctatatcctgcatcctcgaaaaccttccagcattcttccaggaatattcgctcctgaggatccatactcattgcttcccggggagatatattaaagaagagaggatcaaaatctgcaaaatcctccacgaatcctccatatttactatagcttttgcccttctcaaccgcttctttgatgtcggaacagtagaaaccttccctcttccagcgttccgcaggaatttctgttatacagtctttgccctgttccagattactccagtactcttccatatttttggcctgcggatatcgtccgcttataccaataatggctatttgctcgtgtttcacacggtctctgctagtagccgtgttgcagatacgattgttttcttcctttggcaggggtgacaaagaaaactcgctggcagcatgcaaggttgcggaaatggagacggatttctcttccgtctttatcgggcttccgattcctgtccaccgtacgcattccttgtgataatcagcaataaaatattcggccactgcttccaacgtctgatattcataaaacaaggtcattgatatttctccaaaaatcccctgcagcttttgattaagccttgtaatcatgatggagtctatgccatagctctccaaaggctcgctgacatcaatcttgtcaatgctcagcttggtaacttctccaaacaacagttttagctgatgtaaggttttttccagaagcagttcaagattcacctctgaagaagctgactcttcaacatattctttctcctgcggttgggactccaagaaatacttttgcaatctggattgctcaccttctatgaccaataactgatttagaccagcggccagaccgttatatagagcctggataccgtttgaagcttgcatagctaccatgccaatactttgccaagccctctccgtgtcattgtccacatgcatccctccgtccttccagagaggccaattgacagatagcgtctgccctttgcgctcctttgaggatacaaggctgtttcgatacgcggcataggcatccataaaggcatttgcggcagaatagtcggcttgaccggggttgcccataatcccagctattgaggagaagagaataaagaaatcaagatgtagctccttggtcgcctgatctaagttcaccagtccggcaacctttggtgccattacttccgcgaactcttcctgtgtcttattcataataaaacgatcctgtattactccagcactatgaagaataccatcaaggcctccatactcttccctgatctcaaggatcaatttggagacctcttccttccgtgcaacatctacctgtctgtactcaacgcgggcccccagcgccttcaacctctccaatatcgcctgtctaccttcgtccagatttgaacggcctacaagaactagcgtggcttccctgactcgctgcgcgatatcctccgcaaaaataagtcctaaacctcgtgcaccgcctgtaatcaaataagtcccccgatccttccagggcactctgcccattgtctcggtgggtttcatctcgttccagccgaggaccagacgtttgccatcctcataccgtatccttttatcctttggatattgactgttctcttttaatttctcaatcatctcttccaaacctacagattccaattctacgaattgccctacgattttcgggttttctttctcagctgtctgcagtaatcccaacagtcctgcgaaaggttgctgcgcgctttgtgcggaaactgcaatctgtatcagtacgctacccttggattcctctgtgagaaccatttgtacttccgtgagcagctggagggcatacgtctgaaagcgttcatccatgctgctttggctggcatgcagcttgatgcaacgggttcctttcatgagcgattcaatgctgctctctgcgaaatgatccagttcgcaaagtaccaccagatgctggctaaattcagggcgtgccactttctggagagcaacttgctctttccagaaaggctcaagcataaggactcccgtacccgccaatgaccccgaagtccttgttccgctttgcggggtctcatgcgaagccattcgagcttgaaattggcgtatttttacaatggcatcctctttctgtatccgtccgctttttacctcgcctagaatatattgaaaaaagtccttcatcttctattgcctcccagcacgtagaaacttctcatttacgtatacttatattgaggatttcactggcagcctcatcaacagacagggtatcgttcatcatttcatccaagagtctgccgcacaatatatcatcaaagtctacatcgctctcaccttgcgaaaataatgtataggcttttacttgatccttgctttcagaagtccagtaatgctctttagcaaaagggtaggtaggcaggctgatacggtgaggcatcttccctgtgtaaagttttttccaatccaaatttatccctttggcccacagctccaaaagcttggtatatttctttttggaaatccaaagatcgatcatttgttgcaagtcttcgtcccccgaaaaaatagacaacgattctctgttgcgtttagcctgtcccctatataggttgagcatgttatgacgtccatccacaaaactctttaatttttcctcaagctctgcggtagattccacaagtacggctaaacgctcctccatcgcctcgcgtcccacctgaagcgtgtaagcaatatccgataggcttgcggaggatagctgaccctgaagagcattcagtagctgccgtcccttttccttaagctgctcctcgctcttggctgacaatacgatcatagcaggtccctgagagtcagattctgttccagactgttcctgatactcgggaatatactcttcaatcacgatatgggcgtttgccccgcctgcaccaaaagacgatattccagcccgtcttggatattcttttgtgattccatcgcttgtaattaccggtctcttccattcctccaggctttgctgaacgataaatggagtattgttgaaattaatttcagggttcaacttcctggaatgtaaggatggtactagctggctgtgcttaagctgcaacaatattttagtcactcctgcaatgcctgctgcactctcacaatggcctatattcgatttgaccgcccctatggcgcagaactgcttatcctttgtgaatttttcgaaagcccttgtcaatcctgcaatttcaataggatctcccagagctgtaccggttccgtgggcttcaatataactaactgtccttgcatcgacatccgcacgctggagcgcttcttcaatcaaccaggattgagcttgagggctaggtactgtataaccgctggttttacctgaagcattaagcatgctccctttgataactccataaatatggtcgccatctgcaatggccttctccagcggcttcaatacaatcgcgccgacaccctctccgtcgacaaatccatctgcctggtctccgaatgacttacattcacccgttttagaaagcatcgtcatagccgacagcttgatatagtggataggatctacaattaagttgactcccccggcaatggcacactcgcttgtaccgctatacagactttccaaagccaaatggatcgccgtcaatgaggaagagcaagcggtatctaaggacatactcggaccttggaaatccaaatgataggaaacccggttcgagatggaattatattgaggtcccaaaccgtaatttccgttcataacgcctgcaaatacaccgactcttctactctcacaaagattggcaggggtatacccagcatcctctatgcttgcatatgccgcttccaggaacagtctttcctgcgggtccattgtttcggcttctgcgggagaaattttgaaaaatagcggatcgaataaatcaatgccttcgataaaaccacccgatttcgtatagattgtgccccttttccctttttcttggtcaaagtaggtcttccaatcccaacggtctttcggaatttcagttatgcaatttttaccttctcttagattgttccaatattcctctatattacgagctcccggatagcgtcctgacatcccaacaatcgcaacatccctgatattgaaggatcgtgtcgttggcttttccattgtgctgtcagaaggcttaaggaaacgccctccccggtcaaacctcattgggacagtagcgagtaattgcgaagcagggccctcttcaactctggaagtctcttcggtcaactcctgttccttcattcctaccagcttcttcaacgagtccttttgggtttgaagaaggtatgctactagatcatctatggtgttgtactcaaaaaacagcgtgctggcaaaatcctcgatgacttcacgcaaaacatttgtgatttgcactaccaatatcgagtcaattccatactcttccagggcaaccgttgagtcgatacttcccggttccatttttagcgtctcaccaagcaaatgtttaaagtacgccgtacttttttcacgcagcacatgttctacctctgcttgtgctacctctattttgggttgagttcgttgtttcactgataccgtttctacggttcttttctctatcaatattgatcttcgtttgtgctgtcgcttttgccgaaccaagccatcgctttgggctacaacaatctgctggccccaatcatgcgcctcttgcgccgggaagaacactgcatggaaaccttctttgtccaatacggtttcccatatttgagggtggagccctgggcatccaggaatacgccattccggatcctcatacgcccaccagccatctagcaatccgaaggtaaggtgggtaaacacgctactacctgtgatttcattgagcaggagcaagccgttgcttttcaaaaccgctttagcattacgtaacgcctgacggatgtcttttgcggtatgaagcacattagcggcaatgacaatatcatatttacccgtctcaataccttgcccggcaataggttcttcaacattaaaaatctgatagctgagatacggattatacggcccgtactctttttccgcgtgcatcaaaaaggctttggaaatatcggtatagcaatattcctgaatgtgtttgcgatatgggcgtaatttcaggaatagcgtagcactggtccctccggtgcccgcgccgatttccagaattctgatttccgcagcggcgtcggccataatcctctcctggatataagcggcagtagtatcggcaagtacctcattaaagtagtccacaaccagattattcttataaattccttccactagttccattgaggaattggggaagatgatttcggtcgcaggcgattttccggtaagcacttccggtaaagctcgtagcgttgtctcaaccaaattgacccttgctctcatctgcggatattgcagccaagtacgcttgcgctcttcccattcctgccagacatcatctcgatccgtcaagctggaatctctacctgataggtcgttatccatctgtgccaaaatctccatgctctcttttagccatttgccatatagctcaggaagtccgagtttatttttgaactcgtcgacagactgacgatctgtccctgataaccccatggacaagagctgctcctgcaacaacctgcgtaggagatgttccatctccctttcctggagatcgcccatatcgtccccggcataattttcgataaaatggcttcttgattgtattgctgtagcaatattttcctgtatatccctgagattcggagccgaattaggcgggtagagatcaatctcttccgtcggattagtcccttccatctccaggtgtgttgttgttttcataagccccatttggtcgatcggtgaggcaagaagcgtctcaagcgcctccatcccctcctgcgggtcaataagcccaacacctatttgcgccagtctggagtagttttctacctcctgccgtccagtttcggaggcattgttttcgccgctcccccagtatccccagttcatgaccttcaccggacaacgccattcctgcgaaagacgatgcgcaaacgcgtctttaaaggtacttccggcagcatagctactttgtcccggattctttacataggtaatcatggaagagaagaacaatacgaaatccaacggctcattttggaagacctgagccatgcgtacactgacatcaacctttgctgaaagccctgaccggagctcttcctccgtcaaatcttccaagcccttctccaaaaatgaaatggctgagtggactactccgtttatattggagtaccgctgttttatttcctcatatgcccgctgcagctccctttcgtctgctacatccgccgtgatatagcatggaacaggtcccaggccttcaaatccgtccagtttggcctggatagaggcatccttttgccttctgcctagccacaccgtctgggcctggtaggtacaggccatatacttgctccaagcctctccgatagtgccggcgcccccgatgaccacatagacgcctctggctttgtatagcgtctgtccttttaaacctgaagtctgtttgaatggaatcaattgctgccgataccattgcccatttctgaaaacccacatccgtccttgccggtccgaaggtagcgtaaatatatcggatagcggccagtcatcatcgaattgcaggtcaaggatacggattttccagttcggatattctttggccatggtgcctaccagcccatgaagacttgcgtgagtcgggttgactgtatcgttctgatccatcggctgagcttgattggttatcgttgtccagcctagctttttcgtcccgtatcccaataaaagcatcgctttgaccattctaaagaagagaaggactccctgctcctgttccttgatcatggattcagcagtcaccgattcgacggaagcacagggtgcaatccacagaatatggtcaacggctccatattcttctacctttgaggctactgtttcaatggaatcgtgcgcttgaagctccaagaaatgcgccctaggataatactcccggatggcctgtctgtctttgtcagcaccacctgcaatgaccaatcggtctgtcggtgagggggaaacgacatctttttttatagcagccgggtcccatttcgggatgagcattacagatcccacaagcgggtcggcggcactttctcctgccgctgcgccttgtgcattttcaatgccgatttctccgtccagcgcccgggtagataatcctgttattctgacgcaaatagttccttcctcgtcacacaagtcaatattaagcttctgtaccttgtcctctttcttgctgccctcgctgtattgaatcaacgaccacatggtcggggtgcatgccccataaatctcaatctcttggagggcaaacggcatatgaggcgtagatgctacagcgctacccggtagccctccgttctcttggcccatgattaacccgatggatgcatgcaaggccgaatccagcacgctggggtgaaggaccaagctgtccgccatattagaaatgaaggaaggcaatgccagctcggctagcaccctgcccgaatgtgtatatactttctccacacatctgtatgccgggccataatccatacccatttcctcgaagatttcgtaacattgcgatccgttaaacctgtgttgaccaaaatcttcctgtaacgccttaagatttagtctcggtttttgctctacgcaaacctgcaccgcatcaccttggctatgcacggtatgccctctttcgcttcctacttgcccgctatacacttcaaagcttatttttccggtgtcttccaggaatagcctggtgtgtacaggaactggctggttgtccaccacaatgggccgaatccagtttacatttttcaaacggattcctgttgtgctgttgtccatatctcctgtggaacgttctacagccgcccgtaccatctcaagataggctacgccaggcagaaccttttggcctttaacaacatgatccttgaggaaaaattcctcgcctgtaaacgttgaactgaaccgctgctccagaaagtctgaagtgttttgatgcagtaaaggtgttaaaaagaaagattgggacgaagcggcttctgttattgcggcgctcttttcctcaagtacgggtatccaatagctttccctggcaaaaggataggttggcagactcatcctacgaggcttcacatccccataaagcttgttccaatccaaaatcagtcccgtaacccaaagttcagcgagctttccatacttccctttgtccacccatgcatcaatcattttagccatatcttcatcgacttcctgagtgacaagccctcctctattacgctttacctgtcctctatacagctcttctacgccttcctttttttgcaggaagccttccaatttccaatcaagctctgggatggattttgcaatgatcgccagacgttcgtccattgcttcccgcccgatttgcagcgtataggcgatatctgagagacttgtatacgggtcattcagttccctgattgcagacagcaatctttgcacctgctcgtccagcctttccttatttttggctgacaacacgaccatgacaggattcagggacgcaggagcagcttgctgctgactagcttcttctggaatatattcttcgatgaccacatgagcgttagagcccccagcaccaaaggccgacactcctgctacccttgggtattctctggtttcaccgttgatggcaactacaggtcttttccactcttctaacccctgctgaactttaaagggactatcgctgaagtcgatattgggatttaaggtacttgcatgtagcgaaggcacgatttgtttatatttcaactgcaaaagcacctttgtcaccgcggcgataccagcagcgctctcacaatgcccgatattagacttcgccgacccgattgaacaaaactgcttatccccggtatatttacggaaagccttttgtaagcctgcaatttcaatcggatctcccagtggagttcctgttccatgggcttctatatagctgatggttctggggttgattcctgcctccttaattgcctgaccaatcacactggcctgtgcgttggggttaggtacggtatagccgttggttttccccccgtggttcactgcagttcctttgataactccatatatccggtctccgtctgctatagctttggctaatggcttgagcagcaaagctccgactccttctcctggtacatatccgtctccctgtccgaagctttcacatctcccattgcttgatgcaaaacttccctgtcccaacaataggtatttgttaggatggatggagacgttgacccctcctgctactgccagttcgcattctccatgctgtagtccatgacaagccatatgaattgatgtcagtgacgaggagcacatagtatctacagcgatacttggcccttgaaaattacaaaaatacgatacccggttggcaaccgccgaggcattcccgaaaagtccaatcatccttcccttggcttgttgctgggctccatagagttgatactcatgatacatcactccaacgtaaaccccgacattgccttctatgccgccaagctcccgctctgcacaaaggctttctctcgtataacctgcatcctctatcgtttcataaacgcattccaggaataagcgctcctgcgggtccatcgtttccgcttcccttggcgaaatattgaaaaacaacgggtcaaaccagtccaccccatcgatgaaccctccccacttgctgtaggttttcccaggcttgcctctgttttcattaaagtacagactgtgatcccagcgccccttgggaatctctgtaatgcaatcctttccatcccttaggttttcccagaactctcggatacctagtgctcccggatatcttcctgacacgccgataattgcaatgtctagtgccttcgtctcctgatgtggctgtatacctgtcgggagaagccatgggcgcctacgattagccgatatcgaggtcaaaggctctatggttgcttttatagatgctttcgggcctgcatcaggagccgtattcttctctgtcgcttctacagcatcaatcagccgaccgcgatacgtttcaaggaaataacccgtcaatgaccggagattttggtattcaaaaaataatgttttcggtagtgagccgaaagtcttttccaattcattggtaagctgcataaccagtatggagtcaatcccatacctgtccattggtgcttgtacttctatactttcagcgggcagcttgatcacggttgaaagtaccgttttcaaataaccctctgctttttcccttagccattcttctccgataagcgatgctccctcgctttccattacagatcggcctgagacatcagtttccgagagctggcctagaattgccgctttaatcctttggggatatccttcgatcaccataacctgacttctgccggaagacagactttgatacaaagctttgattccactctccgtttgcatggcaatcatgcctaggccctgcatcgccctttccgtttccaggtcgacatgcatgcctccatccttccacagaggccagtttatcgacagcgtttgcccctggcgctgctttgctgtcaccaaagcatttcgataggaggcataagcatccataaagccattagcagcggagtagtcaacctgtcctacattgccaaggcttcctgcgcccgaagaaaataagataaagaaatccaggggcaggtctctgctggcctggtccagattcatcacccctgagaccttcggagtcagcacttctctaacctcttctttagtcttcttgatgatgaagttgtcccgaatcactccggctgtgtgcaaaataccgttaaggccgccaaattgctcgacgatgccatgaattagcccggtaaccgattcgttgtggcccacatccgcctgttggtactctatatgaccacccagcgctctcagttcgtttaactgagccttttggtccgcagaaagtgatgaccgacccaccaatatgatgatggagtttttcacattgcgcacaatgtctctggcaaaaataagccccagaccgcctaagccaccagtaatgagatagatcccaccatctctccacggcaggtctgcatcttcacgtaaggcttcaatttcttgccatattaaagcctgtcgtttgtccccttggtaccatatccgttcgttataccggccactccggttcccttgtagtttctcaatgattccttcgacatcatcctccacatcaagctcaagcaactgacccatgacattcggattttctttttgagcggttttcagcattgcaaagagcccggaataaacctgttggtccttccgagcgtgggttgcaagctgtatcaaaactttctgtttgggtatgtccagcaggatactttgcaattcttcaaatatctgaatggtataatcttgaaaccgaccgtccatatccgcgctggaagactgtaaaacaaggcagcgagtaccatccatgcgggcttcaatatcctccctggcgataccatccacttcacacaggatcacaacataccggatatcttcgtttgcgttcacccctgcggtgacaggcatctcctgccagacaggttcaagcatcagtgtacccatatcctcagtgatgctggcttgtcccacatctccttccaacgctctggataaaagtcctttgaactgcacgcaaatctttccgttctcatcgcacagatcaatatccaccttacttaatccattcgacgtctcttcactcccatcgtgagagatccgggcccacatctctggagtgcatttttcggatatcttcagttcctccaaagcaaagggtaacgcaggcttgcctacaggcaaattttcttccgaacccattaccaagccgattgtggcctgcaaagttgaatccatcaaagacgggtgcagaacaaattcagtttgagtatggagtacagaggatggtaaggacagcttggccagcacgtaatcctttcctcggaagattgcctcaatgccacggtgtgccggtccatagtctatccccatggctctgaaagcttcatagcattggcttgaagaaagtggtgtacgggtacattctgcccgtaagacattcaggtccagatactgtagctcgcccgccctctccaacacagcgactccctgactgtgtataatgccctcagcgtcggctccttccatcccgctgcatatttcaaacgcaatctctccattgtcctggggatatagactgatgagtaccctcaccggtccgtctgctacaaccacaggccgggcccatacgatattttttagccgaatatgtgtctcgccttctactacagcccccactgcctcttctacagctgctcgcaccatttcgagataagccaccccgggtaatgtttgttgagccttgattctgtggtctgacaggaaaaattcccgacctgtaaaagtagagctataacgttgtccggagagatcggaaatattctgatgcaataaaggatgaatttgggcagtcatagctggatttatactgccttgtccagtgcccgtttcggataaccaatagcgtgccctttcaaaaggataggtcggcagactgattcgtctgggcttgatatctccataaagtgcgtcccattcaatgcttgcgccattggcccacaatttggctaccttatcaagtcttttcttctcagtccaggcccgaaccagggttccggtgtcttcgtccgaatccaagagttcgattctgtcccctgcatagttcacacggccgatcagcactttttccgacgagcttccgttaataaaaagttcaagttcatctatcagattttctcttgaatccgtcaaaaacgcgagacgccagtccatagcctctcttcccacttgcaaggtataggtcaggtccgtcagattaacgctttcgtgcaacttaacaaaattcatcatatctgctgcataggttttcaaggattgttcacttttagcggacagcacaaatagtcccgggttgtctttacccactgggggtagattcaccgcagagactacaggaacatattcttcaataaccatatgagcgttagtgccgctaaatccgaaggaacttacgcccgcacgccggggtactcccggttcgggctcccagctttgcagaccggtgctaatgtagaacgggctatcctccagagaaatatgttcatttaaggattcgaaatggatggtaggcggcaattggcggtgcttcatggccagcagcactttcatcacactggccaccccggccgcagtcatcatatgacccatattgcttttcagtgaccccaaggcgcaataacccttcttgcttgtataggatcggaatgattccgtaagtccctccacctcgataggatcacccagctttgttcctgtcccgtgggcctcgaccatggagatggtttcgggatgaatgttaaaccgtcgatatacgtctttttccagcgagatttgtgaatttacacttggagcagttattccgttggtttttccatcctggttcattccccatccccgaataactccatatatggagtccttgtctctgactgcatcagagagccgttttaataacatgaccccaactccttctccggggacaaacccgtttgcacgggcatcaaaggtaaagcaccgtccatccttggacagcattcctgccttgctagtcataacatgcattcccggaccagccataatcatgactccgcctgccaaagcaaggtcacttgtttctaaaaggagactgttgcaggcttcagcaatggccaccagagaggaagagcacgcggtatcaatagccaaagaaggacctttcaaatttagcagatacgaaatccgagcggatagaattgaaggagaccctcccatgagaacctgcgcatttaacccctgcccactcatggacctcccataatcactggctgcacaacctacaaaaacaccgcatcggctctccgacagtgaggctgggctcaatccggcatcttcaatgcatttccagctgctttcaagaaacaggcgctgttgagggtccatcatctctgcttcagcaggggatatattaaagaacaacgggtcaaatttatctacatcctctaaaacacccatccatttgctataggtttttccctgagccttgggatcggtatcgtaatattcatcgattgaccatcgcgttgaaggaatttccgatatacaatccctgccctgagccagattgtcccaaaattcagccaaagtcttggattcggggaattgccctgccataccaataatcgcgatagactccttatgttcctgaccgcgcggaatatctggcatagcttttttagaatcagcatgcttgaccgttttgtgggaatcattgctattcggcagctgtccataggcaaattgaatccgttctttaacctcttgctgattcacaaacgttttatcctgcatttttatttctttttcaatagtagccgccagcttttctcttatcgattgagccatatgatttttcagctcaattaatgactccctgggagactcggacagttttcttgccagctgcatggcgtacggcactacttcattcctcggtacaactggaaaaggaacccttttggtttccagttccgaaccgctatatctagtacctgtaaataaaatttcctgtgccatactaaccccgaatttctcagggaaaatcagggttgaacccgctccgggggtaaagccgtacttcataaagttagtagtatagatgctttcccgactcatcacgataaaatcgcaaaacatccccatgcaccagccagcaccaatcccatgcccctgcatagcagcgatgacgggcagcttgcaatccaaagcaatcttgtaaacattggtatcgctatatttcgcctttccctcatggatagccagcaatccctcttgggtgcctcctgtggcaaagtaggtgtcatatcccgtcagaatcacaactttataattctcgttagcttgcaccgtcttgaatgcctcattcaggccaataatcagttcatcggaaaatgtatttttgtgcaccgtgtccttcattttcaacatgacaatcccgtgctcaaattcctgcaattcaaccacagactgtacctttatctggggtgcgcttatctcctgcccatcctccggcctgtggaagctgtccaatggttgcaacgtgaaagccagtccttctgataattcctgtggactggcttccaatgattcatccgggagttcgccaataaattgaagcaattgtttttcagcatcttcataatttatttcccctgcttgcaccgcacgaaaaatatcttttgaatccataaacatgtcctcctagctgtatgaaataggacaaatatcgtgttggctgtctacgagtgtaattggttgaataactggtcggcctgttcaaaatccaactcaccctgcagtactttctgtatcaaggcttgcatgggctgcttaggcttcggctctgtagaagcctgattggtatctcccgccgacttgttcaattcctttgccaaaaatttggagaattctttaatgttaggataatcgtacactctggttgctggaatagctgttccaaagcgtttattcacagcctgcacccactctacacctataatagagtccagtcccatatcaataaattgatcgtcccggccaatatccttttcattcatactcaaggatttcgcaagactttctaccagttccttctccaatgtttctatccgtacagccgttggcgcatatgtcgaccgctttgcctcatccctggcagcgggcggcgacgaagaaggcttggcctcaggttgcggcggggcaggcttggattctgccagcgcggctgacttctccggcttatctgctaccatctggatgttggaaacggagctcagcaaaatgccctgcggtttttcaggtactttcgccaaagtctgtctctgcacattatcgttgctatggttaactgcaggagggctggaaacgagttcttgtaccgacacctcggctacaggagattccgcctcgacgtcccgggattcgcccccacgcgcgaagatccaatagctctccttggcaaatggataagttggcagactaatccgacgagggctggtattctcataaagtctagtccaatcgaagagcagccccttaacccaaagctccgccagctttgtatacttacccttgcttatccaactatccaccatttttgccatgtcttcgtccgcctcaagaacagctaggatgtctttattcttctttgcctgaccccaatatagcccgtcaatattctcattccccgctaaaaagctctcgagctttcctgtaagctcatgggtagacttaactatgactgctaaccgttcttccatggcttcccgtcccacctgcagagtaaatgctatatcctccaggctggtttgcgagtattccggctctttgagttcagcaagcaacctttgcacctgttcttccagtcgctctttattcctcgccgacagcacgatcattaccggattttgcattgaagtggcagcctgtctagtctcctgctcctcagggatatattcctcaataagcacatgtgcgttggagcctccggcaccaaaggaggagatacctgcgattcttgggtattcaaccgtcttcccattcattgtgacgacgggtcttttccaatctcccagctcctgctgaactataaaaggactatcgctaaaatcgatattcgggtttagtgtttttgaatgcaatgaaggcacgatttgtccgtatttgagctgaaggagcacctttgtaactcccgcaatccctgccgcgctctcacaatgcccaatatttgattttgccgatccgattgcgcaaaattgcttgtcctccgtgtattcctggaacactttttgcaatccggcgatttcaatggggtcacctaaggatgtcccagtgccatgcgcttcgatgtaactgatggttctggggttaattcctgctttcttaaatgctcttccaatgacactggcctgcgcatggggattcggaactgagaatccgtttgtcttccctccatgattcaccgaggtcccctttacgaccccatatatatgatctccatctgcaatagctttggccagcggtttaagcagtacagctcctacgccttctcccggcacatatccatctccgccttgtccaaagctttcgcaccgtcctttactcgatacaaacctcccttgcccaagcatcaggtatttgttcggatgaatggatacattgacgccgccagcaatggcaagctcacactcgccttgttgcaagctttggcaggccagatgaatggtcgtcaatgaagaagagcacatggtgtccacagccatgctcggaccgtggaagttacagaaataagatacccggtttgcaatggaagccggattgccaggaacggcaatcattctgcccctaacttgttcctgtgccccataaagctggtactcttcatacatgaccccgacaaaaacacccacattcctatccagtccaagcgcttcccgggtatagcctgcatcctctatcgtttcatagacgcattttaggaataggcgctcctgaggatcgatgatctgtgcttctctaggagagatattgaaaaacatgggatcaaactgatccacacctttgataaagcctccccacttgctgtaagtttttccgggctggttccggtcctcgtcaaagtgcatactgtgatcccagcgatctttgggaatttccgtaatgcaatccttcccatcgcgcaaattgttccagaattcccgtatgttttctgcctcgggatacatgcccgacaagccgataatggcaatttcctccgatccgcctgctctttccggttgcggttggaaacttgcctgaactggcatgaaacgcgattgcttccgactatcagaaagtgaccttaccgggtcgttttccttcgtagaaggcttgaactctttcgcagcgttgacttctgtctcgattccaagcaatttaatcagctgcttctggtggactttgaggaaatattgggtcaattcccggatattctggtattcaaaaaataaagttttgggcagtgttccaaacgttttctccaactcacgggttagctgtttaatcataatggaatcaatgccatacttctccataggggcatcagtttcaatctgccttgccggtagcctgatggatgtggcgagcaattgctttaaataatttgccgctttttcggcaagcaggtcttgtccgatgaccgaacccatctcgctttcccttatcatagaggagacatctccagtctgattcagggacggttgctgcaggagcgtttctcttagctgactggcatgcccttccaacaccatgacttgattcttttcggaagccaggctctgatacaaagcccgaattcctgcaccagtctccattgcaaacatccccatcccttccatgatcttttctgtttccccatcaatacgcattccgccttctttccagagaggccaattaactgaaatcgtccgcccctggcgttgtgctcgctctaccagtgtactacggtacttggcataggcgtccataaaggcattggcagcagcatagtcagcctgtcctatattcccaaggctccctgcaacggatgaaaaaaggatgaagaagtccagcggaatttccttacaagcctgatccagattcaccactcccgtaacctttggcgccaaaacgttttgcaattcctcccgtgtttttttaataatgaaattatcgctaaccattcctgcgctgtgcacaattccgtccagtttcccaaactcttcttggatatcccgaatcaaatcttcaaccgcccttttatcggcgacatcggcttgccggaatactactcttgcacctaaagcttctatctcctcaatccttgctttggtgtcaccacgaagcggggagcgtccaacaagaattaaagcagtatctctggcctgtcgtgtaatttcttcggcaaaaatcaaaccgagacttccggttccgccggtaatcaaatatactcccctgtctttccacggaatgctgatcgcttccccggaggctttaatttccgtccatacggcaacatgccgtctacccaattgatagcggatatgtggttctatagagctgcgactgttttcttgcaggatatttatcatacctgctgaatcctgctccacatccatttctatcagctggccaaccagtactggattctccagccatgctgtttttaagagtccggaaagtcccgagaatacctgttggtgatcctgcaccggaacgacaagctgaaccaatgttttgcctttggattccgttttaagaatatgttgaattgcctcaaacacctgtgtcgcataagtcctaaaccgtgcatcaatgctcttctcttcggattggagaatgaggcactgcaccccgttcatttgcgattcaataatttccccggaaatatatcccggttcgcataaaattaccagatgctgttgatagtcaggtgctgttccttccagagcaatcgcttgttcttcccacacaggctcaagcatcaaagtctcaggtgcagtccattcatctgggccccctgttcctccttcagcaactcgtgatgagaatcccttcattctcacacaaacattcccctgctcgtcacacaaatcgatatctaacttttgcagcgagccattttgcctgctgtcttcactattacggatccaggcccacatctctgatgtacatttgttaaacaccaccaactcttccaatgcaaatggtaaagctggcttaatggaagctttgcgatcacccgcactcataatcaagcctatcgtcgcctgaagagcggaatccatcaaactggggtgcatcacaaaatgttccatcgtatggtaaacggaagaaggcaaggacaacttggcaagcgcttgacccaccccgatatatattttctcaattccctggtgtcccggcccataggatacctgcatcgtcgcaaacgcctcatagcactgacgggatgagaaggagcccagattgcactgctccagcaaggttttaatatctatagtggggatctctgccaccggaacaattactgccctgccttcactatgcaccaccagctccgtgtccgttgctccagacttgctgtaaatttcataggcgatctccccgccatcttgcggatagagcccaatactgacatccaccgacttctccccaaccacaacaggccggacccaatccacatcttttaaccaaatggacgtccacttgtcttctggagatcctgcgacctgctctactgccgcccgcgccatttcaaggtaggccactccaggcaagagcttctgcccccttatcacatggtcagacaggaaaaattccttccccgtaaaaatggagctgaactgcagtccataaatattggacgtattgcgctgaagtaggggatgaatgccgactgctgtctccctttccagcacaacaccgcttgctcccgtccgtttattgatatcggttatgcaatatcgttctttggcaaagggataggttggcaggctgatacggtttggtttagcctctccgtacaacagggcccagtcaataacgactccttttacccaaaggtcagcgattttgccatagctgccttcgctaactaacacatcaatcgccgtgcccgcaccctctccgtcttcacgagctctattttcttctctatggcgtttggcgtgtcccacgtgtaagccgtggataccatcccggccttccacaaatccttttaatttctcttctagctcccggagagagcctgcaacgaaagccaaacgttcttccatcgcttcgcgccccacctgaagggtatacgctatatctaccagactgctgtctgtgaacggatgctccccgattgcagctagtaatagctgcgcttgctcttgcagttgtccttcactcttggctgacagcaccacaatagccgattttggggtggtaagggtaatagaattctgctcctgctttccaggaatatattcttcgattaccaaatgggcattggcacccccgaatccaaaggagctaacacctgctctccgaggaatattttcccctagagtatcccgctgtggcttccactcctgcgcctcctgaacgatatagaacggactgccttcaagttttatataaggattaattgcatcacaatgaaggcttttgaccagctttttatgctttaactgaagcagtacttttatgacgcccgcgattccagaagccagttccagatgtccgatattggtcttcaccgagcccaatccacaatgggattctgtaatcccgggcccttctgtattctcataaagctctttgaaagctgctttcagtccgttaatttcaatcggatcgcccagctcggtgcctgtcccgtgagcctcaatgtaagagacagtccttgggtcgattccggcctttgtatatgcatttaccaatacatccgcctgagccctcggattaggagctgtcagggaattggcccggcctccgtgattgacggcagtactccgaatcacaccgtaaatatggtctccatccttctctgcatccttcagctttttcaggaaaagcatgccggccccttcaccacgcacgtagccattggccttattggagaaggttttgcatcgaccgtcctcacacagcattcctgctttgttgaagctgatatggagttcaggtgtgataatcacattaacaccgcccgcaatcgccatctcgcagcttccatcctctatggccctaacggcccggtgaatggccaccagcgaactggagcaagccgtttcgacaggctcgctcggaccatgaatattaaggaaatagctcattcgattgggcccgacagacggtgccataccgctggaggaatacgcctcgacatccacatttccctgatagatcataccgctgtagccgctgttcgcggtacctacaaagattcctgtgcgggttcccgatagactccctgcctgaatgcctgcatcttcaatcgccttccagatataagtcatcaacagacgttgctgcgggtccatgagtgcggcttcccgcggtgaaattccaaagaatagcgggtcaaactcatagatcccctcaataaacccgccccacttgatgtttgttttattggcctcctgctcagggtcaccgtaatacgtcttccaatcccagcgatcttcagggatttcagtgatacagtccctgccttcctcaagatttttccaaaactcatccacatcccgggccatgggaaatacaccgctcattcccacgatggcaatgggttcaggagcagcctgagtcagctgcgggttggacaacacattcccgcctgcaaaccggaaacgctgccgtctaccgcgggtactgtcttccctatcatcctccacggcctgcacagcaggctcagtccgggcatgcacggcaaactgctcgccaagcacggcatcatattcgtccaccaaatacctggtgaagtcatgaatcgttgtgtattcaaaaaatatgtccggcgtcagctcaagccggtataagtgattgatgttgttggtaaattgtgtgagcaggatggaatcgaagccatactcactcatttctacatgtgcatcaatatcttcaagtttgactttcagcaatcttgacacagcctgtatcatagcggcctgcaccttgtccagcagatctggtacgacattgctttcagaggaagcttctgaaattcctgtcaccttttcaggctgcctagtctctggagtcgtgattaaccccatggttttcttcatttttgcaagattgccttccatcaccataacctgatcaacgcctgcgatcatgccacggtacaaggcctgaatgccggaagaggttgacatgccgctcatgcctgtacgctgccttaccagcttctccgtctcctcatcaatacgcatcccaccctctttccatagcggccaattgatggatagcgtttgaccctgtcgctgcttagatgctatcagagtgttccggtatccggcataagcatccataaacgcattagctgcagaatagtctgcctgtccctgattacctaatcctccggctacagacgaaaatagaataaagaagtcaagcggcaagttcttgctcgcctgatccagattcactgtccctaatactttgggagcgagaacctccagcatctcctcgctatttttttggagtatgcggttgtcgcgaatgacacctgcactgtgaatgatgccattgatgtttccgaattcctcctgaatttcctggattaaatcggtcaccgcctgctcctgagtcacatcgacctgcctgtatatgattcgtgcccctaatgcctccattttctttatctcagcccgtttgccctcatccagcgtggaacgccccgttaaaatcaagacggctttatggactttatccgtaatctctctggcaaaaatgagtcccaatccaccggcaccgccggtaatcaggtacactccgccatccttccacgggttacccgccgcttcctgagagatgtgaacttcgttccagcaggaaacccaccgtgtgcctttctcgtaccgaatctggacatcctcgaggctacggctgttttcttttaagatgtctatgattgctccccagtcctcatcctgtcccagttctattaactgacctaccagttttgaatgctcaagccgggccgtttttaaaagaccggaaagtcccgagaaaagctgctgcgcctcctgtccgcttatggcaatctggatcagcaccttaccattgggtttttccctgaaaatgctttgaatctcttcaaccacctggacggcgtaacgctggaactgttccgcgattccgtttcggtcgggttgcagtacaatacattgcacgccgtccatccgagcttcaacttgttcacgggaaatcccggacggctggcagagtaacacgacatggcgatcatatgcaggcatttcggcctctagagcaatcccttgctctttccatacgggttcaagcatcaagttactagaattagactgaacatccgaggaaatcgagtccctattcaggattcttgatgaatatccttttatcctgacacagatggctccggtttcgtcgctcaggtcaatatccagcttctgtgccttttcctcagctataccgtctgcattataacgaatcaacgcccacatgatggagctgcaattttttataatttcaacttcttgaatggcgtaaggcagagaaggtttgatctcgccagcccccagcgtcaagcctatggttgcctgcaaggccgaatctatcatagttggatgcaggacaaattggctttggttgtcagaaacggaagacggcaagcataacttagccagcacttgaccctctcccgcatacaccatctcaatcccttgatgtccagggccataatccattcccatatccctgaaaactctatacaattgtgtgggatcgaagttccgactgcatacattctgcaagtctttaatattcagtgctgggacctccgcagctgatcttcgtgcagcactgccgtagctatatatcacaatccctgcatcagcttcttcgctctccccatatatttcatacgaaatctcttgatgatcatccaggaaaagtccgatgtgtaactgcagtggcccatcctctacgataataggccgtgcccaaaccacgtttttaaggcaaattccggttggcccgctctcatcagatcctgttgcctgatccacggctgcccggaccatttcaaggcaagcagccccggataaaactttacgtccattcaccacatgatccttcaagaaaaactcctggcctgtaaaagtcgaactgaaccgctgttccgagaaatcggaggtgtttagatgcagtaaaggatggagcgaagcagcagtgacagaagtcatgcctttgcctgccttgctgtcaagctcaggcgcccaacagcgttctctcgcaaaaggataggtcggtagactgatccggtaaggtttgatgtccccatacagcttgttccagtcaatagttagtccctttacccacaactccgctattttttttagttttctcttcttgatccaggtttcaagcaacgatttggcatcttcatccgcctcaaacatcacaatcccgtctttgctctttttcacctgagccgttaggacgccagcaagcggatcatgattcacaaatccttcgagcgtttttagcattgcctcttttgaatctgccacaaaagccagccggtaatccatcggctcgcggctcacttgcagcgtatatcccatatccgagaggttaagattttcctgggatgcaataaagcttctcattctttcggcatacgtttttagttgcttttcacctttggcagacaaaacgaagagaacgggattatggatatcggcggctgtttgtgatgtcgtagatgttcccgtcccgggacgatattcttcaataataagatgggcgttcgtaccgctaaatccgaaagagctcacagcggcgcgccttttatccccgtgggaaggttcccaggcgttcaattctgtattgacataaaaaggagaattatcaaaatcaaaatgctcattcgggttcttgaaattcagtgtcggtactagttttctatgcttcatgcatagcaacaccttttgcacgcttgctatgcccgctgctgcagaagtatgcccgatattgctttttaccgaacctatggcacagtagttcttctgatcggttttttctttaaaagcggttgataaagcttccaattcaatagggtcgcccagcttggttcctgtcccatgcatttcaacatagctaatgctttcaggctcaatctgatatttgttgtatatttcccgctccagctcaatttggctgtttgtgcttggcgcggtaatcccgttggttttcccatcttgattgattccggacccgataataactccgtatatatgatcccgatcagcttcagcatccttcagccgcttcagaaccagcgcccctactccttcccctggaacaaagccgttggcgctattgtcaaacgctttacaccgaccatctggcgacaacattccggatgcagacatgcctacatacgattcaggagtcagatataacgacaccccgccaaccaacgccatttctatctctccgttagataacgcctggcatgccagatgggttgccaccagcgatgaggagcatgccgtatctacggatatggccggacctttcagattgaggaaataagagatgcgagccgctgcaatagcgttactgtttccggtagtattggtgaactgcgcttgatgcttgtaccgcagcatactatattcattatttaaaattccaaggtaaaccccgcattttttatttcccaactgtgagccactatagcctgcatcctcaattgccttatatgcttcctgcataaagatgcgctgctggggatccatcccttccgcctcggtaggagaaatattgaaaaataacggatcaaaatattccatatcctctaaagcacccagccacttgcaattgattttcccctcttgcgctggacgaggatcataatattggcatacatcccaacggtccttcgggatttcaataatggaatttttgcctagagcgaggttatcccagtattgctgcacatcttccgcaccaggatatcttcccgaaatcccgacaattgcaattacgtctttattttccgaaggcaaaggcgatgaatcctctgctacctttaccaggtggaatggctcgggctcccccttgggcgatagccttggagagcattgcatcatgtcaggtcccttcgaatggacttccgcaataggcttgtctgtgtccgggactgtgctcaagaactgttgattgaagcttcctccatgcttattgatttcttgtgccaaaaatgtagcgaattggcgaatggtcggatagtcgtagaccttggtcgctgctatggatgtgccatatcgtttatttatgtttcgaacccactctacgcctataatggaatctagtccggtatctataaagtttttatccgcctcgatctcgctccgttccatgtacaaagcctctgccaggcttaccgtcagttcttcctgcaacagctctgcagaggcgctgcactcagccatgctggcctgcgcctgcttttcaaacgaaatcggcatcaaattcacctgaatggaagcctctgccgatttctccggctctaatgcaacggatgacggtgaatactctgctggagaatgatccgaaatagactgggcagagaatggcgcaattgatttgctcaacaattccttctctacaaatttgctaaaatcccggatggttggataatcgtagacttttgtcgctgttatggatgtattgtaatgcttattaatgctacgaacccactctacgcctataatggaatccaatccaagatcaacaaagtttctatccgaatcgatatcgctccgatctatatataaagcctgcgccaggcttgttgtcagctcctcctgcaatatttccgccgatattgtagaaggaatagacgacagcgcttccgtcttcttctcatcctctaatgtgtgcgatgtctcctccagtgaagttaacatgatcgttgtcccctcctggttggcagacttgcttaggtgcggctgacggtccaacaaattcggtaaggatatggcgcttggtttttcagaactattcaaaaaaccggattgtattagggctgttggctgcatcgcatgagtctggacgggaattgccttttcctgagcttccgtaacggctctttctacagaagagactctttctacagagggactcataatatccgtgatccagtaccgctccctcgcaaaaggataggccggcaggctgattcgccgcggcttggcatccccataaagcaggttccaatccatcgacaatcccttgacccagagatcaacaaccttcgaatatttccttttccctatccaggcagcgatcgttttgtccatgtcttcatcttctaccagcgccgtcagcgcctccttattccgtttgacctgaccccggcacaactcagggatactgtcccgtccttccaggaatccttccagtttgtccaccagctcctgcatagaccctgctatcactgccaggcgctcttccatggcttcgcgtcccacctgcagcgtgtaggccacatcggccagactgctttcgctgagctgtccttcccgcataacggctagcaatctctcggtctgctttttcagtcgttcttcatttttggctgacaatacgatgatcgcaggcttttgagccgtaacgctcatgggcaccttctcttccgcaatgtactcttcgatgatgacatgtgcattggagcctcccgctccaaacgatgaaatcccggcaatcctcggatattcccgcgtctctccatcaatctcaaccaccggccgtctccattcccccagctcctgctggacgatgaacggcgtctgaccaaaatggatgttcggattcaattcttgggcatgcaggctgggaaccagcgtccggtttttcatctgcaagatgattttccccaccccggcgatgcccgctgccgcctccagatgtccgatgttggacttcacagagcctatggcgcagaatcccgtatccggcgtatccttcctgaatgcctgggttagacccgtcacttcaatcgggtctcccagctccgtgcctgtcccgtgggcttcaatatagctaaccgtccgcgcatgtacccccgctcgctctagggccgcccggatcagttccccttgggctgtcgggttcggcactgtatagccgttggtcttgcctccatggttaatgcttgtcccccggatcaccgcatggataaggtccccatcagcgatcgccttggacagcggctttaataggacgatccccgcgccttctccagggacaaacccattgcctcctttgccgaagctcttgcactgcccgtctgctgacagcatgtggttggcgcaaagtcccacataactgagcggatggagatagagatttactccgcctgcaatagccatttcgcattctccgcggtacagatgctcacaggcttcatgaatcgcggtcaacgaggacgaacacatcgtatcgattggcatgcttggcccttgcaaattaaagagatacgaaatcctgttggccactgaactaaaggatgtgtgagggtatatttgcgttccttttctccataaatccagtccgtatagatcgaaacccgttttggtaattccggcaaatacgcctacccgacggttatgccgcaccgcaagctgttcccgggtgtagcccgcgtcctccaatgcttcccagcaggcttcaatgaacagcctttcctgcgggtccataccgagtgcttcccgtggcgcaatattgaaaaagcgcggatcgaattccgcaaattcttcgataaagccaccccatttgctgtagctttttccattcgccaccgcttcctgtgaatcaggatggaagaacccttccagcgtccaacgctcacttgggatttcggtcacacagtccttccctgcttttagattttcccaatattcgttcatgtccctggaccagggatactttccagccatcccaatgatcgctatcggctcacgcatttccgcaggggcagaccccgccaagcttcggacaggcttcgcttccgcctttgccgcagccggcacggctttttcctcggtgcacaacggtgccgcaagtatttcctctacaggctgcatgtcatggcttattccggtccactgcatgcactcctgcgggtattccgccacaaaatattccgtcaaggcgtgcaaggtctggtactcataaaacaacgtctgggacagctctccaaagaagcccgccagcttggcattcagctgggtaatcatgatcgagtcgattccatacctctccagcggctcatgggcttcgatgctgctgacgctcagccgagtcacctctcccaaaagcaccttgagtcgatataaggttttatcgtagagctggcctgcatccagcttaggggttgcctgattagaaatagctacttggatggcacggacgccggcttgtgagacgcctttcgccaagtaggcctcgattttctcaggctccccttccatgaccatcacctgctccttgccggaggccaagctttgatacaacgccctcattcccgaccgggtctgcatggttgtaatacccatgttttgcgtcatgatctgttccgtgtccgcatcgatccgcattccgccctctttccatagcggccagcggatggataacgtctgccctcgccgttgcttggcccctaccagggcattccggtattcggcgtatgcgtccataaaggcattggccgtcgaatagtcagcctgtccaggattgcccaggctgcccgatatggaagaaaagagcacaaagaagtctaggttctggccgctgcttgcctcatccagatggaccagtccgctcaccttcggtcccagcacctccaaaaattcttcactagtttttttaatgatgaaattatcttgaatcacccctgcgcagtggatgatcccatggacacgtccaaattcctgctgaatgctgtccaataaaccgataacggtgtttctatgagtgatatcgccttgcctgtacaccacgctggcgcctgatgactccagctcctgcagcttcatctgcttgtctcggtccagcggcgaccgccccgtcaaaatgaaggtcgctgcttgcgtctgccgggcaatctcttctgcaaccagcagtcccagactgccggagccgccggtaatcagatagaccccaccgtctctccatggaagcccctcttcttgcccagatgtttcaagcctgctccagcaagcgattgtccgttgtccgttctcatagcgaatccagccatccatcgggctacggctgttatcctccagcttcgccaggatgccttccgcctgttctccctgttccacttcgatcagctgcccgatgaatttcgggttttccagccgggctgtcttcaacagtcccgaaagtcccgaaaagagccgttcttccccggcgttccgcaccacaatttggaccagcaccctcccctcaggcttgtctttgagtatgctttggatgctctcaaaggcctgaatagcataggcctggaaccgctcatcaatccggctcttcccggatcgaaaggcaagcacctgcacagctccgttcaaactcgcttcaagtcgctcgtgcaaagcttcgtctggctcacaaagcaagaccattcgccgatcataggcagggacttcggcttccagcggtacatcctgatttttccatgtaggctcaaatagcagtgtacggctactcgtaacggcaggcgcttccacagctctggcgaccgtaaattttggttcacgctctgccgctctgccgcctgtaatttcgtcctcactcctaggcgcccaatactgctcttttgcaaaaggataagttggcaacggaatcctagagtactgttcatttgaaaacaagcactcaaagtctaacgaatatccctgaacatacagatctgcaatcgtagtcaaaagctccaaatactcgcgggtatcgcttgcgttttgacaattgtaaatacattcatccccgtatcttttcaaagatgtttgtatgcgttgatctttttcgtgcagttcagaatgataaacttgagaagcaatgcccttttccagccactttttaagggacatgacaagctcgtcttgattacgggcaacacatgcaagccgatgattacagtgctttctcccaagcaataatgtatagctcatattaccgcaatccgccttaggctcctgttcacaataagcaagcagttgctctacctgctggcgtaattgttttgaagtccgtgccgacagcgcaatgaaataacctggcttttcggaatgtctccgttccgtctgtggagcctcttctatgaccatatgagcattcgtaccgctggcaccaaaggagctgaccgctgcacagcgtctgactccaggctcaacttcccagtcctgcagatacgtattgacataaaaaggactatccgcaaactgaatgtttgaattgcccgaccggaaatgaagtgtaggaggaatttgcttattctttaatgacaataacagtttgatcattcccgtaattcctgccgcaatttgcgtatggccaatattcgtcttaatggaccctatggcgcaatattccttcttgtcggtatactttctaaaggttcgagtcagtgcctgatattcaatgggatctcccaatttggtaccagttccatgtgcttccaccatctggatttgctctgggtggatatgaaatgtatcgtatacattttgctcgagtcgctcctgagatttctggcttggcgcagtaagtccattcgtggtgccgtcctggttgattgctgagcctaaaatcactccatagatgtggtctccatcagcaacagcttcatgaagtcgcttgagcacaatcgcgccaagcgcttctcccggaaccattccatctgccctatcatcaaaggtatagcagcgtcccgagcgagacagcattcctgcccggtcaccatataaatagcagcgaggagtcgtatgaatatagacaccaccagctaaagccatatccgtttctccggtccataagctttggcaggccagatgaactgcaactaacgaactggaacaagctgtatctacagctattgctggtccgtgaagattcaagtagtaggagattctagcgggtatcacggaacccatatgaccccaaagcgcttgtggaggcaggtcttcacccagcaattgttggtaatctccctcggcacagcccacatacactccacaacgacgaccctccatccctgtccccgcatagccagcatcttccagagcatgccacgcttcctccaggaacaatcgctgctgcggatccatataggtcgcttccaatcctgagatattgaaaaaaagtggatcaaacttatcaatatcccccaaaaaactgccgtgattgcagtagcttgcatgtttttcctgatatttcgaaagatcccaccgggttacctcttccactaaatcgtcaccgttcttaaggtgattccaaagctcatgtacattatcagatccagcaaaccgcccgctcattccaataatcgcaatggactccttaggtgttaaaacgttctctttatccttcttattgagtctctccggctcaaaggatacacttgctgtttccacaggaggaagagtataatctgtgtctttaagtttttggatgtcgcgacttgcatcttccatgttgtctattggattagcgctctggtccaagacttgtgaaactttatcgccatattggcttaaaatgtatagcgtcagttgttttaccgaactgtaatcgaagatgtcggtagtttgcaaatgaatccccagcccctgattgacagcctgcacaaagttgacgccaagaatggagtccagcccataatccgcgaatgactcatgaatatcaatcatagtaaagtccacattcaaagcctctaccagcttccctacgataagctccttgacatactcttcagccatctcgcttgttacatcaatatctgatcgaattccttcgtcacgctgtttcatttgagatttgtcgtgttcaggctcctgtttgttccgaatcataccatcgctttccgccacaataatttgttgacctatatcatgcgcttcctgagcagggaagaaaacggaccggaaaccctccatttccaataccttttgccaactttcgggatataacccgggagagcctggaatgcgcagctccgggtcattataaagccaccatccctctaaaaggccaaaggatagatggtttaacagagagttaccgctgatttcatttataagaatcagaccgttttctcgcagcgccgctttgacattgcgtaacgtttggcgaatgttccgtgtggcgtgcaatacattggtggcaatcgcaatatcatatccacctgtatcaatatcttgtccctgagccgactcttccacattaaaaatctgataagtcaggtaaggatttttcggagcgtactctttttgtgcatgtaataaaaatgctctggatttgtcggtatagcaatattcttgaatatgctcccgataaggttcgagcttctggaagaccaaagcgctagtacctccagtgcctgcaccaatttcaatgattcgaatcggtaccgacgggttatgcttgatccgctcatttagataggaaactacgatatctcccagcacttcattaaagtaatccgctgcaggactgttcttatatataccttctaccagtttcatggaggaattaggaaaaatgatatcggtggctggtatcttcccggttaaaatttctggcagcttgcgcaaggtcgattctaccaaaaatacccaggatgagagatccggatttttcagccatgcccctttcttccattcccactccttccatacagcctgcaaatcgaccgaagcagtacccgctacgctatatgactctccattgcagtacaaatactgattccgtaccaaaatctctatgctttcttcaagccaacgatcgtataaattcagtaagccgttttttgttttaaaatccgcgatcatagctttcttttccatttgcgcatatggacataatcccatcaagcgcaaatggctccataacagcctgcataagatatcattcatttccttcatctgtaagcctccattcccgttcagtccctcgtgtcgctccatcctgttccgagtaagctttgctgtcgactgtagtcgaggacattgtctcgtatgcagccgctagataagaaagatctggcatcttctttatttttacactggcagaaatatgactctggatgttttggatatacgaaggaatagcttcgagatttgaagcatcgatgtcttccttattcatttccgaaacctttgccgttttggtaagtgccttttgggcaatgaacgaatctgttggctttacagcatctgcagattcaatggaagccgatttagttttaatatccgtgatccagtaccgctctctcgcaaaaggataggccggcaggctgattcgccgcggcttggcattcccataaagcaggttccaatccattgccagtcccttgacccagagatcaacaaccttcgaatatttccttttccctatccaggcagcgatcgttttgtccatgtcttcatcttctaccagcgccgtcagcgcctccttattccgtttgacctgaccccggtacaactcagggattccgtctcgtccttccaggaatccttccagcttatccaccagctcctgcatagaccctgcaatcactgccagccgttcttccatggcttcgcgtcccacctgcagcgtgtaggccacatcggccagactgctttcgctgagctgtccttcccgcataacggctagcaatctctcggcctgctttttcagtcgttcttcatttttggctgacaatacgatgatcgcaggcttttgaaccgtaacgctcatgggcaccttctcttccgcaatgtactcttcgatgatgacatgtgcattggagcctcccgctccaaacgatgaaatcccggcaatcctcggatattcccgcgtctctccatcgatctcaaccaccggccgtctccattcccccagctcctgctggacgacgaacggcgtctgaccgaaatggatgttcggattcaattcttgggcatgcaggctgggaaccagcgtctggtttttcatctgcaagataattttccccaccccggcgatgcccgctgccgcctccagatgtccgatgttggacttcacagagcctatggcgcagaatcccgtatccggcgtatccttcctgaatgcctgagtcagacccgtcacttcaatcgggtctcccagctccgtgcctgttccgtgggcttcaatatagctgaccgtccgcgcatgtacccccgctcgctctagggccgcccggatcagttccccttgggctgtcgggttcggcactgtatagccgttggtcttgcctccatggttaatgcttgtcccccggatcaccgcatggatgaggtccccatcagcgatcgccttggacagcggctttaataggacgacccccgcgccttctccagggacaaacccattgcctcctttgccgaagctcttgcactgcccgtctgctgacagcatgtggttggcgcaaagtcccacataactgagcggatggagatacagatttactccgcctgcaatagccatttcgcattctccgcggtacagatgctcacaggcttcatgaatcgcggtcaacgaggacgaacacatcgtatcgatcggcatgcttggtccttgcaaattaaaaaggtacgaaatcctattcgctaccgaactaaaggatatttggggaaatatttgcgctccctttttccataattccggcccatagagttcgtagcccgtcttagtaattccggcaaatacgcctacccggcggttatgccgcaccgcaagctgttcccgggtgtaacccgcgtcctccaacgcttcccaacaggcttcaatgaacagcctttcctgcgggtccataccgagtgcttcccgtggcgaaatattgaaaaacagtggatcgaattctgcaaatccttcgataaagctcccccatttgctgtagctttttgcattcaccattgcttcctgtggatcaggatggaagaacccttccagcgtccaacgctcacgcgggatttcggtgacacagtccttccctgcttttagattttcccaatattcgttcatgtccctggaccagggatactttccagccattccaatgatcgctatcggttcacgcatttccgcagaagcagaccccgccaagcttcggacgggcttcgctaccgcctttgccgcagatggcacggcttcttcttcgacatacagcggtgccgcaactgtttcctctacaggctgtatgtcatggctcatcccggcccactgcatacactcctgcgggtattctgccacaaaatattccgtcaaggcgtgcagggtctgatactcataaaacaacgtctgggacagctctccaaagaagcccgccagcttggcattcagctgggtaatcatgatcgagtcgattccataggtttccagcggttcattggtttcaatgctgccgacgctcagccgggtcacctctccaaacagtaccttgagactatgcaaggttttgtcgtagagcaagcctgcatccagcataggtacgcttgcttggttaggtactgcctgaatggcacggacaccggcttgtgaaacggctttcgccaggtaggcctcaatattctcaggttccccctccaagaccattacctgctccttgccggaggccaagctttggtacaacgccctcattcccgaccgagtctgcatggctgtaatgcccatgttttgcgtcatgatctgttccgaatccgcatcgatccgcatcccgccctctttccatagcggccagcggatggataacgtctgcccccgccgttgcttggcccctaccagggcattccggtattcggcgtatgcgtccataaaggcattggcggtcgcataatcagcctgtcccggattgcccaggctgcccgatatggaagaaaagagcacgaagaagtccaggtcctgaccgctgctcgcctcatccagatgggctagtccgcttaccttcggtcccagcacctctataaattcttcccttgttttcttgatgatgaagttatcttgaatcacccctgcacagtggataatcccatggacacgtccatattcctgctcgatgctgtccagtaaatcgataaccgtcttcctgtcggtgatatcgccttgcctgtacaccacgctggcccctgaagcttccagctcctgcagcttcgtctgcttgtctcggtccagcggcgaccgccccgtcaaaatgaaggtcgctgcttgcgtctgccgcgtaatctcttctgcaaccagcagccccagactgccggagccgccggtgatcagatagaccccactatctctccatggaagctcctctttttgcccagatgttacaagcctgctccagcaagcggttttccgttgaccttcctcatagcgaatccagccatccatcgggcttcgactgttgtcctccagcttcgccaggatgccttccgcctgttctccctgatccacttcaatcagctgcccgatgaattttggattttctagccgggctgtctttaacagccccgaaagccccgaaaagagctgcccttccccagagttccgcaccacaatctggaccagtactcttcccttcggcttgtctttgagcatactttggatgctctcaaaggcctgaacagcataggcctggaaccgctcatcgacccggcctttttcggattgaaaggccagcacctgcgcagctccattcaagctcgcttcgagtttctcgtgcaaaacttcttccggctcacaaagcaagaccattcgccgatcataggcaggagcttcggcttccagcggtatgtcctgcttcttccaggcaggctcaaatagcagtgtacagctacttgtaaccgctggcgctttcgctgtttcggttcttactgctctggcctcaacctctggagcccaacaacgctcctgtgcaaaaggatacgtaggtagacttattcttttgggtatgacattggaatatagcaatcgccaatctatatagaagcctttggcccacaactctgccagcttgttcatttcacaatttgcaatccatttgttcattaattccttgaaaacttcttcctgttcaaatagttgcactgaatcttttgactgattgttttctcccctccagcagttctcgataggtgcttgttcattcgtgaacgattggagcttttgtaccagctcgctcgtattctttacgataaaagctacccggtttttcattgccattcgtcctgtctgaagcgtaaaggatacatccgacaaattaatgtcttcagaagctatcaaaaaatctgaaagctcttgtgcatacactttaagccgatgatgatgccttgcagataatggaatcagatagatagcatcttcgttcacagaatgatctttaaatcgttctgattcagcattggctacaaattgttcaaatatggcatgagcgttagttccgcctattccaaaggagcttaacgccgcccggtgaggagccgacgccttctcccatttttggagacgatcaacaacataaaagggtgattcgggcaaatggatatcagagtttggtttttcgtaattaagcgaaggaggaatctcattatggtataggcttaaagcaactttaatgcaccccgccaaacctgcagcagtatccagatgcccgatattggttttgaccgatccaataccgcaaaattgttttttggtcgtatactgcctgtacgtttcatttaaggcagcaaattcaacaggatcgcccaattttgttccggttccatgcgtctcaatataactgatagattcgggatgaattcgggttgattctatcgtcttctgaataacctcagcctgacctttgacacttggggcataaaaccctaatttgtcggttccatcgttgtttacacctactccccgtaaaagcgcataaatatggtcaccgtctctaacggcatctggcgctttcttcagtagaacaaccccgaccccttctccgccaatcatcccatctgccgactcgtcaaaggctttaatatgtccatccctggagaaattcaagccgggttgatgcacatagcctaaactggtgaaaggaaagatcgtggatgctccgactaaagcgtacttggcttcaccggatagcaggctttgcgaagccagacgcaatccgactaatgaggaagagcagttcgagtgcacaaacagactcggacctttaaatcctaatttatgagagatcatggtaggaattgtcccaccctgtgctaagatccaggttacatattcatccgcgttcttcaggacattaggcgattgcgatgctaaattgggaataaatgcttgatagaagctgctgcttgccgacataaacacactggtatcaggaatttctttgctaatatagccagcatcctcaacggctttccatgaatgctgcaacagcaatttcatttgaggatccataaactctgcatttttctgtgataaactgaaaaactcagggtcgaagtactctttcccttcaattgtgcatcgtccgggaacatagcctcgattaccgacgatttctttttccagccctaatccaaccaattcttcctcggaaaagaagcgaacactctctacccctgccctcaaattgctccaaaactcggcatggtttttggcccctggaaaatgacatgaaatccctataattgcgagactatcctcaaaataatctgggtagggtggcttgaggtcatcttcgcctgaatccattttcggtagggatgtctcagctgtatctgtttgttccggtgtatgtgattgttccgtttgagaatcaacattctcgcttcttgtttctgtaatataggcactgagttccttaactgtcggatacttgaacaatgctgtcaccgaaatatcgcattccaacaattccttgacccttccgatcatctctgctgctgaaaaagaattcccacctacgtcaaagaaagcatcatctgtacttagatcatcaacattcagaagttttttccataccgttagaacttgctgttcaacatccgattgtggtaagtggatctttcttgttgttgctaactcgatcctgcgattcattaattcttttcgatctattttcccattaggggtcaaaggcagcttatctagctctataaaaaatgcgggtatcatataatagggcaagaaagtttttaaatagtttcgcacttccttcggatcgagaggaggcttaccggactcggaattgttcagcaaacagtaggcaacaagctgcttattccccccctgttccttggcaatcacgacacaatcatcgattcctggatatgttctgacctgaccttcaacttcacttagctcgatccgaaacccgcgaattttcacttgataatccatccgtcccacatactcaatagagccgtccgaaagccacctgcataaatctccagttctgtagagcttggtttccggattgaaaggattgtctatgaacttttcagccgtaagctctggctggttccaatagcctctggccaatccgctgcccgaaataaaaagctctcccggaagaccgacaggcacaggtctaagatgtttgtccaaaatgtaaatctgggtgtttgcgataggcttaccgatcgaaataggcttatctgcgtcgatcttttgaattgtagaccaaattgtggtttcggtcggaccgaacatattccatgcgtcacagccgttatgaacaaaataagatttcaacgtttccgaaagggcttcccctccacagagaactttcatgttctcttcgttcttccagtcggcttgaaagagcagggtccaagtcacaggagtggcttgcatgattgtcggttttattctttgaatttcccgcttaagtctttcggcatcctttatgtttttggagctgcaaatatagcattgagcccccttaatcaaaggcagatataattccagtaccgctatatcaaagcaatacgttgtcactgcaagtagtttgtcctgctctgttaaaccgggctgctctcccatggaaataagaaagttggtcaacgctttatgtggaatcatgacccccttgggtttccctgtacttccagaggtatatatcacatatgccaaatggtgaggttgtacttcccgtttgattgtctttctacccttcacgtcacttttcagatgatcccaatctttatcaaggacaatacagctaacgttgttcccttccaagcgtgacactttctccaacaaccccgattgcgtaatgaccagtgaaactttggaatcctgaagcatatactccaatcggtcctccggatattccggatcgagcggcacgtaggctccaccggccatcaggattcctaacagcccaatcaccatatctaaagaacgttccatgcaaatccccacaagagtatcaggagttaccccatgtttctgcaaatataaggccagcaaagtgctcttttcttttagttccccataggtaagcgattccttttcatatacaactgcaatagcttcaggtgtttttcttgcctgttttgtgaataattcaggaaagcatttatcaggataacttgttccggtagcattccagtcattaaggatgatgtccttttcctctggtaaaagtaatgaatgctcctccaagggccaagtgggattctccataagtgcttccgctaattctatataacgctctgccatctgtatgatggttgaatgatcgaacaaattggagcgatatttgatatttaatatcatttcctcttcctgctcttgcatttccaataccaactcgtattcgccttcctggtgaatttcttcaaccaattcgacgaaaaagatatctttatatggcttgcaaagctgccgaaagcttgaagttggaaggaagttttgataagaaaaggcggcttggaaaacaggtgagctcgtctgtatccgcggcacattcaattctcggaccagagccggaaaaggatacgaggcatgatccattccatcgactactgtcagctgcaattttttcatgaaatccaggaatgtctctgtttccgatacctgactccgtattggaagcatattgacaaaatagccgattaaattatcaaaacgctgctccgggcgcaccataactggcattccaacaatgatatcttcctgtcccgaatactggttaagcaataccgtatacatacctaacaagactgtacacaagctcgtatattgcgcttgggcaaaagactttactcgtttgacccatttaagcggaagcggcttggaatatgtttgtgcttccatgctttgagccggaaaaccagagcggtcatatggcagctccagggtcggtaaagcacctgacagctgttgtgtccagtaggaacgatacttctccccttctgcactcgctaacatcgtttgctcccatttaacaaaatcgccgtagctcgctgcgggtggcaacactgtcgatgtctttccctgtaccacgttcttataggcatctaaaaagctttgtataaacatgccgaaagaacttccatcaaaaataatatggtggatgacaaccagtatgaaatgttcctgttcagatctggacataacataaatacgcatcaaaggatcctgttccagcatgaatggttgctttgctttatttctaataaatggaatactctcatctgcttccaaggctgaaatatcctccacttgcacatgaagcggctgcgtgggctgcagcttttgataaggtatcccattttcctcttcaatcacactttttaaaataggatactgttctaaaacgatgtgaaaagcttgtttaatgctttcaatctcaatcttcgtattaaaccggaggcatattggtatattgtaagcattcatctcaggggacattttatgtaatagccacaaccctttctgaacttcagaaagcggattccttcggaaactgagcgaattattctcagtattgacctgtgcagtggatttatcttctttaaccttttgggctaaatatgccgataatagttgaatcgtcgggttctctaaaatttctcttgctttaaccttgatcggataggacttctcaaggccgcgtataagcttcatgacaagaatagaatcgatgccataaccatgaagatttgtattcaaattcatttcttcgtgcttgagattcagttcccaacacaaaaattgcactatatattcctgaatcttcgactgaaccaacgaaatggcatttatggtagcgtgatggttttctgcagcggtttcttccatattcgaatgtgatggtgaaaatccactccgatattgataaagtgcttgaagctcttgtttgatataagcattgcggcagatctttctttggattttcccacttcccgttttgggtatacttcccttaagcagcaaatagatatcgtaaatttcaagttgatgcgtatcggatacggcattcagtatgttttcgaccaaccgtttatattcctgctcatgaaggggcgcttcaatttcctgtacgacgattactttttcctgaccattgatttcagaggaaaatacagcaatgggcaaggtcaactctggcatattcttttggatggtccattcaatatcgacgggatgatgatttttgccgcgaataatgatgacttccttctctctgccgatgacatagatatgattgtccgcaatgaagccaaggtccccggaacgaaaaaagccgccttcttttgtatcggaaagggctacctcaaaagtgctattcgtttcttccttcctatttaaatatccctctgccatccgtacggatttaatccaaatctcgccgacttcctccggtaagcattgtgtatgtctttcaggatgaacaattcgtatttgcgtcggatcttcaatctccccacagctcactacggacttcgatttgttcttctcatccgtgtattggactcttcgttgctccaagctagggatatctaaattaaggaatctcatcgactgacctggttttatactggcgacggggcacagctccgataagccaaggaggggacaaaatatatcctctcgtagccctaatgcccggaatttatggatgaagttctcgtaagtttccttccgaatgggctcacctgcacatataatcgcttggagatggcgaagtgaatattgcttaattgaagcgatgtccagtgtggagcagcaataatcgaacgcaaaatttggcgctgccgtatgggtagcctgatacttgtcaatcatatgaatccaattttccggatttttagcgaagctttctggcgggagaataatgctcgatgccccgtttaaaagtgggactaaaatattgttatgcagtccaaaagcatgaaattgcggtgtccaggaaacaacacgactattccggtcaattctccattgctcagccttggcctgattcatcaagcagctgtgactaaggattacaccttttggtaaggatgttgagcccgatgtatacatcaaaagagcagtatcctgcggcgctggcattctcatttctatgtcaacgttaacggcgtcttcttgaaagatttcatcaatattcaggatacggattgaattaaactcctcccgtgtttggagaaatgctttgaagtccgtattagttatgatacatacagcttgggaatccctataaataggcatcatcttctcaaagattttttcatccggctccgaatctgtaataggtgtaggtatgaccacgatatttgcataaaaacatgccagcatgctgctgatatattccagaccctgaggaaatacaagaagtgcccgttcctgctcagccagttctttcaaaaggatactgcccaaagcctgtatttgatgtagaagcgtatttccggaaagaacttgaggactctggccttctttctcaaacgtaaacaactctctttcaggaaatttccggcaagtttcaataaaagaagcgatcggaatatcaaggttccatgtttggtcatgttttcgcatcattctccaccaactcctcaaaacacaaagtttatataacatgagctaaaggcttatcaccctgtccattttgagctattattcacgtttgaagcattgccgggagttgcctgctaaaatatatcaaagaaaaaacgagtgatgaggaaggctatatgcttctttcacactcgttactggttcgcatgaacaaccgcaaaggcgttcaaggaatctctatttggttattttccaaacaagttgataattcgttctttaacctccgcttgatgaaaggtcttctcatgcatgataagctcttgttctacgattttgggaagctgttcccggagtggagcaaccaaatgatcctttagcgtgattaaagaaaatctgggtttctcggctagctgccgggcaaaatccattacatagcccatcacttctttgcggggcagggtcggaaatggaactccccgtttctccagttcaacgcctcgataattgcccccatttaacaatagttcttctcccaagctgaaccctagttttttaggaatgatatacgtggcacccattcccggtgtgaatccgtatctcataaaattagttgtgtacacactttccttacttaggactacaaaatcagcaaatagccccattacaaagccaccgcccaccgcatgtccctgcatggcagctatcactggaactttacagcccaatgcaagagagtaaatattttcatcggtaaacttcgagattccttcatgtaaagccaacagtccctcttgcgtcccacccgtggcaaagtaattatcgtatcctgttagaattacgactttgcaggttgaatcttcttggatcgtcttgaacgcttgtcttagtccatgggtcatttcaagcgtaaatgtatttttatgaactctatcttgcattttcacttgaataatgcctcgctcgatttcaagtaattcaaccacggattgtgacattatgatcttcttcccccctgcatccccatcttgtggcgcacgccatcagtccatccacggaaattgccccgtttcaacgtaccggaaaatccccttaagattttgagaatctgaaaacacctcttgattggacgccaacgctagtggtttacattgacgcaaatcgttgagttcatccataaagcgcttgtagcgtaagatccccttcttggtcaatcgtctgaggcgtaataaatgtttgcgtagtaccatctcgctctgaacatcgtacgcatcaaccaatccccatacatgggcctgttgaaccgaaacgggctgcgtcattagtgttaaataatgcgctttttggaatccaatcctgcggactaaaaaaggtagaacgcaagcaggaaaaagtccgaatagcaattctgacaagctgaactgtgccgtctcgtcagctatcacaatatcgctggcagcaataaatccgacgccaccagcgtttgcttttcctcgcacatgagaaatcgtgatataaggcccagttgctagttttaaccacagatcatacatagactctggactcattgcatgttcttgtccactttccactttttcacgcattccctcaaaatccgccccaaaacagaacacctctggcagaccctccaaaactacgatcgtaaccgactcctcacacagtgcaagtacatgcaagcactcctcgatgagggtattattaatcgtattgtttgcctcaggtcggtaaaaccgaatataacaaatcgattcttgaaagcgaacctgaatcgtttgataactcatgattcccacctgtatttacggtggaattcatagatttcttccaaatacaaccgctgtctccctttcccggaagctatgacccccggaatcaattgaaaatccagcttggcgttgcgggttccaaatcgtacggcgccactgccttttagcagggattcatattcatccatagataactgatagcgatcattcaaattacgctcgatttcaaaacgccgcagatgttcctggctttgcggcataacaaccccgctataaaattcagagcagcagcctgacccgtaggaaaaacagccgattcgctttggagcatcgaatgtaccttgatcaatcgtacctgccaaggagaggtacaaagttgcccccataatatttccgactcgttggcaatacgctaatccaggcttaacacgttgtaaataatctgcctcaatctcatttggtttggattgagtcaaccttcgcatcatcgtgcgatgcgccccttttaccattccgccaaaaggagtatgaaaggcaagatactgaaaggtatctttataatccactcctttcacccgtttttgatattccaaaaacgcttgctcgcaacaatccagataggacattaaagacaaatctgcatccccagcctcgctatctggaatcggccggcaagtatccatcacctcatagccgtaatatccattagcgcctgcatcgatttgaaaaacatgaggattttcactaatgagcattgccacggcccctgcgcctccacttggctcagcataagaccaatcctcactcaatacatccccgccttcagcagcaataaatcgtgaaatatcactggcaattacaagcgcttttgctcctggcgagacctgagaaagaataaaattcaccgccatttggagtcctgcagtaccggaatagcaggcttgcttgagctcaaataatctgcaattccgattcaaccccaaatagtggtgaatatatgtactgattgatttcccaaaatcaatacctgattctgtacaggtgataagcatttcgattcggtttttttccgcttctgaaagagcgtccaccagcggttttgccgcatttactccaaaggtaactggatcttcataaggcagggcaaccgccttttctttcattaataaattttcgaaccttgcaggatccaattgcctgtgttgggctaattgcataacatccagataggcagatccaccaaaaacgttcattgcctcaattcccacgacaaccataatcgtccccctctctcaaatacgcgactcacatttttgcatacaaatggccgtattgattccaccaaaccccatgctcagattcatggtattgtgaataattgctggtactggctcattcttcacccaattgcagtccaaatggataggctcctccaaattacgggtagggtgaagtctcgactctttcatttgtaaaagagtagccacaatttcaaccgttcctgccgcgctcaagccatgaccgataatggatttggttgcattgatataggcatgtgacaatttacaatcctgtaatgcctttatttctatctcgtctccaacgaccgagcctgtcccatggggattaatataatcaatctcttccggtagcagctttgctttctccaaagctcttctaatcactcgggcttcgccttcgtaagagggattgggattccggttacgatccatccccatatcccatcctgcaagtttggcataaggtttctcccgacgcctcacggcagaatcggcccgttctatgactacaaccccgcaagattccccatagatgaacccgtcccgcgactgatcaaatggtcgacacgccattgcaggttcatcggcatatcggtcgcttcccatcgctcccaaggaccgcaatgcctggcattccatatgcgaaatatccatcaatgcccccattgcaatacaaacatcaacacgatctgcttgaattgcctcaattgcttgaatgattgcgacttgtccactagcggatgcaccaccgacggtataagctaacccctgaatgccgaactgttcggtacatagtccgcacaaatcagtatccataaaggaaaccccataggtcggcggtacaaagcacattttttcccgataggcctcataggtctgaaatagctcccgttgctgaaaattggagcctccaaccaccagtccaatacggctaggatcaacgttatccaattgggcatcatcccaggcttcttgaagggttaccatggctacctgccccgaaaatgatgctgtacgtaacattcgtttggataatgccttcggataagacaaggttggcagctccgcacctataaatgaagcttcgcctcttctgccagggcgctgcatgaagccaaatgcatgctgccctttgaacaacgccgaggcaaaagcagccttcccctgcccaatcgccgaagtcacgccaatccccgtaacgaataactcagacttttcataatttttcataatttcgcataaagtgcatctgtcaattcccctatatttttcacgccagacaattcgacacgcggaatattaagagataatgtttccattgtcttgtttacaatttcggcccggtctactgaatctgcacccaaatccaccaaccgatcgctatactcgaacgtgtgatcttgtaattcaggaagcacttcacgaatacaacgtttaacaatatcgaatacttcttccttatgcatgggtatcctcctaaaagataaatgttttaaaactcaacaacccggtattcaataagcatgacctacaaatggatttcgatgaaaaattgtattgaatttctcataaagccgagaagtattcatactccattccgtcttccttggtgctacaatcgtgcagatatagtcacctaaccggtaagactgggcagcatactgtggaaaatgtgaaaatgtactttggaagtatccatccaccaatctggtctcattcatttcaagtacatgcagcgatgttgtaaaacctgtgcgcaatattttcgacagggcctccttcactgtccaaaaaaccgtcaataaagctgaatactcccctactccccgcacgacagagattctttccatttcttccgtcgtcagttggctttcaattgtcttatttcgcttagaatcaatcctctcaatatcaatgcccatgggatgcgcttcgggaaaaacaacagccgctccgatatagttgcaatgggcaatgctcacctggtaactgtggacaccattgattcgaagcatgggctggccaaagacacctgtctccacacttacgttgcgcaggtttggctcgcttaacagcaccgaaaccgcttgtttcgcacttagcctgccaagcacaaagttggttttccgccgatggaataccaaactctcgaagtaattacactcatccgaatgaaaaacttcccgatcaaggggagcgtctgcgttataatctacatggacaaaactaacggccgccttcatcacggcatcttcccgcttcaatattagttgttctgcatacgaggctacgcatatccccccctagtaaactactaacttagcagtccaaatcaaaaaagaccttcaaatcccttatgggttctgaaagcttcctcatggagtatgaactcgtcataagttctccactttaaaccttacttataatttccaaagctactcttactaacctaatatcacccataaattccaactgaatgaccgcttgtcgtttatgtctatctattttcttaactatactcccccttcctttgagtgggccatctaggatacgtatattgtctccttcaataattccagttgatgattctatacaatagctatcattgcatagactctctaacatttgtttctccgaatctctcattgaagcttcaaacttcgagtatctcaataaacgaatgatatcactagaagtgcaaatcattgaatttgtactggttacgaactgcaagtcaggtaaattcgactcaataaatacatagcttgggaacaaaggagcccattctttctttactattcctgctactttaaaaagtctctcttggagaggtataaagggtttgtagacttcagaatccatccactcattaataagctgcttgacctgttcttccctacccgttcgcacaaaaaacacgtaccagctcacttaactcatctcctataaaaacgtactgccaaatcatcttctataatgtctactacccatatacatagcttcgccctttcacttatcctacttgataagctacaatctctcacgatatatccctcattaatggttaacgtgacccgccagcgattaaccacagacaagttcctttatttttcatataatcatataattggaataatgtttttccattataatcctctactcaaaccctgtcaattcacagttgattggtaacggcaagttcatcattggattcgcaaatctttctgaaaatggctcaatttgaggtcattattatctttcgagtacagcttttatgtttctagcggctcataaaaaaactgatctgggtgttttatactagtgaacttgagcatctgaggcatacacaagcgatagatcgttatgtactattttttatattcaagattttctctcaccattagaactggaccacattacagactcatttgaaatcaaacagtcccttttggttcggacgcattctaaatttaataaaagattccttactcgtaaattgaaaataaatattttcatccatgaggtgattgagtgtaaaaccaggcgctttaccaaatgaatgagcaggataaatttgaatagagtcatcaatttctcgctttattttttgaacgctattatataattctaccggatctcctccatttgggtcacaaaagccacaaccttcaatgaaaattgtatccccagtaaataagcgatctgataacaggtagcatacacttcccacggtatgtccgggggtcaaaagacttttgatttccgtttcaccaaccttgattgaatccttgtctttaattgaatgtaaatttctacatctaaaattataaaaatcgatttcgtttattgacatgaatacttgcgggttatatttttctaggagtggatttaccaaattaatatgatcccaatgtgagtgagttaatagtatcgctttgagattgccattcaattgttgaagataggattctactttcaataaatcccatgacgggtcaacaatagctatgtctcttgttttctcatccattacaaaatatacatagttaatgaaattcataaaacaaactcttaactgttccatatgataagtcagattcatatcagcttcactgaaccaccttcccaatgattaattaaaaacaacaacattctgtttgaaggatttatacctcttcatttttggagataatttacactcaattataaagccccatttcgtggtacctacgattataaccattgatgcaatagaaaggctccgactctctgttacaagatcgcttaatcttgccaaaataaaaaacgcctctccgtatgttaacggtgagacgttttttgttgatcctgcgtacttgctgaatgctccactgcagctacaagatctctcattattttcgttcatttaactttgatgtgtccatggtaattcaagaatgccgaggaccgggatcgaaccggtacggtagtcacctaccgcaggattttaagtcctgtgcgtctgccaattccgccaccccggcataatgacgctgtttctggccgtttttaccttcgtaaagtttgtctctacgcaggggatacgaaccgactagcgaaatgtttggcgagtatcttacgcgctttattcgtttcatcaacgaatatgatcataccatgttacgttatactaagtcaacactttattgtaaatttaattttacgcgtttatactaagaacacacgttcctaacacggaggctcgcaacatgactacgcagataaccgcagaggaccacgcactcgtccgtacatacttattattaccgatggtacttaccgcatttgaacgcgacaaacgaatactttcggagtcagccggattacgtacgcccggcccctacgtagaggtcgtcgaacaggcgatgaacgcagtaagcgcggaactaaaggacgtacgcgcagctatgcgcaaacgcggcgttaaagtatacgaggagacacgggattccgtccaggtagttgcgctatatcaatgtcgcggctatcacggacgctttatgatgctcaactcgttcatagccgccgaagccgggctgttgatgcggaagtatctcggattggatacgcggagaatagaggaggctcggactacgcttcgtccttgaacgtacaacgaagaaaaagcgcccacctccgaagagatgagcgcttagtttattgttatgttaaatatgaggccgtagcgtagtagtccgtacaaaaaccatagtatgataccgccgataataagcccggaaattaatctcgcaacttgtttatctaccggaaacatatcccaaaaactcggatcgttatcgacttcttcagttgccttcgccgttaccgcagattcctgatctttcactccgaatctcctccgtatctgtgttacgtttccctaaataataccattcaaatgggttactgtcactaaaagagtactataggcattttcatttttcctttaaaggaaacctcgcaaacagccagtatcccaaaaacccaaccagatacgctaacagatcaaacgggtcactgactgactccttatagaaaggcgttatgtattcccaaaacactcccgaaaacatcactagtagaaggcaccaccagaagtttcttgctatttgtcgtattgttaggaagtaaacaatgcttacaaaagagattaatagagcaggtgctagtagatcattatagtaccccgcgaagaaccaacttagcggccctttatgtcctttaagtaaagcttcattcgctacgtataatacaaggcacaaaaggatcacgaacatttcacgaaccagccttctatcaaagaacactagcatctagcagaacgataggattaccacagctaggacaatccctaaggcaatagtgataatttgtttcatttataacactccgtttccattttcgtagtatagcctatgctatatctctatagagttgacctcaatgaatctagatatattttactatggaatctatctgtaatctagtatgaatttcctatgcatagaggaaaacgggcccacctacgccttatcgcgcaaatgggtccgcttgtattacttcgtgtcttccgccttctgctccgttttaaacgttgagtacacgcctgtcccgattaacgcgtacgaaacgatgtctactccgatttgccacgttccgaaatccggtgctactccgtacttttcgaggacttggtacgcgaggccgacaactgctgcgataaataacggattagttaaacgttgtttcatattacgccgcacctcccttcgcaccaaatacaccggcgcgatcgagtacggtaatcatacggtagaaatcgtaagagccgtcattcgcggtatccaacaggcccgccgccttcgcgttaacacacgcctgctccgcccacgctggcaccttcgcgagcttattcgtagattccagcgcgactacccgatcctgtaacgctctaaaagctgctttctcttccgttgtcatctcgtcatcatcctccgttttattcgatttaagtgcgtcgatcttcgtcatcgcagtattaagttgcgtctggctcgggcgcttgccggcgcgatagtctgcggttgatagtccgaacgtcatttcgaaatgcggataatccttaaacgagcgccaatctccgccccaattccagccgatccgttttgcctccgcaacgacctcgtcccagtccgcaatgccatccccgtcgccgtcacgtttcatatcccacgatacgtttttcccgtccggcaataataacgcaaagtcgatcgcaacgccgaaattgtggtacgaataacctccgcgagcattcgttacgatctgaccggacttgctgcggccttgtgcgtaaagtccgttctgctcgtcgatggtgcggagcccttgcgtgataacaatcggcacgccgcacgcataggcaaagtcgataagcaactcggccgctttacgttgggtgtcagacagacccgcgattcgattcgttgacttagcgcgtacttgctctagcgttaacatttggtcatccctcccgtttaatcgccgacttgatatcgtttacgtcaatccgcaatgtctcgtactggcccgcgagcgtttcgaattgatgcgtaatgccctccgcgagcttgagtaagcggtcctctcgttcgcgtgcttcggtattgatgcgcagttctcgcgcggctgcttcgtcttgtatgcgggattcgcgcgccttaccatcgtcttgaatgcgccgggactcgcgtagttggtacaaaaaaagcgcgacaaaaaggacggcgaagataccgtccttgagtgctgcgtttattaacgtttgttccatgcgttaggcggcctccttccgtttattcgtacgcccaccattcccacgcagacaacttagcgatataagtaccgcctgcataagcgtctattctgctaccggacagttttacgctaaacccttgtattggaggctccagatacccagcgttgacgtagttgttacgccaacccttagcacttttgttgtcgttaaaggtggatgaagtcatgacgaaagcatctacttgtcgtgacgtagacgtaccttgcgtgtcctccaatacaacccgtataaacacgcgattcacggtaaaaggcagagcgacagccacggtcatatcgaccccatttgccgaactcgtcgcggttgccgactgaccgttgaacgtaccagacgcaaagcgttttacgggtagagttgctattgcattagcatactcttggaatgtgttgccggccgatacattaccacccttgccgttgatagcgccagcaatgacaccttttccatcaacgacagattgctttaaaccgtttaagtccccacccgaccagcttagattaccgtctgtcccaacccatatgagattacccattgtctgacccgtagtgaggtttgctttttgtaggtaaaacgccccatctgctccagcttgaaaccttattccataaggagcgccagtattttttataactaaacctttttcagttccggctagagttaaatcgttgtttatatacccaccatttgaagtcataacttccgtccatggcctccaatcagcaccattaaatgatagccgctgaaaaatcctacccgggttgtcgtgggtataataaacatgtacacacgcacccccgttataatctacgactagttttccataaccgtatgctccggctggatagtttgtgtaacccgtccacactggaagagccacattgtaaccaccagacagtatagcgacgttccaatttaagggtacgttcccccgatccctgtatgcgccgtttgccaagtcgtaagctgccttgaccgcttttggcgtagcagccatcgtattggacgtgctattcgtcgcctcgcttagctgcacgatacccttttgcgtcaggctcgcgtcgaccgggtctttcacgttaagctgatccgcaggcacctttccgtctgcgcccagtaccgctagacctcccgcaacacctaccttcgcgtctaccgcttccgccagcgcattcatgtcacgtggcacgtccgcagtcatgttcggctcaattagcggaagactgagtttatccgtatttgccatcgttaaaacctccggttatatatgtcatcgtacgtcttacccgttgccgcgatctctccgtacgtttttccagtatcgagtagctccgcatacgtaaagaagcggaacacgtagtcgattgcgaggtgcgccggtataatctcgcgcaacgtttcctttaataggtaaatttgagcaggcacgccaaaaacgcctatgaacgtaatcgtaagcgtgtaacttgcgatattcggcgttacgtctacctctccgtttgcatacgcagccgctacattctcgatgagttccgcgttaacccgtcccacaccccgtagtttaccgcgcaacacttcgcgccgctgttcgtacgttttcgttgggtccgttgtaatcccgaatatcttctcccaacgtgcaagcccccatgtagctgttccaatgtaaaactgatcgagtacgtcataagcggacgcacatatacgcgccagttcctccgcttcccggtcgatgaggttcccggcgatacgagattcgtcgtaatagcgcgggagagggtcgcgcatgaactgttgagtttccgctactgttttcgtcacgtaattgtcaccgacccaagcaccgcaacctgtccgtccgtgactatgacgttgccggtcgtaccgttaagcgtaagtgacgcgtagtccctgactggaggaatgtcgataattacgttaccgatctgatttatacgtacgatcgggtccgcgaaggctaacgtttcgaggtacttacgcgctcccgcctcgactagcgcttttacttcgtccaacgtagcacccggcgctaagtccacgtcagcaacgatattaatcggaacctcttccgctcctacaactgtagccaccgcaccgagcggagcctgaccttcgccgcgtccgtcttgtgtcgggtcaatgtacgtttgggccgcggctatgactgcggaatcgggcgaggttttatcgtctccgagtagtacgaccttcacggtcccggctccgttccagaccgggtaaacacgcgcatccgcaacgccgggaacttcacgcgcccattgacgatagtgattcgcattgcctgacgtaactggccgccgcgcccgttcgtagtagcgatccctgaacgcatcgtctgattcgcggtcgacgccgccttcgaagttaactgcgttcgttaccgttacgactccgactaaatcgcccaccatcatattaattgctccgatacttacgttaccggatgcgcccgcctcttctgctgtagctgcgaccgttgcgctggtgcttgcgattgttacgtcagccgtcgttacaaaataaaccggaactgccgcgcccgtcgacgtaatggttcctgcgggaatgactgttccatcaggccccgtaaacgtcaacgtacccttcgctttcaccgctactttgcgtgtcagtccgtaatcggctgcgcgacggtcgagatagtcgtcacttgtggtatccgtaaagcccatcgtaagtacggtgtccaattccgtgtaaagtccggtcatctcgatagctggtggacttaacaaatcgttagttacggaaccttgccgcttgtctatatcctccggagatgcgtcgagcatccgctgcaatatcgcctctttcgtttgatcctcgtacattacaccgtcacctccatcggaatttcctctccgtccacgtcaacgtaaaaagagacgaacaaatcgctcgcctccctcgttatgtcaaatccgtatacatcgtcgatccggtcatcgtaaataagtgcttcggttatgacgcggggtatttccgtttcaagtagctccatcggaacgtcctgaccgatcaagtcttcgagctcacatccgtagtcctcgtcgtagattgagaaatgaaatcgtgacgtcaatatcgccttgagaataaactggcggattgcctcgcgcccgtcaataatcccgccaactgccccgctgtccaagtccaacgcgtacgtccgactcggctccacgtctgtttccgtaactacgtcaaggtcttcgctcaaatcgacgtctacttcctgtaatggactaagcgccatcgtccgcacctcctatccgatccaacacgatataacgttgtcccgccccaaatgacgcaatcgcaacgcggtcgcccgccttcagcgtatcgtgaaacgtaatctcgaattcaccggacgtgaaggacccgaagttgaacacgtcgctgaacgctttcgaattaacaggcgcagacgattcggtctcctttgttacgcgcgtatatcggtttagttcgagcgtagtcggtgacagcggccccgcggagcttttaacggacaccttccgcgtatgttcacgcaagtgctccggtatgattacgtcgtctccgtcgagctcgattttcatgttatcgacttgtacacggagagctggcggaggtgcgatgatcgtcgcgtattcgatatcgacttctacgttgtggccgattttgcggaccatgtccttgagctgaagtactttacttccatcaataagatccaactctacttgccacctcctcgtattgactccatctcagctacggtatcgaggactttcagcgtagacccgcctgaagctgcttttgtggtctttttcttcgctttctttttcttcttcttggccgcttctttcttcggttccgattcttcgtattctaatttcggcaagtcgtccgttttgctcaacgttagcgacatcatgtgcattccgttcgtaaacgtatgagtatccgcatttacgtaataaccgccaacaatgtccgtcatgctctcgaaggcataaacggcagttcccgcgacgacttgcgtaatgcctaatgcatctacggacacgtcttcgccgactttgccgagttccttcagcttggccttcgcgagttgttggatttggctggcggttgcgtccgaatctgcggactctacgtgttgcatcattccatattttttaatcagcgcggcatccttcgccgtggatgtaataggcttttcatccgtacccccctgcgccttaaccgctgtacgcatttcctcgatagactgcgatcgccgcgctgatgtaatgttaacgccgtcctccaacatccagcgtacaatttcgtcctttttctcacgcaaaaaaagcttaccctcacgcgagtaaacgaagaatttacggttgttttgcttacgtgtttccgttaaagcagtcgttatcatatcccacagcgacatatcacggaggataagcttcggaataacgtaacccgtgtttgagacggtgccgacggggattccgaacgatttacaaagcgaggaaacgatcgcgccagccgtcttgccgacgaacttctgcgtatctacgtttttcgtgaggtatacgttttcgtcatacgccgtaatcgttgtatcgcctttgtcgtcgatatcatacgtaaaaataacgccgcgaaagagaccaacatcgtctacgtaaaagcgcagctccttcccgagctcaaacgcgatccgcttatcatccgcatttagtgtattggaatacgagacagacagcgtacggtgaggctgtgaaacatctccggaccacgttgcggacttgacgagcggttctatccaatactttccgtcgtagagcaacttaatatccattacggaatcaccaacttctgccccggcttaagtacgtttggattcggaccaatcgcggacttatttttagcgtaaagctcgcgccatctgtcaccgttgccgagtacgtctgcccgttgcgcaatcttccacaacgagtcgcccgccttaaccgtatacgactttgccttaacggttgcgttcggacgctttgccgccgatgtaagctttggcattgttttcgacgcggagcccgtaagctttttattgtccgatttctttgcgatgtcgataaaaacgtgttctttcagcgacaacgtataatagatatcgcccggctcaccgcctcgctcctcgtattcaaaagagcgaatagtaacagcgaaattaacggaggtgcccgtaatgataaaccgcgcaggcttaccactacgcatccaacgctcgattatcgccacatactcacgtggagctttgaggttagagtacgaacaatagcccgcgttgtaatcgcggggaaagaacgatgacatcgagaactcacggaggcgttgattgccgattatcgtatactcgccgagattcgaaatctcaacgtcttcgtacccgtgggtcatcgtcgtctggatactctcgggatttacgggaagccataggacttccgcgccgttgttatacttgagccaaaactgcaaaacatcgcctccttacgcccacattcgtattagttgtcccgcgatcttttcgatatccgcctcttcacggacgacaaacgtattccccgtgattacgacaccgcccgatccgcctccgcgctgttggtcacgccattcggacgcctcgtgcttcgttaagaccgcttcgtccttgtggagacgcgccttaaatccgttatatggaacgttgtcgaggccgctcgcctttccactccagccgctgtttccggtagtttcgttccaccactgtttgacactgctcgtaaaccccgactctttagtaggaaccatctctgtttttcctgaaagtgcgggggctcctttgggcaagctgttcagatgtgcattgtactccaacaggcgctcgcctttcgctgatccgctaacctccttcaggccaccgctcagaaagtcaattgtcttcttaacccacggagatgctgtaatggcgagagctactgtgagcccgattggatttggtgcttttcccgcaataaacaaaccgaggataaacgcaaactccggattattgacaatcgtgctcgcaaagttctttcctatagccatcgcggattccttaccgaattgcgcaaacttttcggacgctcctccgttccaccaatcggataacgtctttttcacagtgtcaaaaacgaacgaaattttgcttttaatatctggaagcttgttaaactccggattattgatgaagtgtgttttcaggtacgacttagccgtatcaactgcgcgttgtatggccgccgtgatacggggggtgtacttaatcacaaggttagacatagcatcggcaagtttagcaatgatcggcattgttggcatcaaggcagaaatttgcaatgtctctagggctccggaaaattgctccacacttcctgctgcaccctccatcttcttcttggcaacttgtaatgcggttacgttcgccatttcctgctgaaacttcttaacgccagccgcgccttctttgaagaggatgttgcccgcacgaatcgcgtcggacccgaatatctgatgcaagtagtattgacgttgttcgttcgtaagcttcccgaatcggttctttaacaagtccgctacttgcgccaggtctttaatctcgcccttattatcgtagaaagcggaatggatgagattactcgcagtcaggaacttcttcgtttccttcgctgccttagacgttccgaccttgagccccgtttgagctgcgacgtatttctcgatgtccttcgtaacagcctgtacggacgtccccgttgacttaataccctttttactcataaacgcaagagcatccgtagtattaacggtgagcaaattgaagtcttcgaacatgccgtacgccttgtccgttgctggaaccaagttggacagcatcgttttcagcgatgtaccagcgtctgcgccttttaatccattattcgcgaagaggcctagcgctgtatttacgtctttaaacgacatgccgacgccatccgctacggaaccgaccgctgccaacgagtaacgcaaatcatgtacgtcagtcgcggacgcgttcgcagtcccggcgagaatatcagccgcttgagctgcggttaagccgtcttttttgaacgagttgagcgccgtagacataacttccgcagcctctgcgagaccaaggccgcctgctgttgcgaggttgagcgctgcgttcaggccgcccgcttggacctgcgcggtggacatgcccgctttcaacagttcctcgatcccttgcgcggcttcgagcgcactatatttcgttaacgccccctgctcgagcgcgagttgttgcatggccttcgtttgctcgtcggtcgcgcctgttaacgcctgaaccgtcttcatctgcgactcgaaatccatcgcctttttaacggaatccgctgcgaacgcaatccccgtagtcgcaacgccaatccccgtcgctgctacgccgaacttgagcattccgcccatcgccttacggagaggacgggacatatcgtcaatcagccgcaagtgtccgatcaaatcgaatgaaatcgtaattacctccttcctgcgttatttctgccgtctctccgcttcaacttcgagctgaatcatcatggacgcgtacataaagaagcgatgccttcgttcctttgcgtaaacttcgtcgggcggaatcccgtggcgctggaaaatctcatgtaacatgtacgcctccggatcgcccgacttaattagttttttgcgtcttcaacgagctccgcgtcctctacgaaaccggaaagcgctagaaccgattggattaaccgcgtttgttcgccaggcagtagcgccttcttcacgcagtccgccgcgtcggatgcttcgtaatgatctttaagcgccttatcattaaaatccggatcggctgcgctctttgcgattagcaagcggttaaacagcgcgccatctacagaaccgtccttacccgtggttgcctgcgaacgggcccgatcaattgaatcctcgtccagcgccttaatcgtgaaatgcgttttcagtcgcggaatataaatctcttccttcaaatccgtcgttgctccgagtaacgcttcgagtcctttagccatctatgtcaacctccgattattttcgtaattaaaaagaggccccgaaggacctccgtatattaagctgcgcggattttatccataacctcgtagccgctgaacaagaacgtaagctcctgctcaacgatcgaaccgacctcgtagttgataatcggaatcttatcgaacgtgacgtttttcagccgcacccgatacgcaccgaacgattcggggtcgtccagcttaacgacgagctccgtagtaaatgccggactcttatcgtccgtaacctgcgccatcttctcgatccattccgacgtaaccatgtagctcccgattgagccggagcccttcagcgacgtaaccttatttccgatccaacgcgtaccggcgagtttgacgtcctcgaatccgatctcgatattcgcctcgcacgaataaacgttggacatccagttaccgtccgcatcgttcaccgcaccgtacgcgccagaaatgacgcgtgtagcatctagtaccatctatttttcaccgtccttaaacgtttactgtaatgaagatgcgttccattgaatcgacttccacgtaagaaatagctaggaatacttggtcacctacggacggaaagttcggatctagtccgaccgcagggcccgacagtacgcccgaaatctccaagcgttcgaggtacgccttaatcgcaaccatcaacgtagcctgaccgtccgcgttgttgttgagcttgccgatgtaattgtcttccgcggttttggtaatgtccgtactaatcgcttgtcgcgcgcgcatattacggactttttgtttggacgttacgaggccttgcttaactttcacgcgagtaccatcgttgacgaaaacaaacgaaccggccgtaagcgctgcgtcaaattccgttttggtcaaacgccgagtaacgtcatctgccggtacttgtgcgtaagtggtcgagcggttaatcgcagtacccgcaattaagccggccacccacggagcaaatgcggacgaatgatacgtcttgctaccgatgaccactccgctaatcaggttaacgaggtaattgtccgcattaagtacggaccgcgcgttaccaagcgcaggatcggcgtccgtagctgcatcaccgccgattacggagataaagtgcttgccctctgtacgattgcggattgtccacgtcttggtcagcgcttgctcgtccgcgttaaactcgccatcaaaggcaaacacgttgaaatcgcgagcatcgtaagcgtctcgcatggcgatgtagtcttccggcgcggatgtcttcggcatcgtatagacgagtacgtttttagcaccgccctgcaacgcaaataagatcgactggatattcgacgctccgaacgtatctgatgcggctttctccgtttcgaccgtgtaaaacgtcttaggtgtcgcctttgcaccgtaatttaacagcggaatcgcgaccgtaccgcgtgcgcctccgttaatctgcgcggcggccgcttcgacgtaatttatataaagacctggctgaataggtaacgcagtagggtcccaggaacctccggacatatttatgccacctctcttttgacaacatcaaaaaagccctcggcctcccgagagctaaatgattcatcgaatatacttttctttcttggtagataggttttggcgtcactatatatgaagtctcgaaacgcgccgacctgcttccagccggtgtattcaactgagaaaatggtagacgtggggtagacaccaccgccagtcattccggccatttgctttagggtgtcgaagcaccagtgacaaaaatgctcggaaccaacaatactaactcgcggtctcccggatttacggattgtgatacacccgtctccgtcaaatacacctcgaatgtagtgtctgatgagtcttgattcaattagcgtggggtatgtgcctatgaatgacttgcggggcattattccgtaggagatcaagtcttcacacaacgctcgcgaagtcaggcgtaagcggacggtattttcagacgggtacttcaattcatgatcaaaagcaccgactgcctttcgaaaaacctcaagatggtggtcatcatctttgtgtacctctatcgtgagtgtcttagtggtgggctttcttgaatctaagtacacgtttccgtctgcctggataaaaccaagccagtacgcagattcctcatctagcttcgagaagtacgaagtgctaaaatgcatgacccttttccctgccagaagtagccctcctttggaaataaaaaagagcgcccattgggacgccctatacgtaacgcggatgtatgtggttgatcttgtcgtactgtcgttgtggcttcatttcgcggaccgtcgtctgtaaaacaccgaccgtcgcgtatatcttgttctccgtcagaaccggttgaccgaatccaaagccttcgaatcgcatatgcacgtcaggcaatccgccctctgcgtaaatagccgcactcaactcggacatgaccggcattgtctcctccgcatacttcgcgaaatggatgatctggtaatcgcggtcaatccggtaatgcattccggtttcaagcgcccggccatcacgcaaaaagcggacaacaaaaagccccggcgtaggctgctctgggactgtctgcttctcgtatgttgaggtcgggtatttccgctttatgaacgcctcgatcgctccaatctcgctaatcagcgccatattacagcccctttcgcttgatcgcggctttgatctccgcctctatcgtccgttgccactcgcgttcgttctcctctgcgggcttatccaaaaatcccggaacagttcccggcgtagttggattgcggaaggagtcgccgtgtttcttcggatatacgtcgttaagatacgtaacgtaatcgaacttacgtttacccttaacctcgattgcagacgcgctgatctcgccgacccatttatcgccttgtttcgtaacgtccgtcgatatagaccgccgcaacgtaccagtcttaagcggagcgatattcgtactctcccgccgccactcgtccatgacgtcctgtactccggtcttcgatccggaagaaatcgcgtcctcaagccgtgtacgatagcccttgaagaaccgtccgataacgcgcttaataaacggagccccgcgtgtggcgtcaaaatcaagtctgtttaccgccatctatacgttcacctccgttattaacgccttgccgccgagcccccgtttaggctggatcgcaataggcttacgtttaatagtcacgccgagttcatttgtgtacgtaatttcgtcgtcgtacgaaacgtccgccagcttgtcgattaatatcgtcatactcgataccgtttcgtctccgaattgattcgttactgtctttgtctgctcggatacgcgcgcaaataccgttacttccgctccgggcgctgagtgaccccacccgctgcctttcgctgccttcgttatcgttactgtttgccgcatggatacgagtggcacgtcacatcaccgtccatttcgcggagcgcttcgatagcttcacgccgttttccgcgccgattaggtcaagcgctgtttgcgggataaatttgcgtaggtcatcgtaaggcatcgtcgtacttccgtccttaaacgtaacgttaaacacgcctgtgagtccgaacgatgcagtgccctgacgctgaagtcgtccggtatcgttgtacaaaatcgaaagtacattcgcgaactcgtacgtcgctgcgtctggaatgacgtatttcggataagcaatcgtgagcgttcgtcctgcgacatttaacatccgttgttttctcgcggtatcgctcgcttgccaatcctctacgtcaaggcaagacgcattaatgtacgcatctgccgctaatattgtagtcgccacggtaacacctccgtttattcgtcggaggtttccgcagccgctgtcttacgagtacgtggcttcttcggttcctccggttcttttgcatcaatacggctaatccacgtaggcactagcgcatccaaacgtgcaatctctccggcatcttcggttacgtaaacgccgcgtacgtcaaactcgataccgtcaagcgagtaccgaggacttgcgtgatactccgccattatttcgcctccagtgccgcgattctagccgcaaactctgcgaggatgccctgtacgtttgttgcggtgcctggggcgattgccgtagctgttacggcactggccgcatgtgcgtggttgcctgccgccgccgttgacgcggtagtaccgagggctaggttagacgtgcccgccccgattgccgtacgtgcagcagcggcatctgccgcagtcatgacggacttaccaaccgtactcgcatccgagatctgtcccgtagtatgcgtgtgcgctgccggtgcaaaagtcgacggctttccggtaatatccgcccacgctacgggcgatggtccgccactgcctccggattgaatagattggatgatatcgcccaaaccgatgtcatgcgcggtcgggctagttagatttagacgctctttgtcgcgatctgaaatcgccatttacgcagtcacccccgttaaaagtaaagaggagccgaagcccctccgattaagataccgatgtgctgatgttatccaggatagcgatcttctcgcccgcattcttgacggttacaccgtactcaccacggatctgacgggccacgaagtcggcgcccgctacggtagcatccatatcatgcagcgcgcgtccattcagagcgtcgatagaaaggatgtcgcgatcgaacaacgcaattttgtttttcgggaagttcggatcgacgatgacggtagctacggagccgcccacgatatcagaaacgaacgtttgaatcttgtggccagattcggtatcagtgcgctcagtgcggatagtatcggaagcgaacttgctaatttggcgagcacctgcggtgttggtcagaatcgtatttaccgacccaccccgcaagtaaacctgttcggacaggtcgttcaagagtgttggggtaatttccttaccttccgcatttttctttgcagcgcttttcttatcggcaaagtacagcaatccgccagttgtacgaggcatgccaggagtcccatcaatacgacgaccgtaaatcaaccagtcattcatctcgcgctgaatctctttgaggcgcaattgtacttggtagttcagctcgtccgtgacgttataagtccgcacattttgttgggtaccagatacttgcgcataacgttcgatgatctgtgtcacgttgtaatcaacatagcggtcgtgtccttcgtctacgccaggcagtgcgccctccaactgaggacgtgctacgattctaatctcgccaccagcggtgattgccgccgcatttgttccatcataaccgcggactacggtaataacgtcaccagccacagcagttacgcgcatatactcttcgccagaaactacgattgcgttgacgcggaatttgagcccgtcaccctcggctaccgtgatcgatgtagcgtcggctgcggcagcagaagcagccgtcgcgcggttagagttgaggttatcggacatccattcgaacttcgtctgatatagagaattagagcctagcccgataaggccgagcaggttcggggcatcctcgataattagtgaaatacccgcttcaagctggcgtacttggtcctgaaaatcgtaagttctcaacatgtataaatttcctccttaaatttaggaaaaataaaaagcctcggattttccgaagctttagcgtgtaagtttgttagataattcaattacctttgcgaagtctctagctcgttttgcctccgcgagttgttgttcaagtgtgcgtgtttccttatcgtagggatttccaccggaagggcctccgattggcaacggttcttttttcggctgctcaaccaggaacggtttactcgcaatcaacgccttaactacgtcctcgacgccgttgatacttccgtcatccccaacggacgcagtgctcaaatccgccagtacatacgcgtcgtcaatcgcgtccggtctaacgtttaactcacgcgccaatgtgcgaaattcagccttaatgaggcgttgattagcggctgttagcgcttggtcacgctcagccctcgcagtctccgcggctttcagtgcttctgctttttccgcctcaagacgttcagttgcggtcatctccgccttctgccgttcttcatcagcaagctcaaactcggtcaatttcgttttaagcgcgtcgtaatctgcgtacttcttacgttcacgggtgatacgatccgctatgacctgatcgagctcatcctgcgtgaaggtcctcggtggtgtcggatcaatcgacgggtccggcgttgggtctggatcgccctccgcgaatagttgaagattcagcggatacttaacgttagtgaatttgttcataattcctcccgcgtttaagcgccgcgtagcgcatagtatccgtcagttttaggacgtatcgtaggtccgtttttattttgggtttcttacgggcatcaagacgtgacgacaacgtgggtgaaatacctcacgccgtggcaaatcgccgtaatacgggtaatcgccgggggcgtccggcgttaattttacgatccgcccctcccaattacggcacgcgtcctttgctccgtgacttgatatttgcgcgtaataaacaccgcgaccgagcgcttcgtttatcgtagcctgacgctgtgtttccgccattttcgtacggacgagcatatcgacataggcttccggtttccaacggcgaccttttgcgtcaataatcccggtatcgactgcatcgccgagtatcttacgcatccggtcgaacacgtctcgctgaagcgtcgtgtttccgtttattccttgcgatagattcgcgcgaagtgactccgcaagagcctggcgtatagccgctttcgttttacgatccatattcgcggttacggcgagtacatctgcgtgcgtgtccaatattgcagccgccaacatatcgcgattagcccggttcaatttcgctttttccgcagcttcaagcaacgttttagcagcgccaatgtcaatcagtgcgcgctttacgccatcctgcgcagctttcgtaagattgtcctttacccattccttggactccgtgttcagtttcgctagagcttcggaagcttcttttgcggctgcgtccgccatcttgcggttggctcctcgcgtaaataggcggctaacggtcgaaccaatagccgaacgagcacgccgaaaagccccgagcagcttagaaacggggccatcgtaattcgggtcgtccattaggcgtcaccgcctgagtcgtcgcgattaaagatcgaagcgtctaccgttccggacacacgctgttcgtcttcgtcaatcctgcggacaagctcggctgcctgtgcgtcatcgaccccgtcgaggtctttgatcgcgtcagtaaccgaccacgtaggcttaccgccagtgcgcaggttagcgacctctgccgcttccttctcgtcacgcggaatcccgtcgcgccaggtaatcgtggggtacgtcgcctcgtacgttgtgaagtcgtcgacgccgtcattggcgtggttctctagtttcatcgccttccacaacgcgttacgtaaaccccggtcaacatgcgctctaatgcgctttaccttggataagatcggcataaatcgagctttaatagcgccagcgtccgtatgtgacgttcctgttccgcctttatctgaagcgagcgtcgtaccaaacagccattgcggtgtctcgctgatttggtaaacgagaccgagaaggatatcaagctctttaaacgcaccctctaattgcgagtcccacaccatgtagccgggcgttgcatcctccttggtcacgggaatataacgtccgccgctacgcaccgtcgcgtcgtcgtcctcctgaaaatcgggcccatacgcggttgggtcgctgtgtttccagaggatataatcaatttggacgagtcgatcattaatcgcggccaatacgctctctagcttttccgtaccgctctccccgcgccaatctgcgtccgttgtcttgtacggaatgtgctcgacgagtagttccggcatcccggtcggtacaacgtcctgctcccgtccggtcggaactgactccccgatgttatacgttggaataggcgccccccatcggtcatccacgccccgttccgtaagctcatacctttcgtacactatatagcccggtatatgacgctccacgttcaggtacggcgtctctgtagtcgggattccggataagaacgacatgattcggctgctattttcgatctcccactctacccacgcaatattcatcgccttaaaccgttttttagagccgcgcgagagctccgggaatacaattgaagcgtctacgggttcaataatcggctccagcggtgcgtctggcgcatctaaaccgagttgaagcgtctcggatacgtccgcacgttggccgtagtacgtctttagaaacgagtcgccccgaaagcctgctccgattacaatctcgtgaatcatctgcgttaggtcgttctcttcaacgatacgacttagcgctgtttgttcgggtgattccggatcgtgtccggtctcaaacgtaggagcctcgccgaccatcaaatccgcgggcttcgttagcaacacgtccataagattaaccgcaataaataacgttttgagctgcggcgcaaacggcgtatcttttaggagtccggaggcgcgatcgtatatctcaacgtggcgaccttggtaaatagcccgtccgcgttcatacttcgccaagcgaggaatctcataaacaggcgggtattgagctccggtataaaacagctttgtttcctttacgtcgtaaaactcggacattacgttcctcctttccgttacatccatttcggcttattccggagcttcttccgtccggttttcgcaatactgaccgccatttcgagcgcatcgggtaagtcatcgtgcgaaccggaaccgtacagctcgaactgttccagtaatagcgaatgttttcgcgtaaactgaatagcgccgctctcgatatccgggagcagcgcttctatacggaggtctttacgtgaccgttgatgtatttccttaacgcgagtctgtgcgggatagcccgcagcccttaacgcttcctttagcttctgtacgaaaaactcctgcgccgcctgcgcttctgctgcgatcgctgtcggttggtatttaagcgtcttatcgacaatcacgcgcataaactcgtccggcttaactcgttccccgtacgcatcaactacgtacttcgtaccgctttgtttatgccgcgcaatcgtaacaaccgcagaatagtcaccccgcgttttacccatcgcaaagtcaataccgaggtaaacgtcatactcggaaactggacgcggatattgcgagaatacttcgtcaagttttccgtcccaatacgtaaaggactccggattaaagatcatagactcctcgtcaaccggattattcatgtattccgtattaaacgccttcgtcccgttatcccatttccatgtcatcagcttccatagcggctgtgcttcgggccaaagtacgatagatccacggtccatttcctcgcgattcatctcgtacagtgctttcgcgtccgcagctcgattcggattatctcgatcgacgtagacgagccggcacgcttcccataagtccatacgctcaggccattcgataaccgcgcgatagactcggctcttaaagtccgaacgcttgtacaggacgttcacgagtagcgcctcgtgatgaaccgtcgttcccatgtatacgaaggctgtgcgcttgcctttcggatcaccgagcggtacgacggtttgcgcaaaccagtcacgcatcttctggcgtagttctggcgtagctgcgttagacttgatgtcctccaagtcgtcacacacgatcaagtccggacggacaccgttccagttacgaccacggagcgcctgaccggtagaagccgcttcaaccttcgttagcattttcggtattccgctgtctgtcggctcccacgcgataaactccgagctgttatccttcgggttctcctgctgtttcggagacaataaaggaccgaagtccctccgcagcttctcattatgcttgagctgcatcgaaatccagtccaggtttccgcttgataccgccggcgtctccgatatgataatttcgtacttacgtttccggtacactatctcgcgtaggggaaacgccttggaaagatacgtagatttagcgtgagaacggggcgcagcaactgcgaccttatcgttggtattaacgttcgagacatcgtccattatcacgctaatttcacggtgaaaatcaggcgcctcgccgacgtctacgatgtcgaatccgtcccaattgcccgcgttacccggatttttagcctccgagaagtattcgagagcgaacgcaatcaagtccacttcagcatcgttaattacgcttaaccgctcgtactcggaaagctgcgtttcaatgtcgcgctggtcatcgtcactcaaggcggcgatatcaacgccgtcgagtgcgtcaattaatgcggctagttcgttaatttgcgcttcccgctcttcccgaccgatccatttcccgttaacccaagcgatagataccgcctcctccctttgttttgacgtggatttaccgtgaaattagcccgtttcgtatcctccgaatagtctcgttagggtcaacgctctaagacgctaatttcacgtcaatttataagcaagcgctgcgaacatgagcgcgtcgttaggatcggcggcgtatccgtaagcaaagcggaaaggctccgacttaccgactctcgcgcaatactcccgccagcccttatcgtaagtaacgtaggattccggatatagcgtaagcacctccgccatgcttgcgaagtgttcagcgaaaaatttagcgcgatcttgcggagacatttcgttaagttcgaaccaatccatacgttgcacctccgtaaaagtcaaaagttaaatttgatacgccgaaatttcgtacaccagattccgggccgcgcgagggggcgcttgggggtacggtcgctccaccgcaacacagcgtttttgcttcgattctttgtgttccgaaaacaatcgtttttgaaacgttagattaaacacgctgatacccaccgtatgcccgtctattttcgcaccataacccgtctcaatttcttcgttgcgaaaacgtacgtgtttatgatacgatagtgttaattaaaaggaggaatcgcgcatgaggatcggatatgcccgtgtgtccacggctgaccaatcactagacctgcaactagacgcacttaatgctgacggctgcgaacgtatatacacggagaaagctagcggggctaaggacgaccgcgccgagttaaagaaagcactcgatagcctacgtcccggcgacgtattcgttgtttataagctcgataggctcgcgcgctctacgttgaaactaatcgccacgcttgatgacgttaagaataaaggcgtagagttcgtcagcctatcggataaacttgatacaactaccgcagccggcaaagcattattcggtatgctggccgtatttgcggagtttgaacgcaatgtaatcgtagaaagaacacgcgcagggcttgcggccagtagagcacgtggtcgtaacggtgggcgccctaagacggaccgcaaacgcgttagccaagcactgaagctgtacgatagccaagcgcatacggtcgcagagataacggaactaaccggagttacgaaagcaacgttatatagagcgctaaaagaacgcggttaagctgcgttcttctttgcgtctgaaagtttcggagggggcgtgcgccaggagcttcgtgtaggtaaaacgcacccgatccgaaagcatccgaaggcaccacgcacaaatcgcttcttatatatacgcgcctattccgtatcttcggaatcgctacccttacgcaccttaaacgcctcaatccgtgccctcagcgcttctacatccgtagcattcgcatccttcgtttcaacctcgaccttatccgttaacatcccgttaatttgaagcacgagtttagcggctgctgcgttaccctcacgtatagcccattccgccatagattcgactacttccggtagctttgcgctattgttacggatgatcgcacgcttcaactccgcatcaaatgtcggtgtcttacgccagttctccaatgtacgcgcagtaactccgcaaatagctgcgatctcttcgaacgtcttaccgcccttattcggaatagataaccattcgatagctacgtattgttcagccgttattttcttcgccatatttacgtcctcctttcgtgttttcaacgtaaataaccgcacaccctacgctcaggcaaggcgcaaggtaaagcggttcttttaacgataatttcacgttattttaccgggtatttcaacgctgtatattccgtaatcctatcgactccagaagcgatatcaatccggttaagattgtacgcatatactccattctcgtacgtttcgtcataaccgccatctgcgttatggcttacgaatacaaacgctggtataccgttgttaaatattaacgcaggtttgccgtctatctccgtccatactgaccgttcgatacttacgccctccttccgtattgttcacgctgattcataattgaatctacgggaactaaagagatactgcgcgtcgcttcgctccttgccgtcgcctatcggctccgaacgcgtatagagactatttatcaatatacttttctgcgtgacacacaaggaacgaagttccgcggtgtcggacgaagtccggtatcaaagactaagaataaattcgaccccctaaaacgctgaaacctgcgtggctctaaggcggaagccacttttttagtgttcgcgtttttaccgatgaaaggccgtttttgttcgcgtttttaccgatgagaaattacgcagcccgttttgcgaagttatttcggatggaaaacatctcccgcaacgtcgcgtcaggcttcccgttcctacggtagaacacgaatggattgatcttgtaatagcgatattttccgtaggacacttcggcaaatacgtactgatctccgaatttgagattacgcagcttcgtgtatacggatttagcggagactcccgtaaccatagcgatatcctctttcgtaagcggtaacgtattctcaacgtctcgctcgtagggattcgcgcatatcgtattcgtttcgaggtgtatgtaacgaagtaacttatatacgaagccgaggtctttcgcgttaacctccgtatacagctcctttaccttcgcaacgaacgttttaactaccgcgaggttgtccgttttaccttggaaatggtaacgcggattaagccgataacggtcgccacactcgtaaatgacgttgtgatcggtcatctcacgtagaaactgatgcagcgctgtccgtccgagcttcagcgtacgcatgatatcggcgcggctcattgcggtcttgtccggattctccaagattgcgtcgtaattaacgaagcattgcaaataaagaaggtacccgcagttcttatcggataccttctcgattacttcgtcgatattatgcatgtttgtaaccgtaaactccggagcgcgtccggctgcctgtatttttgcgtaagattcgcgttgttttgcggtagtaatgcggtcgccttccgcaaggaccgcggtatattcgtgtatctcgcccgtttccgggtcaattagcgttttaaattcggccatcatgagctaccccctgctacggtgagtcggcgtctatataacgctctacggttagccgttcgctggatgttccgatcaagttccttcagtttgcgtaaacgtgccgcccactcatacctaataactcgctcatcgtgatattcatcttctttgaacctatcaaagtcgtctatttcaatcatcaaccagcgtctttcctcttcaaggtgatgcaaagtctcctcaagttgatcgagactgtccgacacctcgtttgcgtgttccgagaaatacatcttatcccgattaaacttcggacgaagttcatttatgagatgcgtttcgtacacatctacgtagaacatattattcgagcagtatagtgtgacttttgcgatatccttacagaaacgaatagagtctttcttaccactcgtatgctcaagtaacctacgtcctagtgaagcgcttttgcctacgtacaagcacgtcccttcactatcccaaagtacatagacgcctgatatgttgaggtagcgctcacgcatatctaaaaatcccctgattgaaaaatctacacttttaggtaaagtcacgactactcccatgttatcgctctcctctgcgtagtttccgacgagccagtgaaatcaagggagagcgagtgtcggagtatctcgcgttcggcccgtcagcctatccccatataccttttcaccggtatacctatataactttgagactaaggaaaaaacaaccaaacaacgcaaaaagacgcaggaaatctgcgccaatttgtcgaattattacgtaatccagtacgaaagcactatcttatatgaagacgatttatgaggtttttaaagaaaggaacgttgagctattatgaaattacttacaattggctactttactggttggaactctactgtggttgattttggttcttccacatcatttctagactatgatgttgtgctaatagacttatcatgtgttttaaatgaatatgatgctgaagctatggcccccacctttcaaggtttgaagcgcatatcagaccattattcagcaaaattaaaggcggatattgatagaaggaagcatgaaattaaggaactcctaaatctaggtcgaacagtggtagtttacacaccctttccgatacaatgctatgtagattctggaaaaagggagtattcagggaccggcaaaaatcaaaagaaaacgacactagttaatctgttagacataagatccgtcctgcctatttaccccgaaacaatgttagcgtctggatcaagtttagaatttataggcgagtcagcctttaaacctctaacgaaacatagagacaatctcacgtacaacgcatactttaccaaacctctaggaaatccaatttttaaaatcaaaggaactaataattttgtgagttcctatctaaatacaggagcaggcacccttctattcataccagaattattcaaccccgatgatgaagtagatgaagatgtggaagtagatgaagatgtggaagtagaaatagagtcacaatttttcaatacattaacagcaattataacagatttgaaaaaagaagacggtgatttccaactcccgccatggagtattgattatacgctaccgggagagtttgaattaaaacatcagcttttggagtacgaaaaagaaatgaaaataataatagataaaattagcaagcaaaaagaggaagtattaaagcttgaagagtacaaattgctctttactgcaacaggtagatctctagaaattcaggtaggcaaagtatttaaagaactaggcttcgaggttgaggaaggactccctggacgtgatgacttaattcttaaatataatgatcaaatagcagttgtagaagtcaaaggcgtatcaaaaagcgccgcagagaagcatgctgctcaacttgaaaaatgggtaagtgagttctttgcttcaaaagggattaacccaaaaggtatacttattgttaacgcctttaaagatacaccgctaaatgaaagaacagagagtccattccctgcacaaatgatgccctactgtgagagtagaaatcactgtcttttaactagcactgacctgttatcaatctttctaagcgtaaagaaagatcctaatataaaagaggaaattattcaaaagatatttgatacatcgggggtttacgactgtagtagttggaaagaaagtatcacggttacagaagcagccgttataagttagagatgcactaacttcagcacagttccgtatcttactgtataacttaatctgcggctctacctaaacagaaacatgttgcttctcggtaacccagcgccttgctggtttaataaaacgtctatttcgcggagaataccggttgaataggcgttttattttgcgctacttttacgattaaccgaaggaatcgacgtaaacccgtcgaaatatttacgtatgaaaacgctaattactgacgtagatttactcgccgcagcactcacgcaagcacgtgttacagtttacgaaaaagatggtcatatcgcagactacggaggtgtgatcgaaaagtatacgcctgagagcgtgaagatatcgggaacgtattttatgcgcggagtatacgtatttaagacgggaagcgcacgaaaaaagccggaataactccggcctagtgcgttataacagcgttgaaagctccgtccacttcccaccggcgatgcgcacgtataagcggccgtttgcgtaacgtcctgcgcagaatttacgtttattcattgcgtaagcacctccgcgtattatttatttcggaatacaataaccgcgacaattatcgaagcgactaaagccgcaatacttacgatccacgttaacgtatccatgcgattacctcctgttatagatgggccgaagccccgtgttatttaatttctatagtgaactcgaccgagctgcggcccatttcctttgcatcgcgaatggctcccgcgacaatggcgtgaacatccttcattgtgtatgcgtctgtttggctccagtatcctttatcctctgtcaccacatatttcgctttttccatattccatagcctcccgcgtaaagccgccaccagattgtttatataaatcaattatgttatgattgggtatagaaggcgctgtgtaagccgccctctaccaaggaatccttaacgtctgcgccgaccgcgtcgtttattggttccttttttctttttattacggcgatgtgccttccagatagcaagtgctgtagccagttgtaggattgccgtaatcaggtttacccaatctttcatgttgaagttctcctttccgatgactcctttaacgtgtcatccttatatacccataataccacgactcgtttaaggtgtcaataactatttgacacttttttcgagtcaatttatactgaggataaggcttcattttatttcactctaaggaggcgggaaaattgctcattcactcgaatttaaaggttatcgcagattcacgcggtctaacggtacgacaaatcgcgcgtgacatcgactaccgcttcgaaagtgtacgtacgatgtacaatgacgaaatggagcgttatccgcgcgatctgctcgcgaagttatgcgattatttgggcgtaggtatcgacgagttacttactcttgggtagcgtttgttcatactaatacactggattttacttccgctttatttttgaattgagatagcgtactcagcttccgagttcaatccgtttattcgctgctgaaggcgaactacgtaggacgcaaactccactgacctattcccaacctcaagtttaaaagacttgataacattctttatcgtatcacgttgctctgctgttaactcatcaatcacaagaagtatacggacgtttgattgaaacgcatcaaagagaaggcgatttacctcgagtgaaatttgctgttcctttatgttaggtttgagtttacgtacccaacctgctaccttgtccgcaatatcttcgttatcatagatgtattcaattattttgtctgaccaggatgctacggtttgctcgcgaatcttcgcgtcagtaacaacactgaatgttgatgcaaagcgcataagctgaggaataatgtgtccgttcatgtaattgaatttttctactgcttttgttttactttcgccgtagcactcatactcaattaagttcaattgtatgggatggtctttagcttcaggattaaattttataagtaacgcatctgggatacccgatattccattaattttttcatttttataattcgttaagcttgctgttctaaacttacgattttctgaaataaatacagttcgtctttctggaaattcgtcaaacaggttgtaaaaattatcatttacaagtgtttccaaacccatcgtattatgttgctcacctcggaacttgactgtcagaaacgttcctatgatgctaattccttcatcgggaacttgagtgagcatttcagttagttcagccgtagggagggccattagatcttcgtcctcgtcctcatcgtacagatcttctaaattaaatgacagggtagtctcaaattgatacatttcatcccttttccgcgaagtaaactcacggtcaagcaaagtaactgcctctttgtcaggaatcgctttagcaccttgaatatattttaagttccaatacttcccaccaactaaagaaagtatgtcaacttcaaatggggtacaaaactcaatatcactaaaattaaaagcttgcgggtaagcttcagcgttttcccacggacgattgtccgtaatatcagccaggattccccgcgctccgcactcagacttctttccgacttttacgaccaagtatacaacatcgcccgaagacggccccctgcgtgtgaacccaaccacattttgattaagacattggtaatagttttctagtgacttaccgcaatgtaaaatacgtgtgctcaacttctatcagtccttgtagtagtgttgtatacaaaattcgacaccttaaggctacaatcctctaaattaaaatgccccaccgagttaaggcggggacattccattttatgcagttaatcgctggttcgctaagtttacatattcttcgtctaatccaaacgcgacgtagttacggttagtttccacacacgcctgtgccagcgatcctgtgccagcaaaaccgtcgagaataatcccgcctgggtcacttgaattagtaacaaatagtttaagtagatcgaccggcttttccgttggatgtgttaatctcgcgctcggtacctttgcacagtcgataacatctggtatacgtttcccacgtaataatgagcggcccttgtgtccaaaaagaatgagctcgtgtttaggcccgtatgatccttttaaatccccggttccgtgaacatttttgttccatactagcaggttctttaatttgaaatatttctcgaactcccttttaaagaagtcaatatgatgccaactacagaacatataaatcgccgtattgtcttttagaacgcgatagcactcagcgatatagtctgtaattaatccattagagttattatcgttagcaatatggcgaaacttatctttagctacacgcctattacttctgtagttcattaggtaaggtgggtcagttactactaagtcgatactagaatccggaacaaggttacgcatccctggtatacaatcttggtgatagattctgttaatctcgtacatcaatacgccacccccgttaatcccaaaaagtcctcgccgcgcccctcacaccaacgtcccccacacccgacacaatgcgtaaactcttccgtcaattccccgccagtgtcccgcagattatacgtaattaccggtcccggcatcgtatccctgcggtattgctcagctcgctctttattacgtatcttcgcgcctatatctacacgccaattctcgtagcctgtccgctttcgtcgcgtgggtctactgtaatcctttccgtccgttcccattgcttctgccgctgaaccggatgcttcccgatcacgcctaagctcgaattgtcgttcgctcatgaacggatactccgtttgagacaccttgtacggattcgggtcagtaatttcctccagcagaatatagtcggtcaatcgctccaattcgaaaacgtccggagtatctcccgtttcgttaatgtacgcggccgtgagccggtcaactgcgtccatccgctcggttcggtctgcgatattggcgtcgattagtgcggttacggcttcggtaaatctctctttgtggttcatgtggaatcccccttgttttggtctacacaataaatatcgaagcacctacgccgcctgttgcgatgtttcagaatattcgcacgtaatttctccgtattcccaacgctgatacacagccgcgatcttttcgacggcttcgtccgccatctttgcgactgcttgctgcgtaatccccataatagccgccgcctctttttgcgtaaggtcaacgccataaacccacgcaatagcttccgtttgccgatccgtcagccccgctgaattaatagcgctatgcaagtcgattaggatatcgctggctgccgtatcgccgcggaagcgtgcggagctgatacggtgacggtcacggaggagggaacgtacccccgctgcgtcgtttaaagcgtattttactgcgtagctgcggtcagattttgcgatatctatctttacatgaccgataataaacgcctccctttttccgtaatgagcgcggcatcaacgtacttacgctaggtcactaagtacgccgaagccgacgctaatctattgtgaattattcatacgttgagttttgcgaatactaagccgcagtttcacgcgtgataccgagttcgactattacgtactcattttcgcagtgtccattatgcgttttgtctccgttgatgaacgatgtatactcgtcgcctacgtaaatctcgccgccacaccaagcgcagtaagcggaaatgcgcggctcatcgcgtggacctggcggccgaaaccgatccatcgacgtcatcctcgccgacctccttcccgtaaacactccgtagggcggccgcataacccacgccataacctgcgtcatatccacgtgaataaccgttgttagccgctccttctactgctaagcgtataagttcgttaatcatgcagcagcccccacttgtatcaactctacgtcgcccatatctccgaactcccgcgctacccattcgcgtgcttccggattttcgcgttgctcaccctctgacggtatccaaccgaagtggctaccgcagatatagttcagctttgcgagtagcctttcgtccttgaaccatacgtggatcgtaccttttgcgaacattttgaagcggagccactcgttttcaaattcttgcgaagataaagccgtaaactccccgcttacattcggatcaataagctgaaacgcctttacaatatcgtcaacccacatgcgcacgcccgtatttatccgtctataatcctctttaaagtcccacgactcaaatggtgaatatttaataggaataacaattttcttgttgattttatacgagctgttcgttttccagccgttataatagtgtacgttgctggaatagctcgtcatatggcgatcggttatcttttgaaagatcgagacgatactgtctgttaaaatttctcgctgattcgcgacgagcgccattaaaagcatccgtatgtttacgagattgatttccatgtcgctcgcagcttctatctggcggtttagcttctgggctgcctcgttcgtaagcattttacgaaactcgtccgtttcaagaatcaattcccagtatccgctccgtaaccggtccaattcctcgcgcaaatcgtttccggtaaactctttgttgtacggcgttaccatcgatagccgcgatgagcgttcccccttattaacttgcgcaatgtagccgaagaacgacgcctttgcctgtatcgccttgtacgtatctttcgcaagctgacacgccgtttcgtattcgatcactagtcgctggatgtcgttcattttcgcttgtaattcgaacggtttgacgtaagtcgaaagcgccgctcccacttcttcaaccacttccttatgtctcgatgcgctaaagaacgggattgagtcgtatatggacttaccggcgttcaccttttcgactttgacgtggactagcgcgacttctacgtcagtcttacgttcagcctgcgaaaaagcgccgcttacatatcggacttccgcatcgtattcactcaacttccgtaatagctcctgccttttcgttgaaaaagcgttatctatcgtttctttgttgagtattgcgaatatctcacactgtgttagctggttttccgctatttccagtgcctttagaacgtgatctacgccgttcgagaatggcgggttcatgatgatgaaatcatattccttgtatgtttcgtatgttagaaaatcgtcccacacaacggaaatcccctcgccaatcaacgcgcttacaagtcggtggtcattctcaatcgcgtcgattttaaacgtagagccatgccgtaacttttctcgtatgtgccggatcatatcgcctttgcctgcggacggctccaagatacgtccgcttattcggtttctgccgacaagtctgtcgaacaaatcgttcggtgttggatagaagtccttattatccgtataaatcaattcgcattcccctccaattcttacgccttcccacgctcactcggtaatcggctgtcgtataagttcgttaatcattccggccactctccggataagtacgcgagaatctcgtcaatctgcgcgtggagtgcgtcgagtgtcccgccgttcgtcacggtgaagtctgctgcatatccgtcgagcgctgtttccgtatcgtgcacgaggtcagcgtagttaaacacgtcgccggatttgatagcgcggtcgatgcggacggcgtccggagcttcgacgcggatgagtacgtaaccggcggacttgagcgcagtgtactcgtttaactggcggacatcggaaattacggcgcgaaaatccaagtgagcatagtacgcacgcttgacttccgctagacacttacgtacccatatatcctcgtcaaccaatgcacgcataagctggccgtgcgcctggtagccggctcgcggtttagactcacgcggtatctccggatatcgacggtgaaaatccgccttgagttcgtcgccaaacgcaaattgcatgtacccgtagttatccgtaagataacgagctacttcgtcttttccgcttctgagacgtccgagaagtccgatgttgggtagcgtagtcattcggcggacaccgccgtccatttatcgttttcgtcaacgtacaacgctaattttgcgcttctctcaataactccgattccgtagcgatcgagtcggcggccgaaatgataccgcagtgctcgtttagcatccgcaacgtctctgtacgtcttgtcgtacacgactccgcctgtttcacggtcgataatagcgtatagtttatcggtcatattacgccgccacctcctcgcgtgtgtcgtcaatgacttcaacgaaacggatacccttgtaaatgcgtccgtctcggcggtttgctcgactatgcttaaagaaaacgccagatggcgaagactctccatacgtaatctcatctacggtaccttccacacctgtatagatgcccgaattagatcgcacgacatcgccttttcgaacctccgtaggctttggaacggtcagatattccgcaggcacttcgagaccaagcgcacgatacagcgctattgccttaccgatgtgtgcgttaaatacgtcgcctggggcgcactttgcgattccacgtaagataacgtttttcttgccggtttcgagttcacgaattaacgcaacaaccgttcttttcttgtgattaacggtgaactcgcactcatccgtaaccgtgatccaatcgcgctctgatagccatacgccggctacggcagcatcggggtaattgtgcgatagtaaacccgcaacgtcagccttcgcacgctcgacgatatcgtcccgacgttgctgtctcgcagcctttatgttctgctgcgtagttctgtgacgtttgagcgatgcgataacctccgcaggtgtcgcgggtcgcgtccttgaatacgttgtcgccgcttccttcagcgcagcaacttccgcttcgaggttacggacatcgtacgcaatgctctcgtccatgatatcgatatcttcctgtgctacgcggatgtcggtacccatacgccggaccgtttcctctaacgcatccaatcgtaaggctaacgcactgatcgtagctgccgcttggtcttgcgcggactgttcggacaggagtggagcggtggctaccggttcgagtacgcggtactttccgtccctaacgaagccctctacgttctgatcacgtctaccgcatagttcggcgatataaacgccgccataaagagactccgtttcctctccgtatctctgtacgttgaagacctcgcccacctcgtagttggagggtaattcgttattcacgatgattatgcggtcgcccaccgttgccttacgtttgaccatacggagccgctcgcctgcgatgtgaacgatatccatcggttcgatggttacgtattcttcgtcagatacgtaaatatgcccgtctccgccccaaccttcggcagtctcagctgtgtgtactccgccacaacccacgctataaaccgtcattacatcgcccttttcgtaatcaccgaaagatgcgatcggatttacgattttaatacgctcacctttgtccgctttccgtttaacttcgcggtattcacgttcaataccgccgagggattcatccggtaaaaccgtaatttcgtccttctcaagtatgaaccagttacggtaactgtccccaccggagtccggaagtttcgtgtagcccccgaaaccgcggatcgtatataaacggtcatcttcgtgaataacctcgtaccgctcacctaccgtttgtccagctacaccagccgtgtgacaacgcaaatacttcgtcatataatccgctcctttgtggtttccgatatattaaataaggggggaatagcaatgaatgaaaaagaagaagagaaaattaataggattaaattgatttgtaagaattatgaagcgacgagtgattcagacttaaaagttctcgaaaagtattaccttgctgaggaagattcagcgaaacaaatgtccttgttagggtctttgatagcatacgtgataccgctagtgttacttaccgtgaataggctcttaggcgacgggcgagattggactgcgatattcatagccgccgcttttttcgtaggggtattcggaactctagtaacagcaacgggccttcattggagagctgcaacaaatctacgcgcgatccaactcgttatggaagaacgcgaacttttagccgccgcttcccaaaaacaaccgcccgccgaatatcctttacgtagacgtcgatatgtccgtcagtaatccgaccgcctcggtcccaacacgttcggactccgacactttcgatatcaacacgtgtaccgaacggaatagacttcggacaagctgcggttacgccgttcttgacgcgcctacctgatgcggtaatgccgtgtgttggcgtaaacccatcaccaggcgcgtacgcagtgactacgtaagtagaagacggggaattgcctgttttctccgtctttactacgggcgttggcgtcggttcattcggaggattgattgcgactattgctgcgatgaagagttcgatgaatgtccgcgagactacgccacctccttgaatttcgcctccacttgcgcgagaagaacggctttagcttcggctggcgtaatctttccgcaagtgcttacccacgacgtaagatacggatttaggacggggcaaacacgcaacgaaagctcgtcgtccggatcaatttcacgaatgacgacgatgtcgcctatggatagtttttccgcggggcccgtatcaatcacgcgcacataatcgccggccttcagcgtcttctcgtccgctaatttcgcctcaagctccgcaacggctgcggtgatcttaacgagttcttcgcgcttggctgcgaggagggtttccgtcgagggttcgcacggctcatacacgttaaagttgcatgtacccgctctgtagacgttcgcagcgtcgatatcgctgtcgcttatcacgcgaacatcccccgcattgtccttgaatgacgcagcaccttcgaataaacagtcaataaggaaacaatcccctctgttgatatcccaataaatgtccgaggagcatacaacgatatcgcctacttgggcgagtcttttcgtattactgaatctcacgccttcatactcaattacgccgggttcttctccccgaataactccgattaatgccgccattctcccacgctccctattcgaatagatttacgtcaactgtttcgataatccgcgaatcgttcaaatcgttgaccagtacgccgtattctcgcgagttaacgttggccgccgctgttaacgtatcgccgtcgagtcggtccgatccgagccctgcgatgacgacaccggtaatctcaccgcgccgagctgcggccgcccatgcttcgagtacgtcggcgattgcgttaggaaacgggatgacttcggctagtcgcggttctttttccgccatgttacgcctccttaaactcgatatgcagcgcgttttgtagattgatcgaaattccgttgtaagtaaaccaaccaactattggagactggccgtcttgtgtaatgtattcatgaaggcgtcgaacgccagcgcccgttacggcgtgcgtttcaccgccgattaacgttattatcgcggtcatctattcgttccccttcccgtgatagtgtttatgaatcgtaatgaatccgaagttgaacccgtgaaaaatcaacgcaatccccgcaagaaaagcgaatataattaacgcggcttccataacgcacctcctatcgtatagcttcgtgaatcacgaacgcccaaaacaacgcgcagcctgcgagaactactgtgcggataaatccgattgatactcgtttcaattagcggacacctcccgccaagtttcggaagctttgcgcaatccctcgatagctccttccgttgtaacccccgtatgcccaaagccgcccgtcccgcgctccgtctccgaaagctccccgtccgtttcgatgagattgacgtgaggaatcgggagtataaacgcctgagctacacggtcacctttacggatgatgcattcgccactgagcaaattaaccccaacggcctcgctcccgtcaataaacgtcggccattcgtaatattcgtcgatgggcaacgcggtctggatgttatcgaacatcatcgcaacttcaccgcgataatccgaatcaatcacgccaattccgtttggttgccgcagcttcgtcatcagcgcaacccccgacctcatcgctacgatcattacgtagccctccggaatttcgaacgctaggccgagcggaactgtcttcgtctcgccaggcgcaatgattacgttctctaccgctacgaggtcgaaggcggccgcgccgggcgttgcgtattgcgggataactgcgtccggatgtagacgcttgattttaacgttcatttactcgtcccccctgattccgtatcctacgaaatttataattacgatgattaacacaactatcgaatcaaagcggtcaagcgtatagcttccggcaatcacagctacaaggacgcacagccagtaggccgcacacgtccagttaaacacgcgaataatcattcgctcgccccctctgcggcttcgagaatatttaccggctcggtagaaataattagcgtaatttcctcgtgctcataccgtcgcaatatctcgattaaatcgtggtcgccgacgcgtaattcatccgaatccatcggtgtccactccgagtagccccacccggtctcgacgaagagttcgccagtaaacgtatggtctgcgatccctacgataacagatacgctgtcaaacgcattgttaatcgcagcaattacgtcctcgcctccgattaagactgcaccgggttcatctacgtcatcacaccgataggcgtctccgcaagttacaacgcctttaaatacgaggttcactaggccgcagctccttccgtaacaacgctgtagtcaacgtcggtgtcgtcgatgacggttccgttacgtccgttccacgaatgaagcatcgagcagtttcttacgttgaagtccgctgtgttatccgtaagcttacgcgtttcgccggatacgcatctgataagcatgtttgctagcttctccgtcggtttcggcgcgtccgtatactcgctcggcaccgtcaggcccaacgctcggcggagtgcgatcgctttgccgatttctgcgtggaaaacgtcatcaggcgcagcttttgcgatgcctcttgcgcggactgcgcttccgtctcgatacgtaataaccgcagttactgcgcgtttttcgcggttaacgtaaaactttacgcgatagaaattcgagtgaaatggagaaagttcgggtaaacacgagtcaacgtcgcgtcctattcgctccaactccgcaacgtcggcgcgtgccttttcgataacggttgcgcgtgttaattcggtcggctccggtttggttacgttagatgcgttgtcaccgaggattgcgcggactacatcggcgttatcacggatgaattgcgtaaaagcactagctagggcttcggaggtgtctgcggaagttaccggttcgagtacgacatattcccgatgatagacgccgcatctgtttccgttgatgtcgacgaatactccgctactttcggcttgaaggacagtcccttcatcgccctctccgtagccgtgcgcgaattgcggatttacgatcctaatacgttcccctacgtttgcctcacgcttaacctcacgataagtttgtttcgtcatactccgaatcgcctccgttttagttgtgagttactcggcggttgtttccgccctacactacgtttgttcccagcggaatgagtttcgcacattgagcgtaatgttttccgccttacatctacttcaacgacgctcaacgccctgtgacacacttttacgaaaataaaaaaaaaaacggagaagcccgaaggccctccgttatgtactcacgcgtttggccggaaccatccgcattagttcgtctattttccgcagctctgcatccgttaggtcgtcaaattccgaagcgtggcggagaaacgggtgtaaccgaaatgtccgcaacatctcgtacataattaccgaagacatacgcatacctccttatcgtatcggacaagctccgccttcgcatccgtccatcccgtcaaggtcggactcgcccgttgtttcataacgttgtagcagcggcatatcgaacggacgcatagccgcggaaagctcctcgtacttctcacgcgtgatcgcttcgtaaggtgcgaggtcgtatgacccgccgtctagcgccaggaaagacaccgctgtaaactcgtcccaacgcgaatatacgatttcttctgcggtgtcccattcgtgcggacgtactgtgatcgtattagacgaattatgctcggtgtaataacgttggaacgtgaaatacgtatcgagttgttcggccgcgctgacgtcatccttcgtacgagttgctccagaagcgaccggaaaatcgattacgtaggtacgcgcatttcccattcgttcgtcatacgtctcgccaggcgtaccgacttcgggatttacggtccagccgaggtcgataacggccctagcgagcggatcagccgcgttaatacggatacgtcggatgtagtacggagagtgtgaccaatgtaggccggatgaaactccgcccgcgacttgcgatatcgtcccttccggtttaacggtggtgacgagaagaggtgctgacacacggagttcttttgcataacggtccgcttctgagcgcgcgattgcacctagttcctctaacgtttccgcctcgtacccgctgacttctcgtgctactgcggcaaacgcgtccttaacgccagttagcgacgtgccaagtaatcggtcgcgctgttgaaccgtattccagtgcggaatctcaagctccgcaagagtcatacgcataccacagcgcgcggacaaagcttgcgcctccttcagcccatcccaatcgaacgttgcatctgcgcggacaaacgccgtcatatttacggtcgtcaagttacacacgccatatgagtcgagaaggatttcggcacacgggttaaggccttccgcattggggcgacgttttcgcgcctcctccagatttacgaagcccggttcaccttccgcctgcatcatcgtgaatacaaggttaaggaactcacgcgaaggttgctccgtaaatgcgatcgagttattcgacatccgccgatgatgcagcggacgagcgttcggatcgaacgtcggtaagccttcgaggaatcgcgcctccttttcgagaccgagcgcacgtgtcttctcgattaccttcgcgtgtttatctgcgtcccaaataccgttaagtccgtactttgcgaaaatgcactcgtagtcatctgcgtccataaggaaaatttccgcagtacgtcgcacgcccccgaccacaacgttattaccgatgagattgccgatatcgagaatgtgtatcggtcgaaccttgcggtaagacgtcggtggctcgccgaaccactcgtaaccgtctgcacacggagcttctagcggggccaagcccggatcaatctcgttcttcagtacgcggtcaatccctgcgaacatttcacgtaaaggctccggaccggatgccgtacctccgaaagtgttcaagcgctcgccgtttggccgtacggaattgtatgaaatcttaacggtgtgtatgtgttcatattcgcgtttcgtaagaatatcgaggtatatgcgcagggactcgacccatccttccttcgagtcgccaacgtaaatcttcgcgtatccgttctccatgtcgcggagctgcgtatgttcatagcgagcagctttcggaactggctcgtactccgaatgaagtagcgttgtgttagtacggataggtacgagattagccgccatttccttcgtacatttgaagccaacgccagtaccgaccattagcaggtagaataaatcgccgaggtccgaccatgacgcgatattaatgaacgagcaattgaaattcgctaacggatacttatcggcgacaccgttctcggctccacctacccacagcgttcgaccgctgaggaattgacgcaagtgaaacatattatcgaatagcaactcagcctctttccgatgccactcgatatccgtgccgtatccgattttgtccatatgtttaacgccgagaccgacgttatattccgtagcgcgccggactgtctctttccacgtttcgcgccgtccttgttcgggtaaccagcgtgagtatgtccgtaggtaaacgaagtgaccgagtggattcatctccgcaggaaaatccgggtattttgcgataaattcgtctgttaatagttgcgtattaatagcgcatctctcccattctcttttctaatcccgcaagctttgcgcgtgtttccgacagtgctttctcatattctgcgacatccagccgcttgtacacaagcgcgttggtaagcctgccgatctgctggtggaggctgagtgcatagcgtacgtaaacgtcctcttcctcccgagtcatgacagcgccacatccgcatatttgcggatcaacgggcgtataactcgtacaatttcctcgtccgtcattgcgtttaactcaggtgtgtccgttagttcctcgaactttgcgacttcagcttcggtaaggacttccgacggatcgcccccgaattcttgaagcgctaaggtcaatgcgccgcagataataaacgcgtgtaatttttcgccagttagtacgctactcatgccgcaaccccctccgtatctattaaaccctcacgtatcaaatacgccagcgccaccgcacacgcatcgctatcatcgtagccagtccggaacgcgtaatcctcacctagccgcaacaatctccgtacggccgccgcgacttccgccttctcggctttgccgttgcccgtcaccaaccgtttaaccgacgtaggcgctaacgcaggctttaaatccgccgcctgatatccgtaggagtacaacgcacgatccgccgcagcccacgaactgaatatcgtttgtgtagcgcgtttgtttcggccagccgtaaagtcctcgcgaacaacgtggtcaaacggacgatgctcacggacgaagtgggaaacgaatgactctacggtataattgcgcactgcgtccgggtcctcggtcgaagtagcaacggaagaacatgcgacgagatacggttgcctatttcgtacctctaccgcggcgattccgggacttagcgataggtcgagcccgagtacgcgtaacggtttaggccgcgtcgtcttcgccaattcgcaacacctccgctgatttctcacggatgagttccgccatcatctctagctgctcctccgcggtgtacgtcttctcaagccgcgctccgatatcgtacagcgtgtccgcatctgactcgggtaacagtccgcgtaagtctccgccatgttggtcgtacgctatcagtaatgcagagataaccaggtactcgcgtgtttcattcgtggcttcaacctgtctgcgttcttctaggcgtttacgcgcttcctctttctcttgacgcgaggatttgaacactccgtcatccttcggtttatcttcaatgcttccgtccacaaagcccgctacgaaagcccaaatagcaagtagtgcgaagaagatacgcatccaccaatccgaatcttccccgaagattaacgtcaaagcgaaaagaccgccgagcaacaccgagaacgccacacctacgtacataactccgttgctgattctccgtccgtaattcatcaggcactcatcctttcttttacgtaagctcgatacgcggtctcaaatgtcggatacttccccattaatccgcgaagtcctgtcgtagtggcaatgtcttgaccacttggaccgcgaggtacacacttccgttgctctgcgttaagccagtaaaagaaatcctccagcccgctaatccaatagtcatggccgaatggtccgtatttgaatttcatttacgcagcctccttcgtttggctttccgcacgaatccgcataatatccgctaacgcctcgctcggtccgcgcttcttccagtccggtaatgacgaatgattcaacgcgattaccttgcgctccagtttcgcgatttccgattcagacaacgacaatgcaaccgtccgcttgaaatcgagaaacgtccacttgtcgaggtcaagttccggaggattgcccgtttcagccgcgtgtacaatatccgcaaagtggtcgagtacgtcgttacgcatttcgtccgtaatgtggagaccgaacgccaagatatccgggtttttcgcgaactcatcttccgtcatattccacgacttcttcgaaccgttaacgtagaggatgacgtagtagtcaacgtcatacataacggagtaacagacgcattgcttaacgtggtcctccttcggaccttttctcgcagagaagccggacgtcatcgaatacgttgtttgcttcgatttaatttcgaggccgacacgcattatttcgccatcctcggaaacgtagagcataataccgtcgcatgtaccgtagagtgcaaacgcctttcctccgtgttcgattacacggctaacctttgcgaagtcttcgaacatcggctcgcctcggtcgttaagttcgaaagcaaaacgcatgttgccgtgtttcgcagcgaagaggatatcacgttgaattgtatccccgatcgctgtcccgatacggacccaccgtccttgatgcgctggccgctctgtcttgtccttcttggctccgcgcatcttctcgtacaagccacgcgaatccgcgttagccgacgaaggagagaaatacggaatgcctctcggaggccataacttgcgggatttgtccgttaagaaatccgcataccaacgatgaatctgcgcgtcgagagcgtcatcgtatacttctggcgcggaatgccatgcgtttaggtgaagcgtgaggtcttgcgcgatcttatttgcgagttgttgcgacagttaaaccgcctcctagtaagattcgtattggtaatcgtaaatgccgatcctacctctttctgttacgtaagcaatcgcatagcaatcaatactgtaaccggagctatcgaagccaccgcagtgttggtacgcgcacgttacgccgaaatagaacctaaccacgtcaaccgcgtgacgacatatttcctctccgccaaaatccgggtttgcttccacgctcgctattgcgtcggctatttttaatcggatctgcgcttcagtagccattacgcaacctccttcgttattaccttccagccgtaagcggagcccttcttcgtttcctctagcgtacgactcgtcaattgaactccgttaataaaatcaaatacatcggacatataaagcggataacgctggccggatcgcgtgtcctcgacaataagccctgcgcttgaccgcgaactgaaccagtcaacaaccgtgaagtcaccgaagacttggcgtttgtctctcgtagaattgtgacagcggcaacggcaatcgtagcaatatccgcgttcatactcgttgccgcatgttgggcacatgtaaacgttgatttttccgttagccacttacgcagccctccccgaaacataccgaattgtcgtaacttcttgcggtacgacttcctcgatattgacggaaaaatctccgccatcctgcatttcagttgcgggaacttcacgccaaatagagaagtacgcgacctttccgtcatcttgcgtaacacggtatacgtccgttcggtagttagtccatcgaccaccgtcttcaaacgaagaatcaactttctcacttgtgtaccctgccggcttgtagcggtcgaggatcgcgtcaacttcctcgtgcgtttcgtcccacgcttcaccctcgtacccttcaccgatcaattcgcgcagcttctcaattacgttttccatttacgcaacctccttgtatttgtccgtgtattccggcaacggacggcagttatcgaaatcccactcgtccggtccatactcctgcatccagcgcggttcgatcactatatccgtaacaagcggaacactaaacgtaaccgtctgcgtcataatctcgtcgataagcgtgatcgtctctcgcgttagttgctcgttcggtatcgaatttttgatttcatcgtgtatggatgcgttgaactcccaaccacgcgctcgacactcctgggcgttgcggatgccgatacgcttcagcacgtcagcccccgtgccctgaattactgcgttaaatgaggcacgttcccagtatccgataagcccgcgtttctcggacagtacgtcgatctcgtcttgaatacgttgtaacttcgcggattctgacgcgctgagcttcgtcttattccgtagcgccttccgctccgtatataaccggattaaccgctgttcattcttggctgccgctgccgcaacgctcttgtaatcgggaaatctccgtttacggccgtccagtgtttcaacgtatccgtgccgccgcatgaactcgcggatatcggccaccatcgttttaaatgacggaaatgtacggtcgaaattatcgaagaacatcgcggctacgtcatcactaacgcccatcttcttcgcaaaagacttcggcgactggtcgtacgataccgcgagttggcccgtcttcatcatcttgcgcggttgaaatgtatgagtcgggtcgtacgctttatcaacgcaatactcctgcggcaaatcgaacgtcatcatcgccatcgtcgtataaaggtcaacgccgtcaacgaagatttgacgcatggagttatcgccatatctcgtgtacatgatgtgcgacatgatgcgtggttctatctgaccgagatcggcgccgacgaacgtggaaccagggcgaggtataaactgattacgtacggaggttcctgcgccctttgacggcatattctgcaaattcgtgcctttagggactttgcgctcgtcagtgatgagcttacggacgatagcgtggtaatttgcatcagttatcgtgaccaaatggcataccgtccttatcgtagagtggtgacaggcctcctattccgttcgatgtagtactagaacttagcgctgcgtaataaatgcctgtctccttatctcttacagtagttatcacggtagttgtatctataaaatcccgacttataaactcgaatcgtatatttgtagcagttttttctttaacactgtccgtactctcgccacaagctgtcagcccaaacgttagcaatagcgctactaacccgaaaatcatcttcttcatattcgttcctccgtttcaaagtcacgtaatatatcgactggccgtccgctgtaacccgatgaactataacgtccggtcgcggtccctcccgatttgaactccgtgtgaatccgtccatctgcttcaagagcttgcggtattttcgtcacgtacgtattcagcagcttctcataggcggccacggccgcgagcggctttaacgcttcctcttcctcgtagtacgcctccataacatcggccgcagtgctccgcgttttaccgcgcttgaactgtccggtccgatcgcgtataccgaggtggtcataaatgagatacgccagatgattaccgttcgtaatcgaaaattcagtaacgaacaaaggcgcatgttcttcgtctgctggcgctagttgctcggcctctaactccgcgagacgtgcgactgcattcgtgtacttcttcagtgctgtcttaccagccgctttacattccgcgataattgcacgctgtttctcggtcacttccttattacgtgcgatccgtcgccgctgcttctcgatccagtccgtaatcttactggcgtttagcgtacggtccatcttacgtacaaactcagttccgacatcatacgaagtgattacgtcctgacgcgcttgttcaagtagcggtgtaaactccgcttccagctttgcaagcccttcgaggtcgacaacgaagccggaccgcgccaggaatacgtctgtttccggtagcttcgagtcaattaacgcgtaacaatcgaggagcttaccggcaccatctgcggaggctgcgtttttcatctgctcgtactgccactccgagagcttccaaccgtacagaacgtcctttatcgcgtaaatcccgacgagctcgacactaaaaggagctggcgacctgtttccgaacatgtcttcgaatgtgtaaatcggtccgttaatgccgaagaatcgtccgtacttcgcggttagtggcttgagaccgaaggactcctcatgttcattaagcatccgcatcgcatctagcgagtcccatacgcagccgtgaatctcgtaaccgtccttaatcgcgacgtgaaggtcatagcgcgccgatcccatatgaaacgacttgccgtggtcaggtagcgatagatacggagaaattgccgcaagcactttcgaacgcgttagctgactatccgtagacttgtgcgcactcgcatcgtcaagaaactcgaatcccggctcaccacgcatatcaacgtgaccatacggaaggtaataaccttcgttgagtagcggaagccacacggagtaaccgatagatacgtcaatgtacgtatcaacgcctgtaccctcgaagtcattcgcggtcatggactttacgccaagtttcgtccatctgtccggccactcacgcatctgacggcggcactcttcacgtagccgctcaacgaacgccggcaactccgcgtcatccgtaataatgtggaagttatccggtttcgtccgtaacgtctccgctatcctttccgccctttcctgccgttgcgcatccgccaagatacgctcgcccgctgtaactacgtcagccttggtaatagagcccccgccagagcgaagtgtaatagcggacgagggattgcctgtttccctcgtcaacgttattcttaccgcctcgactgccttacgctcgcgctccgtcaatgacattgcgctaatacgctcgaccgcttcggctggcgtttcttccgccgctttcttacgtttggctgcgtcggctacacgttcggctacgtcagggtctgcggttggctggcggagattaagcgttaatttaacgtcagccataattgcggcacctccttacgctgcggctttcgtatcctcaagctccgtccggtcaaaacgctgttcgaccggtgtaacgagcttgacggcaacgtatcgttgaaccccgcgcacagtcactccagggagttccgacccgtcagcgttcgaaattactccgatatcgccccgctcaatctcgccgaatccttttgtgacctctacgatatcgcccgccttaaactcgttcactttgcgtccaatcatcgcccacttcgctgtttccacgtcaacgcgttctagttcgtcttggcggtagaagtcgtagtcacttccgtctaacaacacggaacggaacggtctgctgtcgcgatcatctctcgtaatcttaacgatagaacctttcggtaggtctttgcgaacgtctgtgagagtacgcgcatattcgccgactttgaaacgtacgggctccggttgtggttgcggcttctccccgtcagtaacgagagtcaactcggtaagcaacgcgtgccaccatcgttgctccgaaaagtttacgtaagcgttaatcccgtcaatgttcgccaccgttccgatagctccattactagcattgccccatccgtactccggtttctccccgtctttaatcgtaaggcgaacggtagagccgacttcgatcgtgagttttgcgagttgttccggtttagcgtaaccacgcgagagaccaccgccgacgatcttaataacaggtccggatctgtgcgtatcgtaaaggggcgtatcgacttcgtaaatttctccgttgtcgtatccgaccagcggccactcgccgccaccgctaatcaaacgcaccttttcgccttttgcgaatcgactcctcgggtccgtagtagtcgtttctgccgcgagtttacgcttagcttgcgctacctcttcgtcggtggcgcggactagctcggactccgtaaaccatccggcattcttaccgtcgatagtatccgtgtggaacggacggctggattcgtcatcttccataatcttgactaagccaccgaccgagacgcgatcttccgtaaacattccgttcttagcgactaccttcgcaaattctccgaccttcaagcgtttttgcgcaaggaactctgcttcggttgcgggttcgtattcgcctggaccgaaccagaccgcaattctatcccggccgtccgcggtttcgcccatatacggaaggtgctcagactcgtcgtcctttacgatttttacgatctcgccgattttaaactgatggccgcgactctcgctcgtgatcttagcgtaatccccgacggtcaaacgtctaggtgcgagctcttttgcggttgcgggttcgagcacgacgtactcactaagcagtaccagtacgctgtatcctgatttagccatagcgcgtacgtcaccatctccatccaccgagtcgactacgaactccgctccgttttcgtaacggtcctcgtcggaatccttacgcacaatgcggatacgttcacccggctctgcccatcgtttaacctcgcgatattctgcggtctctgatactttcgtatacacttcgaacccctcaccgcaaaggtcgtgctcgtctccgtcattgtctacgatttgcgggtctccgaattcatcaatccgtgtaacttcgtaaaacgcgcccgtcgttacgtagctggactcgtcgtccatataccgaatgatatcgccaacttgcgcatcacgctcaaccttacgatacttaacgccgtttacctctacgtctacagccggtacagttacgttcaatttcgccatttaattgatctccttttaggggctcgttggcccgcgttttattagacttgcgtaatcttccgtaaactacgactaagctgcgagtgctaacgctggtgcttccggttcgggttcgtcgagattccgattcaacgcgatggacaattcgacccaacgttcggacgccttagcctcgctacaccagtactcgctcaggcatctattttcgaacgtgaacacacggggaacctcgccgtcgaccgcccatacgccaacgatatagtcagcctcggataagtcgtacgtcgtaccgttgcctttctttgcgtagactacgaggtcagccacgccgtcgccgcgctcacggtccgaacgtcggcgtaccgttttaacttgaatcttaacgtggcgtcccgtaagtggctccgtcgctaatacgtcgtaagcctccgcagtttccgaagtgtgtacggtccatccgttagccaacagcgcaagacgcgccgccagctcggagtatttgccggtgatttccgtttgatgtgccgtattactcgcctccttccggataatttaccgtgccggctacgtcgtcaatttctaacgtcggacgagctacgttgattcttacgtagccactgccgcgaagtgcgttggtgtaaccctccgcgtcctgctccgctactcggaatgcgaccggttgtttaccgttgtttttgtccgcaattagcctaacattacgcatagaatcgcctcctttcgtaggttaaaacggtaaatctgagtcagagatgtcgataggcgcatccgtttgttgcggctcggtcggcggtttttgtgcggccgctccgagtacggatttatcgacgtggtccgggtcagcctcggtcagtaacgtgataatgtcgtcctcttcgcggaagtttgcgagttcttcatacgggaatgtaaaaccgagaaactgtgcggcttcttccggtacctctgcgtcacctgaaccgagcgaaaaagactttccatctgtcgttttagtgagcgtaaagacatcgccaacaagtgtgtagtctttgctgaacttcttcgcagctttttcgagcttgtcgtagtctccaattaagttcatggcgtggaactctttgatatcaagaacacgccaagtcttgtactcaagatcaaataccggaatcatgaagtatagtttgcgcttggctttagctttgcacgagatacatacactcccattcggcttactgaacgccttgatctccgaacctacgccgcgcggtgagtgtaagcaagtgtgctttttgacgtaagtcacgaaaggactatacgtgctatcctcgtggcaaaagtaaaagtaccactggtcagggtccgcaagcattacgaactgacggccctcgccgagttccgacgctttcccacccaaacgaacatacctcgttacgccttccggaagcccctcgttcaagccgccacctttcggagtgttgcggtcttcctcacgttgcttcagttgatcgcggatactcattcaatcacgttcccctcggttaatttcggatttcgaatcagcgttgttacacgctgtattcttacgtccgctacacggcaccatcggtatagtctcacgttgacaccgcgtagccggcgtaagaaattccggcttatataaaggaagcgaaaatttaaacgtaagcaacaacggacttcataatattcgttttctcacgttgaacctcgataagctcacgcgccaagtttcgcaattccacatcaatttcgtttatacgggcgttcatttccgcgataacgcggttagactcggacttaatacagcgtaattccgcttccgcacgttcgaccgctagttctgctttacggacgttaatacgtttgacttcacgcttttctttgcgttcagccgttttgactgtgcgttgaattaagcgctcgatcggattacggatgacttcgtttgccttgtgctgcgggtacagcgtataaacggtcgactccgaaggatgtacgataaacactgtacgtcgatacgcgaacatgcggccgggcttgccttcttcgtcgattacgtgctccgaaattaacgaagctcgacgcaacatatccattacgtgcataggcgctttagcgcgatccactccgaaatgttcaacggcgcggtcgcaagcgtgcggagatacgaatatctttccggtaaaatgcgtgccggctttcgggtcaattgcgatactcatgcgatgcgaaccccctttaacgtgggaacacggatgtaatccgcagggtcttcgtatggagcgaacgatccttcgtaataaacgtgcgggtaacgcttggatatcgtatgttcgttgttatgcgcataatttttatgcgattttctacgtttcatcttaggcacctccgggaatgattgcgtcattttcgttgacaagcgttatcatcactggtaaaatgctcattgtgaggtaagcgaatttccagtaaaaatacataactgcatacatcaacggtcttgtttaacaaacgagtcattgtgttataatgcatttaaggaaagtcgggcctcgtgcctgaagctccgacttaaccttaagtcagttacgcggaaatatactttctattcacgcgtaacccctcgggcaagtaatcgctaatgttcccgaaacgattggcgtcgtatcggtgacctaatttgcgtaacttgcgactaacagcttcaggatgtagtccgagcgctttggcgagtgctctgacagattcatattcttcctgaaggaatattgatacgatggctgtcgtatcagaatcgacctgggtagggtctgaaaggtaggcgatcagttggtgctggtcgtcttctttctttattacttcaacttccgtttctatttcgtctctgattttgagtattggcgtactctcatcaaaacctatatccaaacttaactcgtaccgtctatttctccttagcgagattttaatgtagtcctttctggcgttactcaacgaagttgaaagctgtagcccgaagttctgtagatattctcttgaggttaaccttagtagaacatcatcaaaaactgcatcagcttcattctgtgtacagagaccactagccgctaaccgtcttcgatgctgggttaagaactcaactttcgctgtctcatagagtaagttaaaattatcagtagtcttgtccttaaagaaagcatccgatgttttatttaatttttcaaagctcagaggaaccaccgccttttgtttttcgccttacacttacttcaacgacaccgagagtctcgtgacacacttttcttaaactttttttgaattttttatacggaggcatttatggctgcttatacggtcactaaatgcctactcggtaccttattacgaactggccctaagccaatgagccaggctgagttgtcgcgtcgcacgggaatcaacaaaagccagataagtgcgtatgtaaatcaacgttacgctaacccaatggacctggcacacgcccgttcgattgcatcggcgttagaactaacgtctccttacgatctctacgaatggtatgaagaattaccgagtgggcgcacgagcgattaaatcgttccgtgtgctattaatgaacgtgattcacgtccaatcggttcctaatattacattattcgacgcgatttgccaacgggatgttgcagctttgcgaaaatactccgtcttgctgcgccgttgcataacgctcgaacttttgctgcgtctcctacttcgtttatgtcctttgccggtgcaggcacatatacgtcatatacttcgcaatatccgcgcattttctccgcaacttcccgacgtagcttctctcccgcctcgtcattatccgtacctataagtagttcccttactggagacctgcgtaatagttcggcctttgcgtccgtaaacgccgaccccccgactgctatcgccggtataccgcagctccaagcgtacattgcatcaatttccgattctacgagtaatacacgttcaatcatgcgcgcatagatgatatgaatcccgtataccatgtttcggaccggagcgccgccgcgcgcataccaaaacgccttactccacgttgctcgccatttcgcattgatcggcgttccatccggagagcaccatggcatgacgaccgcatttttagcgcgatcatcaccgcaatcgaacatgcgttgaatctccggcgatatacctcgacccgttaagtacggtatttcctcatccgtcagatacggtgacacgtcgatcggcttgggtttgggcggtggctcaggcggcaccaacttaactcgtaatgtcggcggtcccgcatcctcaacgattccagttgtaagttcttcgcgggcttcttcgtatgtaatatcgcgaatgaagctatacaaccgaattggaccaccgcgtgaccatgaggaatcctttgcgcccaaatccgtccagcagccgaatgcagccgagtcagggttggtaactagcgagaatgacggcgtactgtccacgcgtagcccgaatggtgacgatgcgttgagacgtccgcgattattcggttgaatattacgccaatcgtaggaccatactgcggataagaacacgtcaacgtttataatctcctgtatgaggtcgtcccccttagaatttaagaatacggccctcgtatgccctttttcgaatacgtatcaacttttctcggctttcattgagcgtctgaatggccctctcgacgtcaagaacaacccgcaaagagtcctcaggtaaatccttataaaaattcataataactttaagctctgcctctaaattaagatttctaatctcatccgttattctagctacggaaggtgtgagactattgtaaacctttcctgctacgaactctgagtcatcatgataagaagcttcattagtttcttcttcggtctctggcgccaccccctctgcgagcaatgaaaggagagcatgtgtggggtgcaagatagccagtctaggccctaccttctctttccgcaccaaactttcatttgtgacttcgatattccacaacgagttcctcaccagattactaggtacatcataatggttttcttctttgagcctcttttcaacttcactacataagtctgagagtcttatacctgaatcagaatactcagagataaccctcaatcccaactgacgtacggtatccatgcttggttgtttcacttgtaccacaactcccttagcaaactatactactttactaacgttattctaatccgggactaatggtaagtcaaggaaatatatcaaaaaccactcactccggcaaattgtccagctaacgaaacatgatcaggctcacgcaaaactccgtaatccattagcgctattagctctatcgtaaacccttcgccgccgttcctccccttctcaactccgagcttgccgttaccatttgtcgcatcgaacgcaaataagttcgtcgcaatttccagtacggctcccgttgtctttacttgatcgcgttttggtagttttatttcgcgattctcacctacctcgacatcctgtcgctctgagcgcgcttggatcgtgtagattccaaccacgtcgtgtgcgcctataatcgcctctagtctacgcgcagcctgttccgcagctcctcctgtggtcttgttcgagtttctaccatagacatccgcaagtccataaaacgggtcaacgactacagcatttatctctggatgttccgtaagctctcgatctaactcatccaaagtacgtgttaaatcaacgtctccctttgcctgtaaaatcaaattacccggatagtagtcgttcacttttgcggccatctctaacagatattcctcgacatcgccttcgagcctccccgaaagtatgtccttgttcgggactccaactttaaccttaaaatctgtagaagagatggcttcttcgcgtgccgtaataattgagagtagccgggagaaccaagggtaccactttacctcgtatgttttcacgaggacgttggcaccttgtcgaagtaactcgtcaacaaagacagcggagagatacgttttcccacggcctgactctgccatgatcccgtaaatgtccccggagtacagaccgccaatctccgcattcagggactcgaacggcgtgcgccaaagtgtaaatgacttcccggccttccttttttggtactcttccgaaaacgcacccgaaaggatatcaaaggtatttcctgtatttttacgaacacttgttcccgtttccagtttaatccgttcgacccgtttcgtcaaccattctgcaagctccgtgaatgggatgttcccaaacttttcgcctaattcatcattaaccattttcgcgaactctcggttacctacgtcttccttcatccgccgcgccaaataatcgaagctatccgttattcccggtatatactcaatgtctggacaattcgcaacgaacgtcgcgtaagacggcgccttaccctcgttctctgatgaaaatttaacgacgaagtcatacgcacgttgttcgctcaacgtcgggaagtctgtgcgctttacattgtactttgcaatagctaacgtatttcccgagtcgattaacttcgatagaaactgttgactaattattgccatttactacacctcctgttttacaatacctttacaatctatgtcaaagtcgatttaggacaattttactaggtttatagttcgacaaaacagtaatattacgtaaataactggacacttttaggaaataagatgcaatttacgtcgtgttatatctgcgttctttgtcgaataatgacgggtataattatagaaactcgttattacgccgttattctcacgtttacactttcttgtatcgtagaagagtttggcgatacgtagtgatccccagtaatcccataattaacctccgtaatagtatcacgtaaataagtttgtgtaaagcacaatatatagtttttataacgattaaaattcaatatatagcggaatatcgctattctgatattttggaacaacgtatttccgcaacttttctacgcaggtcggcgaatcccacgtttactcccgcccacaaatggaatcactacgcacatatcccgaacacggtccgccaatctcgcgtcaaatacctgcgctaagtcctcgatcacaacgttagacgtatacaccgtcggtaatccgtttgccacacggtaattgacgatgccgtgcaagtccgctcgaaacgcatcggttgccgaccgtacgcctatatcgtccaagactacgaatggcgtcactttggcgcgtgattccattgcgtaatactcggccgcgtgacgttccgctgtctcggctggtacatgactacggttgaatccgaggaataacgtttgccaagcgttaacatcgagaaagtatgcgcacctttccagcggctgcctgtcccgctggagcgatccgatataatggcgcacgatgtattcatgtagtaccgcgctcgccgacgtagtttttccggtgccgggagattccgaatagaggtatagcgattttatacgctccgttgcatcatcgaattgccgcttgaacgtgttaacgtacgcgtcgataagtttataagcccccgcctgatcctctcttgccggagagtttaggagcgttatgcctgcgtactctttcggtacgtttgccgctgcaatccgcccacccgcgccattgaatccgtgaactgcgatccatgatgaacagagagcgttgcagcttgatccaccagattgcgagcagtgctgcgctaatatgcatttgtctgcgttagacattgcgttcctccttacctacttaagtttatatctacatatagttttgtcaatcggcccatttacaaccaatccgtaatttcctccgtagccatcccgccattaactacggtcgcctccgctttttccttgcgctgcctgtccgcaaggatacggggaattaccgcgtttaaacggtagctgatcgcgaaccctgccgtaagtatcggatagtccggcgtcggcctgtattcacggaaaatcaacgtaaaagcttcgtgtaaaacgtctgctccgtgctccgccaaagctcgtttaattgcgccctgctcgaaaccccagttacgcatcggtaggtacgcttcgactccaaagtgctcgcggttcaaatcggcgaacattgcatgtacggttcgtacgttccactgtgtgtgcggtaatgtgcgccaggctgtacggtcaattttcttcgctggcattttcttctccctcctgtagcttagatctaaaatgaacatcaggttaataattaatttacaatatcaggataacgatattccgataattaattagttattgcattgttatatgaattataaaaagacgtaattcctcgaaaatggttcaatacacctatcttgttttgatcatctccgttcagttttggtaatacgatcacgcagaaccgatctatgtttaagccctgtaatcactgtcgcacctctattatataattgaactatattttagaaaaacagcaaaatagtcgattacaaagatatgtgtatgtttatcaagaaacccacttaaaaacatttataaccttttactaggaattataaagcgaaagttatcgtaaacagtaaaattagaaaatcaaatgtatcgtaaacagtaaaattccgaaacgcactataagtctcttttttgtacctcctcttgaatacttttgtatactcttgttttctcaattttccgtttttttgcaaatatcgaacacttccccctcagccgcgatcgctctgcggattgcttccagctagccctctcgcacttcttcgatgaactccgccagttctaccatagacgtctttgcgtacaatatgcacttctccttcgagagtactgacgttccttcattggtcgttgcttctacgacgaacgcgggcggctctgtcagttacaaaacgctaactcttcgtttaagtctcgcatttcgttaccgcctccgtattataaattgatatgggaaatccggtaaaacctcaaattcggcgattttaccaatttacagttttttcaagttgatgcttaagaatgaataatttttcttaaaaagagaagaatttttctctttatactataaatatatctttttttcgtatatttgccgtgtttcgattaatactgtgtttctcttaaatactcgttcttactcgtgttctctcagtatttcatttctgattaataattgcccactaagtctaaatacctactatcttccgccctacccgtatacgtccattcccgctaacctctcgtagcaaatcccgcctattccgccggagctgccccgcggatgggaacacgcctagctccgttaaaatcgcgggcaaatagcggttttccgtgcgtagagtacgacaacactccggagcgtcaacgccgcctattatcacggtaaagtgacggtagaaatcagtcttcatacgccaatgccaagcatatcgagcgtgtattggacaccgtccgcaaaggcgtaatcctcactgtatttacggtatcttccgcaaccttcgcgatgcctttgcagagtgagcgcaatctccgcgtgtgtttgcttgcgggcttgttcctccgtcaactcacgttcataaccgttgaccaaagcggccattaacgtatcataagaaatcgagaccaacgctgtgtagtacgagttgccgatccgctctctacgcagaagaatgccgcgattgcccacccctcccccacgcagttcctcgatcgcatccgcaacctccgcaggtattaccggcttattgacgtttgacatttacaccatccccttccgcatttttattgccgcgataccattcaaggatatcgtcgaccgtttcgagctttccgtttttcatgttgcgttcaacctttcgttataaatatcatagcaaatagcgtgctggaattgggtgaataatttgcgggtgaaatgcgggacaaatgctgcctaaatggtgaatttgcttcggctcataccagcacctcctacgtaatatcaagcgcctgcacgttctcaaacacgtaagcctgcgaaccgtatttacgttgcgcccactcgcccgcttgattgcgtgacttagcgtacacaacctccttgatttcggtccctacgtatactacgaatgtattttgtgccatcggttttcctacgcggatcattattcggcctccgttccgttggggttaattcgcacgatgatcggtgagtgtgccgccttctccgcatactctacacagttaccggttccgccttttgtcccgtcccaaaccgcaatcacgagaccggagctatccaccatccacgcattgcgtcgctgcatcttccaagcagcgtaacccggatcgcaaacgtactgcacgtcgtcacaccgcgctatgatgttggaccaacgtatacgcgacgcttgcggccacttgccttcttgcccctcgaatggaaccgcagccactagacggatatgcgttgccgtagtagctcgaagtttcaacacgatttccgctgcaaccatatcgacgcccaaagccatgccgctaatgaatgtatcgtaaccttgctcaatggcgttccctattacccgctcaagttcggatttgacacgtatcataatcggattcgactcgtcatatcctcctaacttattcgggcgatgccccgtaaagcataccgttttgctacgtatcattttcccgtctcctttacgttaaattagcgcctttacccgttaccctaccgaataccctcgctctacccttacgcgcctaatttgacggtaaaatcaagcgatcctgctgcatttatagccgcaaccaactcggccgtctccctggacaagaccgacataaactccgccagcgtttccgcagaatccgcagcggccaccgccgagcgaacgcggaccgaatcgagagccacgtggagaccgacggcgttgagcggatagtagccgtcgtcgtcccaacgttcgcgcaactccggagccggcgcgccctcgaccgctttatagccgggtgccttcgtagggtcgacaatcttgcgctgactgacgataaattgcgtaccgtccgagcgtagtgcgtaattagcggttagttgtacgttcatttagcgaaacacctccgattgatttgtgaggaaacgtatacgcgtcgattacacacgcgacgagaccgaataaagataacgttacggatgcgagtaatactgcggttattttcatacgcctacctccgtttataaatgcgtagtgatataagctcgcgattcacttcgttcatactcgccgtcgactatcgtctccgacctattttcatacgcgtatagatattaataaggtctgatacgtcgctaggaatgagcaaagcgaatgacgacgcgtaatgttttatctagttcttaatggctcttgttaaaagactggttatagttagtgtcttccgtagccatgtcggtaaccaccatgtcggtattcgcggacatggacgtaactaaccggtgtcaagcacgtcaggctccgcatcaaatatcgcgagttgactgatcggcagcaccgtataccgcgtattctgccacgtacctgtcggcgacctctcacgtactgcgcgaataactggacgtccgttccagcggtatgccgtcagcttcttaacgtatctattcgcagtctgacggttgacgccgagatacctcgcgatctgatcctgcgtagggtaacagttaccggctgcatccatgaacgaagcgataacgcagagtgttgtccagttttgcgcgcccatacttgcgatgagccccgcctttgctgcgtcgacgtacatcttgacgaagatgcgcgtctcggttgcgccggatgtgacggagtattccgtttgtgattcgacgctgacgaggcgttgatgatcggtcatgctgcgtcctcctttctataggttaccgagtctataaacgcctccatatccgcaatcaaatccgtacatcccacgcttctcagatgtgggtataacgctgttacgtgaataaccgttgcaatcccgatttgttccgctaccggctcgcctcttgcgtaatatacggttaggttatccgtctcctttgcgtacttctctagcgtcctacacctcgggtcgagtatcgaattggcgcttagcttggcgtcgacccactccgtttcattaacgatgaagtccggaatgcacgcgcctactttgacgtggtacctaacgtctgggtagatagcacgtaatatctcaccgagcttacgttcaaactcatgtccgagtgggatagagtcgcggcctttgtacctctcgctaagtgcgtatttgtacgagactttatacgcagctagaaactttcgatatgttccgtagtgcttgcgtaggtatccgtacagcttcggataggtctcacgcaaaacgcgcgtaggtaaatcatcgaaagggtagtgttcacggtagaaattgtccagtgcgtcgatctccacccgctccctaatttcctgcgaaaccttccgaaaactgaaatagtctaaattgtaaatatcacacacatgcgcaacgtcagccgtttctactactcggaaatcgcacgttatttcaaaacaccgttgaagctcgatttcgcttggcgtaccgttatagtcgtataatccgtattctcgaagtgcttgtgtgtaactaccgaaggatcgtgcagcctgtttatggatgttgttatactcctttgcggaaagttcttgcggtatgttgataacgtcgaccccgcgatcgattagttcgtcgatcttcgtgagcatccgctcttttttatccatccgattgcctccccgccccatttgtttctgttcgggatagcttcgcacattcgggaaactatcgccctcacttacttcaacgacactcaagtatccgtgacacacttttacgaaaaaaaaaataacgcacacctccgaagagacgagcgttatatacaaaatttataatcgttccaatggcgaaaatttagcgtgctgccgagacacgtctgttccgaagaggtttacgtacattcttacaatttcaagcgaggtatgcccgagtatcttctgaaggctgaacgagtcgcccccgttcataacgtacatcttagcgaacgtatggcgaaaggtgtgcgggctgacacgtacccctttaatccgtgccgcctgtccgtatagttgaatggcttgctgcataccgcgcactctaaacgtgttgttgtctatattcacaaatagactatccgtctccaaaataccgcgcatctccatataattaaacagtattttttctaacgaccgggaaaaaggtacgaggcgctctttgcgtccttttccgtatactttgaacgtacggtccttccagtcaatatcggtaacatctaacctttcagcttcgctgatccttattcccgtatccaacaacatcgacattaggcaataatcacggtaccccgtaaatgttgacctgttcggagcgtcaaacaatgcctttatctgtgcgttattgaacgtttcaataatacgcttctctgctttgatcgtaccgataccgactaccggatttatatccgtaaaaccctccgtgtgtagccagttgaagaaagcgcgccaacctcgtataagtttgttaatcgtagcatctgcgggagttgagccacgcccccttttaatcttctcgtttctcttcgtatcaatagcggtcattatattcatcttcgtaacgtcaatcggacgctcaacttcctgcatcgttagttggcgcattagttccttcgtcgtgtcgctgtaaaagtttaacgtttcatccgtaaggtttcgtatgcggcagtagcggagaaaagagttcctagcggtttcaaattcgagggcttccggggggtatgtggtcgttacttgagcgcggccagcagcggccaggttaacgcgtcgttttcgttccaatcaaaaacgcctccattcgtaaatatccgttaatgaaacgaataaaacgaatgcaggcgtacaggatatcgtatataacgtatcgcataacttgcgtaatttaccgtattggggatgcgtaccgacttcgtaatgttgtcgttaatcaactgaaggttatacgtaaacagacgcttacttttaagtcctgtgcgtctgccaattccgccaccccggcataaatttaggaacgctaatctttacacttacttgtcttacaagtatctgagaaacatgcatctgattaagaagtgttctcgttatgtaaatgtcgttcaattgggcaccaacatataatacgataattttatcgaattgtaaagtgtttttaaaaaaaaataataaatttctctttttgtataacttgtgcacatttgaattacactaataaacgtctttccaaactaccagaaggggtgttacgaatgcgtgaaggtatgattccagctgttcttggaacggtagtatcggcttcaggcgctgtgttgctgagcagtaagtacaaacttgcagctacaggcattctcggtttcggactggctcatgttgttctgggagcgattgatctgattgagcatcgctagttgtttgggaagtgccgggtgggatttagtccctcccggttttatttttatcaacgtttagtctggagcacaagcgtttatgtaaagtatagaagctgaatgtacctaataaaaggagctgtgatgtgctatgagagataataactctgaaaaaaatcgtactgacgatcaaatcgaacataaacaatccctcgacaagcgcgagccaggatttaatcgcattcctgacaccgatgcagatacacctgctgctaccgatatgattgatgaagccataggtcgcgggatagacaagttacgtaacgatttcacaaaataaagcatgggtaatagggcacaggtttgtgagcagcccttaattttatttgctttgatatgtacagtgatttcgtaaaatcacttaaagatcagcataatccagccaatgatcgagatccacagcacgatgctgattaagagtccacacatgataccaaaagagaaattaccttcattcttcggcatagtactgccaaatttcaatctaagcttcatttgattccagttcatagaaccccctccttaagttctatttcggaatatgaagcttatttttttagacctatagtcatgttttcgaaaataaaaaagggtttttcgtcctatcaccctgatcgcggaaacaggattacagctataccgaccaaacaaatcaatccaccaatgaaatcgtacaagtcgggtgtctttttatcaatccaccagccccatgcgatggaaagaacaataaagacacctccgtatgctgcatatacacgcccaaaggaggaaaaaacctgaaaggtagcgatgattccatacacagccaaaattactccgccgcaaagtccgacataccatgtcttaccttcacgcagccactgccaaatcaaatatcctcctccaatttcagcgataccagccaatataaaaagtaaagctgcctttaacaccatttcacatccctaattcttcaaattcttttcgttttttttggatatctcaattagtgcactcgagctaaaatgataatcaatgcaatcacgccaactagaatcagcaggttgctgacctgacgccataagctaggcactccctcggagtgaagcttccgctgattggcatcaaagttcgctttggctccttcagcatctgctgatctagagaatggtctgttttcttcattcataagagtacctccttttcaatccactttaatcttaccaaacttttccgtcgatttcgcggtgcttttatgcatatacttaccacatatttctgattgcaacttcatatatgtgaagtgcatatccatatgtcaatatttcgctgaatataaagtatgatgtcgaatcaaggtagagtgggtatttagacgtctttcattgcaggacggtagttatggtataatttagtcaacatgttcaagatcgtaaccagcgctcaactgtttattccaattgcaattaaatttacatccaataatccacatcccggttacaacctgcatattctgtttgcaaacccaggaggaggatacctatgtccccaatctttatagcaagtttaatgataatgggcatatttttatttcagacagccatcgttttcggcatcatacattggatttcaaaacgcacccaacgtccagcacaaaccaaaatgtatctcacaatgggtttgctcgttgtaattttaggcttccttatatgggacaactggatacactcacaggaattcaatggatgggccacgattagtctgctggtgattattattagcgcctatatacagcttagaaagcaaaaagaaaaatattaatcccattaccatgcatcaaaggaggagcgccatgaaatctcactcaacacgcttttggttacagagggtgctactgctaatgcttgttttactcttcagcggctctcagcaatcattcattgttgccgatgccgccccgccaattaatgttcaggcctctgccaaagctaagcaattactcgcctacctatctaatgtaccggatgatatgctaatttccgggcagcatgattacttagaggcaccggatgaacaaaataacaagctacaacaaatcagcggacaatacgcaggacttcacggctatgagtttggaggattagctaatcagtcccgtacggccctacaagagcaacgtcagcatgttgtgaatagtgctatccaatggagtcaggacggcggaatcgtagctattaccttccatcaggcgctaccgggcacacccaaaacgtggaaaaatgtacaagcaaaaataactcaagctgaatttaatcgttacatcacgccgggtaccccgcaatataaacaactgatcgccgatctggatgaggtggctctgtcccttaagactttacgagacgcggatgtacctgttttatggagaccctatcatgagatgaacggcaactggttttggtgggggaacaagcaaaattacgctaagttgtggaatctaatgtatgatcggttcactcatgtccatcatctggataacctgttgtgggtgtggagtcccaatgccccaaacgcatatagcactccctataatctatccttcccaggtattaaccgggtagatattcttgcagctgatatctataataatgattataaatcctcctattacactgaattgctaaagcttgcgcagggcaagcctatgggaatcggagaaagtgatattctgccgagtgcgaaggtgctgcaaaaccagccagcctgggcctatgccatgacatggggaaaggagctgtctgcaaccaattcacaaacagcaatcagacattttatgaaccaaaataatatcatcacacgagaccttcttcatgagtccctccgctgaaagaaaaaagcttccacttcgctctaagagcaaagtggaagctttttttatactaaatccaaataaagctctctaactatttctgataacctcttctagatcaatatcggcatacgcctcttcaccaagatgtacggatacaatggtgtagatccgcttggacagtctagacatcagccgatcacccggtgctacagaatattcttcccgataatctccaattttgtgaaaaccgctggacatatggatgtacaagttacccctacgtgttctaccatgcaccaacatcaaatctcctcctgctgtgtaaccaacctaatttccctgttacatgtatatcggtcagaacaagataggatataagtccctggtaccctactttcgtttcacaagttagtgcacgtaaacgaaacgggtctgccagtgatgtgacagacccgtttttgtaaacccattttcgtgatttaggaagaaactattcttgataggattctgctattgcattcgctgcaatgattgcattgtacacgtcagcaggactaaccgggaacggcatgttgaccattgtatcattcgatgcacaagcagcttcagccacttggcgccattcagcctcaacaaattcctctacacccaagtcacgaagcgtcaacggaaggcctacatccttcaccagtttaatcacggtttccagttcctctttcggtgcattttccagcactagctgggttaacaaaccgaatgtaactttctcaccatgctgtgctttatggagcgaaggaacagccgtcatgccattatgaatggcgtgtgctgctgccaacccacctgattctgcaccaacaccgctcagataaatggtagcttcaatcgtatcctcaaccgcacgagtatatactttacgatccacagcacgtttggccttcacggcattttccagcaacgtatcataacaaagacgagcaagtcccagtcctgtagtggaaggcttgttcagaaccaggttatctccattggcctgatagcaggcacgagcttcaaaataagtggccagtgcatcaccgattccagctgcaaagaaacgtgcaggcgctgctgccaggatgcctgtatccgccagtacaacgtctggattagtaggcaggaacagatattcatcaaaagagccatcttttttgtatataaccgcaagcgcggtacaaggagcatctgtagaagcaatcgttgggaaaataacaacaggcagcttttcataataagccgttgccttggcggtatccaatgtttttcccccgccaatccctatgataatgttcgaaccatgtttacgcaccaattcgcggttacgatcaatctcttcttttgtacattcatattgaaatttctcgaagaccacctggttaccagctgcttcaatcgaagcacctgcctccttttgggccctttcaagtatgaactcatcacaaatgacaaaggctttatcgccataatccttaatatagtcatttaacgacgagagtagattttgtccagaaataaatttcttgggtgaagtaacggaccttacaacgtttgccatgtaaattcctcctcagctttgactcatactcaaattaataatgatttgggcatgtgaccccttaactataaacctcttttcacgttattaaaaggcttattatggaatattttatgaacaaattgtgtatctattatatttgaacagtcgagctccattcagaatacaggatacccatcatgatacgatcataactgttaccatcacgaagaacagcggaacgaactctaccctcaagctggaaccccgccttctcataagttcggatcgcttgtgtattgtactcaatcacatccaagccgacccgattcaaattgagctcataaaacgcataacgaagaatgagccgtaccgcttctgccccaaagcccttgccgcggtagtccgtattacctatacctattgccagctgtccgctgcgattattccactcaatcccgtggatagcaacaaatccgatcaagacatcatctgccaatgttcttaatcgaaaatagacctcgttagagcggggagatccttctgactccatctgtttcaacgtgtaggggagcgccaaatccgtatctacatttcgcagatacttcgcatcctcaccccatttgaacatcacttcggcatcttcttccctgactgcggccaattttattcgttccccataaaacaaattttcgattttaatgactcttcagctcctattatgaattgtgtgccatgttttccgtcataattgtcatgctatccgatgtccgcaatataagctctcccttttaattcaatgtttaaattttacaaaataatcaaacatagcacaaccaaatcattacaattgtcattgtgtgacacacaaaaaagaccttacagctgcaaggtcttcgcataactaatatttaaacaacatagcaaccagctggtatccagctccaatcgtccagaacagcacataatcaccgcgccggatacgatccgattcaataccttcatatagcgcaatgaacgggctactggtacctgtgtaaccatatcgatcacccacataaatcatttgggcatcctctagctccaagtgatcctgaatcttcaatacatttgctaacgagaactgagacagacaataagcccgtacatcctgaggcgtcaacccattcttttttaaaatgcgttcaagcagatcaaatgtaggaggtaaggccatattggcgtcgaacggaagccactgaatatattttccgggggcgttcctttggagtgttgccgctaacccctgagccgggtacaaaattttatctatattgactgggtccgtaaaatacattgaatctataaaaccggtgtcttcttctgtacgctccaaaatagccgcacatgcagcatctccatagttcgcataagtaatctcatcctccggaccggaaatgagtgaattataatctgaaccgataataagcgctgtccgcacgtcaggattagatagcatcgaccgactggcttgatcgacagcgactgtcatccctgcacaattcgcgttggaatccatcacggccacatcatgtctcgccccaatcgcctggtgaacaaacaaagcattcatcggaaacagtgactcaggaacttgagtggagaacacgatcatatctacatcacggcctgtcataccggcttgttccagagctttttgcgcagctgcaattcccattgttaggccgttttcgttcggatcatcaatgatataacgctgttttctacccatatgctccatgaagcgtcgaatatctttgccccgctcgtcaaaatggcgaacatagtattcgttatccaaggaatggggcggatggtacacacccagtgcttttattttgatatggctcatcaggtctcccccttacacatacgtcagcgcattattgtacgacaatatctacgctgtttaatcctgcttcacgtgctactcgaccaagctgcattttaataatggtttgttgaagactgatgccaaagattactttggcaaatccagtttctttgtaacgtacaaatgagcccttcaatttttccacttctcccggacccaaaagtgccatctgggtacaatctaccttgagtgtaaagctggacgcctgaatggatgaagttttggctacataatcttttacaaagctatcatactcctcctggctaaaaactccattcaccgccatatgtaccgttttcatggcttgatcgacttcgatagtgtaaggatgttgactcatttagaaagactcctttgatttcatttttttgtctattaagagtatcggaataataggtagaatttttaatattaaatcagataaatcaccactaaaatattacaaatttgtgaatataaaaaaccgccactgctcctagaagaagcaactgacggctggaaatttgcgtatttctcatgtgcaattaattcgtaaacgtatggcgaccgagtgagatgacagccgggcgacttttactccatttggctgtggcaatggccgggttgtaataaaacaaggacccattggttggatcagcaccattaagtgcctgtctggctgcacggtacgccgtcttgttcggtttcaggcggtattgaccatcctgtacagcggtgaattggccaggctgcaaaataacgtccgggatcgagcttggaaactcgccggactgcacacggtttaatacgacagcgccaacagccacttgaccttcaaacgattctccgcgcgcctcagaataaatgatacgagccagttgatccagtgcggttacgcgtacctttccgaaggatttcagcttggcttgtgttgccgctccggctactccatcaggtgtcagaccgttatctcgttgaaaacgagccaccgctctactggtcagagaaccatagtatccagtaaacccagccttgaaataaccgagcgaatgaagctgctgttgaagctccagcacccgttcgctttgaacccctttcttcaaagctgacgtttgtgcttgtgcttgtcctggtgcgactgacaatacagtacctaacatacatgcgcaggacaggattaaaatagataactttttcatattccagacaacctcctctttcatgttctgtccggtgcaaccattccggcctatacaactcagggacgtttatccgatgatgtttcttatgacataacttatgcctagctgcagaaatgacgcgtggctacatacggaatgggacaatcctgctttcacacgtccgttgcagtataccacaagccgcatttacgtatcatccggctctggtcctaagactacccaagctaataaaacgccatccctaaagggatgacgtgtattaaaagcaatggatcatgttctgaccacacttgaatacgtgacttttttcgctatttttcgcttcaacttgcctgggatcggagcctgatttctactaattcaaatcacatttgtgcgcacacatatatgggcgtttgcatagggtagcgtacgatcatcaaatcttgaataacagaaaggctggaaacgacgcgtgaattcatatatggattacacctctcctactgtacaattcacctatgatttaagcgacaatgttttgtttcagaaggatgctcaaaattcgatcaacgagctgtcgatccagcagctgaatacattggcaaatgtatcgctgctggatattcgcctcagcactgctaatgttgtggagcctcactatcaccaaaatgccacagaactggtctactgcatctctggagcagtaaccgtgtcactgattaacccctttacccgtgagttacgacattttccgatcacacctggccaagtggctaatgtccctcaaggatggtggcattatctggtcgccacgatggataacactcatttgttgacgatgtttgatgccccgacccctgaattcatactgggatctgacattttgcgcctaacgccaaataacattctggctcatacttactgcctggatgagaataaggttcaggaagcgctcgcccctattaaaaaacctgtcatcatcggtcctcccaatgactgcaagcagcagcccccccgaaaaccagggatacatgtaaggcttgctgatgcttcatcacaccctcaggtcgtcccccaaagagattacgcctatactaatggatatcccggcttctcttttaatccctatcaagaataggctaactctagtcaggtcttaagttggagggaataccttttccctgtatgttcgccgttaccataagaccgtccctctcataaaatgccaatgtataagagggggtgatggaatggacgcttactacaactgtttgaactgcatgaataaaaaggtgcgtattctcaccattgacggaaaacagtacgaaggaaccattatggatgtggatcgtaataatgtgtacttaaaaacagaacggaacggacgtgtacaaacgtctgccttttatcctggctacgggtatgggaatcaaatcttaactttgagcctgttcaccctgctggcgattgcgttaatttaatcctgatccattgtccgttcctgcctatagatgccaatgtaactcaaatgacagctgcccagcccggcacagtttgtgtagggcttgtacgctgttatttgaggtgttttacatacgttccatcctctaatacacttaaccccccatcggttatataccaatggggggttaagctactcagttcattttaaacccataaagacttcgtaatgataacgagcagaatgaacagtaccagaatagctcctgtcgatgtccatactcctgggtagccccctactgaaccgccaccacaacctctttcacattcactcatggtcattgcctccttcaattcaaggtacaacatagcttatgtattgagctttcctacggaccgggcttttcggcaatgttatgaatgtttttgctgatgggcattagcctacacctttcctaggcaggagcataggataacacaactaatcttgaaggagtgaagcaattgaattcaaatcaaatgctcaattacaacgttaatcaacctttcccccaccatcctacctctcaccacgtcgtggtgcaccctgtagatccgtacgtcgtagaaacattaaaatcggtgatcggcaagtacgttgtacttgagaccacacgtggcagaattgatggatgtgtagtggattgtaagcctgatcatgtcattttagatgtatacggaaaaaaattctttgttcgaatcagcgaaatcgtatggatcatgcccaactaaacaaattagacattaaaaatcctcgcagatcctattccggattcgcgaggattgattataacgttgattatgctaatcaagctctcctgccagtgaagcccggagttcatctatcgttccgttgtattcatccaaatcgacttggccttgaatacccggaacactgcctgtgctactgtactgccaagcccaccagctattccaagctgggactgcggtcggcttttgcgtagtgctgtatcgggctacccacagcttatacatagaaaatgtaggatcaaacttggaagcaaagacattgcccgtgtatacgatcggctgacgcccggtaagcctctccatttcatccaaaaaagcatgcgccacttcactaatttgtgcaggagtaagacctttggggttattttcatagtccatcacaggggggagatccagcctgcctcctgctgaatctatagccctggcaaaattagctgcttcctgacgagctccatccgcagtagtagcgttcaaaaagtggtaagcgccaaccaggatgttagcatctctggcaccctgcacatttactaaaaattgattatcttgatattttgtgccctccgtagctttaataaaagcaaatgtcttgcctgccgccgccacttgctgccaatcaatattgccattatagtgtgagacgtcaatcccttgcgcgtgtccgtcggaagaaatcgcaggtacaactggtatggtagaaataacagtcacggtagttgatggctcctccgtttcctgatccaacgctataacaaccttatcatcacctgcattgagtacatgaaagggtgtgctgttattaagatcaaccacaatacgtaccgaggcgggggttgcactaaacatagagtatcttacttgggaaacatctggatcatctgtgattggcaaagttccttgtccaccattgttaaatgattgcgatgctaagaaatcctcagcaaacttcgaatcaggtatatctacaacaatacggtctggatgagtcagcgtggttactttggggcttacttttccattcaccgttatcgtcaattggtgattagtgaagctaatttggtttatagccgtacgcgcactctctgtagcatcacttacagctcgagtagcagaatgatcatggacggtttcgctattcccgcttgaagtagggggagtcgtcaagaacaccgttttaagctcgttgttccaggtcacattcattcctgtctgttcggatacaaagcgaagcggaacataagtcgtccccccgttaagcaaaggagctacagccaatcccatgggttgatcattgactgaggcaatggggttgttgacctgaaggctgagcttaagattttgcttatgtatagttatggtccctgtcttggactcccaatttacgctataacccaattcctctacaatgagacggagtggaaccagcacattgccctttacttcctgaatctgaacccccttgccaacacttatatctttaccgtccaactgaagatgtgaatttgaagacgcagcgtgactttctcctggaaatgctagtagaaacagaaacaaaaaagcaaataaacaaattttcttcattatgtaccctaccaatctctaaattttctcttatgaaaatcttgcactctatgattcttaggaccctccattttgatagacgcgaatcatatataaaaagttacgattcattcagcatatatttcagtcttatcatacaaaagcactaaaaaactctgccagctatacagcaagcagagctctttccagttttattaatctagtttactagcaatctcatcacaatcagatacttcctattcacactgttaaaaatgttaagcctacaagaataattgaagtaacagacagtaccagtaagggaagcattgctttctctcgcaaagccttaaagctcacattcagccccatgcctaccatagccatcgttaacataaaagtggtaacttgggaaagtccgttcaacagactagatggtactacaatatattttccaaaaacatagctgcccaaaatacttgtagccaaaaagccgatgaggaaccaggggaactccactttagcgtctgtatgaatttttccggttcgtttcatccaatacatcaaaataaaactaagcggtatgagtaagaagacacgccccagtttggctaataagcccattgcaagagcatcctgtccggcaggcgctgcagctaaggccacatgtgcaatttcatgtaaactgatgcccgaccagattccatattgcatatccgtcaaaggaagccagggccgaagcacagtaaacaaaatggcaaataccgttccaaccaaggcaatgagtcctactcctatggctgtatcctcatctttggagtttaacaagggagaaaccgctgcaatcgctgctgcaccgcaaactccagtcccaataccaagaagaagcgaaagcgaagcatctgccttgaaacgttttgccagccaaaccgtaaaaaagatggaaaatacaacggtgcccacatcacgcaaaagtaaacccaacccatgatgaatgacaacatccatgttcagcttcagcccaaataacacaatcgctccacgtagtattttctttgctgaaaactcaacccccgggcgcacagcttcagggtatccccacaactgtcggtacagaatagcgagaaacatggcacaagccaatggacctacataatgaaaacctggcacttcgttcaggctgtagcctgccaaagcaaataacatcgtgaggataataccaagtatacgctggaataatcgtcctctgttcgaaaataatttggtgtgttgtgtatgactgttcatggtgaacccctccaattctacatgcatccagcttaatatgttttttgtcataagaaaaataaatcattataataatgataataagtaaatagatatgatgaatttggaggaatgggctttggaccaatctttaatcgtatttgttagggtcgcggagaaacaaaacttcacacgagctgccgaggtgttacacatgacccaacctgcggtaagtcaatatattcaaacgctggaacgtagcgtagggacccgcctcctggagcgtagtaataaatatgtgcgcttaaccaaagcaggtgaaattgtgtatcatcatgcacaggagattatccgtctccatacacggatgcaatatttggtggacgagctgatgcatacagcaaaaggaaacctgtcgatcggcgcaagctacacgtatggcgaatatgtactgccgcatgtgatcgcgaaaatgagaatccagtatccactcattcagccctccattaccatcggtaacacccaggaaattgaaaaactcatgatccataatcaactggatgtaggcattatcgaaggagaatttcagcatgaccatttacacattgaatcatttgctgatgatcgaatgtatatcgtcgttccgcaaaatcatcgtttggcgggtaaatctcaagtggatgtaagtgagctgcaagaggacatctggattctgagggaagaaggttctggaacccgggaagcggctgaaaagatgtttgcacggcttcggttctccccttctcatatgatgaattttggcagtacacagatcatcaaagagtctgtagaagcaggcttggggatttctttgctgtcccaatgggtcattcagaaggaacttgctctgggcacattaaaagtactggatattcataatcttccggtcattcgaaaattctccttcctaactccttcttcgacatttgaaacgaaagcaagcaccgcttttttggagattttgcgaagttataaagtgaaaaagtaaagtgcagaaaccacgaaaaaaagcacccattaaggtgctttcaacataatcattatcatgttttttatgaggaaagatgatccttaccctgatataagaaatgagaaaaatcagcgtagcttccttggaattgttgcatatcatgagcagcaatacctacaaaattccctgtaaaaccaccggataaaaagctgatatcctgcatttcaaaaagccgcttccacgcaggtttgtctccgactccataataaaattgcccgtgggatgcatggacttccacagctaaatgtataggaagatcgtcctgaagcgtaatcgcttggggaactaaggtaaatgtgttggcttcacatcgcattatgcgcagtaccttcccttgtccctcctcatagctaatataggcgtacaaataatcttcttcattaaggtacagtagaagccccgccatttgcaaatagcttgttggctgatactccaatgctgtttccacccggaaatgatgatccgtttgccgaatggcaagcacatgatgctggaacagactttgaatggattctccagctagaatccgaagataaccggggcgctggcttaatgaacaccagctatcatccgccaggatacgcaatgtgttccacgttttatctaatgtgggtccctcgaaaaaatcctcgaaaatataactctgctgctcttgattaaccgagaacttcccttgaggtgcgggcacttccaattgaggtgtatggcccccagcggttaatcgcagccagccttcatcattccagtacacttgctgcaaggctgtttcccgtcctaaaatggcatatttcccctctactggacgtgtgcataaatgagccatgtaccattcgccgtccggtgtttgtacaagactgccatgtcctgcgcattgtaacgggaaatccagtcgatcacgtgacgtaagcatggggttgtgcgggtctacttcatatggcccggatatctgcttcgaccgtgctacggtaacggcatgccccgtacccgttccgccttccgctgtaacaagatagtaataaccgttttgcttgtagatgtgaggcgcttctgttttcttcaaaggagtacaatcaaagattttaacaggctcgccaatgagttgttgttgcttgctgtcatactcctgcatgacgatgccggaagatttattactttccaacatgcggtaatcccacaatgcgttcaacagccatttgcgtccgtcctcatcgtgaaataaagacggatcaaatccgctactgttaagatagacgggttccgaccaaggcccttggatcgtaggcgccgtcatcacaaaattatgaacatccttgaacggacgtttggtgcttttcacatccgtatagagcagataaaaaaggtcatccgcatagctaagctgcggtgcccaaatgctgcaatttttcgggtttcctcttaaatcaacctgatcggtcaaaatatctgtgcaatgctcccagttggccaaatctttggactggtacacccgtactccaggcaaccactcaaacgatgacaccacaatatagtaagtatccccgactcgtgtaatacacggatcgggattaaagccttttaatatgggattttggatcatcatgagacctcacttctccttacttccaaaatgtgacttcatcaaaaacctgttccttgctccatacttctgttcccgtttcaaaacaatccgcccacggaacacgctgcttacgtaacgtagcaatttcatcgggtccgttatattcctgataacagaccgttttctcgttcgcgacattgttccaattgtcccagccacgtgggtcaatatgatcgcccattttacaatcgacaaatacggtcttggcatactcccgccacggacgccccaaaaaaaccggggtaatatcagcttctgcggttaagtagcaatggttgaatacataaccatacgcttgtccttgcggcgtagaggcagctgtgacgtagctcgtttggttgtcatgatggcgtaaactgcgaatctcgcaatcttcaaaatacgcggtagccccaccaaaaataaagtccaccgtcccctctatataacaatgctggtagagctgccgatagtgcctatgatgctccttcaaatggattccaccaaactggagtcgttctttcggtgcaggaggtagagggcctgtaaataaagtatcctggtgccctttaaaggtacagtttctaaagaccgtttcatcacaatgagcgtataccgcaacggcctgcccaatggcttctccctgtcctgccgtgttggaaatcgtgagattttccaagatcagatggctaccacctaaaaataaagtaggtgtggcaaaggtccctatttcctcacccgcttcatcctgctccttggcataccgatccattcgaatctctacctgtccgatgcctataatatgaagatatgaacggtaaattcgcaccttttcctcataagtacctgataaaatagttagcgtttccatttcgttggaatccgactgctccaatacagcaatcgcctcctgaatcgtatggaaatcgcaaaaggattcttttccaactagcatggttaccccgatcctttcatttgatttacaggtgttcagctaaaaataactgccacgccgttcgcatttccaacgtctccatatgtccaccgcccgcaatcacaggctgccaatgctcagggtgacctgcttcctggtaagcttccagcagaccttttgccaaatgctcgactccctcaataggacacatccgatcattttgacctgttatactcatccgtggacgaggtacgatccgcttttgaatatccaaggtggtaaaatgcttcaacaagccagggacataggaatagaaaccatgatgatccaacccccttttggcgattagcgtatgggcatctacctgtccacaaatatcaaccgtcacctgtatccgttcatctaacgcagccatccaccatgccatgagtccgcccatcgacataccgattgttgcgatacgggaagcatcgatatcttcacgctggcacatataatccaccaagcgacggttatcatacagcatcatgccccacagcacttggccctgccagagcatttcctttaccagctcgctctcagttttgcccccacgttcattgaaaccccacatgtcaatgcagcatacacagtaccccatgtctgtcagggtagtagcaaacgagggctgctgcaagtaagggctactatggatcagttccttgcgcccgttcgtataattgcctccatgcgaatggttaaaaacgaccaatgggaacggaccgttcccttgtaagggtgtagctacataagcgggtacagactcgatcccgttcaagtcgagcaggagacactccagtcggtatccctcgcgctcttcttgattcagcagagttgccgttacagggcgatctgccggaaggtcgcccaacaatgcttgcaacttatccacgttgtacctcctttcatgccctcctaattcatcttatttcgttcagaaggttgtatcgttacttgttctatcagcttttcgggctgagctgtattcttcgaatgacaacgattgatttcaacgtcttctccattttcaatgtaaaaggcaggaccttcatgattctcaatcgtcacatgttgaaaacgaatatccttcacattacctagataaaaaccacggttgttcatatcttcaatccctgtcatcatcgccggacgaccgggaattgcatttttagccatagaaatatcaatattggaaaatgtaatttcagcaatatattgctctgcaagtccgtataagaatccagcagccgcatgaacctgtcgtgccgtaatatcggaaaaatggattcgtctaaagcatggggtttcattggtaatcggatagggatttttatcccacacatatttgtctttgccccgagggccgcagaaataataaaggttcagaataaatggacaaattacatcttccatcacaatgttgctgacgcgaatatcctcgatggttccgccacgtcctcgtctggatttcagacgtataccccgatccgtttgcttgaacacgcaattactgatcgtaacattacgaatatcaccactcatttcgcttcccagtacgactgcgccatgtccatgtaccatcgtacagttggtaatcgtaatattttcacatggaattcgctcttgtgtatcttcggttcctgctttgatggcaatacaatcatcgcccacatctatattgcagttgctaatacgaacattggaacaggattcaggattaatgccatccgtattgggggagtccgcagggttaagaatggacaaattatcaatcgtaacgttatagcaagcgatggggtttacagtccaactgggggaattttttaacataacatctttaatggtaacccgctgacaacggtcaaagctgattaatttgggtctcggatactgtaactcctctggatgattccggtgcttttcccaccacggttgaccatttccgtccagcgttccgctacctgtaactgaaatattctcaagattctgtccataaatgcatgacgcatgtacttcccgctgaacgccttcccatctggattctactacagggtaatcagccagttccgtactgaaggacagagttgcgccagggcttacatgcagctcaatgttactttttagaaagacagctcctgtcagatacgtcccagacggaacataaacggttcctcctccagcattgctggccgcttcaatggcagccgcaatcgcttccgtagccaacgtcgtaccatcctgaactgctccataatctacaatgttatataattgcatttcgttctctcctgtctttatattttgtgaatgttagatccattttgtattgggaaagcataagctgcccccgggtttcaacatccaagaaatcattcaaggagtctgggggcaacagccatactcagctattattttttcgtttttttatacgcttcctcatactcagcagtaatccgtgatccaccggagtttttccagttttctacggctgctttaaatccggcttcgtcaagctcgcccataataaatttgaaggaggcgtcggtaatgattttctccagctctgttccttgctcattagcggtgactgaatccagtggcacggtcgggtccagaacagcaaattcattattttcacggactaattcattagccagttccttttctggattggcatcttttaagttataggtcacttcacttggtctggagcttgaaaacggctgaacatctgcttgccacaaatctgtattcgtaattttgaaggctccatctttttcgattttataatgagtgccttcaataccaccggtcatatacatatatacatctttgtcaattaaatcatctacaaattgcagcagtctcttcaactcagcttctgtttttacttcggattttggaaatgccagcaaacctcctaccccgcttccttcagaccatacatggtatttgccatctccattcgaaatcttgttaaccggtaccagcttcagtcccttttgtaggccttgagacaaggttctgaggttagagatatcgatcatgcctgtataaatacctgctttaccttgtgcaaattgttgctgctgatccgttttagcggttactgcaaagtctttagagagatatccatttttgtataatttattggaatactttaaggtctccaaatattgaggagtatcaaattctggcgtaaactttccgctttcatctactttccagccattaggtgtgccaaagtaggaacttaaagttttgaagctgctgtagcgtagatctgatctgtcaacaaacccagtcgtatcattttttccatttccatccggatcatcttctgtaaacgctctcgcaacttcatacaactcatccagtgtcgtcggcaccttcagtcctaagcgatccagccaatcctgacgaatgactagacccgcccgagccagattcttctggaacggaacgccatacagtaccccttcaatggatgcggcttcccgaacttcaggcgggatcttcttcaaattttcataatcatccaaatactttcctacatcccagaatagccctgatttcaaagagcttcgtactgaagaatttgtcatcatcgtcagcgtcaccatatcggccaattcgccggatgcaagcgcggtagtgattctctcttctttggaagcgtcaggcacccaattgaacgtgattttagaattggtgtattcttcaattttgcttttgatcgtttctgtaggcggagaagcggtatgcaatacgtttaaccaggtaaattccagtttggacttcggatcataggtttggccgctttgatcctcagctcccttgtcaccgcaagcagctaaaaaaacactcatgaccattagtacagcaagaaggcccgatactccctttttcgtcgtgattccctttttcatcgtgtttgctcctcttctgtttatatatttatgccatatcttcctctttcaccagaacctctcgctctattttgctgaacacctgatgcgtcatccacatcacgagataacccataatacttgctccggcaaaagttagaattcctggatacaagcctagaatcaatgcaaaaagcacgacaatggctacaaaaagaacaagcgtatattgtaaatacgaaaatccaatcactatcgacattttgaccttcagtctgatacctttccaatcatagtgagccagtaacgggaaaatgtaggccaaagagatgaggtacaaaaaggctccaataagcgtcaccacacgaacataccaggacgagacattgactatatccacgtagagtacgtaacccacaaggctgtaaagcccgccaatgattgctgcttctttaaagctttctctaaagtaacgtacaaacgtcgagaaaatggcgacttcctcattgccccgaatccactgccttaaaatactaagcatagcgacggttgcaggcccaacacctataaaacccaagcccagaatcgtcgcaatcgtccaaagtaagttaaggtagaccagacgcaacaagcgcatgcaccatttgttcatgttttctacaaaccgtaccattatgcatccttcccgtcgtcattagtaaacgccgtcttcaccaaatttcttggccagtcgattggagcccataatcaggattaaacctaccacacctttaaaaagtcctaccgtcgtactgaaacttaattgtccattctttaaacccgcagtataaatgtaggtgtcaaagatttcggcaacctcgcgatttaatgagttcaataacagatacatatgctcaaagcccaaatccaacgtgctaccgattttcaaaattaacaatgtaataatgaccgggcgaatcgcaggcaaggtaacgtgccatgtctttctcaggcgtccagctccgtccatctctgctgcctcatacaattgcgtatctaccactgtaatcgcagataaataaatgatggtagaccagccgagttccttccaaatcacttgcccgatgtagacggttcgcagccattggggagaagttaagaagctgatcttctcaccgcctagcgcggcaatcatttcattcagcaccccaccatctacggttaggaatacataagaaatcgaaacaatgataacccatgacataaagtgcgggatgtagataatggtttgaataatgtttttaaaaaacatcttcctaacctcgttcagcatgagtgccaaaatgatgggcaatggaaaaaagattacaatgttcaatgcgaacaaaaccagcgtattgcgaagcagcataaaaaacgtaggctcggtaaacaaacgaataaaatgcttcattcctacccatggactgcccgtgattccctgaaaagcttgataatcctgaaatgcaatcaccaatccccccataggaaaatacttaaaaataatgaagtacaccagtccgggtaaaaccattaaatagagcaacttgtgtttctgcattcgtaaaaggctttccgtcgttcttttgttctttttcattttcatgtttggtgcggggacacttgaaactttcattagttcgacctccttcaaacgttcctgtatacgttttcaagagtatgcgattttcggcattccgcatataatcatcaaatgatagcgtttacaaaactgggtgtgcagcctacttttcaaccttatcaccttagctaatgattactacacaacctaatgagcatccgcttatttccatgattagagaacacctcaagatttgattatatacggaattctttcctcttgataaagttgacatgtaaacgattacgaggaggtcaaccacattgacacagccattacgaaaacaaaaattacgaaaaaaagaatcgctgggcagccgtattttcaacattgtaaacagtacactattgattctcattgccctcacttgtctcttaccttttttgaatatcatcgccagctcttttgcctcaaccgaagaggtgatagccaagaagttcattttattcccagttactttttccttggatgcctaccgctatattctgtcgactcccaccatttttagaggtctcggggtttcggtcggagtaacgatcgtcggtacagttgtaagtatgatatttactgcttttatggcttatggattatcccgaagatatctacttggccgcaatacgattaacttcattgtcgtgttttctatgttgtttagtggggggatgattccgacattcctggttgtaaaaagcatggggcttatcaactcgtattggtccttgattcttcccgtggccattaatgcgtttaacctgattatcatgcgtaacttttttcaggcgctgccagatgatctggaggaatcagccaagatggacgggtgcaacgattttggtatcttctttaaaattatgttgccattagccctgccttctattgcaaccatctctctattctacgctgttgcctactggaatacgtatatgcacgccattctctatatcaatgattctgccaaatggccgattcaagtcttgctacgacaaattgtaatcgtttccagtggtatgcaggcagaaggaactgctgtagatgtcatcccgcctgcgcagacgattaagatggcggtcattgtcattgcgaccgttccgatgttaatcgtgtatccatttgtgcaaaagcactttgtcaaaggagctttgttaggcgcggttaaaggctaattggcttgcttcatctttcggtaagctcccggtgtaacctgttcctttttccgaaaagagcggataaagttttgtgaattatgatattgcagtcgctcggcgatttctttaatcgtcatatctgtctcaacgagccactttttgcccatttgtaaacggtagcccattagatattcactaaacgtcgttccgtattcttttttgaaaatactgcttaaataattcggattgtaatggagtcggtctccaatgagttctaatgataattcctggtcatattcagcacggataatagcagcaattttctccgagagacagcggaattgctggttggtcttctccttcatgcttttaaccatggggaaaataacttgctctattagcatacgttctatctcttccgggttacggatgtccagcaaacgatgatacaaggcatgattgtcttgcgtcagcagcacttcaatccctaatagctgctccaattggatgaggttattcacaaaccgtaccaacagcacttcaaagttcatggaatgattattttttatcatcatttcctctaataaagagtgcacggtatgatatacctgctcttcgtcccctattcggatggcatcaaacagttttgattccaattccgtaggataatgaagcagcaccggacctgaaatgaccatggaaatatcttcataaaaaataatcgactctttgcctaaatttaaacggtgatgcaaagcttgcttgctcatctcacaggcttctttactttctaataagttatcatacaccgtactaatgccgatgctgatggatacattcaaatactcttttacgtttcgaactaaaagggtcgcatcatctaggacttgctttctcatttcctgttcgctcttacctgtcaaaattaatatggtggcctgagtgttatcgttcaagatgatgggaagcattcgctgctgctctggaatcgtttcttctacgattttgttaatagccagcagcaaaacgtctttatccgagggatctcgatctcccagattatccagttggactaacaaggtaatatacatttgattcttgatctgtggataacccaagcgtggcatttttcgtgccaattcctctgcagaaatacgttttcggaacaggttgagaatcaattgggtttccaactgtggcatttcggactgaatgagactttccaagctttccttctcggttacaatgttgtcgatggaattaataatccattcaatttcatttttagaaggttcatttttgaaagcgaaattaggatttataggcaagcttcgttttatttgctgaaatggctttgtaaagtaaatggcaatgaagtacgccactaccaccattaagagcgttaatacaagtcccatcatgatgatcccaaatttggtcgtttgaaaggcatccgcaatttctttcttatccaataccgttaagtaagtccaattgttataggcagatttggcgtaaatgacttgtcgtgcaggctgctgatccgttttctccaaagttaacatacctgtgttgttcggcttcactgtagcttctgaaatgtgctgaagctgctgagtggacaataattgttcagcaggctgggtttcatacattaaatcgccttgtttattcaaaataaaaacagccatatgatcctcggtttgaatcgtatgatttaacgtttgcagcgaaatatccgacaaagcaatggcttgcttcttcttagagaatacaggcaaggtattcacaaaacgaattcctttatctgttttaacccagaatagccccttctcttggtggtcgatataggtactaatcagcttttctcgttccgttttcgtcaaataggacaggctaccattggagattctccaattctgatccagactgattagtgaatattccgttccttctaatcccatcgtagcaatataattgagctgagtattcacattccgatacgctataaaatctttttctgtaatgggatttttcacaacatcattaaaggaactggtcgtgctatacgtattaaaagcatattcaatcgtttggattttctgctccaggctatttctgatctgtgccatgtagctttgcttggtattggaaactctctccacaacggagctaattgttgtaaaatagatgtagctgccaaaactggccaccaatcctactcccaaaaccagaatcgtaataaaaatagtgtagaacattcttccttttttcattgcgctccccctctggctctttgcatcacaacaaaattatagcgctttcataacaaggtttaaatcatttttttcacgtgtgcattattttttacatccgtatcattccaatttaagtcgattttgtttggtttgcggcagttaaaaagaattttggaggcgttacttatgttacatgttgttagtcctaaagaaccgattataaaagaacaatttccgtcaaacacttcttttctctccctatatcccgtagcagttcgtcaagctcgtccttttatattggtactacctggcggtggctacgagcatttggcctcacatgaaggagagcctatagctcggtggttgaatgatctaggtattcatgcgggtgtgctggagtatcaagtcggcgatttcgagattacttctttgttggaggatgtagaacatgctctgcaatggattcgccaaacaccgcatgactggctagtcattcctgatcaagtggggctcatcggtttttctgcaggcggtcacttggcctccattgtctccactatagggacagtaaagccagatcttctgttgttgggataccctgtaatttcatttcatgagccttatacacatatcggaagccgtacacattttttaggggaacagccgacgccggagcagctgcaagccttttcatccgatcagcaagtaacttcacagacacctccaactttgatgtggactacagctaatgatggcgctgtaccagtagaaaatagtctgttgttcgctttttcattatccagagaacatattccgtttgaactgcatgtatttgaggaaggaagacacggcttgggattgtcagagggcaaccatgaatgccatcaatggcttaatctggcggaaacttggcttcaaaaacatggatatgctcaggcaaggcaacagatgacaactcggctgtttatcgctggggactccactgcagctcaaaaaggggctaccgaaaaaccgatgacaggctggggcgaacacttgcaaagctacttggcaccgtctgttcatgtggacaatcgtgctgtcaatggacgaagcaccaaatcttttatagcagaaggccggttagctgatattgaaaaagatattcaagctggagattatctgtttattcaatttggacacaacgatgagaaacaagaagaccccactcgctataccgatcctgatggagagtatcgtcaaaacttaattcaatacattcagtccgctcgggagcgtggtggaattccagtgctattgacctctgtaagccgccgccgattcaccgcagacggtgaacctgatccgttggctgtaggagcctatcctgctgccatgagaaaagtagccgcggaaaccaagacacccctgctcgatatttttgaagcttctcagcaactttatcgttcaatgggtgaaaaagagtcacagcagctatttatgcatttgcctgaaaaagcgcatcctaattaccccgctggtgtaacagataatacccatttttctgacgaaggagccaaacaggtcgcccagcttgtagcggaagccattcgacagtgtacggaactgtctgcattaaaacagcgtatcgtagaaaggaatctagacagcgatgagaggcttgcacatcaacttgtcaactgatatcaagaactaaatagatacaaacacaaaacggacttggagctaatcactctgacgtccgttttttattccgtgtggatcaaagactatacagctaggagaatagttcaaaagtacagtaacttaaaataaaattatttaattgttatattttaattattttgtatttaataggactttagaatcgttttattgtattattttgacaacatttgtcgaatgaagtgagacccataactttacatggtatattttaggagctcgtatcctacataaggaggatttttttatgaaaactaagaaaatattattatcaacagctatgtctctgggacttattgggagtattatcgtccctagcgcgtccgcatctgtaggcccttctccggtaattacgcctgtcgtagaagttaacggagtatactacagaacggctacgttgccacgtaattattcctatgcgttgtcaaattacccaggggatacttataaagtggcgagcggaaatgtcaccgtctccgcttccggggtggtaaccaccactactgcaacgaatgcaagagttgagatttacggcggtaacggtaaattgagaatggtatacactgttaaggtatcttaagataaaaacggtaaaaatagcactgtccgtttattggggcagtgctatttttatggacgggctgatgtcaacccattctcatagctattcaatgtcctgttctttgaactctaaagatcatgtttaaaccgaatccaattaaaacgaagcccgtagctttatcaataacattttgtactctcggagacattaaccatttccttacataactcaacaataatacgattgtggcaaaccaaacaatggaaacagctgcataaaaggaccccataagtaaaaattgtagacttggattgtagtccggcataataaattgcggtaaaaacgtaagaaaaaatatagctactttaggatttaaggtgttagatataagtccttgcataaagggtgacttcttcgagtgtactgtctgatcataattctctgttggtttacgtcgtttgatgaaagataataggcccatataaatcaaataaatagccccgatgtacttaacgatttcaaatgcgaatgctgatttcattaagagcaaggaaagtcccaatgcagcagcagccgtatgaataagaacaccagtagttatacctagtgcaattttgataccatcctttttaccatcagtgagtgttcgctttgtgattaatgcaaaatcaatccccggtgacatgactatgaaaataagtaatatcacaaaagctagtatgtcattcatgaatgtgcctccattaatttaaatttcggatacataatattaacgcttcaaccaccatagccatcctcctgcggtatgtaatgaacaatttattattatgataaaattgagatttaagttgagattaaaattattagttttagatgtagctactcgatgatcaacactttcaccaagccatattcaccagtgatctttttattttcagatccttcatagctggcagctaagtaaaatttgcaccaaaaacctgtctgatacatatggatgaatgaactaattttttaaaggggaatgattttgtatgtatggtattggctataattctggtcctgtatttagacaaagaatttcactacagcaagcacaagaaatagcccttagaaatgtgcctgggcaagttgttcatgtaggcatggatttagagaatggaattttcatttatgaaattttcattttgacaccacaaaacaaaatattcgaggttgaggtagttgccaaaacaggacggataataaagattgaagaagaaggtgattttgattgataccttcggattgcaacaaccttcttccaattcatatttgagtcagaggagatggagtgaagaaaaatatcgtggatgaagattcgtgtggtgtggcaacgtgggattcgaaatttagagagacgttacgacgatattctaacacttgatcaaatccaacaatttcgtcgaacagataatttctcgcaagggtacaggactttaatatgctagcaaagaagcagtcggttggataacttccttccgattgttttttcgcctatgggtattacacgtagttgttttacatataacttatgattcaactaattgaaaacgattgttcaataaacacgataagacggcagacgataaatgaagtgaccccttaaagtt

SEQ ID NO: 2623 - DNA, 10274 bp, Unknown
  Kingdom: Bacteria, Phylum: Firmicutes, Class: Bacilli, Order: Bacillales, Family: Paenibacillaceae, Genus: Paenibacillus
gagcttcttctcgcatctcaaaacggaagggctctacccatatgatatccgaaatatggacgaggcacaaaggagaataaaagaatatatccaattttacaaccagtgtcgaccacaacgaaagttaaataagctgcctccgaaagagtatcggaagcagcttatagcctagggtcttttttcagtgtctataaaatggggtcttgaccagattcacaggaggttttttgctggaattattcattaagtcgtcccatcataactgtgttgaggtaattaccgtcggacagaattttgaccttttttaatatgcctttgctctcaaaccctagtttttttatactgaattgcactccttaaaattgatattggaaaaaccccatatgggaaaccgacgggactgtccccagttgccattggcagctttttgtttttagcgatataagttcttgtcctcagcttgggacaagaacttatattgtttccgattagatgaatatctaaaaaatccgacataaaaatagattcgcatattgctcgaataattaaaagcagcgaagaccttcttccaacgttacgaaacccgattacccttcaacggcttctataaaattcaaagaaagctaaacataatagagttaaagctttaatttgctaggtttatatgcaaacgctagtattctataatttcactcagaaaggggattaaagtaaaaaaaaattacggaatatggaacgtataggtgatatactgcaaagagaatcaaccaacaagcaagtgtatgggacaaacacaaaattttaggaggtagagtatgtttaattttagtaagaaaatgatgacggtagttcttgcagcttccatgagttttgggttgtttgcaacaacctcaagtgcagcgacagactattggcaaaattggaccgatggcggtgggacagtcaatgctgttaatggatcaggcggtaattacagcgtaacatggaaggataccgggaattttgtcgtcggcaaaggctggactactggatcgccaaacagaacgatcaactacaatgccggtgtctgggcgccgtccggtaatggatatttggctctctacggatggacgagaaactcactcatcgaatattacgtcgttgatagctggggtacttatcgacctaccggaacgtataaaggtacggtgaccagtgatgggggcacatatgacatctacacaacaatgcgatacgacgcaccttccattgaaggcgaaaaaacgacgtttattcagtactggagtgttcgacagtcgaagagaccgaccgggggcaactccacaatcactttcagcaaccacgtgaaagcatgggcgagcaaaggaatgaatctgggaagtaactggtcttaccagatgttggcgacagaggggcttcagagtagcggtagctctaacgtaacggtgtggtaaccactcaactgcaagctgttcaacgaacaggcgcggttgggactgtctcacgggataagcgggttttgagagctgtctgtatagatagggtttaaatgaatcgatcatggaggactcaccgagccctaagtattgtagacaggccgatgaccgttcccctccagtctatccgtcagtgcggatgcgttgaaggccgtttcctgccaggcgaacggccttcgacgctgctggaggcgagttgcaggccatcacggcctactatttttcctatcagcttaaaggatatctatccatgagaaagctattaatatttattttaatagcgacaataagaatgataacgataatataaaatggacagcaacgatcaacgagggagctaacagttaccgattgcctacagaagtaaagtgggaatatgcagcaggcggaggtcaggcgagcaagggctacacatacagcggaagcaataatgacgacgaggtcgcatggtattggaaaaatgccggagacaagtacttatctggagactggaactggcctatcatcgagagcaacaataataaaacaaaatcaataggtacccagaaacccaacgagttaggaatatacgatatgtccggcaacgtcagcaacaacgagatatcattccgaggcaagttcgatgcgaatggctttggtcccgatcaagggtttcgtatagctcgcagagaatagtcgaataaggcactacaaatgaaggttaaactaacgggcagtttaggttaatacagttctaccccaccgagaagacagggtcggggagtgtccttatcctgccttcttgcatgttatatgttttctactgtactaaattatccaaatccggctgcaatttggtccgcagaacatacagcatggtggcaccaacaaggaacgcaacggcatccgaaatgacaagcgaccagaccaccccgtggaatccgttcattcgattagcaatatacaacacaggaatcagagtaactccttgaataactgacataataaacgcggcggttccttgcgctgttgcttgaaagataccggtaaacagcgaggtcattcctgtaatgaacaaggataagaacgtcacatgtagaatgtagctacccatttcaattaattgcgggtcactcgtaaataaaccaattaagtggtcggaaatcagatagacgataacaccgaacacgattgccaacgtcacaatagctttgattgtaaatccaatggtatgcttcatgcgtaatttattcgctgtaaaagagaaggcaatcaacggcacaactccctcgcataagcccatcagaataaactcaggaaattgcaataggcgcgatgaaattccgtaagccgctacggcctgatccccataatcgacaagaaaatggttaaagatgagcgacattgcacccaagaagatactcataacaaagacgggaactccgattttgaatacattgctcagaatatccgtggtagccttaaaccattttacggagacagttaagaattggctcttatatcccatatggaaggcgtagaatgcactcgcaaccaaattagagatgaccgtagcagacgcaacgccgatcacgctccaatggaagacgaagatgactagcgcatcgagaataatattcacgacaacactgagaatcataccgatcatcgacgtgattgctgcaccctcggagcgcacaatattctccagcgtgaagaataatacgacgaatggtgaaccaataagcataatcgtgacatagtccttcgtgaatccgaaggagctagttgttgccccgaggccatgaacgattggatcgatcaacgggagaccgaccgccatcacgataagaccgagaactaaactgctgtaaaaggcgaatgaagacacatgcttcacatcgtcatattttttctctcccagcaaacgagagatgaatgtgccgctacccatgcctatcaagttgcctagcgccataatgatcgcgaataacggcaaggttagtgcgagtgcggttaacatggcagtattgcccagtgtaccaaggaaataggcatttaagatggaatagatgacattcattgacgtacctagcatcatcggtacagcgaagtgagctacggcttttgcgaccggtgctttttcaaagtaatggaggttttctgcatccatgcgagtcactactttctttatttattttgtccttcagtctaacagtgttaggttgtgccttacagtgttagatgatatcatgaacctatgaacctgtaaagcataaacttacactgttagataaaagggcggataccgatgaaaaaaaagcagcctcaaatttcggaggataagattttggaagcctcgtgggagcttcttggagaggagggtatcgagaaattcagtatgagacgattggccgaccggctagggattcaggctccctctttgtactggtacttcaagagcaagcagaatctctatcagcgcttggccaaccaggtatcgaaaatgattctggaggagtttcattccgagggggactggaaggagcagctgacggggcttgcggtaacgatgcggagtgtgctctaccggtacccctgctccacgcaactcatgatgatgacgctgccccacgaaccggacatcatccggttcaccaaccgtatgctactctgcgtggagtcgacgccgcttgagcaagagcagaaaatacaagtggttactacgcttgtgaactatgtctcctacttcgtcctagacgattatcagcatgagcgtaatgtctccgctatcctcaaggaccagggagcgcttccgggtgaggagatgattcaccttctgaattccatgagcgagacagaagtgggactattccggaggatgttcacgaacgggctgttcgagctgatggggaccgacggagcgtttgagttcggattgaagctgattctgttgggggttgagcaggtgataaaggagcaggaaagtagtatgtaaaaaccgcccatccggttattggatgggcggtttcaattaggttacgtttaccctaaattgttagtgaatttataatcttctgtctgtcttttgtcctttgtaaacgtgatttacttgtattaatcatcaagacaggaaatatgtatcttcaactcaattactaagcataaaatcaaaagaagcatttataaagttgatgttattgtcatataaaataatgatagattaactagtattggagtacattacagaaaagagaactttatcaccgatttttttagcacgtaatagcgaagaattcgcttttgatatccgccgctattcaactaaagggcagttattcaaagtgacttcatatcaatgtaagttttacccgctcaaggatttcggtgttttaagtcttgtaagaacttctgatttacgtaaagtagctctccaagccgcaaatcacgcggcattcaatgagatattgttttttttcgatgtggatatctttttttaatatagactgtatgttcagtcatgattaaaatgctaatcaagaaaatattacctcactggggaggggaacaaggtggaacttttttacgaaatcgaagggaatggagtccctatagtcatgattcactcgggaggtgtcgactcaagggtatggagatatatggtgcctgaattggcaaaatcattcaaggtcattaccttcgatggtcgaggaaccggccgctcgcctgctatgcaagagccgacttcacttgtggaggatttgcgcaaacttctcgaacatctcggactggatcttgtcacacttgttggccattccatcggtgggcaagtcgcgactgattttgcgttatcatatccttctatggttgagcggctagtggtgattgccccttcattaacggggtttgcatattcgcaagaatttaccaattatatagcatcggtgaatgcggccgctcccgatatttcaaaacttgtagagttgtctttagccggaccgatctatcgggctacgatggctagcccccaccggagatttctgagtgaaatgcatactcactacatgacaagggtatttaccgagtggaggagctttgatgtcctttggccagagccgccttcgattgaacgtttagagaacattgcagcgagtacgttatttatacaaggaaccatagaatggccggatatgtataatatcgccgagcacttcaagcgtgtacctgagattaggtttgccgaaatcaaaggagctgatcatatgcttgtccttactcatgcggaagaactagcaactagtatccgacagttttgtcacaggaaccatacgtgattagattgggtatctcttgaatcaaagtattataatggggtgataagaagttttcacttctgaaactggattctttgatcgaatcattttaaagaaggaaaacgcaacaccagatgaattggaacgcaaccctcgtctcaaggggatctcaaggaagaagttttgaacctcaaagagcaacccggaagtaacatcttggtgcttggaagcggcgagttagttaggaagctgatgaagcatgatctcgtcgacgagtttcggatcatgatctttccgtttatatgggtgagtggaaagcgtttgtttacagataacatcaagacgatgtctcttaagcatgtctataccaagaccttacattcgggagcagttgaattgacgtaccgtccatcaaaagaagataacgtttttcaccaaggctcagactgataaaaacaaagtctgagcctgccgctgttttatattggagccagtcttataattataatccggagcctgacggtaaactatacccagctaccctgcatcccacagacggttcttgcgagctgttattctgaaaataaagcatccgttgcaaccggctgaaggataggcagtggcttaagggagatggtctggtcgagatgaacaaacgcatcataacgatccgccatgctggaaggcacgtaattgccaaatcgctcatgagcaggctcatataccacaccgatggcacggtggccaatgaccgtatgcagcatggaagatgcatcggtgagcattaccatgccattccggccgcctcccgcctggtgcatgcaatactcccagcttcctggttgtccgggcggcacggtcattttctcaaccggagctccccaagctcttccggccagtacctcgccctgataggttccgaagccaacggcaaatacacgatgttctggatcctcccgcagcagctgacccacattgaccatgccatcagccatcatatccgttgcccgcgcatcaccgatatgcgtattatgctcccagacaatggcttttgccgaggcgccgtaataggacatgattcgcttcagtgattgaaccatatgtctgtcccgtatattccaggactgcgggccgccctggaccatcgtacgataataggcctccgagctggaagtgacgagcatgttcacctccgcatttagttcttcctcacttcccggatacgccatgcgccggctctgaatctgcttcagtagctcaatcacttctttctcacagctctccgagagcaatcctgccgcaatgccataagtctgatggtccctgctatatggatcaaaacaggcgtatgtcctgcgggcctgttccagctggggagacttggtcttctccaaataaccgatgattgcctccatcgattcccataacgagtacatatcgatgccataaaatccaaccttgggacagccactgccgcccccttgattcacctcattgtaatccttcagccactccgcgaaatcacgaatatccgtattcgcccacatccaggtcggccagcgagtaaaatcacccagtgcatcggttgccgaagaatcggccctcttcattcctttaacataccggttcaatcgataagcagagggccagtctccttccacgccgataatgttaaatcccttgcttgcaattagcttcttcgaaagctcggcccgaactcggtaaaaatcagacgtcccatggcttgcctcgccaagcagcacaatatctgcatctccgatggccttaactatgcggtctagattctccattccgtccaatgggataaataaggcattcagctctttcaaatatgcattctgctctgatagattatcattagaattcatgaatgtgttctctcctttagacggtatgagtgaattatttccgatttgtccattcattaacccaaaacatgtctcccttagtgataagcccgggtaagtctggtcggggcaaaatttgaattgatctaacgggcaggatagcgtgacgaagtaatctcgataaataaatagaggcacagctaattcagaagatcggctgccatttacattagtctaaaaaccattcaaataaaatcggagcgcttcggaaagtgttatggtgttgggaaattggaagtcataacaaaaggctgaagtaattaagataattgtaaaatgttgaggataaggaaggttactaaagtcctccacggcgaaaaaaatgcccgatttttagcatagtaccacagcagttcaagggatatcattaagatgtgcgcaaaaaaggaggagaaatataatgtccgttgaacgttttcatattcacattgcagatgaagtccttgatgatttgaaaagaagattacaccacatccgctggccggatcaattggaaaactcaggctgggatcgaggtgttgatttaacttatttaaaatcccttgtttcgtattggcgagaacagtatgattggcgcgaacaagaatctcagttaaaccgtttttcccagtttcgctgcaagatcaatggagttgatgtgcactttgttcatgagtacggaaagggtcccaatcccatgcccattattctaacccacggatggccagatagttaccttagatatcagaagattattcctcttcttacagatccagctagctatggaggtgatcctaaggattctttcgatgtcattgtcccttcattacctggttttgcgttctctagctctcctgaccatcctggtgtcaacaattatcaggtttccgagatgtgggctaaattaatgacaaaagaattaggatacgataagtttgctgcagcaggtggggatataggttccggagttacgagatatctggcatcgaaccatcctgaacttttattcgggattcacctaacagatattggtatcataagagatctacttacgtcccatgagcaggtaaaactttcagaggaagaacttcaatacaagaaaagagcattagaatggctttctctagagggagggtacatgtcgatacaatcgacacgtccacagactcttgcgtatggactttctgattcaccagcaggcttagccggttggattattgaaaaattccgagcttggagtgattgtggaggtgacctccgtcaaagatttagcgaagatgaactcattacgcatatcatggtttattggcttactaacacaatcgggtcgtcaacgcagatgtattacgaaaattcacattctctgccgtcattaggctatataaaagtaccaactggggttgcattattcccagcagatatagtattaccaccaaaagactgggcagtacgcaatttaaatataactcgctggactaccatggctcgtggtggacattttacggccatggaagagccagagcttttagcccaagaaattcgtaccttctacaagccttatagagtggaatagtgagtgtttatgatggagcagatatcttagaataatattcaagagcgaaaagactttttgagtatgtgcgaacaaccaattgattcagcgtttgtttgatgaaaaagctacggataaaatcttttattcgaatgctattaaaaggtatttcaaattttaaaatgcgcactgatacgctaacgggtacattagttgaaacaaaaaggttgccgtggcagccttttttattttatgttaggtctagtaggaccaacttaccagttgaggccgattggatcaataaatctgccttaaatgatgtgggttagtatccattattaaaggcggattcacgaaattcaatataaggctccttaacgttgtaaaaccgtgtttgctggcgatacctcaataatgtaaaaaaatacaattcattctcgttcctaaaagcatgcttaataggaacgagaatgaattagtctatttcacgtccccaaatgtgtataaataattattggaacgtttcagtattaatggtcccttttttggaactaaaagggggatgcatcatatagtagatatggcttatgtttgtgtcggtcggccaaataccaggctactttcgacgctactgttgatcaagagcatgatgccaaaaagtcgtcacaagatatctaactgctattcatgaaaagcatttatcggatgcagtagatatggtcaaagattcactgtacctttaatgaagaaaaacaaattcgtaagtataagcagtacagtaatagaactgattttgataactcggttattaattggtataatttacatgtagtaatcagcaaacttaaatgatatattatgtatccggtcgtaagataggctgtgatgtaatagttagatggacttcaaaaattcaaaggattacctacgaggtattatttaccagtagcatgaatcgtcgaagtattatatattattattcccggtgttgatatggccggaaatgattgatctttgaaaactgaac

SEQ ID NO: 2624 - DNA, 71486 bp, Unknown
  Kingdom: Bacteria, Phylum: Firmicutes, Class: Bacilli, Order: Bacillales, Family: Paenibacillaceae, Genus: Paenibacillus
cgttatggggtcagttcctctcattaacagacggagggagggcctatttacatggatacatctcatattgcctcattagctattcctcttcgtagcgtgcaagggccttggacgttgtttccttcattcgtgagatcagccgggagccttggacgaccttgacacgtttgccaaggaaacggattttggatagcacatattcacattcgtctgcctggaaggtgagcgtaatacgataggtatctgcttcctgaacatattcgacctctttttcaaagcaggaaaaagcatataaaatacgagacatttcaccgttgtatatgggaataatttcgatgatgccttgctctttgcgcgactccagtatgccgagtatacgttgggtgaatttttcggcctcttcgggtagaagctcatcttccctgatgttcacgatattagacagcttggtagacatgagcgcgcggtgtctgcggttataccacagcaggctccattcttttttgaccatggagaactccagcttatatggaaaaccggacatttgctcatgcatgcgtccgttgcgcagtttgtaggtcatacagatgcctgaacgggaccgcagaatgggacgcaattcacgcaggagtggatgatataccgagacagcagggatacctgctttttcccgcaaacttccatcggcctccagcggctcgtcgtctgcgagcatctgccgaagcttgtcaagcgtagacggggtgaaagcctctattgctgccgagtctgtcagcatagattggagccagactctttcctgcgatgtggtagcaaaagcgcccgattcatccagccgagagacgatctgatagttaaatattttctcgaacaggctcataataggcttgcagctccttccattcctgtctgaattccttacgcagccgctggggctccaatacctcacagcttgacccaaagctgcgaatccacggcttaatctcggtgattccattcactgtgatttcatagataaaggattcactttcttcctccgcaatcgtaccccactgtccctgtgacagcacacgttcccgaataaagttgcgcttcgcgccctcaggattaaaaaaacgtacccgtaccttcacaggacgaccggtatcaacaagccagctgtaccgcattttttcttccaacaccgctagcagatcggcatgaaactgctctggtacaggcttgccctccaccaattgagtcatgccctccatacgaaacttcatgattcctttaccgcctacatgaccaagaacataccaacgtccatattgatgatcatagatgacttgcaggggaagaatggtatgttcacggccctccgtctctttttcaaacagcgggtttgtgttctgtgacccgtacatgcttcgtttagatgtcgaaaaatataaaaaagttacacagcgacgttgccgaatggcatgcagaagcggatgaatatgggcttcgtccagaatgcgtgaataatagtggtatttatataaaaaaggttcaatcatatcccgatctccggcttgacggcgcatagctttttttagatgatctcgcaacagatatccctgaacagagggaagctgggtgttggccataatgtctacaaaatcatataagtccagtaattcctcgtccgtcagtcctgtcaccaaatcgttgcggacagcatagcggtaaggtctgccgccgggttccttgcgaaccacgcccacttcgaccagatatttcagatcggaacgaatcgttttttcatctggcagcgaactgtcggaaggcagcccgttgcagcaagcatccagcaattccatagtggtcagaggctgtgactgtagcgctgtcagcagaagagataagcggacgctttctgattccttgagcgatttggcccgaaacaggaatagtagtaatggatcagcggattcgtaataattaaagcgcagcatcccattaaaatcatgtccctggtcctcaggcaactgctgttgtacggattggacgatttccttgagacgccggattgttttatcaaaggtatgcactgaaatgcccagtctgtctgcaaattgctgccgattataagcgccgctggtcagtgtgagcatgcgcaggaattgaatttctttatcaaaactctctctcgccatgatgcattccccgtttctgttgccgttctccgaaagcaagtatccctttattctaacagggaagggatgcaggaaaaagggaatttattcatctttgtaatacttccaccatgttcacgacttccaaagtaaagcatcatagggatataagatagcacgatgaaataagaagcaatacataacagaagggtgatgcaacatgtttggacgggagaggaaacggctatgcgtcttcgccgcttattaataggtgaaacggatgagtcgattagagaacagattcgggaaatactttaatgataagggagggaacaacatgacagatgtgaagcatgggcagggttccattcaaccagaaatgcgcgaaacgattttgcgtgagctgcgcgcgttggagcaggaggagcaaatacgtattatatacgcctgtgaatcaggcagtcgggcatgggggtttccttcacaggacagtgactatgatgtacgatttatctatgtaagacccatagaatggtatttgtctatttttgataagcgggatgtgattgagcggccaatcagcaatttgctggatatgaacggctgggatttgaaaaaggcactccatttgtttcgtaaatccaatccgcctttgctggaatggctgcaatctccgattccctatctggagcagtattcagtggctgcccagattcgtgcgatatcgccgttaaccttctctccgaagtcctgtatgtaccattatctgaatatggcgcgaggaaactatcgggattatttgcaaggagaacaggtgaaaattaaaaagtacttttatgtactacgcccacttttggcctgtggctggattgaacgttacaacagcatgcctctgattgaatttggagacttgctagaggaattaattccgtcagatacagaactttatcaggtgatcgggcatttgctgcaacgtaaaaaagcgggcgaggaactggatatggagccacagctttcggtggtgaatgattttatccagcagcaaattgcttattttgaacaaaaggcgcccttgcttcagcatgtggagagtggacgggatcagcagttggatgatttgttccgcgctgcggtgaatgaagtatggaaagcataagctgggaaggagaagtcgagtatgcacatcacgctaaaagcaactggaacccatgcagggatgatttcgcatttgcttgctaagaatccttacaatacgtatgatcgcacagaaaaaggcgcacgtgtacgcatggtgtacaccgtttttaccgaggaagaggctgagatcgtcattcaggcctcgccagattcgatagatttggtcaaaaacagtccagacagctatgacattacacaatatattaatgaccgggagtttgtaaccagcagcttattttgcacttatattcgtggctcgcttggcacggccctgaacggcaaacccaaggaagactatgtaggatgggtgacgcacccttttgcgctggagttatcgtttgggcccattgcttcggatttgccggattctgtggtggaaggactatttgctccgctgggttatcaagtggctatagaacgaggggaagcggactattcttttcagctgaaaaatcgaagcaccgtcagatatgtcacattaagtggtcatcagacagtgcagtatgcgcttcgtcagttattgctgttgattccggtgctggataattataagcactactatattagtgaagaagagtttgacaagctgagacgttacggagaaggctggctgccagagcatccactacgcgagctgatcattcgacgcacgcttcgttttaccaatttgattgagcaatttgagcaatctgattctgctgaaacaacaggtacaaaaaaacacattgaaaaggatactgtccaagctcaaaaggataagcacgaacaggttcaacagcaagaacagccacaggaggaagggaagcagcagcctactgtacggctgaatgaactgcgatatcaagccattatggacgtgattcgcaagctgcctcgaagacagaaaatcgtagattttggttcaggggaagggaagctatcggctcggatggcccgaatgacgggcattgaagagatttgggcggtcgagccgtctgcgtatgcacaagtgagagccatggagcgttttgccaagctggaaaggcatgccgacgcgatcagccctacacccatgatgggctctctcttttattatgacgaacaattgcggggcaaagatgtgatgattctatgtgaggtcattgagcatgtggatgagcatcgtctgaaccgggtgatgaagacaattgtgacggagtatcagccgggcgtgctgatcgtgacgactcccaatcgtgaatataatgaagtgtatcgtatgaatcagcaagagctacggcatggcgatcaccgttttgaatggagtagaagcgagtttcaggaacgatgtgagcagtggattgcggaagctccttattcggtagcgctgaaggggatcggagaagaggtcgaaggctttggacaaccgacccaaatggctatatttacgcgcagaaaggagcagaaggaagcatgagcaattcatccaaacatacgattcatttaccgcatgctggactggttgtgttggttggggcctccaacagtggcaaaactacattattggacaggctggtgagcgaagggattctactggagacagaagtggtatcctcggatcattttcgcaagctggtcggagatacggaatttatagactggagtggacttccaaggctggaatcggacgtactgttctatgagtatcagcaaatgtcagccaaggcgtttgaggcgatggatacgattctggctatgcgctgtcgcttgaataaactgacggttgtggatgccacccatttgtatgctgaggaccgtcaaaaatatgtacagctggcagccaaggcgcatgttcctgttatggcctgggtactggatgtacccgaagctgtgctgctggaacgggatttaggcagggagcatccgcgtggccgccaacgggtcaagcaacaggcacagctgttaaagcggaacctgcgtggtatccgtgaggaaggctttaacgcttgctatatccttaaggatatagaagaaatgaattttgtccgccgtgcgcagccactgtttcatgagattggctcaggtattgacatcattggtgatatccatgggtgctatcgtgagatgctggaagtgatagagcggctaggatatacggaagatacggaaggactataccatcatccagatggcagaagactggtatctgtcggggatgtgatgagccgtggcccagaatcgttacaagcggtgcagttctggaaaaagcacgtggatgccggactagcgtatatgattgacagcaatcatggctggaaaatcgggcgttacctcgatggaagaaaggtgactctcagtcatggcgatgaacgatttgcagaggaactggcccaatatgaacaaaaagcgggcaaggcagcggcggaacagcttagaagtgagttgagagattttctgctacatgcaccctctcatcttatttttggcagaaatggattgcgacacgtggttgtggctcatgccgggattaaggatcattttattggcaaacagtcggcacgtatttctgattattgccgttatggagatacggaaggacaggatgcgaacggaaaaccgattcgcaaggattggttcgtagaccatgaatcgggagaaatagtagtatggggacatgatccgagaccgcagcctacccttgtgaatcagacggtgaatattgatcagggtgtggtatttggcggtatgctgaccgcttatcgttatccggaaaaggaatttgtcagtgttccggcacatgagaactatgcgaatgatcccgatagcccacttgtccggtggcagagaaaacggttttccccgccgaatttacgcaagctcatcgctggttacagtgtgctgacggaatcgtatggcgaagtgcgcgtacaaggagaatggatcaaatccgctatagataccgtgtcacatgtaactgtacccatggaggagctggtgtatattccaccgacgatgagtcctgctccagcggtgtctgcagaggcaggatatctggagcatccccgtgaggcgctagcttattatcgtggacaaggagtacaaacgatggttgccgagaaaaaacatatgggtagccgggctattttgctattattcaaaaacgaacaggctgctgttcaatatgtaggctacccgacattgggcacgatttacagtcggagcgggagagctttctttgaacaaagccttgggaagcaagtgctggaaaagctgaatgtggatctacagacggctggatattttgaacggaaccagacggattttgtgttgctggatgcggaaattgtaccgtggaatctcaaggctcgggaactgattgctgcacagtatgcccatgtgggggaagcagctctgctggatcgcagtaagctggtagacaagctgaagcaggcgaaggttgcaggtcgagaggttggagactggttggaggaaatggaacagaagtacgcgaatgctgtaacgtttcaagaggcttttcaaaaatattgctgggatgtggacggtctagatgaaattcgtatcgcaccgttccatacgctggcacacagcggaaagacttttttcgaccattctcatatttggcatatggagcaaaaccgggagctggctgggctgtcttccctgtttatggagacagagtatcgcgttattacggacgaagcaagcgaggaagaggtcattcgctggtggaacgagatgacagaggatggtcatgaggggattgtgatcaagccggaacgctttttgatgaaaaatcgggacaagatgattcaacctgcaatcaaggtgagaggccggaagtacttgcacatcatttacggtatggattatcttgcccctgagaatttaaaacgtctgaagcagcgtcgaacgaacaaaaaggagcgtcatgccctgatggaaggagcgcttggtgtggaaggcgtggaacgttttgtccgcaaggatacggtagatcgtattcatgaatgcgtccttgccgcgctatcgctggaatcggagccgattgatccgagattgtagtttgcgaaggagggattgagatggaaaggggtacaccgttaattgatattggtgtgaacttgatgcaccgttcgtttcatgcagatcgggaacaggtggtagagagagccgcggctgtagggatttcaccgctgattattaccgggaccagtgtccgcagcagtcgggaggcttctcagtatgcagcacgttatccgggcaagctgtatgccacagctggcgtgcatccccatgatgccaaagactgcagcgcagacacgattcagcagctctgccagctggcgggtcagccgcaggtcgtatccataggggaatgcggattggactataaccgtgatttttcaccacgtgatgtgcagcgtcgatggtttggggagcaaatccaactggcgggtgagctgaatatgccgttatttctgcatgaacgagatgcacatgaggactttgtcgctatgcttcgggagtatcaagggcttgtcgataaagcggtagtgcattgttttactggcactgaacaggaattgcatacgtatgtagaaatgggactgtatatcgggatcaccggctggatttgcgacgaacggcgtggcaaacatctgcgtgaactggtcagagatattcccttggaccgtctgatgattgaaacggatgctccatttttgaccccgcgtaatttgcccgtgaagcccaaagaagggcgtaatgagtccgtgtatctcgctcatattgctgctacggttgccgaatgtacaggtcgaagcatgatggagatcgaaatcgcgacgacggagacagccaaacgtttcttcggtttataggattgtcaaagccatagatgtggtatatattatagtgaattaaaaaagcattgtcgggagcttgagaaagtcaggctgagagggtggcccttgccactgaccgtgaaatctgatctgggtaatgccagcgtagagaaaccaagaacactatacaggaatgccgcttgttttgcggttgtcgatagattcaatgtatgtcctagcattttaccttgaccctgactttggcttggtatcagtgtagtagcttagactactggttatataaggcatatcgacgaatgatgttttgtatggtgcttcaccttttactgcgcataaagcttgcctggagattcagctccagacaagctttttttatggccaagaggccaattataaggaaaaaggggagcacgcaataatgaatactgctgtaagagcgtccaaagggttgaagctgactgatattttggtcacgattgtgatatctgttgtgttcgggttggtctacaaaatatggggacctgcttatgatttgatgaaaccatttggtctacacgccgagcaattgatgtatggcatgtggtttatggcaggcacgtttgcttatctcatcattcgcaagccgggtgttgcgattttggcagaggtggcagcggcaacggtcagcgcttttttgggaagcgaatggggcatgtccaccttatactatggcctgctgcaaggcttgggagcggagctattttttgcggcttttctgtatcggaacgcaaacctatgggttgcttcgctagctgcggctggggcggctgtcacttctctgattttagacttcagttacgggtatatcgatcagctatcgacctggaactatgttttgtatattggctttcggatgattggcagtattgtgattgccggggtattcgcgttctatctggctaaggcattggaggtaaccggagttacacgaagtttgagacctgcaacggaacaagattataaggggctggattgatgagccgggcaaccgaagatgtggtggcttcgatcacccgtctacggttgaaatttcccggtgagcaagagctgctttttcacaatatgtctttgtctgtccacaagggggaaaagctgctgctactgggaccgagtggatgcggtaaatcaacgctgctccaagtgttaagcggtctgattccacgcacgatagaagtgcctatgaaatgcgatgctgctgtaatcccaagtgtctcaggtattgtatttcaagatcctgatacgcagttctgtatgtcatatgcagacgaggaactggcttttgtgttggaaaataatcaggttccccgggaacagatgcaatcccgtattcgcgagctgctgatacaggttggtctatcaacggatgatatacacatgcccattggcaacatgtcacagggaatgaagcagcgtctggcgattgcgtctgtgctggctatggagccagaagtgctttttctggatgagccgacggctttgttggacgaggaaggcaccacacaggtgtgggataccattcgcaacatttcggtagaccaaacgctggtgatcgtagagcataaaattaatgaaatcgtccatgatgtggatcggattgtggtgctttctgctcaaggggagatcattgcggatggaagggcagaagaagtatttcatgtgcatcggcaggcattgtctgagtacggcgtgtggtacccgggagtatggaatgaatcgtcttcgccgcgttggagtgaatcagtgacacagcagaatggtacggggaatggtacggagattgatttgctggagctgaaacattttagtggtctccgcggtttaagttcagtgatttatgtggagcatgcgcaggtgaagcctggcgactggattggcgtggtcggtgaaaacggggctggcaaaagctcgttgctgctctccatgatgcgtttacttcgcacacagggacgttatagcgtgcgcggaattgaggcaggcagtacggaacaactggcagagcgcatcgggttcgcatttcaaaatcccgagctgcaattcgtagcgcataccgtacgaaaggaactagagtattcgttaccgaagagcttgtttagtgctgagcagtgccgggagcgggtggatcggatgctcgtacagttcggattggagcggctggacgagcgtcatccgtatcagctttcgttaggccaaaaaaggcggttgagtattgctacggccatgatccgtgagccggaagtgctgctgctggatgagccgacttttggtcaggatgcgcgtaatacctttgtcatgctggatatgttggagcagttgagagcggcaggcacggccattctgatggtcacacatgacccggaaattgtccgtcgatattgtaccgatatatggcggattcagaaaggggaactacagtatgaacctgtcctttccccatcataaaacatggctgcatcgcgtgaatccgggcttaaagctcgttatgttttccatactgtttgtggtcgttatagtcattcatgatccgaatgtcatgtttaatgttgcgtgttctatgctgttgctgcttgtctggtcaggccatccatggaagaggctgctgctgtacggatctccctttatattggtgtttctttcaacttcaacgggcatgatgatgttcggcaaaggggtgacgacctggtggacatggggcttgatccatgtgacgcaggaaagcttttaccgaggcatgcatctgggctttcgtacgctgagtatggctgcggtagggttgctgtttggtttaacgactcgtccggtggaccttttttattcactgatgcagcaatggaggcttcctccgaagtatgcgtacagcttcttggcagctatgcggttaatgcccatgatggtggaggaattccaggcattgagacaagctcatcgcattcgaggcttgcatcagcatgtgtccaaatggaatatgtatgcgacgcttcgcaggtatgcgattccgctgctcgctcaaagtatccggcgtgcgcagcgcattgctattgctatggaagccaagggttttgctaatgaaaccaagcgaacgtattattatgcgattggctattcggctgtagatattttatttattttctattttgtggtgatgcttacgctggcttggggattcggtatccgctttccttatgtaggggtatgggatgtacgttaattgttgtcaaaatgctttgcccgttttctgctctgtggtatattaatgcaatgggaattgacggctcgtacagacccgcccgggctggcgggcttattacattttcccgcagaaatggatcatcaggaggccaagtttcatgattacgctgcatcaggtaagcaagcattataccacctcaagcggccaatttcatgcggttcaatccgtgtcccttcaagtggaggagggggaaattcacggtatcataggtgccagcggtgccggcaagtctacgttgctccggttgatgaatgtattggaaaggccggatgagggaaacgtggttgtaaacggggaagatctgactcgcatgccggaaaaacgtctccgagaagcgcggcgatccatagggatgatttttcagcattatcatcttgttcacaatcggacggtcagtggaaatgtggcaatgccgttagagctggcaggtgtcgcgaaaaaagagagagcggaacgtgtgcgcgaatgcctgcaattcgtcggtttagctgataaagcagaacagtatccggcacaactgagcggaggccaaaagcaacgcgtggcgatagccagagcgctggcgaatcgacctgcggtgctgctgtgtgatgagccgacctcggcgcttgatccgcagacgaccgcggatattttgggcgtgttacgggagatcaaccgtgaactgggagttaccattgtaatcgtaacgcacgatatggatgtagtacgcaatatttgtacccgtgtatcagaaatgcgagatgggcagctactttcaacgcagcgtgtagctgacactgcggtaggttcaacagcgggagcaggtgaagctgatgaatgaaatgctgagcatcattgcgcaatatcagtctgagatatggaaagccatcggagagacgtttatcatggtggggatttctattgcagcagctgtactgttagggcttccggcaggaacgattttgtatttgtgtggtaaagggcaaaaatatgaaaatcgactgctgttcaccctattgaacagtgtggtcaatgttatccgctcattcccgtttttgctgctcgtcgtgtttatgattccatttacacgtctggtcgtagggacggcgctgggcacgatggctgcaacggttcccttgtcagtggtggccatcgcctattattcgaggctggtggagcaatcattgctcgaggtgcccaagggtgtaattgaagccgctacttctatgggggcatccaccctccagcttatttttaaatttctgtacgtggaggctcgttccgggcttgtactgggtttgaccacgtccaccattagcttcatctcctactccacggtgatgggcattgtgggcggcggcggggtaggcgattttgccatccgctacggttaccagcgttttgaaacaggcttgatggcgttcaccatcgtcgtcatgattattttcgtacaaacaatccagttcaccggaagcaccatatcccgccggatcgacaagcggtgatgataggttgtatggtaatacacttgcaccacccactatgggaaataagaatgactttacagtacctcaaaagcggagcgaagaatttgaatctgaagaagcgtcagcgttcgcctttgaaatgggattctaacctataaattgtgtcataaattagagagaatcctatttcaacagcgatcgtaagatcaaatcattcgcgaagcggctgtactgtaactcattttttatcttcccaatcacaatttacttggaggttcctcatcaaatgagtcggaaaaacaacatgaaaacgaacttgaaattacttacactatttgctgtcgttatgctactggttgccggatgcggtggtcaaaagcaggctgctccagaaacacagtctaaagaagcaaattcccaaaaagaagtgaccttgaaagtagcaacgctaatcccaccgatgacagatgtgctggatatcgtgaagccgctgcttaaacaggacggagtcaatctggaaatcgtcgtgctttcagacaatatccaaccgaacaacgcattggcaagccgggaagtagatgctaacttctttcagcatgctccttttatgcaacaatataatgaaagcaacaagtctgatttggtggcgataaaacctatttacaacgctatttacggcgcgtactccaaaaaatacaagaacgttaaagacctgccggaaggtgcgactattgccattgccaatgacccggccaatactggacgttctttagtaatgatggagcaaaacggtttgatcaaacttaaagaaggcgtaggctataatgctacacaggccgatattattgagaataagaaaaagtttgtgtttaaagaagtggatttgttgatgctggcgcggtcactggatgatgtggacatggctgccatgtatcccgcatatgccaagccgctcggtctgacaccgaagaaggacgcgctgattaccgaaaaagacgatacgcactttgccattaatctggtagcgcgtaaggataatgcagattccgatgctattcaaaagctggcaaagcgaatgactggaccggaagtacgtaaattttttgaggataattacaaggatagcgttgttccagcattttaaataaataagtatgctgaaacatcgttttatgatgaaatacgacctgtataatggaaggaagtctgtgaagagcagatggtctcccttgtgcaggtctttttttcatccttaatatggaaaggaattatcgaaaacagggtataaagtcttattttttaaggttttagggtgttgcaacgctgcgaattttggtcataaagggcgatggagtaatgataaggaacatattaaaataaaaatacgaacaaacattcgttttcgatttcgttaacggtgtttttatatgggtcaaaaaattcagctgacaacgggccaaaagcgtgaataaaaaggaaggggaacgacatgaagctgtttgtaactgtaaaaagtttgggaaagcgcaagcccgcactcgcacgacaggaattagagctgagtcctgctccagaaacgttgcgagatttgattactgcaaccgttgccctgaatgttcaaaagctgcgggaaaagcaggagagtgtcgcgctgattccgttccttacgggagaagaagtacaggcacaaggcgagataggcaaagtaggattcggttccatatataatgatggtgtcccggatatgaaggatgccgtgaacacggcgatgcaggcatttgaagatggtctatacagagtttttgtatgtgacgaggaaactattgaactcgatgctcctttgtcacttaaggatgggaatgagattgtatttatacgcttcacaatgctggctggaggcctatggtagagggggaaatgaaacatgcatcaagagaacaatgagcaagaatatttcaccacactgaaggagcgcgcggcgcaactggatggaccacaacaggagttggctcagtatgttgtggaactgggtaagcttcattacatacaggagaacgaggagccttttaacgaatgtcagcgaatattaaaagaacgggcgacggaaagcggagagtcactgtttaagccactgacagaggtattacatgctctaattggacaaacaacgggcgacgtattcgcacatctaacggagcatgtgactgaatatccatacagcacagggtatgcgcgaaaaccgtttcgcacttcggatattacggcccatacttcccgggtttataaaagaatggtgcagttgatccgaatggactgtatggggttctccgtaatggattatttaacaaaaaaggattatgaaccaggcagagattaccggattcaggaaacgattggtgactggattgcttatgagctggatcacggtaattcacaggtgcttgaggcgttaaaagctattatttatggggataatcaggcggcgttacttacgcgcaatatgattaaaggcatgctcctgagtcatcaggaggagaattatcgcatgattggcgagctcttggcagccgccaaactccaggagggattgcgccaaagtatcgtggaacaaatggatgaaggaaccccggaggctctaatatatctgttgaaggtaatcatcgaccaaggcttcattcgttacagttcggtggtgcgggcgcttgcagtatggacgggaatgggcttggaatccgccaatcagcgggtcgttcgccaactgatcgagcaggcatatgaagcattgactcgtagtgaactgcgccaggaatggctgatcagctcaaatgctaatgaagtttatatgagtttgtgggctacggcagtacatgaggaacgtgatttgtatggacaggttcggaaactcatggagcaaggagcaacctaccagaagatcgtagcactgtatgtactgtctaacagtgacaataaggatgtgcgcctcggaattgcgagagaatatctggatgaaacggaccaagagcttcaatattggatactgacgaactatacaagcaattatttttatgaatggatagaaggcgggacggtcgcggatcggatcgttaaagtggtgcgtactcctttgctggagagcaaagaggagcggcgtaaggattttgaacgacttcataacctgtttgtacatatgaaaaagggtgagtccaccgagccctccaaggtgctggattttgttaatctgtatcaccgctcagatgcacctattcaaaaaatgctgtatctcgctggttatgatatggatgcttcctggattggggaaattatagccttaaaggaacagattagccctaatctgcgtggcgaactgttgaaccattttgtgcaaaaacctgaggatgcggtacaacgtgattttattttttccagtttgtctgacaaaagtatgagtatccgtgagttcgctgtggccaaggcacgtaagctgacgctgtcggaaccagaaatgcaacaaatggaagccttattaaagctcaagacgggatcattgcgccaaagtgtcattggtgtgttgctctcacaatcggaagagccgctcgttggctcattggaacgcttgctgcgtgctaaggcggagctgcaacgattgggtggactggaagtattgacgaagatatatgcagacccggatcgtgccgaacagtatgaaagcctgcggactttggcggatatcattcagcaacctacagccaaagaggagcaactgctgtccaagctgggacaggaggatgcttatacaggggctaacggttttggactgtacgatccgaatgtcaaggaagcttggctggaagagaaagttgatctgggtgattttcgattggccgatatttttgttagtccattggagaagctcaagcagttcttgagcggactggacgagcttgttcatcatcatcgtgatgtggaatatactgcggagtattattcgggctacaaagatacattgcttatcgggacgaaccttcgtcctctacggttggttcaggtcgatgaagaagtagattccagactatctttatatcctctctatgaggagtgggaccgttatttgcaggaaagcggcatggaagcgcgtgaactgctggagcttgttttttatgaccgattagagcctatggaccgaacgctggagcgctattatcgatacttttcttttaacatggactattcagaacaaagcaagcacaagctgctggaaggatggcgtaaagatttcgctgagcaaatgtatccgttggatcgcattaacgaggtacagaagtggatggcagaactgacctattccgatcaggtaagcacattagttaatgcttattttatggacacatccggtgaccaaacatttgacgtaattgaccttgctttaaattcactaatgcaaggcatgcctaaggacagacctgaagaggatatgggaatgctccatctattgtctggcccgtgggtggcactggagaaggggcaggtccatgatgatgagtcctttaagcgctttttccatacctttgtgaactacgcagaactgctaggagcggaaaatcgtttttattctccgctggatctggaggattacttcaaagcatatgaaaaagggttgatcggtataggggaagtgtatcgggagctgctggctggtagtgaaagcagaagacatatgagttccttaaccaatgcccgcaatacatggatttctagcaaaccagaatttttggagatacgtcgtacggttattgatcgactgctagaggttgaattggttcgaggcgatttgcctaccgaggctacgccaaaggttatgggcttgagccaatttgaaggtatggattatttcatccgtattctggagggtctcgacaaggaaacgtttgtgcgtggttatgtgtacggctacggtgatcgtattaccaaaaaggaatcgttcagccacttgctcaaggcatgttatccgagtgatggcgaggatgccacgttgctcaaggaaaagctgaagaacactaaaattacagataaacgtctgctggaggcggctatgtatgcaccgcagtggattgagattgtagcagactatctcggttgggaagggctgcgcagtgcggcatggtatttccatgcgcatatcaatgaaggtttttcggccgagaaggaaacgattgtagctcattactcgccgattgctccacaagattttaatgatggtgccttcgatattcactggtttcatgaggcctatgagacgttgggcgaggaacgttttgacctgctgtacgattgtgccaagtatatttcggctggagccaatcatcgtcgatcccagttgtttgcagatgcgacgctgggtaagctcaaacggagtgaaatggaaaaatcagtggaggacaagcgaaacaaagaccatttgctgacctacagtctgattccacttgctcagccacctgaaccagatatacgcgaacgttatgattttatccagaggtttctggaacaaagcaaaaaattcggggcacagcgtaaggccagtgagggactcgtttcacggattgcgctcgggaatttggcacgtaacgcaggctatgatgacgtaacccgtctcgtatgggatatggaagctcgtaagctggatgatcttcggtcttattttgagccacatgctttggacgaggctacaacggtgcagctcgtcattgatgctgaaggagcggcagatattgaaattgtcagcaaaggcaagacgctgaaatccattccggctcgtttcaagaaggatgagtatgttacgtcgctgaaggagcttaaaggagatctagtggatcagtaccgcagagctcgcaaagaattggaacgctctatggagtctggtacgacctttatggtgaaggaattgagaggattgctgggtaatcctgtgcttgctccgttggtgcggacactggtattcaaggctgatgatcacctcggatattttaatgaggaaacgttggtattgacggctccttttgctgaacagcatactataggagaagaggacaagctgattattgcccatccccttcatttgttcgaaagtggtcgttggagcgacttccagaaggacttattcgaccgccagatacgccagccatttaagcaggtgttccgtgagctgtacttgctgaatgctgatgaacgtgcaaatgcgaccgtttcccgtcgatatgcaggacaccaggtgcagccgaataaaacggtatccctattgaaaggtcgccaatggacagtcagctatgaggacggacttcagaaggtgtactatgctgagaacctgattgcgaacctgtatgccatggcggactggttctcaccagcggataccgaggctcctacactggagacagtgcagttctttgatcggacaacgtataagagcgtaccgttggacgaagttcctcctgttctgttctccgaagttatgcgggatgtggatctggtcgtcagtgttgcccatgtaggtggcgttgatccagaggccagtctgacgaccattgaaatgcgtagggttattgtgcaggaatcacttcgcctgctgaaaattagcaatgtacgcttggatgggaattatgcacgtgtagatgggactcttggcgaatatgctgtgcatctgggaagcgggggtgtctacaagcaagcgaagggagcactgcatattatcccggtgcattcgcagcatcgtggacgcatcttcctgccgtttctggacgaggacccaagaacagctgagattctatccaaagttgtgttgttggcagaggatcagaagatcaaggacccgcaaattcttacacagcttcaagcgtagaatagaattctgatctatatatagattcataattaactcaacgttcgcacctaaacaatgatttcgcatcctcgactgagtaggtggaaacttagtttagttgcggaggttgagttatttaatattgagcgtttatcgagcacgaataaggagatatgggtaatattttaggttctgtggtttgataggaatctaacagtataacaattgacgatcataggagaacataacgatgtttaaaagtatctttctaaaagagtactcaaccgagtatcaatcacaagttgttgatttaattttacatattcaaaaagatgaatatgatatcgccataaccaaagaagatcagccagatttgcttgatattgaaaacttttatcagcgtggtaacggcaacttctgggtggctcttagtgaaggaaacgtagtagggactatagctttgttagatattgggaaccgtaagacagcactcagaaagatgtttgtaaaacaaaactatagaggtaaaacattcaatgtttcgaatcaattattgcatcatgccataggatgggctagggaaaggtctattgaagaaatctatcttggaacaacaccacaattcgtagcagctcatcgtttttatgagaagaacggctttgttagtatagctcctggagaattgccgattggttttccagtcatgaaagtggataaaaagttttacagatacgtcattcaataatgggtataaatgaagatgctgctaggccacaaaagaaaccgtcgtctagcagatgcttcttttgtttaggacaggcgtttgctagaataaaagggtatgttgtaagtcaacgttaaccaaattgctgggagggacacacgtatgagcaaagtgattaaatggggaattgtcggcacaggctggatctcagatcaatttgtggcggatttggcgcatgttacgaatggagaagggtatgctgttggatcacgcactattgaaagcgctaccgaatttgcagctaagcatcaaatatcaagggcttacgggagctatgaggaattagcacaagatcccgagatagatgctatttacgtagggactcctcatccttttcataaagagaatgttctgatggctcttcgggcaggcaaagcagtcttgtgtgagaaacccttcaccgtcaatagcaaagaattggaggaaatgatcggctttgcacgtgagcgtaagctattcctgatggaagcaatgtggactcgttttttgcctccgattcgccaagtgcgggagtggatacatgcgggacacattggtgaggtaaagctggttaaggcggaatttggttttcggatagattggaacccggaggggcggcttttgaaccctgagctgggcggaggtgctctattggatgcagggatttatccggtttcttttgcttcaatggtcttcggccctgaacctgagcatgtatggagcactgctcatatcggggagacaggcgttgacgagacattttcgatcttgctggattatggaaaaggacgcacggctatgcttaacggggcagtccgtctcggattgacgaatgaggcatacatccatggaacaaagggctatatccacattccgtcattcctgaacagcacatcggctactttagttgtggacggtgaagaggcacaaaactttcaggatgaccgatcctctacaggctatgcctttgaagcagaagaagtcgggcgttgcttgaacgaaggcttgctcgaaagttctactatttctttggatgaatcattaggaattatgaaactgatggatcagattcgttcacagtgggggcttcggtatccgtttgaataatcacgttaattccagggacctttcaggttctctggaattttttgtttatgggcgtttttttataccaggattttgcaaaatcctcatacataagtatttccaattcccaaatagcgactttggtcgcacgataggtaacgccatatgagtcaatcaagagtgggacatatgaatcattttttgtgatttaaattagttaaaaaaccgtcattaaaaagttacaaaagtgtaattttattatcagttaactgaattgtgagcgctctctttttatggagaagaatgaaggtcctagtgctgtacttccaaaaactttcaatgaaattttcgaaaatgtacggtagggtggtaaacgtgtcacttgagccattgcggcttttgctgacttgcttgcttatcccgtggctctcgattcttgtcggagctcgcaggatcgagagcctttgcaagcctgtgagagttgaataggcattcacctcatgacctaacatcaaggaggagttacaaacgtgaaagtgaaatcaacatggttgttccgtatggtgatgatgacagttatcgcggctgttgtgatcggacctatgaatattgcaggagcggcaggaagccagacagatcggccttggatgaacacggccctgtcggctgagaaacggacagcgttgctgctgcaagaaatgacgctggaagaaaaaatagatttggtgactggtaaggtcaacaattactatggattttataataatccgatggagcggttgggtattccggcgctgacgatggcagatggacctgcgggtgtgcgcatcgccaatccagatgtgcaggacaagcaatctactgcgttgcctgctccaattgcgttggctgcaacgtgggatacccaagctgccaaacagtatggtgatttgatcggagacgaggcttttaatacaactcataatgttgcgcttggaccggggatggatattgcccgtattccatggggatcgcgaaactttgaatctatgggtgaggacccgctactgcaatcgcaaatggcgaccgcttatgtcaaaggtatacaaagccaccctgttttggcgactgcgaaacattatcttatgaataatcaggaaacggagcgcttcacgacgaatgtcaaagtcagtgaccgtgcgttgcatgagatttacatacgcccgttccaagaagtcatcgccaaggcagatttgggaggggccatgtgctcctttaacaaggtcaacggcgagtctgcttgtgagaacaaaactcttttgacggacctcttgaagaaggagctgcaattcaagggcttcgtgatgagtgattacggtgcgaacctgagtacagtcgaatcagcaaatagcggattggacctggaaacaccggggacaccatatggtaaatggggagatcagctgctggcggctgttaagaatggcaaggtaagtgaaaaaacgattgatgataaggctgggcgcattctggtgcaaatgttcagcaaaggtttattcgatcgcccggctcaaaataatcaaattgatgcccgtgaccatggcaaaacagcccgtcaattggctgaggaaagtatggtactgcttcaaaataaaaacaatgcattaccgttgtctaaagataaactcaagtccattgctgtgattggccccgatgcagataacggcactgtggcaggcggaggcagttcgttggtgaacccgacgtataccgtgagtccgttagagggcatccgcaatcgtgtcggcaaaggagttaccgtccaatatgcaccgggcacagacccgatctctgcaggagacattatgccagggccatctgctgttccgtcttcactgttgactacatctgatcagaaagaggatatcagtgttggatatgcgacttatggagatggcgaacaggggcttcgaggcgaatactggaagaataacaagatggaaggcaatccgattcttgtacgcaatgatgaccaagtcaatatgaaccttggattttataattatcagggcttcaatgcgaagtcccctaaagttcccaatacaccaacgacactgaacggcttgatatctgcacgctggacaggggcaattgcagctcccaaggatggtgactatgcattgtcattaaccagtttgggatcaagcaagctgtatctcgacgataagctattcgtggataatcaaggtgaaaagctgggcactacgaagaaaaacatctcccttaaagcgggtgaaaagcacaagatacgtattgaataccgcgctgattatccgacaaatggtcgtgattccggtggtatggttcgtctgggctgggaacctccagcagatacgtcagataagttgattgataacgctgtgaaattggcgaaaaaatcggatgttgcgattgttgttacgcgtacgtatgagagcgaaggatatgttgagcgttccgatatggaactgccgaacaatcaggatcggctgatccgtgcggttgcggctgcaaatccgaaaaccattgtcgtacaaatgagcggcagagccgtgcaaatggatacctggcaggacaaagtcccttccatcgtacaagcatggtttgctggacaagagcaaggaaatgctatagcgcgcgtcttattcggtgatgtgaatccttcgggtaaattgccggtaactttcccggttaacgagcagtctacacccgtgtcctcaccagagaagtttccaggcgtgaacggtataggtgactattcagatggtatttttgtaggctatcgtgggtatgagaaatcgggtattcaaccagcgttctcctttggacacggtttatcctatacgacattcggatatagtgatctgaaaacaaaacagcatgcgagtggaaaaaaatccgatcgtacgagttccgtcgaagtttcgctaaaattgaagaacactggcaaaacagccggagctgaggttgtacaggtgtacagcggtaagcttccgacaaacgtagagactccatcccgtcaactggcaggctggtccaaggtagagttaaagccgggtcaagagaagaaggtacgcatagagctcgacccgaaagctttctcttattgggatgaaaagtccaaagcatgggttatgccagcgggtgaagtgcccatttatgtgggcagctcctcacaggatttacgactgacaggaagtgttacgattccggcaacctctacagaaaaagcaaaaaagtaatcccgttacatttgttttaaaatggttatattcaagagagcgcgggcacaagcaccggctctctttttgctatcggtatgtaaacgtccaacaggtatgcaaagggaaacccaagtgaaagctgaaatagtagggaggatggggacgggataatgatggggagaggaggatatagatgaaaaaactccaaaagcaacgacgtactgacatctggctgcttatagctgcagtagccattttgatctgtgcggtcctggccaatatggctatacggaatgttccggggccgaaagcagaaaataacgtcaacatgtggctaacaacacccgacccggcgaatcgcctaacccaacaaaccccgatccgttgggataaggataacagtaaagaaaatgcagcgaatgcggatacactgacgattgagattaagccagatattcattatcagacgatggagggatttggcgcagcggtgtccggttcgtccgcatacctgatgaatcatggcatgtctgccaatcagcgtgatcagctgctaaatgatttgtttacagctagtggcattcaactaagttatattcgccataccattggagcctcagattattccgtagatgaacagggacagcctggtagctatacctatgacgatgtggcaacaggcaaggactatgagctgaatcatttctccatcgccaaggatcgggatatgatcgatgtgttgaagcaaatcctgagaagaaaccaggatttaaagattatgggaaccccatggacagctccgccctggatgaaatatggggagcagatttataacggctggtatttggattataccgatccgcgcgtctaccaggcgtatgctgactattttgttcgttatctacaggcttatgcgaacgagggaattccgattcaggcgatttccattcaaaatgagccagaattcacgacgcccaagtatcccagcatgagtatgggagcagcagaacaggcgaattttattaaacaatatctgggtcccaccctaaatcgaaaccatttatctactcacattattgcctttgaccataactgggatacagggagcgaatatgccaagaccgtgttaggagatgaacaggctcgaaactatacgcacggaacggcctttcattgctacaaaggagagcccacagcgatgacagatgtgcataatgcttttcctgataagcctgtatatatgacagaatgtagtgggggagcgtggagtccgggctttggagataatttgagctgggatatgtccaagctgatcattggtgcaccccgaaactggtcgcaaaatgtcctcttttggaatatcgcacttgacccgtccgggggtccgaccaatgggggttgcgccaactgtagaggtgtagtaaccatcgacccgttaagcggtgcagttacgaaaaatgtggagtactatgcgattgggcacgccagcaaattcgtccgtccaggtgcggtacgtattgattctacacattatagtgggagtattgaaacggtcgcctatcgcaaccccgacggtacgcttgtcctgattgccgccaatacgggagagaacacaaagacatttaaggttcggcatggaaataaggttttcaaatctacccttccatccaagtccgcggctacctttcaatggaatcctacggcttcctgacacggcctgtacatcaacgttttagagcgcttagcccatctggctgagcgttcttttttcatttgctacaaaatccagactgcgaaaaaaatttaatattgttcagaattggttcagaggcggatgataagatcttttcactaataacaagaatgaaccgtttggcagcctttctggtgaatgtgttccaatcgggtgaacggacgggtatcctttctcgtatcgacggggcgcatcgtgctgcaattgttttacaaccgagaatgtgacttctctcataaaatagaagaatatgagctggaggttcaccaattcatgaaaaaccacgaaccgtatgaacgtatccagcatagcactatatccggttaatccagtaataccgtatctgatcataaatagctccttttacgatttcatggatgtgacgaatgttgcctattttaatcaagagggtcatttctataacccaagcgaatttaatacggtcgcatatgtactcaaatatcatgaaactatacccgaaaggtacttatcaatatgtaggcaggcatacaccttaatcggtgtgtttgtctgagctcgctgtcttttgaagacaggtcataaattcttataaaggtgtaacccaacaactatggagggttacacctttttgtatactgagcatattgtattcatccaagcctttactgtacaaggagattttcaacatgaaaccaggggcatggggagttcttccgcagcagtatcaatatgcttgaacaatgtacccaactgaattacaatacaattgataatgatttttaatatcaattagaatgaaaagggggagttggactacatgtttggattgaccaaaaagctacatatttatacagcacttattctgttgatatcggtgctggctggttgtgcctcgggtggaactacagggacaacagacccttcaagtaagtctgcaagtggtaatgagagcaatgcagcaggcagtggtgcggacgagcagaccagagttatcaaacatgccatgggtgaaacaacagttaagggaactccgaagaggattgtaaccttgttccagggtgccaatgatgttgttgttgcacttggtgttaagccaacgggtgttgtggaatcctgggttcagcaacccgtatataaatatttgagagatgatctggatggtgtgacgcaagtaggtcaggaatcacagccgaacctggaagagatcaacaaattgaagccggatctaatcattgccaccaaaacaagacatgaggatatctatgatcaactgtcccagattgctccaacggtagttaccgagactttgtttgactggaaagagacggtaaagacggctggtgaagcgatgaatatgaaggaacagtcggacaagttgcttgctgattgggatgcaagggtagcggattttaaaggcaaaatgggtgaccgtcttcccattgaagcgactattacgaattttagagccgatcaggttcgcattttctatatgggatacgccggaaaaatattgaaagagcttggatttaccagaccgcctggacatgatgaagacacctggggggtggagttgacctcgaaagagaacatcccggatatgaacgcagatatgatcttcaactttaattcaggcacggaaacagaagctattgagaaaaactataaggattggaccagcagtccgctctggaaaaatatcgatgcggtgaagaataataagctagtacaggttgatgaggtggcctggaacatggggggcggatacacatcggccaacatgatgctggacgacctatacaagcagttcaatctgaactaatgggagcaagacctgccatgtaccaggacattcgtatacgaagcgtatgggcaggcaggtctttttgcatttcacggatgaaagagtgagaatatgtttcccctttttacgaaggcaagtacgaaaatttatggactatccggcttattcattttgttattactcgcctgtgcagccagcatgatactgggacgtacacacataacatttcaaatagcagtgaatgcactacaacactatgacgaaagctcagtggagcatgtcgtacttctgacggaacgtttgccacgcacaattattgccgctgttgttggtgcaagtttagcggtggcgggaggactcatgcaagcgctaactcgtaatccgctcgcttcaccaagtgtgtttgggatcaatgcgggcgccatcttttttatcgttattgccattgtggtgctgtcggtgtcctcgctcagtacgatgatgtggtttggttttgccggggcaaccattgcaacagtgattgtgtacacgcttgggtccatcggtcgtgatggtctgactcccatcaagattgtgctggcgggtaccgctatctctgcactttttgcttcgttcacacaggcaatcctggtgctggatggaacgggattacaggacgtgttgttctggcttgcaggttcagtgagcggtcgaacacttgacatgctgtatcctgtactgccatatatgacggttgccgctgtgatatccctgtttatgggccgggcgatcaatctgcttttgaccggtgatgatatcgccaaaggcatgggacagaacgtgctattggttaaggtacttatgggagccgttacagtattgctggccggtggttctgttgcggtggccggttcgattggtctggtaggattagtcgtaccgcatatcatgcgggcgtttgtaggcaacgactaccgctggcttgttccctactgtattctgggcggcgccattttgttattggcggcggatgtggttgcacggctgatcatcatgccgcaggaagttccgcttggcgttatgactgcgctcattggtggtcccttcttcgtctatattgcccgcaaaggggggacgaagatatgaggaagatgattacttttcgcaataaaaaagatacgttatccttgcaaatggagcgcaaatcgctgctcattatcggaatctgtatggttttgatattgattgcatccattgcaggaaccagtgtgggtaatgattttatatctccgctgaatgtgctacagacgattttcggtctgggcgcaggtgatcatgactttgtcgtgttgacgctaaggctgccgcgtgtgctgttatcgttgcttgtgggtgcagcactaggcatgtccggtgccctcttgcaggggattatccgtaatccgctcgcttcaccggatgtgatcgggataacgggaggagctgccgttgccgctgtaggttttgtcaccctgctgggtggaaccatcagtatcaagctgttgccgttgtttgccattatgggggcgatgattactgcaatcatcatttatcttcttgcctggaaaaaaggagttagcccgattcgactagtgttgatcggaatcggagtgtcagccattacgggggccgggacgaccttcatgctgatccttagtccattctatacggctggccaggcgtatatctggctgacagggagtgtgtatggcgcatcgtggaccgatgttagaacgatcatcccggtgattgtaatcgtgcttccgttggcgatctggtttgcccggagtctgaacgcacaggaattcggggatgatctggccaccgggctgggggtcactgtacagcgtcatcgttcagcgctgctactgtgcagtgtactgctggccggggctgctgtagctgtcgcggggacgattggttttgtcggtctgattgcgccgcatattgcccggaagctggtagggcgcatgtttggcagcatgctcatcgtttcgggactggtcggtgccctgcttgtgtttgctgctgatctgattgcccgtacagtatttctgccgctcgatgttccggcaggggtatttaccgccggggtaggagcaccgtttttcctgtatctgttgttcaagaatcgaaatcagttttgaggaggagaatgctgtgagtattctggaagccaaggaccttacgatcgcctatggcgcagagcctattatagagaatttgaacctgactattcccaaggggaaaactactgtcctgattggcagcaacggttgcgggaagtccaccttgctgcgaacgatggcgcgactgctgaagtccagttcaggctcggtactactggatggcgaggagattgcgaagttgcctaccaaggaaatttcaagacgtatgtccattctgccgcaaggtccttctgctccagagggactgacggtaaaccaactggttcggcaaggacggtacccacaccagacatggctgaaacagtggtcctgtgaggacgaacgcatggtcaggcttgcgctggaatccacacatctgactgctctggctgatcggcccgtggacgcattatctggcggacaacgccagcgcgcctggattgcgatgacactcgcacagggaacagaaaccctgctgctggatgaaccaacgacttatctggatatgacccatcagattgatattctggatctgctgtttgatttgaatgaacaggaggggcgcaccatagtgatggtgcttcatgatctgaatcttgcgtgtcgctatgctcaccatattgtggctgtccacaacaagtccatctacgcggaaggaaaaccggaagacattgttacgcaggacatggtccgcgcggtcttccagatggagtgcgacattacggttgatccgctgtttggcacacccatgtgcattccgcacgggaagggaaggaagttaaatgaaaccacacgctacagccacttggcttgatgatcaagagatgcaggccttggctgccgaataccgtctgacctgggagccttcgacagatcgtacattttcgatgccatttacggacttgctggacccgtccaaaagcctgaactatttgcaaggggtgagaggcatctttgagacggactccgaaacggctactgtatcgctctttgctaaacgatatgcttacttgatcacagcttcaggtctctatgccatgtcacgcttcaacaaaggcctgaattatgagattgccaacggcacgattgaatccagttatcagggagaggcatggcttcccaaggctcggctgaccgattggcagacgacctcaccagaggcggatcagcgtgacgtatggagagatcaggtgattgaacagatgttcgccggcaatctggctaaggtatggcaatcgctgtccaaggcaacccggatttcccgttcagtcctgtgggagaacacggccatttacgtatactggctctatgagaacaagtttgccgaaggagccacgcctgaagaaaagcagcgtgtcgaagaggacttccattatctaatttgtgatgcacctgcgcatctctttggtgaatcccgtaacccgctcaagcagtttaatacgcccaaacgggcaacagctgtctcagatacacctattcgtgtacgcaaaacttgttgtttctattatctcgccgcagatgatccagaagattgctgcccgacctgccccaaattaaagcattaataccgatgattatcatccacatccccagcctatacttcattgcatctcaatacagcgaatagcacaggcaagcttatgacataacgaaattcagagcttgccttatttgttgtgtgggggttatatcatcaattgagactaaaccatgcctagaatagctgtttttataacattaatcaaagatatttataacatctagtaggataaacgtactttttctataagatgcagtgagacattatgattacttgtttaatcttatttaaggtatctggtagatttcgccatggagcaccaattgagccgcccaaagcatagcatttagtatgtgtcgattgtccacggaggtatgtcctatttgtggttttctttcaggtggaaacatcttggatttcgtatcatgtattcatctaatttttttaacctatttattcctcgttgagcagtttgaggacacagcctagtttgaaatataaaaaaactttttaggactcttattttctctccaataactcactatagtagtcggatattccatttactcccattaatttatgagctggaatacccgaaattctctaaacggaagatttcgaaatagctatatcatgatttttcaaatattcgattgcttttttgagtttttctttgttctctattgtgactcaaattgctcagcagctttccaacacttagatatttgagcctcgtcatctttctcttgaaaagactttcttgaagcagcaatcaaatgatttaaaccagaatcatgtagtgtttcaggagaaataccactctgaacaaagaaatcttccatagaacacaatctattttgtttttcacagtcttttagatatttagctagtaatgtatttatgtttttatggacgtgtggtcctctctcacgtttcggtaagtttattagcaaatgttgaacttctttttgatagtaaccgtttaattcctattttactaacgtccctgttagttgaataagagtacaatttgtgatttattaggaggacaggaattgatgcatcagcagaacgactttcgcacataagacttatcggaggaatttatggataataaaaggtgcttttcaattggggaagtttctagattaaaaaatgttacgataaaagccttacgttattatcataatattggcttgttgatacctgcatacattaattccaataacggttatcgctattatacaattgatcaattcatctatctggatattataaaaatttgtaagcaaagtaatgtaagtgttaaagaaattaaagccttatttgctaaagccgatactaattaccttaaactttacttagaacagaaaaaagaagaaattcataaagaaataaagaaattagaacaacttaataaacgaatagaactattaagggcagctattcattcatctgaagatgaacttatgaacaatggatttaatattcagacatttgaagacagatactttttaagtttacctacacaaggtggagaacttaataagataaagtcattcgataaattagatgaaaaattaggcgaatttgcagcccatacgtttcagtatggattaattttttcatgtcactatgataattgggaaatcagtgatgtatttcgtctaataacatcagatgattatagattacttaaagatacctctaatgtacctgaattacccaagggggaatatttaactgttaattgtacgagagatactgaaattgaaacatttcaattagtaaaagaatatttgaagaaaaacagtttgacgtgtaataaggtttatatgttttatttagtgacagatgtttttaatcaatataatcacttctcccaatttcaaataagtctaaagcccaccccataaatgaagtggactgacttttagcttaaagtttgtattcataaataaaatttgtattttcgagtttaccgataggtagattaaatacagttgctttttcatcaagacggacaaacccattatggtcatagaatccatagttacacattgtgtctgtatacagataaattttatttgcttttgtatctcttaagtaagagatgagctcattaaataatttttttcctaccttttttcctctagcttcttcagaaacagcaaagaattctaagcaaccctgaaactcattttcttttcctctaattaacttgctgtttgcctcattagtcatggaggtgagttcaacaaatacttttcgttctatgtcatttagatttaagagttgtagcaattcacttgtataatcttcttgtagcaatctataagatgttgcttcaccaactcttgaaccaaaaattacaccaatgacttctccatctaatgtagctactcttccaaaagtacttctgtttaatattggacttatgaacatcattgtaactgctgcatttatgatgctctcatcctcgataaaatcttttgcgttccaagtatctgcaataattgctttaataggttctatatcctcttttctaatgtctctaatatctaagttcattttgacttcctccttttaattgattagcttacaaattgagtttaatgtctcctctaatggggagagtcaagtatttattgcaatgctttttttcaactaaccgtttattgaataaaaaggctctccttatttcaggaaagccgccgtaagtatattaaaaaagaacaaaattctgccgatggttaataccacaagtcgatactcatcttgttaaaatatcttttttcattttattcccgtctttactcgctttacgggcatttgcgttgtctcatttggatgttataagctgtctcattcgataatttaattagtctccattgatgttataacccacattgtgcccattgttccatgtacaatccttcatttggggattctctccctgcaaaaacatcttttttttcctaaaaagcttattattgacaaggcgactgaaattgccataaaatagattttgtttgaaactgataatcattatcaatattatttccatcaaatcaaaccgatgaaagcacaaccaggagcgaacgccttcattcggtcggggaggattttcattgtttccgaaaggaattcataatctgcaaaaccgactcatcataagcaaagcaagagaaatgggaataacctgcgagccacttctcgcagaatgtgaagattttctagaattgtcctatggggacaagcgcagagtcattaataaaaccagatcgcatcgtctacccttgatcgctggactgctcgctaagaacaagcaggtatgtaatatgctactgcatgagcggggaatgcctgtgccgccgtttatcgttatcgaggcaatgggtgacaaggcagcgcagtttctgaaactgcatcgttccattgtagtgaagccgctggacgcaagcggcagtgcaggtgtgacactggacgttcgaacaaacgaggaactggaagcggctattgcccgggcgggtacccatagtaacagcatcatgctacagcaattcataacgggtttggattatagggtactgatcattaacggggaagtggcagcagtaaatgagtatcggcctgtctttgtagaaggggacggcacctcaaccatccgggcgttgattcgaatgttgaatcggcagcgaatccagcatacccgtatagggaagttcgaggcctttcccaagattgatgaagacgcagagcctttgcgaaaggttctgcttggacagggaatcacgctggaggaggtacctgcggcaggaagagagatcgagctatatgatcttcgcaattcggccgccggaaacattagtgagttttatgtggactgtacagaagcgatttttcctgataatgcacaaatggcaattaaagccgcagaagctctccagattgatgtggctggcattgatatccgttgtggggatatcggccagccgctgacagcagatcagggaggcattctggaagtcaacgcattgccggacctgacgcaccatgtctttccctttgggggaaccacacgtgatgtcgtccgattgtacctggaatatctttttcaaatggaacatcatttcgaaaagtcgattacagaataagggcaattcattgcctgttatggctcaatgtcccgcttactttgttctcgctcctatggtgtggtcggtacattcgaatgtgtgtgcccacccgccgcaagcggtggcatccatccagcattctgctgctggtcaccagtgcaggtctctggatgataggtctgctaaagacttgccggggtcggaacaccagcgaatatggcccgatgagcggcactgaaagaggttagtaggctctcggctgtgccatcctgttggccttgtccctcgttttatttataacccgaaagaaggttggcaacattgttcgagatggaaaacaggctcaggtctgaagcagagcagcaggcgaatgtacactcttgtaagttgctgctcaattgttatatccgggagcttgcggtggagaaggagggcgacattcggattaatccagatgcgatgacgtacgcagttgcttttcaggccagcggggtgacgataaccggacaattcgcgtattactcggctatgggtgagcatgagtaccgaagcatacaacagcttcacgggcaagcggtgcattatcaggacctggttcgctggatcacccgggagctgagtgaagacacggcgtatggaaacagtcggcatgagcaaggtgggttgacccgtgcggctgctgtgcgtgattttgcggaaaaggtagataacagcgtgaataatcttgtgctgtatatcgagcaggctgctggacttggcatgtatgattactgtacttccgaacagtctctggtgtatggacatccctttcacccgtttcccaaaaactccaaaggtttcactgaacacgacgtacggatgtacagcccggaactgcgtacctcgttccaactctgttacgttgctgtcaggaaggacgtatataggcaggaatgggtagatgatcccaccaggatcaatctgcatgccagcctgcacgggcatgtggaacaagtttgggaagcggagtacggtgagcatggggatgagtatgaactgctgcctgtccatccctggcagtatacgtacgtattgagcttgtccgaggtccagcagtatattctggacaagaaactcattccgataggcagctgtggaccgaaggcctatccgacctcctcggtacgcaccgtttatattccagagctgaattgcaatatcaagctgtcactgaacatacagattaccaacatgattcgcaccaatagtgcggagcagatgcgaaggacgctggacgcctccaggtacgtcaggcagcaaaattgcttcggtgcagatcagcatacgcagattgcctatgagacaggtgtagccacttgtgattttcaggaggaagaattaacaagtttgtttactgtcgcatacagaccgattgagtttgacccggaatgtacatatgtcctgtcgagtctggtagaagctcccttgccgggaatgcaatcacgactcatgacgatgctgggtggcgtacgtgctgaagccgagcgctggtttgcacgttatctgaccttgtctttgctgcccattgtacgagcggccggagagcgaggcattcactttgaagctcatttgcaaaatactctcgtgacgctaagagacggaatgcctgaggcatttatcgtgcgtgacttggaaggagtcagtgtcgatgaggagctgatccatgaggtggataccgctccctctagattgttgttttatccacgggacaaggcttgggcgaggacatcctattactttatcatcaatcatttgggttccctcattcatgcgatggcaagggatgtgaacataccggaggagcatttctgggcaaaggtccgcgaagtgctggtgaaggaactagaccgaactggaaacgtatatgtgcagcatttgctgaccgcggacagttttctggcgaaacaaaatctggtgagctgtctcaaggggatcagtcagaccccggcgtatgtgacggtgagcaatataatgaaccgaatagggagtgaagtggcgtggggttcatagggtacagggctgagaaaggtcacaagacggcagtatacacggatgtacaggaacggatcatgcggcagacgctggaagccatgtggttcgagggtatccttgactgtaaggtggatgggaacgaatggcgcactgtggggcggaatacgtcagggcaggctgtgacatacagctgtgaggcggagcagaaattttcatttggccgagtgaaggtggcgaagggctcgattcgaagagagggcgtgccctgcaccgatctggatctgtttctggaggaaatggtactgaaccttctggagggtgcgaatgtgacggccttcattcaggaattgctggagacgatggcgaaggacagccagtgccgggctttgctgcctgagaagattccggataaagaccgacactacgatgccctcgaaagccatatgagcgacggtcatctctaccatccaagctacaagtcgaggcttggcttcaccctaaaagacaatcttgcttacggtccagagtttaactcggatgtgaccgtatactggattgccgtgaaagaaggacttgtgcaaacggctctctccacaggctacacgtcagaacagttggtgagacaacatctcacagaggcggatatcagccgatttgatcggatgcttcagtcggaagattctgaggggtatcgctatatgttcattcctgttcatccatggcaatgggaacaccagctggaatcggtgtttgcccggcaacgaatgaacagagatatcgtttttctcggcccttcggcatcagcttatcgcgcccagcagtccattcgttccctgtcgaaccgaatgaatccagaagcgccttatctcaagctggcactgagtattaccaatacgtccagtacacgtattctcgcacaacacacgacccagaacgcaccgctgatcagcgactggttggaagcactgattcgggaggatgagttgctgcaacgggaacagtttgccattctgaaagaaatcatgggactctcgctccggtacgagaacttgcctgcaatccagtatggacgagcgtatggcacaatcggggcgatctggcgtgaaaatgtatctgttcatctgcaagaaggcgagacagcttggcccttaaatgcacttatgctagtacagtcgaacggggtaccgtttatccagggtgcagttgagcgtcatggcattcagaagtggagtgaagccctcgttcgaacggtatcgctacccattattcatctgctctatgcacacggcattgcgctggaatcgcatgcccagaatatcattctggtgctggaaaatgaactaccgaaacggatcatcatcaaggatcttcacgatggtgtccgctatgtacccgagaagttgctgaacccagaacgagccccgaagctgcaccccgaaccggagacccatcgcaagttcaatcggtattcctttatctacgcaagtgatgtgtcggaagtccgggactatacgtatgatgcgttcttttttatctgcatgacggatattgcgctgacgctggagaagttcggtctgacggaagaagcgttctggcaactgtgcgcggctacgattatggactaccagcgggagcatccagagtatgaggagcggttcgagtggtttgatctttttgccgaggatgcgctgattgaagagatgaccaagcgccgcctgtatggggacggagagctgtatttccgtaaggtcagcaatccgctgaagttggcgaaggacgttttcggatgagaaccaacacgcttaaggagaaaattgaacgtaaacagccagtgttcggcctttttgtctctatcccgcatccggtcatcatcgagatgattggacatgcggagtatgattttgtaattatcgacctggaacatgccgcaacgaatatggaatcggtggaagagctggttcgtgctgcggaactggcagggatgaccccgctggtacgcatctcaaaggtagagcgagcagagattctaaaggtattggattgcggcgcacaaggcatcgtcatacctcatgtggaacagcgggagcaggtggaggaagcggttcgtcatgcgtattatcatccgcttggcatgcggagtctgaacagtgggcgaccgggggtattcggcaagtatccactcaccgggtatattcaggaagcgaatgaacaggtgatggttgtaccgatgattgaaagtgtggagggcgtccggcaaagtgcgagcattctatctcatccccaggtgagctgggtactagagggggcggcagacctgtcgcaatcacttggcgtaccgtggcagacggaacatccagacgtgcaacgttcgctaggtgcattacatgaagccgcgaagcagtgccaggtaccgtatgcaacggtggccagaagcaaggaaggcatggcgctgtgggcggaacgaggggtatacatatacgtgttgggcgatgaccggaatacggcttttcgggcatacgaacagaaacggaatgactatggaaatgcgggtggactgatatgaaatcaagcgtatggaatatgatccatgaactgcaaagagatagtgaagacccggtgtgtgcttatgtctacgatctggctggtattcaggagcaggtccgtcacatgctgcacacgctgcctggaggcatacggttgttctatgccataaaggccaatcccgattctcgaattattgaggctttgctgccctgggttcacgggttcgaggtagcttccattggcgagttgctcaaggtgaggagcgtaagtagcgaggttccaatcctgtttggcggtccggggaaaaaagagaatgagttgaagcaggctatcgagcatcaggtgcgttttattcatgtggagagcctgctggaactgcggcgtgtcatcgccattgctacaaggagaggagaggaagttcgcattctgctgcggatcaatctgagaagtagcacattgccacggacccggattgtaatgggcggtggtccgagtccattcggcatggatgaggagagcgtggaggaagcagtccgggtcattcgtgaggaaggtgcaggttcggtgcgtttatgcggatttcattttcactcgttatcgaacaatgtggacgcaagactgcatgccgagatgatcgagctgtatttgcaaaaggcggagatgtggcagcagatatatgacctgcatcttgaagtaattaacgctggaggcgggtttggtgtcacatatgatggtagccctgggttcgactggtccctgttcacatccctgattgagcgaagtgaagctagagggcgccttgcttcacgcggcatacagttgtatttcgagccgggtcgcatgcttgtcgctgaccacggttattatgcggcagaggttacggatatcaaaacatcgcatggtcagcattttgccgtgttaagaggaggtacacatcataatcgtctgcccgcatcatggggacacaaccatccatttcacattatgtctacggaccgttgggggcattcgtttgcaagaccagaggtacgggacagcaaagttcacgtggtcggagaactatgcacacccaaggatcgtatgcattcagatgcggaagtagagcggctacgtgtaggcgatattattgtgttcgagaagtcgggagcctattgctggaccatctcgcatcatgattttctgggtcatccgcacccggcattccattatttgacggaggacgacaaccatgtcaacagtgatgaagcgtgccagtctgcaagacgctgagcgccggattatggaggatctgatcaatgcatttctggccgagcaattgcttccgctggaagggcatccgttcattgaactctctacttcaccagaaccgttccgccgaatgtttctgggggatggtaatggaggtcctccgcagagcggacgaggaatagctgacggactcgacggcaatgtcgcaggcaaggataagcaggatgagaatggaacaggtaggcatagtggacagcttatgctgcatctgaaagggattttgtttctggtggaagcaggaaaaaggcagggatatcaatgggtacaaggttcacctgtctatggagagacaccggatggaggctggaagcttcttgaatctccagcagtcgtaggacaggctgtgcttcggatgacgctttccgatgaagcatacgcgcatcccggggttgcggaattcttggcaggcgtggaaatagccaccgagcaattggcactgggactccagcaagtgcaagggctgggagaacaagttccgttcaatgcctacgattggtttatcaagggagagcaggttgcagcgctacgagatcgtccatttcaccccacctctaaggccaaggtgggattcacagaagcggatgtggcccggtatgcagcggaattcaggaaggagatcccgctgcgatgggtggcggtgcgttgggatgccgtacaacagggatgtgaggaagggctgtccacactggatgtactggatgaagaacagcggagcaggctggaagcagaattggcccggaaaggcctgaatctgcaagaatacatgcccatgccagtacatccatggcagatggagcatatcatcttgccgcgttttactggagaaatcgcggacggcaccctcattgtactggatatcgaattgggagaggtgcaggcgacatcgtccctgcgctcgatggctccgatggaggaatccacacagatgctcaagcttccggtcagtgtgttgtctctcggggccgcccgctatctcccggtggtgaagctgctgaatggtctggctggggagaagatgttacgacaggcggtggcctgtgatgaatcgctcacaggtaaagtgtggctctgcgaggaacggaactggtggggatacatgccggaatccatgggattgttcgatgatcatcctcgccatctggccgcccagattcgcatctatccgccaatgttgctggaagaaggtgtgcaggtcattcccatggctgcgcttggggtgacgctggaaggtcgccatatgttatccgacctgctgggcagagaattaaccagtgaagaggtcatgggattctacaccgatctgacggcgttattctatgatgtggtgatgcggctgttcaaggtaggcgttgtacccgaaattcacggtcagaactgctgcgtggtcctgcgggacggacaggtgaacggcctgttattccgtgaccacgattccgtacgtttgcatcagccgtatctggacaaacacggcattgcggacccgggttatcatattcggccaggatactcgaacagcttgtataatgagacgatccgcaagctgatcttctacgtgcagtcgctgggcacgcaggtgaatctggctgcaattatggaagcgctaagcgaggtgtatcctatcccggaagcgaagttatgggatattaccgagcaggcgtggaaggaagcgctacgggtggttccgcttcccgaagctgaccgggccgagctgttccaagcggtattcgagagcagggagtggccggtgaagctcattgtccgtccgttgctggaagcggacggtgtgcctggggcgatgccatcgggcaaaggcacagggcataatcctttttacaaaggatagagttgtggctagaatgttagtttagatagggtggcgatgacggaggtgacccggtgtaatcgggttgccttttttaggtaagagttcattgatagcagtgagtgcagtcacatagacacatacaaaaacatgactataatgaacacatagttaaaatttagtctttatggagctgatggctccaaacatctcatttacaaaggagagaattcatctcatgagcatacatttagaattggattccttgtccgttgaaaggctagaaatggccctttcaggacgaccgggaatgttcaagttgttttatgacaccgaggattgcggatgcaatggcgtacttgtcatcttggttgtcactacgccgaatgcaactgataaagtagttcagtctgagccttattctttttgggtagatcgccagcaggagcagcagttcgatagcagaatgcggcttgaggcagaccctagttacccgtcattcaagctaagcagtgatgccggtatatttagtagcaacattagaattaaagatgtccgcataaaatcgtctgaggagtgatatggaatggaaaaggataatagcgatgggtaaaccatccattcagaactagcaccaaactccaaaagacgaacctgatccagcccaattggaagaggttcgtcttttgcgttatatacaattcgttcctccaaaaaacgaagtgtttagtgggctgctctgaagtggtacaataacctttatgataatcggagaaggacgttgagaagatgaaaaacttgctcgtttcgggctatcgtgcccatgagctgaatattttcagtcagaagcacgaaggcattccatatattaaaaaggcgattgcaggcaggcttattcccctgattgaagaagggctggaatgggtgattacccccggtcaatacggggtggatttgtgggcctgtgaggtcgttactgcactaaaacagcaatatccccacctgaaatgctctattatgatggcttatcaaaatatggaggaaaaatggaaagaggacaaaaaggaatattttcagcagatttgtgccgaagttgactatgtgggagtagttagtcgtcagccctatcagggaatatggcaactcaaggcacgggatgaactccttttccgcaaaacagacggtttattgcttgtttacgatgaggatgccggagagggcagcccacgttttatgaaggaacttgcattgaaaaaacaacaggcagagagctatcagtatatcagcatcagctcggaggatatccagagtatcgcggatgaagaaagattattcatggacctctgatttttaaagcattagcccggatttttgaacaaaaaggacgtgctcgtccctttacattgatgtaagcgctatcataaaattaaacaacaataacttatcagtcacataaaataaatttattgaaaatacaaaccatgaaaggagctaatgattcagatgaacaaaaggtttcggtatgctgcgttgctctgtctcggtgtcatgttgagtggagtggtcaccccgatggatagccaggtctctgctgcctctacgaggcaaatggaaaagctaaaccgtggagtcgtcgctgttaaggtgcctgagggtgtactggtgagctggcgcttgctgggcacggaagcgggttcggtcggctttaatttgtacagagggacaagcaaggtaaacgatgcgccgattacatcgagaaccaactttttggacaaggcaggtacgacctcatcttcgtataccgttcgtgccgtggtcaatggagcagagcaggccgcttcccctgcggtgaaggtatggaacaacaactatctggatgttccgatccagcagcccgcgggaggcacaaccccggataatgtgaactacacgtaccacgccaatgatgccagcgtaggggatctcgatggagatggcgagtatgagattgtgttaaaatgggacccttccaatgccaaggataattcgcaatccggttatacgggaaatgtatttttggatggctacgagctggatggaacacgcaaatggcggatcgacctgggacgtaacatacgggctggagcccactacacacaatttctcgtctacgattttgatggagatggtaaagcagagatcgtatgtaaaacagcagacggcacggtagatggtgcaggtgtgaagattggtgacgcttcggctgatcatcgaaacacgagtggatatattttgaaaggtcccgagtttctaactgtgttctcaggtgatacaggcaaggctcttagtacgattgactatgtgccaccgcgcggaacggtatcgagctggggagataattatggtaaccgtgtagatcgttttctcgccggggttgcttatctggatggcgtgagacccagcattgtgatggcacgtggttattacacccgcaccgttctggtcgcatatgattggcggaacggcaacctgagccgacgctggacctttgacagcaacagctccaccaatgctggaacggctggacaggggaaccacagtttgagcgtggcggatgtggatggagatgataaggatgagatcgtgtatggctcactggttgtagacgataacggagcgaagctggctaacacggggatgggacatggagatgcacttcatgttggcgatctggaccccgaccgttcaggttatgaagtgttcaaggtgaacgaggacaaaaatgccacctatggagctgccatgtacgacccgcgtaatggaaatattttatggggcgtaaatacaggtaaggatactggaagaggcatgtcggcagacattgacccgcggaccaaagggaacgagcagtgggcaccgggtattggtttgtgttcagctaaggggcagctcattaccaacacgctaccgtcttccattaattttggcatctggtgggatggggatctcctccgtgaactgctggatcatacctcatcaagcgctggaaaaatagacaagtggaactatacgaactcgactacttccaacttgcttacggcaacaggaacgagttccaataacggaaccaaaggaacaccgtccttgcaggccgatctgttcggtgactggcgtgaggaagtcatttggcgcaaaagtgataattcggcgctgcgtatctacacaacaccatacgagtcagaacaccgattctacacgcttatgcatgatccagtgtatcgcctgagtgttgtttggcagaacgtagcttataatcagccgccgcacaccggattttatctgggagaagggatgtccaagccccagcagccgaatatatatactccttgatatgtcgttcggtagtggtctgaaggcaggtagaatgaacaaaaacagagagggctccaagctaattggagctctttttgtcatgacagcccacaagataatgtatgctttccataaaaaatgggaacattagttcttattgatggaacatatgtatgaaaaaggaggcggaatcggtgagttctttaacgactgaagccatgatcgagctcgtaactaatgtcggattccctgctgcattaagtctgatactgttaaaatacatccttgtcactttgagtcgcagattggaggagctggaccgatctgttaagcaactgtcgctatccttggaagagatggaggcaaagcagttgaaacagtcagaacaaccgtccccggcaaatacggacaaacttcgtgcagaatgaacaaaaaaaggcaaatagaaacaatttagcaacccaatcgagaagcgaaattcttataatagaaacgtgtgcagtttatgcagacatatgattatggaggtgtatatgagtatgaaaataaatacgaagctatccgcactatgcattgcggccacacttatgagcgtggcacaggccgctgctgccgcgcccgctgtgaccgctccagcggaagcgacgcagccgagcgttgccaatccggtcgcatccgctccgacccaggtgccagcacccgcagcgtctgcgtcggctacgacgccagccccggcgcaagcgccgtcggttccagcagcctcgaccccggctgcagccgcaggttctgccaaagccgcttcaccagtagctccgtctgcatcagcacagcgtccatctacatcagtagcacccgcggctgctccgaccgtaccgtcgactgcgaagccgtctaagccgcagcagccgtccacttcggcgccagccgctgcggctaccagcgtgaaaccgacgcagctggacaagctgaaccacgagagtgcgattccgcttgtgctggaggcacaatctcgttatcagtatgcggttagcggtggcagctcggtaggtgaggcgttccagttgaacggcaaaagctaccgctatctgtccgaggacatcggcacgaagaccaagctgatcagctatctaacgcaggcctacacaaagcaagcgagtgagcaatttgtcggtaaatttttcgttgaagtcaacggcagactagctcagttgaacgcagatggcggaaatttgctagagttcagccgggctacggcgaaaatggtaaccatgactccggtgaagcgcagctatctgctgaccgtgccttatccggcagaaaccaagcaggcgaatgcgaaaatcaccgtgaattttgaaaaggtcggcaactactggaaaatcagctccgcaccgcatgtcattttctaaattaagattttgcaacaggcttcatatggggtaaagtgatgttaaggcttgtttcgtaagccctaattcaatacaggggagtgctgtgcaatgatgacacccattaaggtaaaagacgttaaggatattgaaaaaatcaatcaaatcgtttcgaattatacctatgacatctggattcatggcaaaagcggcatggcagatgccaaatccattttaggcatgtatgtgctgaagctggatgaaccgctaactctggttgtacctgacaatgttaatcccaagaagctgttcaaggagttggaggaatttatccattttcctgctcaagaagaataaaaggcaagaaagcacctactctattactaaaataacgcaaagaagccgtggaaccctagtcccacggcttcttttttagtgttcttcctcgtccaaaaacgggagattcaccgaatagtacataacccccataagcaacacgccgccaaccagatttccgagcgtgaccggaacgagattatggatcacaccagcgacagaaaccgtacccggatgatccagcacgagcgcaatggcgaaagtacacatattagccacactatgctcatatcccgaaatgaaaaagcagaacacaaacagcatcatggcaaacatctttgcgccattttccttcataaacattggaacaaaaaaggcaagacagaccagccaattacataaaatagctcggaagaatagctgcattgcaggcgcttccattttatgctcaaccacactcagtagaaagctgttcacgctggaggagtcaaacagcccggtcaagtaaataaggagtgcaaatacccccgcacccagcaaattaccgccatagctggcagcccataatcgaagcacctgcccccagcgcagctttttacggagtgcagcataagtgtaatagaaggtgttacctgtaaacaaatccccgccgccgtaagcgatcagaatgatggccgctccgaacgtgagtgccgccatgggataagtgaatggagaatgctccatgtaaaaaaagttgcccgtcttgaaggctacaataacgccgaacccgatgaacatactcgccagcatggaacgtgccaaataccggagtaggctctgcttgtaaattttgtacttcttcatggctagctgttcgacattgcgtaagccttccgtctccatatttaaggacaacctcctattttctcatatgtaagtctttaaacagactttattttttccgaaacatgtccagtctatcagcaatcctgttagcttaacaaaccaagtttttgcagtccgtacaaaataccgtcttcatctgcgcgttttgtgaccattttagctgcggctttggcttcatcacagccgttgcccatcgcgacgctgttatgtatagctgtcagcatctccacatcatttaaaccatcgccaaaggcgtattgattttcatcggcaatgcccagtctggacgtaatttcgcggatgcccttcgctttggagccagaatgaggaacaacgtccacagaactcggatgccagcgcacaaagtcaaacgccttgaataccgcttcatagaaaggctcttcttctgctgtacacatcaacagcgtctgataaatatctcttccttggaaatagagcggatcgtatccaaccgaaatcttggccttcagcgtttggaccgatttctccacaagctcatcgttagggatattggccttcatgtccatatgatccatgtatacgagagcatgattatgtgtgagagccagatcggtcatcgcttgcaacgcttctctgttcagcggattggtagcgaccacttccccgcgaagcacgacatattgcccattaaagctaacgtaggaatcaatttctaactgctcgcgaatatctttgaacataaaaggcgcacggcctgttgcgatagccacctcatgtcccagctctttcaaagcaaagacggccttttctgccgttaacggcattttcttgtcatcgtccagtaacgtaccgtcgatatcaaaaaagataatttttttgtctgacatgtccatacacctgactttcaataatgtattgtcgaaatgaactcatatggattcattatatcaaaggaactgcttctgaatacacaaatacgtataaatcctcatgaatgtccgacctctatagcttacaatatgaaataaggattactgtaaaatataatttctatctcctattttcttagatgggatgtgatcaccatgacaaaaatccaagtcacaccggagcagctggacaacgtggcctcccaatttgccaatgcccacggcacactgtataaccagttaaacggcctggatagcacaatgaaccgccttcacagccagtgggatggtatggagaggaatcgtttttataatgactatcgtacggctaaatatacactttcttctgtattaaataaggttcaatccattgaaattgagctgaaaagcatcgcttcgaagtttagaaatgcggatggtgaaagcacacgtggcttctggacagccctagcagcggcaatgaacgctagcgcagcgctggcaggcagtggagaggctggagatcatggtggagaaattcccaagcagccaaaaaacatagacgaatgggatcaggcagacgcggataaataccatcaatatgaggaactactgaaaaacgccgaggccgtcggcgacaagcaagttatgcagaaaattcacgatcagatgaatgtcctgcagctgcaatatgaagactcggttacccgtacagattacaatacaggagagacctctaagatcacatcccattcccttgtcgctgtcaccgaactgacaggtaaagacggaagcaagacggatatatctatagataaaaaagggaatgttgtgagttacgagcaaaatacggataaatacgattactgggtccaaaagcatacccaatccgccggagagcacgctctaggtaaaacggcccagaccgtcaccggatatggaataggtcttattttgtcgcgcggggctggtgttagtggagcaggttcgggcctcggttctggcgcagcctccggctggggggaacacgtcgtcggcattggtggcggcatgctcagtgacaaagtacttttctctgtacccgatgagggcgaaacccggaccatgatctaccgaacggataaagaaacgggacatattgaaaatatggtcgttgtcaccaagggtgagaatgaaatggagtatcgctattgggaggattataactaggtcgtgagctgtgaacgatgataacgtgaataggagtatctataaaatctacagtctttttttctggaacaggtgagcggcagttggaaactgtcaactcgctagctggagaagtctgtagatttttttgtttaccaattttttcggagttggtgagaggcacagtgcttctgctaaatcggaaggctgtgcctttctatcaactctaccatttcacagacttgcaattggggtaccaaatgatggatgatagaagagagagttttatgtagaatatagggctaaagatagagaggataccaataataaatagatcggatttaccgtatttttgtatattattgtagaaaaagatcgtaattcaggttatagtaaaggaagaaattaactaggatgcctttacccaaatacgtaattgtggagggaaacatgagtacatttaaaaattggttgaatacaactaaaaaaggacttggagaccaagttaagaagttcaagaataaagattttatggaagctgttgttgcaggctgtgcattagtagcatttgctgacggtacgattagtccggaagagaaaacaaaaatggccggatacataaatatcagtgaagaattgaaagtatttgatatgggtgaggtcattaaccgtttcaatcactatgtagcgaactttgaattttcacctcaaatcggcaaacaggaagcactgaaggcgattggtaaattgaaaggcaagcctgaagtaggccgactcgttgttggcgtatgtagtgccattggtgcagctgacggtgactttgatgccaatgaacagcgaattgttgctgaaatttgtggcgcgcttggtttgaatccgtctgaatttagtctgtaaattttacggaagggaggtgtgttaatcagtggctgtaattaatctggtcaagggccagaaaattgatttgaccaaaggcaacacaggactaaccaaggttatagctggattgggatgggacccagtgcagtccaaaggattttttggcatcaagaagcaaccgaacattgattgtgatgcttctgccattttgctggacgcaaacgggaaactgactcagtcagataacgtagtgtgtttccataataaaaaaagcccatgcggctcagtcgttcattccggtgataatctgaccggacaaggcgacggtgatgatgaacaaattgcgattgacctggcacgtattcctgccaatgtcgacaaagtgcttgttgttgtgaatatatatgattgcgtaaaccggaaacaggatttcggcatgatcgagaaggcgtatatccgcattctggatggtgctaattccaaggagctggtgacgtttaatttatctgataattatgaagggctgaccgcactggtatgtggagaactctatcgtcataacaacgaatggaagtttgctgcaatcggtgaaggaacccatgccgtacatattgatgtgctggctcagcgttatatgtaattttagttactcatacaaaacttaatgtgaaaaggggttcttactcatggcaattaacttatccaaaggtcaaaaaattgatttgacgaaaacaaatccaggtttgtccaaaattatggttggtctcggttgggacacaaacaaatacgatggcggtaaagattttgacctggacgtatccgtatttttggctaatgcggaaggtaaagtagaatccgataagaactttgtcttttttaataatccacaaaatgagaacggttctgtcgttcatacaggggataaccgcacaggtgatggcgatggagatgacgagcaaattaaaattgatctgggcagcgtgccagctaacgtagaaaagatcgcttttacgattacaatctatgaagcacaagaacgcagccaaaactttggacaagtgtcccgtgcttacgctcgtatcgtaaacgaagcaaacaatgaagaattggtccgctttgatctgggagaagatttctcgatcgaaacaggcgttgttgtaggcgaactgtatcgtcatagcggtgagtggaagttcaatgccattggtagcggctaccaagatggtcttgcaggattgacgcgtgattacggtttggtataaaaaaatctatacaacgaaagcaggtatgcggaatgaccattagcctttccaaaggacaacgtattgatctgaccaaaacgaatcctggcttgactcgtgttgttgtaggtcttggatgggatacgaataaatatagtggtggcgcggactttgacctggatgcttcggctttcctactttatgaagacggtaaagccaaagctgcggatgattttgtattttacaacaacccgacaggcggagcaggatcggttactcatacgggcgataaccgcacaggggagggcgatggggatgacgagcaaatcatcgttgatttctcgaagattcctgcgaacatccaccgtatcgggatcacggttaccatttatgattacgaggcacgcgcgcaaaactttgggcaagtatccaatgcttttgtacgtgtggtagatgcggcaacggatcgtgaagtgctgcgctacgatttgggagaagatttctccaccgaaacggccgtcgtattctgtgaattttaccgtcagaatgcggactggaaattccaggctatcggtagtggctttgctggtggattgggtgcgcttgctaaaaactatggcttggacgctcaataatatccacttggggtggtgtccatagggcgctaccctttctttttaagctattacattagcgtacgctgacacatgacaaacggacagaaaggtgacacaatcatggctgttatcgtagtaaagggacagaaggccgatttgacgaaaacaaatcctggcctgacccatgtcaacgtagggattggctgggagtccccagcgtctttggaactggatacttcggcatttttgctgggtcctggaggaaaagtatcgggcgatgaggacttaattttttataacaatccgaccacgccctttatcacctattcagacggacaacagtccggtgacaaaaagcaatttgcccttgatctgacgcgaattcctgcaaacatcgagaagattgcgtttacgttgacgatttatgatgcggatcagaaacagcaaaattttggacaggttcaaggtgggttcattcgttttgctcatccggttagcggagaggttttgcggtttaatttggacagtggatttacagtggaaacggcgattgtcattggtgagctgtaccgccataacggggaatggaaattcaacgcgattggcgcaggtttttccggtggattggatgcgttgtgcgttaattttgggattgaagtggaaaataatccggctcctcctacgccagtgcctacacctcctccagcgcctcgaccagcaccaacgccgccaccagtaccacctgctccgaagccagagccatctgcaacaccagtgaatctgaatttgcgaaaaattgagctgaagaagaagggcgatactatcaacctgaaaaaaggctcaggcggattgggtgaaatcctgatcaatctgaactggaatcaggtgcagcaaagcaagggctttttcaatcgcggttccaagggtgtcgatctggatctcggctgcttgtatgagatgaagaacggagataaaggcgttgtgcaggcgctcggggaagttttcggttctctaaatcgcttcccgtacattgctctggatggcgacgaccgtacaggctctgtgaaaacaggggaaaatcttcgcattaatggtgctaaaatttctgaaattaagcgaattttggtgttcaccttcatctatgaaggagtcacgaactggtcacaagcggacggggtagtcacgctgtaccagaaggatgggccggacattatcgttcacatgaatgaacatgacaatcgcaaagggatgtgtgcaattgccatgattcaaaatgtaaacgatgaaacgttcagcattgaaagactcgtgcagttctatggcggtcatcgtgagttggatcgggcatataactggggcatgcgctggtcgcagggtagcaaataaattgaattatcggaggcactcttttcatgttgaatgatttgtttaaaaatatcagcgaaaactacggccatttcttttcatggagtgatgttgtagctacgcttactgatccagtgagttgggggattataggaactctcattttgctggaaggacttttatcggcggataacgccttggttctcgcagttatggttaaacacttacctaaggaacaacagaagagagccttattttacgggattttgggtgcgtatatattcaggttcttggctatcggtttgggtacattcctgattaagttcaccctgattaaggtactgggtgcggcttatctgctctatatcgcttataagggcttattcaagtccgaaggtgatggagaagtgaaaaacaaacctacttctttttggaaaaccgtattaatggtcgaactgatggatattgccttcagtattgacagcgtcattgccgctttcggtgtgagcgagaaagtatgggttctgttcctgggtggtattctcggcgttctgatgatgcgtggtgttgctcaagtgttcctcaagctcattgataaatttccggaactggaacagacagcctttattatgatcgccattatcgggggtaaaatgctggctgctgcttttggctttcatatgtcgcaggttttattcttcggcattttgattgctgtctttgtaggcacaatggttatcagctcggcgaaaagaaagaaaaaggccgacaaagaggcttaatgtacaaagtatagcgaaatccctcctgaaactaaggggggatttcttttatacccgaagcacagggcttcagtcaggcaagaaagagcaagaggaggggaagggccctgaaatattttaatgatttaacctctgaggaagtagaagcgatcttttatactccaccgttggagtttcataaccgttctcccaaaagtatactggcttatgcgataggagcagctttgtacatgcccgctacccgctcggaagtagcagaagagatcaaaaatggaaaacatgaagggctaacaacggtcattctggatctggaggatgctataggggatcagcaggtcggtcaggcagaacaatcgctgacacagcagctgcttcaactattgtcctatgtacggacggggatgatgagtgaacagcaattacctttgttatttgtgcgtgtgcgctctgtggagcagttggaacgactactgaacggtttgggtgaatctttgtcgctgctcacgggctttgttttacccaagttctcttcggttaatggacgagcgtattttgcactcattgctgaatataaccggaatatgcatacaggggcaggaagcgaaagcaacatgcctgtgctgtatggattaccgattcttgaaagctccaaaattatttatcgggaaacccgctggaatgagctactgtcgattaaagaaattttggacgagtaccaggaatatgtgctcaatgtacgaattggggcaactgatttctccagcctgtatggcttgagacgcagcccggatattacgatttatgaaattgccgtcattcgggattgcatcgcagatattattaacttgtttggacgcgtgggctcaaattatgtcatttccggtcctgtatgggaatatttctctcaccgagaacgtgtctttaaacctcaattaagagtgtctcctttcgaagatgcacttggaaagccgggacgacacttgcggatggacttcatctcagatgccgtagacggattgattcgagaagtcatgatggacaaagagaatgggattattggcaaaacgattattcatccctcccatattaaaccggtacaggccatgtatgcggtgacacatgaagagtatatggatgcacttgaaattgttgagcgtaacgacggtagtctgggtgtattcaaaagtacctatgccaacaaaatgaatgaaattaagccgcatttgaattgggctcatcgtattatcaatagatcaaaagtatacggggtgttacatgaacaacaacattttgtcagtctcttacccaaccacgaaaacacatctgctgccaattttggagcagttcagcgttaaaattacggagacacataatccattccgccttcctgtggagaagctgtttgcgatggcggcacgggtcaataaaaagcgttcgtttttatttgtcagcaaggtgctgggcaagcatattccggtaaacccatacacctctctgctcagtggtgcggcgctggcgattctactatataaggagcttgtcccacaagcgggacaacagatggatgaactgataggagaggccgtgagaggacttcttgacccggactatgcgaaagaggcctaccgaaagttgatggatgagcgtttagcttttgcttttacggagccgatcaagtttgttggttttgccgagacggctacagcactgggacacagcatgtatcggttgtttgacgacggagcctcgtatattcatacgacgcgcgaggatattccgggccttcggcctattattcggtttgaagaagagcattcgcacgctgttgatcatcgttgctatgcactggatgaagatgcttttgcgggagatggcccgattgtgctggtagatgatgaaattacgacgggaaaaacaacgcttaatatcatacgggatattcaggagcattttccgcgtaaacagtatgtgattgcttcgttattggattggcggacagacagcgacgagcaggctttcactgacctggaggcagagctaggcattacgattacgcctttaagcttgctcaaaggaaagattgaggtacagggtgtacccatcctggatcacgtagcctatgccggacaggctgggcacccagaacatgcagccactagcatggcagaggttaataaagacgcttctggagtaattgaccaccgttttgaaaaggatacttcaagttttgaacgggtagtacacagctccatgtcaacagacgggtatgccaatacagctccttatctaaaatatacaggccgttttggtctacaatccgctgacaattcagcattggatgcagaaatcacgcgtacagctgaacgactgaaccaacttcgttctgggcaacgcacgctggttatgggcacgggggaattcatgtacattccaatgcggattgcagcagagttaggcccggatgtgtattttcaatcgacgacacgcagcccggtgtatccccacagagaagaagggtatggcgtcgcttgtggggtgacatatccttcgcctgaggacagtacggtacgcaattttatttataatgtagaccccggccagtatgacgaaatattcgttttgatggaaagggagtcagacccagggcggatgaaacccatgcaggaagctttgacccgtctgggctgcgataaagtgcatgttgtttattttaatgggttaactagtcaggagagtaaaggagcgcggatatgaagcaagcacttatggagcaaatacagcagaagaacattcatccgcccgaaccgctgggcagttatcctgcctcggatgtcacttttttattgaaggatttgagccgggttacgttggaaaaagggacggaggatcgtgaagaggcgattcagtcgggagtccattattcagaaatgctgccagtggaatatgagccgacagcagagtatattgcattgtttcacgaaacgcttgcccaatctgccaaaaaggttgcattagcggcagcttctgtggctgagatgattgtgagaaaaagaggcctgaacacggcgattgtttctctggctagagcagggacgcccattggtatcctgatcaagcgttatattgactggaagtatagcgtatccttgccgcattacagcatttctattattcgtggcaaaggcattgaccggaatgcgattttatacattttacagcagcatgggctggggattgaacttcagtttgtcgatggctggacgggaaaaggggcgattcgccaggtattgattgaggcctgtcgtgagatgaacacggattacgggttgcatctaaatgatgatctggcggtgttggccgatccgggcagatgttcggagaccttcggtacacgagaagattatttgatcccaagtgcttgtctgaattcgactgtatccggtttgatgagtcggacggtattacgcgacgatctcataggccctgacgatttccatggagccaaattttatgaatcctggcggtcagtggatcagtctaatacgtttgtggatacgatatccgggtactttcaagacgtggctgaaacagcagttgcatatgcagaacaaatgacattgaatccgcctgcggtgacatggcagggcttacgggatatagaggcgattcagcaagcatttggtattcgggatatcaatctggtcaagcccggagtgggggagacgactcgtgtactgctgcgcagggtgccgtggaaaattctgattgaccgcgaagataatccgaatcttcagcatattatgctgctggccaaggaccgtggagtgcctgtagaggtatttgaaggattgacttattcctgctgcggaattatcaagccgctcaaggggggacaagaatgatctacgcaagtgatttggatcagacactgatttactccaaacgttcgcttggcgtaccactggagtcccctggtctgttgcctgcggaacagatagacggggcaacgtcggcttttatttctgaacaagccctgcaatggctaaagacactgcctgaagatgtgatgtttatgcccgtgacgactcggacgatagaacagtatagacgaatcaccgtgtttcagacggagttggttcccgcatatgccgtgacaagtaatggtggaaacatcatcgtcggaggcgaggtggatcgagagtggaatcggcgtattcatgaacaagtacgccgtgatggtgctcatgcggaagaagcacgtcaggtgttcggacaggtgctgcatgaagactgggtggtaaacgaacgcttttgcgacgagttattctatgctttcatgattgaacgggatcgtatgccgctggaacaggtgctggagaaggcgcgaatcatgcgtgaaatgggctgggaggtatccattcaaggtcgtaaggtgtatttggtacctgcggccgtgaataaacaagcagccgtggagcacatccgcaatctcacgaatggaggggccgtggttgcgtccggtgactctttgctagaccgttgtttgctggactatgccgattatgcgattgctccgcgtcatggtgaattgtatcgggaacagctgcgggataagctggaggtcaattaccgttttacagaagtgtcgggggtttatgcagcggacgaaatcatggcgtatgttcatgcaatacaccggagtgtgttcgcagctcaaacttcattttcagaatagataggggacgtggctctgtgaagaaggttaaggtgtattttaaccgctggttttcagtggcgtatcattatatgaatgctattcgtaacaatgaggacggtattccgttcgagatctatgcgacgcactctgatccgcagcacatggcgctacaggccagtgatatagctgaagtagagcctcgcatcagtggtgtggagtacacacggttttgcgctgatttttgcaggcggcacggaattgatgtctttatcccacggtggaatatgctcgatattagcaagcatctttatttgttcgatgatattgggacaaaagtaatggtatgccaagataccgaactgctggagcaactgatggaaaaggatctgttttatgaatccattcgtcaaaagaatattgtcacgattcccgactatgccattgccagcaatgccgagcagtttaaacaggcttatgagtcgttaatagcacttgggcataaggtatgcttcaagccttgtaatgcagaaggcgggatgggctttcgtatcattaacaatgaacgtaatccgctggaggagctgttcggccatgcgctgaatcatatttcgttcgaggaggcacatcgcgtattgtcatccacagaatcatttcccaatctgatggtgatggagctgctggagggatacgaatatagtattgactgcctagctgaccggaacggaaagctgctagcggcagttccgcgtaggaaggcaggaggacgattacggctgctggagcagcatcccgagctgttggaggtggcacagaaggtcgctgaggcgtatcacattccgtacaattataacattcaggtaaaatataacggcgagcatgccaagttgctagagatcaatccgcggatgtccggaggacttcatgtatcatgtttgtccggtattaattttccttatctagcggtgaaatcggctttgggtcatgagatcggttcacttcatccacaatacgacattttagccagtcatatcgagcagccaatcaccatacgtaaatccgtacattgacacacacaaatattgttttctacaatatggtaagggtttacgtcaggaggtacaagctatgacgtcaaaaatgtggggtgccacgattgctgtggttagctacctgattgcgcttttactaagtttttggttgccattgtttgtgtgtttggcgattccgatcattggtttgggaggatacagcgccatcatggctgttcgccatcctcgccccaatctgaccggttccgtgattccggtggtgcaggagcaggtcggtgagacacagcagcatgaaaaggaagctaccgttcgaccggagtctatgacaggacaagtacgtcaaccagatcaagtgagtagtgaatttgctcaggtgatggagtatttggaggtactggaggatatggtgatctccgagggacagaaggatgcgcttgataacgagattgtcgagaaggcgctggctctatttgcacgtttgcagcgggtcattccgcttttgcatgaactgaacaacagcgaagtgaatcatacggttcggagattgattttgaaggatttgaacggactgattaacccgtttcttcggctcagtggcgatgcgaagcggaccaaccggaggacgttattaaacggattacgggatgtagacagcaaaatatcggtaattgtgtccacggtggagcacaaggatctgctggaattacagagcaaagcggagcttattcaccagcgatatagcagttccgaattgtaggcgattttttgagaaaataaaaaaagtagcagaatagctgctctgaataacaacgattagacttgggtaacagttgttttcagaataggaggtagcgtatggcgaccccatgggctgaattgaaaaaagaagatgaacaaaaggtgactgaggaggcttcacagctgattcagaaggtatcacaaagcgatgtcatgagcctggataccttaatggatgatatcggtaagttgggggttaaagcgcaggaacgtgcggggcagactcttaaaatgctggatcgtccggtaaacgacctcatgtccggtgatcgggctgaggtatccaatatgatcttaaagctacgtgatgaatgcgaaacgctccagcagagcaaaaatatgagcttttttggcaagcttctgcgtaaaagcccgttaaaaaactacatttacaagtatcagtcggtgaagacgaacatcgagaaaatcattactgccttgagagatggtaaagataatctggaagaaaacatcgtcagcatgagacagttgaagaaggcttccattgaagaaatttacaatttacagacgaagattgcctttggtaatcgcttgaaagaactgtttgagaccgagattgctaagccggaaaatgaaaaccgtaagcctcatctggagcggggattgcgcaaggtggttactcgtacgcagtcaatgactgaaatgattttattatacaatcaggcgattgcggcaacagatattattaatgataacaatgataaactgattgattctgtaaataatgcgattgataaaacatcgaatctgatcactgtatcggctatgatcgcgatggcgctggcggatcaggataaaatcatttcagccgtcgatgcgaccaaccgtacgattgaagatcaattcaaggaaaatgcaaagcttctcaaaacgacgaccgagagaacgacagatctacttagcaagccttctatgtcactggaagctgtgaatcaggcgattggtgatttggtatctgctttggatctgtctgaaaaatcaaaccgtcggattattgaaagctgccatgattatacaagtaaaatgacagcaatcaatgccaacctcagccaacgtctggggatcgaagggaaagaaccatccaaaccgctgaaggatagcaattcttctgagggtctaagctcgtttttgaactaatgacaatgtagaataatagactcaatctatgaaaaagacgccaggatgactccgaaaggcgtctttttttggtttggcagcagctaataaaggacatgatgaacatacatagcattctcgtgcataaactcttaaaaagcgaatgacaaaaggagagagcgtatgatgtcctttattttgggctgtgtcattgtctatttacttgtggctgccagtagcgaaaaagcagattcaattgtggagttaaatgattctatgaaataaatttttttattgaaaatcatgcattttctgataggatagagttaaatattggaatcccaaaggagaatgcatgctggaattttcatttgaaatcatcgacgaatcgaaaatcaacattgtatatcagtatggaagcagtagcttcaattttaatttattttttaactacggtgtgtggacgctgcatccttttgacgggattctactgcagaacaaggaaatgtgccgtctgatcgttacggatctgtttaagaacaaagattttcatgtcatgctggcgcgcgaaaatattttattatcaaccttgcgtacctctattgatctcaatcccgaaactcggagagatcgatatcaggaacaggaatttgatgagctgtctgattttgctgagacacacagctttgaagaggtactgcaaatcgagcaggattccgtccgcgagcgtatagatttcttccaaaacatcattcaaaaaatgtatatggaaggattcggcccggaagacaatgattttaacaaggtacaagctattcttcgcatttataaggctgcacatgaccaactcggagaattgagcgactttcccctgagaggcgacgaacgacgcagatggtagactagacgggctagggtatacatcatagaggagcgtggggaacatgagcagtatttctataacaaaaaaaagtataaaaatcagattatctgcataaacactggatttacaaatgctattcaaagattagttaatccattttaccactaatttactacttttggatgagtcttgatacgacgaaatatcctagaaaagtgaagaacagtaaaagatacttccattacgaaaattgaatatgtaatagatggacacttcaaaattggggtgtctatttttgtgttcaccattaaaacaaaggaaaggagatttgtttcattgaatgaacaggaaatatacgaagataaggtaatggaatggattgacgatcattttgtactaaatgagattgaaattgaagaatatccattttttcttcatgggaaattaattcgtgataaaaaaggagaaacaatgattgtgttttggtgtgtgatttatggacgtgtcgattatcgttttcaagacacataaggagtgattgctcaagcagatgttttactctcgttccgctctctgctacctgtgtttctctattgatttataaggaaaattaaaaacaagaaaagaggtctgtattatggaattaaaatatgtcattcccaacatggaaaaaacatttggcaacttagaatatgcaggagaaggaaaggttgaacagcgacgaatcaatggtcgcatgacgacactatctcgcagttataatctgtattctgatattcaacgagcagatgatattgaggtcgttctccctaacgaagctggcgaaaaatttttcgagcatgaggatagaattaaattagttaatgcaaaaattatcgcagaaggctataaaattggggatcgtggttttacaaattatatcttacatgctgatgacatggtaaaaggataggaggaaaaaaatatgagattggcacaaggcattgttattgataaagctctgacatttggattattaaagttttccgccttacgaagagaagtttttcttcaaaatgaagatggtacggtgtcaacagaagtgaaagaacgaacctatgatttaaaatcaagggaacaaggacgcatgatacaagtaagcattcctgcttctgttccactaaaggattttgattataacgcagaagtagaattaattaatccagtggcagataccgtatctaccgcaacttttcgaggggcagacgtagactggtatataaaggctgacgatgttgtattgaaaggacaacaaaaaacctcctcaaaagccgaaaaaagagccactggaaaatgaaaaataggaatcacttatgaaaaaaatgcagcttattatcaaagaagtatcgaaagaagaagccatttgttttattcgacaatatcattactctaaaattatccctaagttgtataaatacttcttagggattttttcagaagaaaagctgttaggtgttgtggagttaggttggggtacacagcccttacaaaccatccgcaaactctttccaaacaccaacctgaaaacgaaagattatttagaggttggcaaaatgtgttttctacctgaaatgaatcaaaataattattttggcagtcgcactctttcggcaccgatgaagtggttgaaacaaacaacatatagatttatgtatacatgccttcgaaaacgatatatgcgaacaaaaaatctttacagatagtatgtctgttgatgaaattgtcgaaaccatttctaaaatgtctaacatagggcttgaaagcgataaaagaaaaaggctgaaaaagtggattgatagaacagcaatcacaattcgtcatattcggaaataatactatatttttaacggaggctataatgcaaaaagtagattgggtgttatgtcctgtttgtaataacaagacccgaattagggttcgcgatgatacgatacttgaaaacttcccactattttgcccaaagtgcaaacaggaaacactaatcaatattagacaattaaatgtgtcagttatcaaagagccagacgcaaagacgcagagccgataatttgaggttaatatatctcatattatcggctccttttataaacagtattgcgatagaagtttttctcattcctttatagtcggcttaaatttgcttcactaataatgcctttttctagaacagtagctttatcgccatactctttaattaaatgttttccgccccaatcacatagagaatctaaaattggctttaagctccagccgtactcacttaactcatattctactttgggaggaatttgattatagataatacgattaataataccgtcatcctctagttcacgtaattgctgcgtaagcattttctgagtaatttttggcataagccgttttaattcactagttcgtttcttcccacgtactaggtgggttaagattacacatttccatttaccgccaatgacttctaatgttgtctcgatggttatattgtaatttttttcttgcaatagaatcatctccttttataggtgctttaaagtacctatagtactttgaagtgtctatagtactttgaagtgtctatagtactttgaagtgtctatattactttaaagtgcgttcttccttttggtgaacctttctatcataataacatctataaatggaagttcccagcattcatttttcatttatttaattatagaaaatggaaaggaagatatatcatgtcacagaaagaaaaaaataaaaaagggagttttattacgttattggcactagctattaccgcttttgccatcggaacaacagaattcattagtgtggggcttctaccacttatatcagaagatttgaatgtccctattacaactgctgggttaactgtttcgctatatgctctcggaattacagtcggtgcaccaatccttacttcaatcacctcagggatgtctcgtaaaacgatactcacttgggtgatggttgtattcattattggaaatttagttgcaggactatccacaagtattggtatgttattaacagcacgaattatcacagcattttctcatggggtgtttatgtccatcggtacattaattgcagccgacttagtagcaccaaaccgtaaggcaggtgcgatttctattgtattagcaggtttgtccattgcgacagcaacaggcgtacctcttggaacattttttggacttcaattaggttggagaaccgcgttcatgtttatcgtcgtcatagggattattgctttagtagcaaacagtattcttgtaccatccaacatggcaaaaggtgaaaaagcgagtatgaaatctcaatttcaattgattacaaatccaagacttattttggtctttacaatctcaatattgggatacggtgggacatttgttgcgtttacttatttaacaccattactcactgatattacaggctatatgccagaaactgtcgtcattatcttaattatatacggaattgcgactgctattggaaatctcattggtgggaaattagccaatcaaaatcaaattaaagcattattttatatattcttggtgcaatctgtgattttacttgtcatgtactttaccattccatttaaagtggctggcttaatcactgtattatgcatggggctactggcttttatgagtatttcggggttgcaatcttatgtcatgatattagccgaacgctttgttccgtctgctgtaaatgttgcttcagcaattaatatagcagcttttcaagcaggaatagctttaggttcatacttaggcggcgtagttacggactcgattggacttgttcatacaacttggattggtgccgctatgattctttgtggtgttgttttatctgcatggggacgttctttggagagtaaagaaggcaggttaaaagcaacttaatatcttactactagagatttttattcatagatgtactaaccttgcttactagaacaaccttatatagaagatgtacttccatctttaaataaccaataagaagaaacagcaaatagtttagataactttgattaataaggataaaaataactgagacaacaagagtttacagtatgctaaatattagattcatctctattatgatagcttcgactggtacatgattcttgatgtctcagttaatcgttcagaatatactgatatacaatttcactcctaatatatttataatacttggagtggatttcaattaactattaagcattatatgtatgcaattacaatctttcttgcattatttatacgctttattaagaactggtattttgatattacgtcataaaagaatagtatggattgaaaaaattagttattcatttcattagatttcttaattccgtctgttaaagattctattaatattaagtctctttctgtaaagctatccatctgttcttctatccatctacgtcttgcacctttaactgtatttttattaggcaagaaaaactcatcaacagaaacatttaataacgatacaagatcgtataatacctgtatgctaggatgctgccctttattctcaatattcgttaaataacgggagtcaatttctatcaatgtgcccacctgttctcgggttaaaccttgtttttacgagcttcttttatcgcaagtccgaacgctctaaaatcatatttatcttcttttttacgcataataaatcacccctatacattttactgttcctgttaaacaagaaacaggtatagaaaaacgtataatgtggttaattaattcctgttatgaatattattcaaagaaaatttactggcagatagtttaaaaaaaccgttatctggcagtacccttttcatgcctttttaaaagtatatgtcattcccagacgatggtttaaatagctgtcgtctctttttttgtacagaattgatagctggtgtattaatcttcatttttcaaagagatgacggcttctaggaggtagtcgtcatgctacaatatattattcggcaacaatatttattattggagattttgtcaaaaaaggttattcacttatattggctaaaaatagtctaaaatgtggttttttaggacacataaggagaataagtaaaacacatgtacagattgaactatctgtttatgtgtttttttgtttacttaaaaagaatgcgcaactagtactgactaaaaagaatctaacaaatgtaactgcaagagttggattggtgctcgatatttcaggatctatgagaagcttgtacaaaaatggtactgttcaaaaggtgttggaacgaattgttgcagttgcgagttctttggatgatggtgtactggacgtatgggtgtatgatcaccgtttttcgcgtttgccgtccgttaccgaaaatgacgttgacaactatgttgaaaaacatattttgtccaatgattatttgcccaagttcggtcgtaatgatgagccacctgtgatgcgcgatgttatcgccaaatacaccaaggaagaaccctcttctgatctggtcaagaccccattttatagacactaaaaaaagaccctaggctataagctgcttccgatactctttcggaggcagcttatttaactttcgttgtggtcgacattggttgtaaaattggatatattcttttattctcctttgtgcctcgtccatatttcggatatcataggggtagagcccttccgttttgagatgcgagaagaagctctccatcgaggcattatcataacaattgcctcggcgagacatgctgattcgggcgccaacctttggaagcatgtcgtggtacgcatgggacgtgtactggaatccctggtcgctgtgaacgatgaggccagtcacgtctttttgctgtttaaaggcttgtcgaaacgtctgt

SEQ ID NO: 2625 - DNA, 334779 bp, Unknown
  Kingdom: Bacteria, Phylum: Firmicutes, Class: Bacilli, Order: Bacillales, Family: Paenibacillaceae, Genus: Paenibacillus
acaaacgggggtcagtcccaccataagagggtcggctcttttattattcttgcatctctgaaggttccacgattaaggatacaaccttgcctgcatttacatcaatcaggccgtgatcggtaatcttcaaggccgggctgaccggcaaagaatgcgtactcagtgacatgattggattgtaatgacggtagcccagcgacagcaaggctgaacgaagctccttcacatgggctgcaaccatttccagcggtccttctgttaaaatcccgcctacggttaacggcaaatgggacagcaccttgccattttcaactacgcaaaagccgccttggctggatagaaccgtattcgcagccagtatcatatcttgcttgttatgccctacgaccagcaagttatggttatcgtgcgaataggtggttgccactgccccacgtttaatcgtatctcccccgatcaaaccgtaagcacggttgccattctttccataccgttcaaacgtagcgatgagtccatgttcaccatgttcccataccagttcaccctgctccacatgtgcaggtgcaatccgttcgctcgtaaaagttgagccatccttgaccatcataatacgacattgatgtgtgccatcagctacatccatctttaccgtaaaatcctgctccgtgagcggattgagcttcacactttgataaaaatgggcggggaagcggctttttatcggtgcttgatggtattcctcgaacttatcgaataccttgagtccgtccttatagacttgctccacatcaaattgaccaagatcggacagcagtacaaagtcagctatttttcctggtgcaattgttccgcggtcatgcattcgcatccgtgcagcaggagtaaacgtagctgcataaatagcatcctcaggcttcatgcccattccgattgctttacttacaatatggttcagatgccctcgctctacgaaagagtctggcatgacatcatccgttacgaagcaaaaatgctgtgccacatcttcctgaataagatagtccatcacttcaggggtcatggacttttcttggatttcaataaacattccggcagccatccgcgccttcataccttcaatactttggtgagtatggtccgagcctattcccgcatagatcaactgatgcaggtccagatcaagcagctgcggcgtatggccttcaatgatcagctccgggtagtgctcacgaacatggcgtaagatgcgattcgtcttgctctccggatcacgaatgacatccacatagttcataatttcacccaggcagatcatttcgccggtttgcagtagcgcatcaatctcgggaataccaatctcgccccctgaggtttcgagcggcgttgccgggacagagcttggaatgccgtagaacatatcagccacgcaatctttgctggcttccatcatttcctggatgccttccaatccgaaaacattcgccatttcgtgcggttccggtacaatcgtcgttaccccattgcgaatcagcccataggaaaaggttgccggtgtcaccatggtactttcgatatgcaaatggatgtcgatcaggccgggaatcatatatttcccgtgcccttcgacaatttcagcagcctcgaaagactccagaccacgctgaccgatatacataaacttaccgccaagtatagctacattaccttcttcgaacgtcttgtagtaactgttatacaccttaacttgtaaaatcattttgtctgcacgcatgatgtatctccttcatcgaacccgctgattattggaccagcaccattttatctgccggaaaatgtagggtaacccgctgaccactcaggtaaggcgtatccatttcctgattagccgtaaagttgcctttcgccgtttctaccacatactgatagctacgccccaggtaagtacttactttaataataccgggaagctcattttcccctgtctcgttgccttctgttcgaatgaccaaatcatccgggcgaatagcgccctgacgagcacccggttgggcagtaccctgattacgcgctacgccgaacgaaagatcgcctgtattcagtcgaatacgatccccttcatcagtacgctcgtcaaagcttagaaaattattaaacccaataaaacgggcgacaaattcggtcgtcggatatttaaaaatggtcgatggagcatctaattgttcgatgttccccttattcataatcgcaacctggtcagaaatcgaaaaacattcctcctgatcatgcgatacatacacagtagtgatgcccagttcctgttgaatacggcggatttccacacgcatatttacacgcaggttagcatccaagttactcagaggttcatcaaacaacagcagatcgggttcaatcacaagcgctcgcgcaatcgcaacacgttgacgctgtccacctgacaattcaccggggaaacgtttttcgaatccccccaggctaaccgtatccagcatggtcataacgcgacgtttcacatcatcttcctttaccttacgtaaccgcagaccaaaggcaacattatcaaaaacggacaaatgcgggaagagtgcataactttggaatacaaagccgaagttccgtttattcaccggaacccgagtataatccttatcgccaaacaaaaatgttccttgtttagcttcgagaaatcctgcaatgagacgaagtgtggtcgttttgccacaaccactcggtccgagcaacgagagcaattgcccccgttcgagctgcaaatcgaaattctgcaagatcagttggttgtcataagcgaccgatacgcgatccagagtaagcagtgccataaggttgaagcctccattaccttttagtgaagtaagacaatcccatcagtcgttcaatcaagaacatcagaataccggtcaaaatcatcagcataaccgaaatcgctgcaatcgtcgggtcaaaataattttcgacgtaagtcagcatttgaatgggcagggtgctgaagcccggtcctgtcatgaagacggagatgtcgacattgttgaatgattccagaaaggcaatcaggatagccgcaataatacctgagcggatgttgggcagaaccaccttgaaaaaggtttccagccgtccagcccccaaactaagcgctgcttcctcaatcgcaaaatcaaagttagacaaactggatgcaatgactctaataatgaacggcaacataatcaccgtatgtccgatcaatagtccagcatatactggtaaatggtaaacaatgatcaaatagcgcagcagtgtaaaaccaagaacgatacccggtataagcaacggggaaaggaacaaagcattcagcgcatccttcccgcgaaacgaaaagcgactaagtgcataggcggcaggcataccgatcagcagtgccaagatgttgcctagcagagagacgacaatggacgttttgaacgtggacataaacaaatccacttcaaaaatattttcataccagcgcaaagaaaagccctgcggaggaaattttaataccgtgcccggctcgaaagaagtgaccgatatgatcaacagcggaccgagcagaaagatgaagaccagcaggctaaagaagcctagtccgtaatgtttctcccgcatatccacctaccccttcggattgagtttatgggccgccttatttaagagaccgaccacgataaatgtaataacaatcataattgttgcaataacagaagctaaaaaccagtcgtttagcgtcatcgcgttctgatacaaaaatgtagcgataacccgctgttttcctccaagtagtgctggtgtcgtatatgcagtcaggctgcctacgaaaacgagaatgcttccaatgatcaggcccggcacagacagcggaaatacgattttacgaaatgcgctgaatctggaagccccgaggctctgagcagcatgaacaagatcaccgtcgatattttcgagcacaccaatcagtgaaataatcatcagtggtaaaaacaaatgaaccagaccaataatcatcgctgccggggtgtacaaaatattcagcggttcatctacaagtcctaaaccgatgagcacgttatttaacagccccttgcgacccagaatgaccatccagctgaatgaccgcaccactggactcgtcaataagggaaagatagccagcgcaagcaaaatacctttacgacgcggggccttttgcgaaatataataagccgtcgggaagccgagtaatacgcacacgagtgtcgttacgacactgacttccagcgtagtcagcaatattttcagaaaataagggtccttgaagaaatggagatagccttctagggtgaatgagctgttctgtacgaaggtcgaaccgatcgtcaacacaatcggaatgaccatgaacaccgccagaaagagcagacctggcagcagcagccaatacaagtatgttttcttcatgggtagctccttgcggttatcgaaatgttattccttattcagcacctggatgaacagctccagaaaagctttgctgtccacctgttcgcacacattcatattggggctatgattgaggcggttctgcacatcgcccaccgtttgtccgtcacatatgcgactggaggtttccacgtcgacatacaacgacgaggtatctactaacctcgaattcaatgcgacacccacggcaagcgggtcatgaagcgcacacgcttttaccccgttgcgttcttcataacgcttggtataaacggccgtactttcagctacataattacgaattgtaggatgggacagacgagcaatatgatcggcagtcagcagagccttccgtgttacatccagtcccacctgtatcaaccggccaaatcctgcatgaaatacgatccgtgcggcttcagggtcagcatacatgttgtactccgctacaggtgtaatattgccgcacccgtgaataacaccgcccataaaaatgacctcatcgacgtgatccgtcagttcgggacacttcagcagcgccagtgccaaattggtgagcggaccggtacaaatgagcgtcacttccccccggtgagccatcacggtatcaatgatgatatccggcgcaaaaccttcggatgcagacatcgctgggactactccactcaatgcacctccaatgccgtcttctccatggacacggtgctcgtgcagacctttacgtattaagggagcctccgccccccgataaaccggaatatccggtctatccaaaaggtcgaggattttgcatgtgttcaatgtcgcttgtttaagtgagacattaccgcatactgtagtaatcgcttggatatccaactgaccacttttggcggccagtaaaatccccaacgcatcatcaatgcccgtatctacatctaatataacctttttcattactgtgctacttcccggttccagcgatctgtccatgccttgatatgatcattaacgaacttcatatccagcttggtcaacttattcactacatctgtaccgtacgtaattccttctgtatccgcaccggacagtaccacctgcgtgttcaccggagaatcaactttcgccttggcggatttttcttgaacttccttgctcagctgccagttgataaattcctcagccagctccttctggtcggagcctttcactacattaatcgtgttcatgactgcgtaagcaccttcactaggagctacaaatttcgctcctggcacagccgcctgcaaatctttgaagtacatttccatgatcggaccgcccgcaatttcttgttgactaaacatgtttacaaactcggacgttttgctataaaacttaacgatattcggactcagctctttcagttttccgaaggcttggtcttcattaaactccttactacccgctaccttggaggctgcatctaccatcatcggtccggcagtcgccgtaatattcggcaaagtcacgtttcctttgaactcagttccccacaggtcagcccaagaggtcacattctttttcaccagctccggattataggcaataccgagacgcccgaccgtataagcaggaccatactcctcacccagcggcgctttggcaatatcataaatttggttcaggttcggcaccttgctgcgatccagcttctcaaacaatccctgttggattccctgttgagcataataatcagacagataaatcagatcgacatctgtgctgccttgactgattttgttcaaccgttccgcgttatttccaatttcgactacaatgtcaacgttatgttctttttcaaaaggctcgtacacttctttgttaaaaaaatcctcggaaaagccccatgtggaaataactagtttctttttcccatcagctgaaccatcttttccatctgtctgaccgccagtagcattgctgccgcaacctgccagtaccacggatgccaaggtcacagccataaaccctttaaaccattttttcatatgaaactccccctatttttttattatgcacaccttatgacacaaaaaagaaaagtactcttgtaatacaagaatacttttcttcgtaaacaaagaataagttgatcccgctgcgcgttataacaggttctcccctcagatagatccgaagcgaaaagccgaatatccaattttattaggattctttcagtatgatgttcgtaattgcccactgcgttgctgaatcataatcacgcagtaaagcttctatatcgagctccatatcctcaatcagcttctcgcgaagtctcttcttgtacagcatggacattcggaaatccacttccagcttcaagccgggggcttccacttccaatgccgccgagcgtggagaacgccggtgcttcgccacaaaggtaacaatgttgttctcaacggtggcccgcagtagcgtggtcccgaagccgaacagttcctttgaaacttcattgtaaatctggcacatccgcttcttgctttcgttactgtcgagcagcgtcatgaacccaccctcatcagcatattacgtacaatcaatctttcaacacgatagattatacataaatatacgataaatagcaaacaaaaatccctaatctaataacatatgatgcgaaaaagcgaacaatatgtcgaactttgtagcttttcaacatttttacactttttcgtctaccccttaagttttcgaacactgctatattccccgcaggaaaattaaagtagactacaaagtcgttatcgtcaccactctgggagaatatttttttctactactatatatgtagtttttatttaaaagcatttaaccgtaccccgcgggagtcccctagcgattgtacggtttttttatgttatgtagctgactggcagatgggaaccccttcaagaaaaagccgattgaatccacgaggacactacaagagtagctggccacagcagcataaagttagctatgatatacgccttcttaaaagcataacgatgataaaaataccaacagctccatgaaataaatactcctatcgggtagctcattatgacataggcaaaaatataactgatgagataatctccagctgttggtgcatcgaaagaaaatacgaccaccatcagcatggccggataggcaaatagcgttaagccataaacgatattcaatataagtaaaatgacaaatgcattttgatctttcatgatgttctcctaactattgcagtccgcctgtatcaccattgtgcagcccgtttgcgtctctcctcacgccgatcagcttcttccattttgcgaatataacgtttcaactgctctttatgatcgtccaattcctgtattcgtacagttgtaccttggagaaacgtctccattttacgtgttaattcagcagccgattcgcccctccagtcttgcagacgaccatatatattcctcatctgctgctcctgatgctgaagtctttgctttagctgctcgcactgctgtacagccctacgcagatcccccaggctcaaagatattctactcatctcttttgcctcccgttgtgttcttccagctgctctttttattgatccaccatcgtaaattcctggcccttgcgatcgatatactctgctatctctgtaatcgattcctgataccagcgattgatccgatccagtgttgccgttgcactatgcgcaattggggtcaaagactgactttcacttgtcccgatatgagcctgaaataactggatggatgctcgggtatcgctagaaaatccatgcaggctggaacgcatctggttagccgcatgctttagctcctcaggtgttaattgaattgtgcccccatttttgttgcctacaaaatatgcaccgccattggagcgaccattctgttgtcctactccaaggatattcactcccagtgcattagcagcaaactgcccgaaggcccccatttgtccaccatagcgttcaaccagatcgcccatgacttccttgagctctgctcgcgcggccagcatctgctcgtatgcctgcacccgtggattgccttccaccaattgaccgtccatggtgtacagtggattgctgatattgccattttcatcaaatgtgaaatgatccatgctatgcgtcgcttctccaaataccgaattatagaactttgtaatcggatcttgctgtatcataggcaacgtaatcgggacatacacaatgggagaccatttgggccccagaaaaaagttagcccacttattttctctttcgactggtaatgaaacaggaatagtgattttggctttattagccgtcttataatcattgtctataaagtaggttgtacccacatgtggctgtgcatcattagctcccgaaccgatagtatccttcgggttgacataagcgacattcgtctttcgaaaatcgccattttccaccttcttttgaagatcatccggtaataggtgtacaatgcttggtggattataagcgactgatgtcagtccgttccgcaccgccacatattctgcctccgctcctcccagagaatgacctgtggtcgttatttcagcagagggatactctttttttacaacatcatatagattctcagcttgtgtaaattgattattctggtacttctcctcatattgaagaaatgcgctttgcacttgtggtgggagtttagccacctctgccttattattttcataatattgatggacttcttccaacgttttcgcgcgtcctccgacgacatcgttgaaatccgttccccagtccatcgccacgctccacttgggtcgattcggaggttctgtccccctataaccgatgatcacctgattggtcttttcgttaaggaatacagtcgcatcgaatccagaaccattcgtatcatgcagcatagctccttcaggttcaacaatcttccagtcaggaagaattctgcttttagaatctttggcagtcaactctcggtcataaactctatccgcaatggtccagtatgttttatcgttaatgtaggtcaagttattcccaccttgtctattgtgtaaatatattatagagttatgaaaaaaggtgattaccagaaaaggagaattgtaacttgaacagaaaaatcccactgattctggcacttattttaattattatgtatttaggaggttgttccagcttgtccgacaaagagaaaaaagaattagtagacgtcgccactcccatcggtgtggagtttattaaagaacactataatgccgatttcatattaaaggattatgctgtggatgatcctgctgtccactccaggctttatttgtatgggtacattaaaggccacgaagacaacaaaattaccatctactataattataaaaccaaagaagtgattgacgtctccgggccagattggtttatcgacagtgaagtccccaaatacaagaccccttcttcctgagaagggatactcatcgagcatttcactttcaacatatttgttatctatgttaaagtctaatttttcccaaattaagaagtagtataattatagtgcatcctttttgcgagcgatatagccgagaggaaaaataagtataaagtcattggatacagtatatctggtcacattaaatggtttatgtagaataggtctttataactgtatgttagaagagattttcgtatatgaacacaataatgtttctgagtatataaaaggagatactaaggagaaaaattcaacttgaagaaggaaaaggtttggggaagcctctttatagtcgtttcaatccttgtaggagtcttttattacatgcaatatacggaggatgtacaaaaagaagagtacgtccaatccggcatacctatcgggcaagactatattagaaaatactacaatgctgaatttatataccaaaataacgactttattggtagttacgttaactctaccgtatatctccgtggctacataaaagggcatgaaggccagataatctcaataaattacgactataagaaaagagaggtgctctacgtgactggaccggaatggttcatcgatagtcgggtatccaagaaggacgtatctgttccctaaagtaagattcagtaaacaaattggctcttactcttccattctcaggaagtagaatcattataatgtattatatttatttcgaataacaatcgaaacaggaatgagaacgaagccggagaggattgtatttttggtgatagttcttacctgaggattttgcaaaaatccaataagcgacttccaacaaacaatatatagatcgaaatgatctagttcgtctatatattgcatcttggagcgattggaatcgaattttgcaaaatcctgacctaataacgattaggactttatagctgtatgttaagagaagattacgtaaatgaacataccttttaagttgtgtctaatatttctatgacgccgcttattctgacaggattcggtttctcagtacctcaagaaaaagaattatagatgagggtgctccttattcctaaaaaagcgtgtagcatatccactccccatctaaggagaataattcaacttgaaaaagaaacaattatggctttttgtctttatattacttgtcattctggtaggagtcttctattacatgcagtacgaatctaatgcaaaaaaagaagaaatcgttcgaacaggcatacctattggaaaagagtacatcaagaaatactatagggcagatttcatatttaagagttatgactatataggtagctatgttaataacacggttcatctaatcggttatataaaagggcatgaaggccaatcgatatctatcgcttacgattttaaaaagaaagaagtgcttagtgtaaccggacctgcttggttcattgacagccactatcccaaaaagattatctctccattctaaagtcaagtccagcatccaaataatcagccctctagcagatgattttttcctaaatatgaggaaatagtatcattataatacttcctgttactgagagatatttgcaacaaaaataagaaccaattcattgttcactgcattctggttgtagttcacattaaattataaatagcatgttaggggaatgttgcgtaaatgaacacaatccttaaatgttgcacagtcctcatcataatattaaccattctgggcggttgtggtttttctaccgctcaagaggaagagatagtggagtctgctactactgtcagtatcaaatatattaaaactcactataatacggatttcgtattaaaaaattacaatattgaagaaaacagtgtctttgcaagagtacatctttacggctatataaaaggaaacgatacagacttaattaggatatcctatgacttggactcaaaagaaatcgtcaatgttacgggaccggattggtttattgatagtaaggttatagataagaatgcaccttattcctaagaaagcgtatagcatatttagctaaattttaaggagaatacttcaacttgaaaaagaaacaactatggctttttgtctttatatcacttgtcattctggtaggagttttctattacatgcagtacgcatcgaatgccaaaaaagaagaaatcgttcggacaggcatacctattggaaaagagtacattaaggaatactatagggccgattttgtttaccaaaataacgagtttattggcagttacgttaactctaccgtatatctccgtggctatataaaagggcatgaaggccaaatcatatctattgcttatgattataaaaagaaagcagtgcttagtgtgagcggacctgcttggttcatcgacagtaggaatcctaaaaggaattcagaatattgaactatgattgcagaaaaggctccctaggagccttttctagtcatcattagtcatatttaacgctcttcacctttggtactatgcttagttacatgaataaaaggatattcgcctttgcttattttacgtttccattcttgaatcatatcctcttgggtaggcggtttctcattcacgattgctcctgtagttactttagccatattctttaccctctcacgatggattagttattgcgtctttatcttttctccagtcattttgatgttaccatccatttcgaccaaactcgttttacattttaaaccgatagcatccttcgcggtgacctgtattgtgttacccgcattgaatactaagtttccatcagccttaacacgtatgtcctttttactccgcagttcaattccatggtcatccagcagtcgaatcaccacttcatcgtcattccccgtgattaaaatttcatttttctcaaatataatggctttgcggtacttggtcataaagatcttcgtcgatgggtccttaataaagtcgccccctttggatcttttgcggatcgagtgagttacaatggcgtctttttctttagcggttggaaagtagatatctacaaagtcaaacagctccggcatgcagtaccatcccgtattcccttccgatgtataaaatgtagccgttggaaaagcgcaggtttccttgacgttaggcttgaccttatccatttcataaaagaaaacattcacatggtcctgctcgattccaataaccttcgattttaacgagatgccacgaatactctcatttacaatcaaatcctgtttcattccatccgatgtggtcagcacatattcatgccacaagacactatggcgtataaacgcaacagactgcaggacgtataaggttttccctttgaatttgacctctgcgccaatatgcagcagaacatctttggcccctgtcgtttgtattttgtaatacaaaaggttgtcttccttgctggcccctggcttggtttttctggtcatcgagtagttatactgtttgagctcaccttgattgacaccatccggtaatccaaaataaaactgaggtttttcaccaatcggatcaggtattagtccccaaccaagccgagacgctatacgttttagaaatgaccagtccgtttcgtcgaattgcatcgtaaattcctgtagaagctgatcttttaagcggctcgtacaattcgctttgggatatgatttgagtacatgttcaagcaatgcctgcaccttcatcttcacattttgaaaggattgtctatgaggtatttcatccatctggcatgtataagatagagcttcgacaaccaaatgagctacattggataccatcttgattctgaactgcgtgactggccctcgaaatagcacactctggttatgatcgtcattcatataagaaacaactaacttcgcccctgcttccatatgatctgtatattcttccatttgagcacccgttaacacacctgtcaaaaagaccttcacatgctcattcattttctgtacaactttaacttttggatttttaagagataaaactgttccattatacttgatgattggatatcccatgttaccgctcctctatgtcggttagtttacgtttatccgttgtttgcttacgtattgaatgacagctttaatggtttgattatgcccctgatcgttaagagcctcatctaatgcagagagcgtggtaaaggttttatttttcttttgaaaatatatgtctgctatagggaattggtcaactctaccaggtccatgaatcccgttgtcaacatcggcaatgatgataacatccttcaatccatccttattgacatccttgaaggccactgcttctactcctccgtaacgtgcaacccactcacggttcccgtagaaatccaggaatggatacagaatatgtccttggtcatccaataggaagaaaaagaatttacgaaaaccttccgtatacccatatgtcgatacaaaccgtactttcccaaagccttcgaaagtagtttgaaaagactgcgactcttcaatttcatattggtcagtattcaacttttcaccgccaactgtggaaacagactgatcctcaacggaacttaactcactccatagttcctcattttgcctattattctctggaatttgtgcaaaacgaatttcatactccgcatggtcccctactacatgtgccataggtacactcatccccaaggaatcatttgtgaaataactaaacgattccatttctacttccgcaagcgaacctttggttacatccgcattagttaacaattgaatcaaatcatcttttgtgaaatcaccgattaatccttgttgctccggctgaacagctgtaatcttcccgctttttataagctcaataaaaggtttctcgacctttaccaaatccctcaatcttattcttgaagcctgcttcatatctaggttcgtcgtataaaacatatgagtaggataggctgcatctttcacataatgaatacccgtatattgaacactcaagaatcgttcactttgtcgtttgatctcataatcaatttcgacatggactccagaattggaatccgcatagttttgtaatccttctaaagcatcagtcttaagaatttggtttaaagatttttgctttgcaatatccttgagttttgtaatttgagggtatttaatcaccatcccattttttgaatattcctcttgaatgagttcatagctttgccgttcactatgagtattcaaggtggtgctatattcagaatcaatacggacttctccacttttggagaactcaatgataaggttttgttcagaatcatcactgtttattaagaaaccatcgccgtggtctaaaactccgatactcatgctatcatgttgtcgattctcaaacatgataggcttattcatatccttgttcagttcccacgcatccggaagcttcatcttacctacatttatgcttttctccgtccacttttgtccagacaactcccacaaatccacaaatacagggtctgggtgatatatggagacatgtccccctaaccacaactgtattccttggtctgaatctcgaaccacaaagtctgtagtcaactctgacccgccattctgaatcatctgggcgtgtacaagttgcttcttactccaccactgaataaatgtgtatttatccccgatcgtacctgtcaccgttttaggtgctctataattcataaccctaacgtttagctgccaactttttaacggaaacgattttgttaagatagtgagattgttatcgaacttttctactaattcttcatccttcatctctacactttcaggctcgtttaacaacgaattaagttcctgtgtgaactcctcaagcttattttgtctggtatcagaatccttattttcatcgttgactatatggagttttttcactagcgtgtccagctttttcgaataggaaatcgttttatcgtcattttggagagatagtgcatgatttgtttcagttgctggagaatcctgtcccttcatgcacccattcagcactacaaaggaaatgagtagtaataggacgcaagaagctcgcccgtacttcaagtaattcatgctggatatcacactttctacgatttatcgttcatctctatactcataatcttccacttgcctgactttttttctaacgtaaatagaatttcctttttcgctctttcttctaataaatcatcttttaccaaaaatatttttcggttatcatcgctactaacctcattaatactcagttccaacaccgggtaagataaatatgctaaaccggataaatcgatggcatcctcaaaatcatacgtttgccttgctgccggatcggtaagctggtccatttcaggaaaaggtaaatcaaacctcttcataagataatcaacttccaagtaattcagtatcacagccttaggatcgcttggatatacaaactttttacttttgtttgtatacagaatctcctttttttctggtcctgttccatcatatttttgataggccacgatggtatgctcctgagtatcgctaaattcataataatctacactttcaaatacaccgtcatgatcggtatcctttaacgttcgaattccttgtccagtagcattaggaaaatcagaatttatactcttgatatgattattttccaaggtgtatatggagaatccctctgaataagctcctccgtcacctatagagtatacaacgataaatttttggtctgtttgatcgagcttcatgattttcacatctgtatttagatgcacaactataaccgggtcctctagtttatcaatgatgtgataaccatcatcctcccggactacaaatatgttgtaaatctcctctttttctaatccaaaagcaagcacatattccggcttttcatcatggtccaaatcttcttttattattttttgaagctgctcattttggggttggatttcctttataaactgatctaatgtgttagaatctgcgacgtaatttccatttcttttatttattgaatggacattattgctatttcgatcttgttcttgagcagcagactctggttcagtcacaactttttgctctatcacttgagtgctaggtttgatgggctcaactgcccgctgcttctcattcgtagatttttcagaacatccatctagtagcagggcaattaacatgattaaaagtagtattgtattttgttttataaagttcatttcaaaaaaagctcccttttcgtattacctattgcatgtttatccgttgtttgcttacgtattgaataacattttgaagtgttcggttatgtccagtttgattgatactcttatccaattcaggcagggcagtatatgtgttatcttttttctgaaagtaaatccccgcgacaggcagtgtctctattccgtgtgcattaactccggtgatataatcagcaataataataatatccgtacgtccatcctgattcaaatccttaaaacttactgctttgatcctgtcaatcatcctaccggtgttaccataaaattcggggaattcgtacaggatcttgttttccacatttttgtcactgttaacttccaaaaaaaactttgcgtgtatcagatcatttgtttcctcatcttttaatgtagatacaaaccgtacttttccccagccatcgagagtggtggtaaacgattgttctttttggatagtatatggttccagatcagggtcgggctgagcaccttcttctacatagtcagcactacgttgctgctccacggatttctccatgttatattcgataaaaatattatctactttctctgttttagtatcccaataaatattcaaatgtaggccatttttggagtaaaccagacttctatttgttatggtacttggttgaccgtaaagttgtagcactttaccaagggtttcaccaatcttcaatcctcttttggttttaaacttgggattttccaagctcacggctactagatagctttcaccatcaaccggttcctccccttcaaattcgattttagatagaactacaaaatcaatttctggatcttcatagttaggataagacaagctccaccttctatatgttccattcccactaacatacccccgattgaagttatcgtatccttcaccataaccccacttacgaataagttctttaatatccgtatttttatcaatcttgtgcgaccgataaaaaatttcaaagtcctcgtcctgaaggggtttaggatcagcagatataacatttttggctttgtctgcttttttatctggatagtagccaatgtcttcttgcttaactttggtggtagctgtttccccactgttataatcatggatagacgaaggactacatgcagttaacgtcaatatcattacaagcatcataatgagataaccgcagttttgcctgttcatatctttccctcgtttctcattatagttttcatttaccaacgattgtccactctccgttacgtctttttttgtcgtcattaccattttgcataggtttaaaattaacattaggcagtctaataccttcggatgcagcaattttctgagctacacttttatcgagactcaacagatattgttcatagttagaagcttcatccccactaaataaattgtaaacttcctgcacatgttcaccccaatggttatcactagcatattctccgcaatcaacttgctttgatttcattctaatgatcggcgtgacccaattacaatattgaaatacgtttcctttacctgaaataccactcaatttattgtttttcactacggcctttctgaattcctgaccatagtatatatagcccaatattttctcaaatattaacctattggctttcattaagtctttagcataattagtttcagcaccatgctcaccatctgccgccctatttgtactaagctgattcaattcatcctccaattctgctaaaaagctgaatgcccagcctgcatcatagattccataacaaggttgaggatcaaagaaccaatttttatcataggcttcgacgacatagttatagttacggtccatcagatacgtgcgcctcatagaataagtaatgtatccgatcctcgtcttggccacttctgcggaattggcttgcaggcagatcgattgaaaggattgaataaaagaagagatgagctcttcttttatttgttcatacaaagacgctgcttgatgtaatttctggttcaatgcatcttctgcataggtcttaaggaagtgttgtagggcttcctgtctattcataattccacctctgaacctattatatagaatatttacatgatattactggttctatcctcctattttattacacaattttcatatcatgagattacatatgaatttatgaaaacagaatgaaaataatcacattttttcgtgaatgtgtaataatatatgcaaaaattctccaataaaggccagcattggacctaaaaaatgaaggtttgtgcaagcgaataggtaaatcgaagtagaagactcaggtttataacgaaataatcatgtataattaacaatacgctccagcaatactttcagaggactaggaatgggatacacaaactattagagttttgttaaccaccactttgcatcaagattggagacatatgactacttcacctacaggtttttataataatattcaagaggctaccgcgcatgtcattgatgtgttgagtgatattttacatgttaataccatttttattgccgctaatgatggggttacaaatgtaattgtagattcatttaaccgggaagaggtgctggttcgtaatggagaggagcttccttttgagcttagctattgcagtctggtgctgaaccattctgcggattacctcaccatttcggaaacgtctactcatccacaaacacgtgatttagatgcgactaaaaccatgggaaaccactcatttacaggaatccctattcgcatgaaaaatggtcaggcttacggaaccatttgtatcttgaacgcgccatctgtacatttgacagaatcagaactgaaggcactacaggctatggccgtatttctgggttatgtagttgaactggagaaaggcaagatcgatgctgaaatatcttccatgagcaagctggatttgatatcttccctgagtaataaaattcggttttcgctgaccgaaatatggggagccaccgatctcatgctgacgacggagttaaccgaggaacaacagcaatatatgagcatcatggagtcgagcagtcgctcgctcatgacgttattgagtaatattttggattacagccatatggaatccagacagattgatgatattgaagatccatttgatctgagaacgatgatggaaaatgtgttgagcctgtatgcagaagtagccgcgcagcggaatctagagttaaagctcgactggaatctcaccagctcgcctatttttatcggggatgaagctaaaattcgccgtatgctgattaatttggtagataatgcagtaaagtttacaagcacaggagctgtcatcttatctgcaaccgcccaatccgtgaccgatgcacctgaggttgaactggaattaaaggtgaaggatactgggatcggtatatctcctaacaaactgaaattgtggcttgagcatgaccgtgggaactctccctcatatggcaatccaggattgggttggctgattaccaaacatctattaaaacgaatgaatggtaaaatgactgggatcagtgaacctggtagcgggacagaaataacgctccagttcactctgaaaacataccaggagtcagcatgaaatagaaactagcttgtgataattataggacacatcatgtaatagaagcccgtgacgcataacgtcacgggctttatgttatgagtacgtgtccctaggcaatattatcaccctatgccgcacgtttgtgcatagtcagacttagtaacgtttgggagcagccagcttggccaaatccgccatatacgtaaaaaaggcttctggatctgtatcgtataccaggttcacagggcgtccctctgcctgttccaccgttctgccctgactcgggccttctgcgataacgctgcaatgcaccgtctttttcttgacaatgtccgggcgtcctacggatgcagtggtcagtacatcccacaagtagtaggttgagttcgtttcgctatagacgagcggcggacatcctgcatagcaattacccaagaaatccacgccttcatatcggcgctcggcagcccaacgattgcgtactgctggagttaatggcactttgcttgtgctttccagcgctaccagatcaatcgtgatgccgctttgccacacccgatatgccgcttctgggtcccagaacacattccactctgctgtgccgtcatgctccggctcctccacattccctttttcaaaggtgccgcccatccataccagcttttcaatctttgcttcaatatccggtgcttcatccagcgcccgcgccagatcggttagcggtccagtgaatagcaacagcgtcttaccttcagctccgcgtaccttttcgatcagatgctgatgagctggcagggatgaaagcggtgcttccattcgccccgattcattcagtaccggtaatgcatccacatagaaggaatgtaaacgccaagcagcaggaaacggatttttaccgcgtgaattagactttgcgacttccacaggccctttattttgtccaaaacgatcaataattttacggctggcatccgttgcaggctccagataaccatctgctggaatcaccgatactccggtcaaatgaatctgttccatctgaagcagcataaacagggatactagatcatccactccaccatcatgattaaaataaacgtttgtctgactcatctgtctcttccttcctttatccccgtaaaacaggcttgttcttatcggcaaccacccttcattatgcctgatcgcttcacaggagtaaatgtgcgatagtgtgtggatcagggattttttgcttactccatgcttaagataggtagaaatgtgtgtaataacagggtagaatcatgggtcctaatcggaagcgtatgaaggagagatgcatatgacagcccgaacaatagaagagttggagcagatccgtagagagtgtaaatccatggtgacgaaaagggctgcggcttctggtggagcggtattagttccagttccaggggctgacgttcttgctgatgttggcattttgatgcagctactgccagccattaatggaaaattcggattatctgagaagcagctggaaggtctggacgcagaaacaaaatccatggtgtatggttttatcacctcaattggcagcaagctgatcgggcgactcatcacccgtgaagttatcgtgcagattttgcaaaaaatgggcattcggatcgctaccaagcaggttagcaagtttgtcccccttctggggcaagggctagccgcggcaattggcttcactgccatgcgaaccattggtaatcggcatgtcgatcaatgttatgaagtagccaaacgcttgctggagcagcgaactgccgcggataccgcgcgcaactggacagttccacagcagcctctagagcctgtgggagtggatcatttgccaaaccgggacccggaagcagcgattccactactgccggcaccccctaaagattaagttcttcacattcgagtcaaccatccatttcacacgcacggggtactgcagatcgagacgggtcctgtatcccgtgctttttagccttccaccttggctccataggagcgggccaccgctactgcctgctcgatatccaacttggctccggtgatgtccagatctttaaaattcacgccatccatcttcgcaccgcgcaggtctgttccttgaagatgggctttgtgcagtcttacccgggtaagatccgcctcccgcaaatctgctttttccaaattgcattcggataagtcggcttccttgaatcgtatttttcgcaaatcttgttttcttaaatctgcatgacgcaaattcgtataagaccagtctccgcccgtaattgtgataccatccatattcgcccccgcaaaatctgaacctaccagcttgcagttatcaaaccggactacaaacaaattggcgctggtgaacaaacaattggtaaaagccgactccttgtagtgagatgcattcagaatggctccggtaaaatcacagtccacaaaagtacagccttccacgagggactcattcatctccaccccccgaaagcgacatcgggtaaactcacaatttctccactcgccttctctggcatccattgagccaaaatcacgggcttcgtagacctcatctgtataaaagaacatgttctctctcctattccttattccctatattaggaactcagcatttcggcaaagaccgctcaaaaccgcccttcatttttcccagtaaacccttcatcatcttatggtcctgtggcgtaaactcagacatacacgaccgaatcaacttcgtataataagggactatcttactcaacagctctcgtcctgcctcttttaatccgacagtcaccatccgtccgtcactctcatgagccacacgttcaatcatgccatctcgctctaatccgtcgatcagccccgtcatggttccacgcgtcacatcagctttttccgccaactctgatggtgtcatgcgatgcggcgaatggcaatgcaacaggctaagaacaataatccgaccctgagaagcccccaacttgctaaaatccgtatccatttctctgaaaataccattagccaagcgcgcaaatgtcacaaaagtctctatattatccacttcggcatcttcatgcccaaagctacgcagcaccccgcgtatggagtcattatgaaaattaaaattcatagtctatccattccttccttaatcccgcttgttccgtcagacggtagcttttccattcgtcaggcagcaaagaagcatatggttccttggcaaaacgatcatctaccaggaccagcaatccttcgtcgtgctccgtgcgaataagtctgccacctgcctgaagaaccttgttcattcccggatatacatacgcatagttgaaaccattccgtccctgttccgaaaaataatcccgcagcacatcccgctctgctccaatttgcggcaagccgacgccgacgaccactaccccatttaagcgatccccaggtaaatcgacaccctcagcaaacacaccacccaatacggcaaagccaagcaaggtgtgctcttgcccaggctggaaggcctctaggaattgatcccgctctggttcggtcatccccggactttgtaccaacgtatttgcggacacgtcccgaagcatgaattcctcatacacctcacgcagatatggataggacgggaaaaatacaaggatatttcctttccgttccacaaccaatgcagccagcatatccgcaatcgcccctttggaacgctcacgatcccgataacggatggagagcggcagcagacgtacatcccactgctcctgatggaagggcgaaggaacctgtaacgtataatcttcctcgtttgctccaagcatgtcccggtaataagcaagcggtgtcaacgtcgcggaaaaataaacggctgagcggtagcctttaatagcttgtcccaacaagttagaaggatcgaggcagaacagcttgaccctcacttcactgcgccctgcttccacataagtaacgtaccgttcatcatataaagcagcaattcgcagcatattctgagcggtaaaatacgtatctagaagcaatgcataatccgtaccctcaccgcttgcatggcttgtactgccccccgttaccagttcacgttcagctgcttccacaaaaggcaccaacagctccagtacctcttgcggtgctgctgtctctactacttttcctgtatctgcatattgcttgcgcagcgtaatcatatgtgcgttcactgcactcgcagccgcagcaatctccgggcttagcaacttaaattcccgtttaagttccaaaaaagaagatttcaaaatttccgccgaaaacatgtcccggccgcgttctaccagattatgcgcctcatccaccagtacaacaccttttcgcttgtgctcctccagcaatcttttcaaagaaatccgtggatcgaaaacataattataatcactgattataccatccgaggcatacgccacatctagggaaaattcaaagggacatacgttatgcttgcacgcataatgttcaatcaccgcccgggtcattaacgtctcattcgccaaaatatcggaaaccgcaccgttgatccggtcgtaataaccctcgcacatgctgcatgatccagcatcacaatcattttcatccttgaagcaaattttatccttcgcagtcaaagtcaccacatgcatgtgcagcccttgggcctgcattctggcataagcttcttcggctgctgcccgagtggtggtacgagccgtcacataatatactcgtctcaccaatccttcgccgatcgccttaatcgcaggaaacaaggtggataccgttttaccaatacctgtaggtgctttggcaaacaggttaaccccttcggaaatcgtcttgtacaccgaacccgcgagcgttcgctgacccgaacgatacgtgtcaaagggaaagttcaacatagcaatgctggcatcccgcttttccgcatgtgctctcagcagaaatgcatacggtgcataaccagcaatcatctcctgtgcaaaagcttctagctcagtaaaggatagttcccgtctgaatcggcgaatgtcttcactatgtgcctgtacataagtaagctggacctgcatggaatgatgttgttcctcacgagcaatcatataggcatacagaaatgcttgtgcccagtgtacgggttgaccgtcaccctgaatatcttcgaggggcaaagagatcgatttaatttcatcgaccgtccatacgccatccagctcaatcagtccgtcacaacggccttcaatgataaataattcgtccttatacggaatttctgtacgtaaatgtacctctttgcggtcatgctccttgtaacctttctggataacctgatgcacgcgagttccttcgagcatactgctattcgatcgaaagccgctatgaatgctgccgctccgatgcacatattccacaagtggacgcaccgatatgtgaattggttccttcatacgatcacccgttccggtcatagtcctttcactgtaccacgtagataaacgaaacgtaagggacataagaatcgtttgtattcaattggtattcactcatgcctactttttaccgaaatatagaaacgaggccttttgctttattccccacgatactacaactctcaatacagcataaaggatagggatatgttaaaagaattaattaacaattttgcgttattaacaagcttcttattctttggaaatttatttttccggaaatatgaacgttacctaaaaaaacatgtattcatttatcgggtaatgaacggtttaatgctgggtctgtttggcattctgttaatgatgaccggtttatgggtccgtgggcactttgtggtcgatctgcgccaattggcgattatcatatctgtttatatgggaggatcggtatccggtctgctgaccaccttgatcataagcctgtaccgtatttacatcacaggtggttggacagatgtttctctgactgctaccgtcaattgtttcatgacattgggcatttcacttatctttattcgagaaaaaagcctaacactccgcaagtggatgtcggccgtacttggagctgctgtagtgtcgctgttatctactttctttgtagttaaccctcctgataatgaatctattataataatcacaactgttaagttgcttggcggcctgttcacttattttatgatgtcctatatcaaaaaaacagaacgggctgttcatctgctggaagaagctgcaaatcgggatcatttaaccggactctacagtccacgtgctttcgatgcgctatttgaagaggtctttcatacttccaagactacaaaacaacccttcggactcgtgatgctggatattgaccactttaagaatattaatgatacgtatggtcatttgaacggagataccgtcttaagccaattgggaatgctgttaacccgggaatctacaacgagggcgtacccctcccgtaagggcggagaggaatttgccattctgattggaaattgtgatagtcagaaagcagcaagctttgccgaaaaaattcggaaagctgtggaaaatgaacgttttcttttgaatgacggaacctcgatctctctaaccgtatccatcggagcaggcagttcacctgtcattgcatcgaggcacttactggaaaagtcagatgaggcattatatgaagctaagcgttcaggacgcaatcaggtgaaactggcaaaaccatagatattagtcgctaaatgtcaggaaagctggattattgttaataaaaagtggtaaaatggaaataacatcgttatcaaaaaaacttctgccgctagtggagacatgccttacaatcgacatggggggtgggctttgtgaacctcgaacaattggaaaaactcatggaaaaagaacgccgtgaactgaatcgcatggctgacttacacggattaaaagatgaacgtgtattggacaaatcctccagacttgaccgtattatggacaagtaccttcacaccaagcgtgcaataaaccaaacacactcatagaagcaagctacatcgctgcccctcagggcagcttttttatgatgtaaacagtatttgtcctccttcggtacacatctgcatcgtactcaccttctcgcggactgactacttcccgccatattccgtccgcaacaattgctgtgtgaacgatatccattctctggcggcaaaggacagatagcgatcgttccgccagatcatccccaaatgccaaggaatgacgggattcaccaatggaagaacacgcaagcgctcagaatccagatctcggcaaatggcctccggcaacagagctacccccagatttgcagcaaccatttcgctaatcagatcccattgtgagctctcgtagactacacgcggctgaaagccagcccgtacacattccgcaataatacggtcatgcagcgtaaaatcctcacggaacagtacaaatgcctcctccgccagcgcagataacggtacctccttgcactctgccaatgcatgcgtaggatgaacgagcaaattcagcttttcctccacaaacagaaatgtctcaaacatatctccaaccgcaggcagcacaatcaccccgatatccaatgctccggcttctacgtcctgttccactttcttcgccccgtcctcaaataattgaatggtcacatcaggatatgccttatgaaattctccaatgacacgcggaaaaaagctcgatccgaccatagggggcaggccaatacggatatgtccttttttcaggttcatcaaatcactcagctccgaggacaggctctgaaaggactttacaatcgcttgtgcttgaagctcaattaccttgcccgcatccgtcagttcgattcttttgccaattcggtcgaacaaagcgacccccagttcatcttccagacttttaatcgtcttactgatcgtcggctgggtaataaacatgctctgggctgcctttgtaaagctacgcaaccgcgcgacttccaaaaaatattgtaaatgtcggatatccaaacctacaccttctctcatagacaaacggaatagatcacattctttatatgcattttactcatgaaagcttgtgatgtaaaatttcattacagtttgaaaataaccgatctcaaagataggagccattatatatgaaaagcttcatacgcggtgtcctccagatcgccgtcctgatggccttttcgctcatcctgaacgcgctagtctcctggctccacctgcctgtacccggtagtatcattggtatgctgctcctttttattctgctgcaaaccggcttggtccggctaagctggattgaagttggcgcaaactggttgctggccgagctgctattattctttatcccctccgctgtcggcgttatgaattattggccgatgctggaacacgatggtatgagcatcatgctggtcgtgttgctcggcacctttctggtgatggcctgcacaggtatggtcgccagtctgcttggtaaacgaaaggagcataaatcatcatgaccggtcttctatgtattgtattgacactcgctatttactggatggccaaacgcatgtaccgcacactgcccaaggtgtatttgtctccattgctcattacacctattgttatcattttgattttgacgctgacgggtgtgaactaccgttcttataattcgggcgcccacttgctgtccatgctgctacagccagctacgattgcatttgctgtccctttgtaccgatatttccctgtgttaaaaaaacacgcgactcaaatcgtgcttagcgtgctgtctgggtccgttgtagccgtgttgtcctccatggcgcttgccaagtggatgcatctgaattcttcgctgctgagcagcctgattcctcgctccattacgacacccattgcgatgaatgtatcgcaaacgattggcgggaatccgacggtcacagctgtattcgttattctgaccggattgagcggtcttattatcggtccgatgattgtaaaactgttccgtattgaaaatgaagtctcacgtggggtgctgctcggtaccggtgctcatggtactggcacttccaaagccttcgagttcagttcgctgacggggacgatatccagcatctcgatggtgctcgccgctctctttaccttggcagccgccccgttcctgttccacttgatgctgtaagcaatatgtatacaaagaagcagcgattctcttgttattggagaatcgctgcttctttgctttcggtctatgccgcgaagcgggcgcaacagctattggaacaacggtccgttcgcggagcgtccatctgaagtaccgacgaatatccttctctaaagcaaggagacgctcaagaaaacgcacccttcactgcaatcagattgccttaacgacgccagatttcttctctgcctctgcctctacaggcgttacagcttcatacaggcaagcatccagctcagccgtatattgtcgttcttgcgcggcactccagcctgcatgttcggacattaatgcaatggcgggctgtttccagcgcttcacctcgtcaatttggaagaacagcgccccggttcggcgtatgaaaaaatcagacggtgtcaccgtcatttcctgttccatcgcatacaggagcgggacacgcacttccacagggagcgccgcttcctgctcggtagcctccttcatgctccgtaccgctatggcaaacagccgctctgtgttggagccatagcgggttgcccatgctctagccgtttccggcgacaggccgagcgcaatacccgctgcggtttgcttgctcacgaaggcgtcccagcccgccgagccgcctacgccgccacccgaaatcgggatatgtctggtgcggcatgcccggaagctttgcccgtgcaagcgtcccagctcccgtaccgcacgatccacgacgagttcggacattttccggtagcccgtcagcttgccgcctgcaatcgtgatcagacctgaacgggattcccaaatttcgtccttgcgtgaaatttccgaaggacttttaccgtcttcataaatgagcggccgtaccccagcccaactggattctacatccgtaacagtcagtttcacatctgggaacattccgttgatcgcttgaagcacataggcccgatcttcggcggtcatccggggatgcgccgtatccccttcatacaccgtgtcggtcgtacctgcataggtttttccatcacgtgggatggcaaataccatgcgtccatccggtgtatcgaagtacactgcctgtttgagaggaaagcgctcagcatcgaacaccaggtgaacacctttcgtcaggcgtagcaccttgccctctttggagcgatccatttcccgtaacgtatctacccatggtccggccgcatttatagccagtgaagctcgaatttcgtatggctttcccgttacccgatccgttacgcttgcaccgcttattcgtccttcgtcatacagcagcttgtcagccttggcatagttcaccgccagcgctcctcgtgtaacagcttccttcatgacctcaatcgtcaggcgagcgtcatctgtgcggtactccacgtagctgccgctccccttcagtccatcacgcttcagcaaaggctcgcgctctagcgtagcctggatgtccagcatccgacggcgctcactacgcttaacgccagcaaggaaatcatatactagcagcccgacagaggtggtgaatgcgttaaacgtgccgcccttgtgaaaaggaagcagcatacgctccggtatggtcacatgtgggccattttcgaatacgatggctcgctccttcccgacctcggccaccatcttaacttcaaactgcttcaaataacgaagaccaccatgcactagcttggtcgagcggctggacgtacctgctgcaaaatcctgcatctccaccagtgctgtcttcaaaccacgatccgccgcatccagcgcaatccccgcccctgtaatgccgccaccaataattaaaatatcataatgctcatctcccatacgttccaaaacagcggttctctcctgcgcagcaaatccctgttctcccatcatgtatccctccagctttgtatatattcacgatgcaatctgccaaccgaatcatcataaggtacaaaaaaagaccacgaacatcgctgcggcggatgccgagcggttcatggtctctccaagtctcctgacgagtattaacttatctatatcgtagcacacacgatacgctatgaaaagggaaatctgcctgttgccacatggctgccttctatcgtaaaaccatccctacttgaacgccattgcggcatgaactgcctttttccaaccaccataaagcctagcccgcacgtcttcactcatggacggagtaaaggtttgatcactctgagcatatccccggacttcatccagactgctccaaaacccaactgccagtcccgctaaatacgccgcaccgagtgcagttgtctcgttcacagcaggtcgttctacaggtagatcgagaatatcgctctggaactgcatcaggaactcgttcatcactgcacccccatctacacgcaatgaacgcacaggtacacccgagtcgctcgccatggcagttaggacatctttagtctggtaggccagcgattccagtaccgctcgtataaagtgctccttggtcgttccccgcgtcaaaccaaatgtcgcaccgcgcacgtcactgtcccaatacgggctgcccagacccacaaaggccgggacaaaatataccccttccgtcgaggtcacacgcgccgcatacgcttcactatctttggcttcgcggaacatacgcaacccatcacgcagccactgaatagcagatccggctacaaaaatgctgccctccagcgcatacttcacctgaccattcagcccccatgcaatggtcgtaatcagtccatgttccgagtcacagggttcatctccggtattcatcaacataaagcatcccgtaccgtatgtatttttaatcatgcccttgtcaaagcaaccctgaccgaacagagctgcttgctgatcacccgccgctccggcaataggaatttcctgtccaaaaaagtgataatccaccgtatgcgcatatatctcagaagatgatctcacctctggtagcatagacgcaggaacgccgagaatatccagcagctcctcatcccattttagctcataaatgttgtacatgagtgtgcgggccgcattggagtagtccgttacatgtgctttaccaccggacaatctccagattagccaggtatcaatcgtacccaacagcaaatccccgcgctctgcttgagctcgtgccccttcgacgttgtcgagtatccatttgaccttggtgccagaaaagtagggatcaatgagtagtcccgttttgctatgaaaaatatgatcaaatccacggcttttcaattcctcgcagatcccggctgtttgccgtgactgccataccagcgcatgatatacaggcagacccgtatgtttatcccacaccactacggtttcccgttgattggtaataccaatcccggcaatttggctggctttcacacctgattccgacaagcaggaggcgatgacggccaaaatagagctccatatctcatttgcgttttgctctacccaccccggctggggaaaatactgtgggaactcccgttgtgccttgtataccacttttccctgccgatcaaacaagatggcccgcgaactggttgtgccctgatccaaggcaagaatgtattgctccatcacttcccagcctccttgcatatttatgtattgttgcccacttgattcaaataaaggctattgcttataatgctcgaacagttgtttattggaggtcgtaactgctgtagctcccgcagccaacgccgcttccacatcctctggggtgcgaataagtccgcccgccaaaataggaatgcccgtgcgttcgctgacctccttaatcatcggtgggacaacaccaggcagtacctcaatataatcaggtcgtgttttttccaccagcgcgtagcttttttccagcgcaatcgtatcgagcaggaacacccgctgtacagcaagaatccccttctttttagcggttgcaatcaccccggaccgggtcgaaataatcccaaatggcttaatttcctgacacaaatattcagccgcatattcgtcattcttcaagccttgcaccaggtcggcatgcaggagcatttgcttgctgcgacttctagccatctggtacaggttgcgcagctgcgctacatgcgtatccagaaaaacagcatactcataagaactgtccaaaataccctccagctgcttcatatgcttagctgcaggtaaaatgcgttgtccctgaaatggcatggatatcccccttaggctgaatgtcggtcaaactcgttcaaattttatattatcactctgttcgacgaacgtgaagcggtttcattgcggatatgtataaaggctgccttccctgcaatagatgtcagcaggaagaagacagcctaatcgttcaaaggaactggatcaaatcacacgacggcacccttaaaatgctctatagtgtactagccctcaaacccttggcgcagccatgaggtagcgagcgtgatcgcaccgcgcttggccgcggtttccgacaatgggttcagcatcacaaagtcgtggatgatgccctgaaagcgtgcagcggttacctctacccctgcttcacgcagcttgttcgcataggcctcaccttcatcacgcagcacatcggcctcgcctgtaatgaccagcgcacgcggtagcccattgagctgttctctggtggcacgtaacggggacgccgtaatctgcgctcgttcattgggatctgtcgtatattgatcccaaaaccattgcattccttcgcggctcaggaaatatcctgtggcgaactcctgataggattccgtgtcaaaggaagcgtccgtcaccggataaaataacaactgctgccggatggaaggaccactgcgttctttggccagcagcgttacggccgcggtcatgttgccgccgacactgtctccggctatcgtcagcgtatcgggcttcagtccatgctcgcgcccatgctgtgccacccattgaacgaccgcgtaaatttcctcaatcgccgtcggatatttagcttcaggtgccaagctgtattccgggaatacaacggctgcctgggagccgactgccaattcacgaatcagacgatcatgcgtgtgggcattaccgaatacccagcctgctccgtgaatatatacaatgaccggcagatcgcttgtcacttgttgtggacgaacaattctgacctttacctcaccgccaggcccacctggaatagttagatcttctacatctgcggcaggtttgtctgctggaccggattgaacctcattgaccgtttcacgtcctttttcaggacccaaatcatatagaaacggaggtttggcattatcgtctgcaaatttctgtgctgcgggttcaagctgtacttttttactcatatcgattcactcttcccttcttatctgtggtctacatatatccaatatggcttaagtttgctcattcagtttcaccttatatatttaaacgagttcctctctttccaatcggaggactttagtttgcccaatagaagagcttgacttttattttgtattgtaactataatagttacatattaaagttcgtaaatgcactgggtacacttacgatcaaacgaatgaatcatccacatcatatttataggaggctatctattatgaaaattgcagttattggtgcaaccggtaaagcaggaagtaacatcgtaaaagaagcattagacagagggcatgaagtaaccgccatcgtccgtgactcggctaaagtaacagaaagtcgtgctactgtagtacaaaaagacgtttttgatctgaaaacagataatctgaaaggttttgacgtagttgttaatgcatttgccgcaccactcggacaagagcatctgcatgtcgatgcaggtaacgtactgattgaagccctgcgtaatgtatccggtactcgcctgattgtcgtaggtggtgcaggcagcttgttcactgacgaatcccaaacacttttggtaaaagatgctcccggcttccctgatttcgtatatccaacagcaaataatcaaggaaaaaacctggaaattttgcgtggtaccagcgacctgaactggactttcattagtccttctgcggaatttgctctgggtaaacgcacaggctcttaccaagtgggaaaagacacactgttggttaattccaaaggtgcaagctatgtcagctacgaagattatgcagttgccgtagtggacgaaatcgaaaaaccacaacatctgaaccaacgtttcactgtcgtatccgagtcctaattactgtgttctcgcagcacatttagcataaaaaagaccctttgcccattctctcatgcagcacgctatgagaaattgaacccgaagggtctttttgttatgacctgttgatactctcgtgatgacttgtccgtgctgaccttcttttctgtatcgtgagcggaagtctccctcttatcgctaaaacacagcttgagaatcggaggcgaagccaaggtcgtcagaatgatggcaatgatcaccgatgtaaaatattgctgtgccaacagacccgactgtagaccggtagctgcgataataagtgcaacctcgccgcgagatatcatcccggagccgatcgcaagggcagaacggttatcgaagcccgtcagccgcgccccgagtcctccccagaatagctacgacgaagaaagctagctttttgccaacaagaagtcccaacgaagtttctccacccataccgaatatactcattactaccgctagcagcacgccgatttcagacatattatgaatcagcgagtcattccgaacccatcctaatacggctggacccgggacaattcctgcgatcagctttcccaacaccgctggttgaccgagcttgacagacacatgacccacgacttttgtgaacagtagaatcagcagaagatatagtataaattgcataaaataaaaagggaaacctgaaataaagcacaggttcccctaaaaaagacataaaggagccttggtgacaggctcctccggtaaattcatatattcttttaatgttgtcggtcaaacttgcgcaaacgagcaattttatctcttctgcaaacccgtgtaaacgtgttgaatcaattttctgcttttttcacatagcggtcgcggtattcgtggtccagcatactcatcagaatcgaatcatggtattcataattgtagaataaagcatcccgctgcacaccttcacgctgaaagcctactttttcatagcaacgaatggcacgttcattaaaatcaaacacattcagctcaatccgatgcagattacagataccgaatccgtaacccagcatgagtacaagcgcttcggtgccgtagcctttcccctgatttccctgctcattgatcgcaatacggatgttggcactgcggttcaggctgtccatatcctgcagggctatatccccaatgacacgatcatcttcgcgaagcgcaatcaacagcaacaggcttgaggtgtcctgtcctttagcttcaatataacgggcaatttgatccttggtaaagctgcgttgtgtgcctgtcagcctccgcacatcctgatggaacaatgtattatagtatagctcggtgtcctctacgttaacgggacgcaagtacacccgtgatccttcaagtaaccgtgccacaggctctgaggctgaagtttgttgagtcatcatgatctctcccatgctaaaaatataaatgacgaaaatcaaagcaattattgcacaagttcgactacgcaaggtctgcattttgctccgtagtcaggctagaatcagcgagggactcgcgccaaattacggattgaagcagcaggcctgccaaacccaagattccaacagtcatcccgatccagacaaaagccgttcccgcccctgctattcggatcaatactccccccgcaagcggggaaacgaccatgattgctccaatcacggtactttggataccaaagacgcgccccaccatatcagcaggggttttggcttgtaatatataattctgggtgataatgtacaggccgttgcccacgcccagcacggccccgatcataagcagtacgggcaatcctgttccgggttgtgcccagcctaaagcagcaatagctccgccaaccagcacatatccaccaccgagcccccagcctgcgcttatgcgattcaagcgattaagcacaagcatgcagccgacggcgccagcaccaatggctgaaaccagccagccaagcagtgattcattacccggagcgagcactcgcagcaatgtagggaactggtagtcgatcatgagaatggcgattaagccgaaaagtccgaatataagcgtatgcaaaagcattcgactgcgccataggaacgcccagccctcacgccattggttgaaaaaacgagatgcgcggacatgctcctcccgcattttggcttcatcggccttaggcgctgtatgcgcagccgcctttccttgctgcccggctgcaacagcttgttggtctgcgctggccagcgccggaccgattccccgcaacggccacagtagcaggccggaacagagacgcagcaatgcattgagaataatgcatgcctgaggggacaacacagtcaaggtcatagcgcccagtaatggcccagccactttggaggcctgattgaccaacccattcagcgaggtcgcccgaaacaggtcgtcgctggcgactaccgtgcgggtcaagccttgctgtgaaggcatttggaatacgccagccgccgcgcgcagaccgagcaaaggcagcagccacgccgggcccgggacggcgaggatcgccagcgtcaataaggcaatagctgcatcgcagacgatcatcagccgggccttgtgtacccggtcggctaacgtgcccgcgatggaacccagcagcagacccggtagggccatcactaccggaatcagcgcaatcatcatagggtcggcttcccagcgataggcaacaagcacctgaatggcgatagcatcaaaccaatcgccaaaggaggcagccgtgtgcgccgcaaacatccgccgaaaacggccattgcgccaaatgctaggcgtggattgcagttctttcttttccttcattatctactcaccctgctctcattttcagcttcttttagctataagaacattctagcgggtctatatcagaggaaaatcagacagctaaaaacatcagaccacagaaagtgtttgctccaaccagtgccttagcgcctgacgatgcagtgttaaactgttgtcccggtcaagccgatcatattgagccgcatatttctcttccagcgtgggataggtgccacagagcttcaaaaaaccgcggatttggcagacggccttgatttttagcaaattctgtttagccatatcaagggtatccaacccttcatccataagccgctcggcattgttcacatctccagtacgcaaaagcataagtccgcgcatcatgcgataacggcccagttcacgcaaatacggagcctccgacagcatgccttccagacgatcagacagttccgcagccttttccatttgattggaaaccagatgcatgtacatctccatcagtgcaacaggcatcacaaatttatcgagatcatcccgctccatgaccctccaggtaagtggtagacctgcctgtgcgcgttcaggttctccattttccacataagcctccaaaatgttgagaatgcgtaattcccgttcctgttcactggacagcagcctgctggaaagcgcacactcacatagagcaatctcctcattcgttacccctgctgtgcccgtaaatagcagcaacatccaatacaatcggtctacaagggcaaaatcctcccgcttcaagaaccaggacacatccgcctgtacaaaacgggtatacatttgataaaaggcggacatttgaaaacccatctgctcctgctgggcagccagcgctacgatggaattcccctgccccaacagctggtatttccggaaaagtccatgtacggcgtcctgcacctcctgatcgagcaaggacggatgattctgtggctgcacgtcagtcaaggtcaagctgtagccataccctctaaccgtatgaatacggagcccatcccatgacttcagttttttgcgcaatctgtagatatgatcatccaccgtacgctccaccggatactccagcggccacacacgatccagcagttgttcccgggtgaacacctgattccggttatcgtacagaaagcgcaacagcgcaaattctttagccaacaacataacacgatctgcattacagaccacactgtagccatctgcatcaaattgtagcctgatcatccacctcgcctccgacatatcgtttcttagctgcacctagccctataaacataagcaacacactcagacacaagagcagcagcagcgggattgtccagccttgcgtcgcatcatgcagataaccgaacagcgtcggtcctgttgctgctagcaaataaccaaaggattgtgccataccagacagctctgctgcctgctgcggtgtccgcgtccgcaaattaaagaacatcatcactaacgggaaagcaaaaccacccgctataccgatacaaatgacccaaatcacactccactgtgtagccccaagcagaaatccacccagaccgataaaatacagcgcagccataatcagaaccaatacccgctgatccttcacccgcgctgcccaaataggcacaataaaagtaaatggcatttgtgaaaactgcagcacggacagcatccatcccgcagtctctgaatccatcccctgtccgctcatcatttcgggaaaccaagcggcaggaacatagaacagggcagattgcagccccataaacagcgtcaccttccaagccaaagacgatgtatacacattcacagttcgggcagacactgccgctttattggctgttttgcgggccttaaggagttggggcacccagagtaagattcctacgacacccacaatcgcccatattcccaaagcaccgcgccagcccatacctccgttcagagccagcggtatactcagccctgatgctgttgcagcaaccacattcatggatacggagtatacgccggtcatcagtccgctgttgcgaggaaactcctctttgatcagactgggcagcaacacattacacacggcaatagccagtcccagcatggcggtcccgacaaataatgcggtcacccccagcgttgagcgcaccacaatacctgcggtcaacagcagcaaggctgcaaaaataataagagacgacccgaagcggcgcgacagtttggctacaaaaggcgacaacagggcaaaagccagcaacggcaatgtcgttaataggccactcaatgtattcgaaatatgcaaagaatccttaatcaaaccgataagaggtcctaccgaggtaatcgaggcgcgcagattggcacctaccagaatgatccctatggcaagcacccaaggaccggcatgccacaaagatttgtataccaaagctcgttggtgttgctgtgaactcatctctccattctcctatctatctgtgttatgctcaaaggctccaaccaagtgtacggctggagcctagcaatttttatctcattaaattataaaggcattcgtgccatatgcataggacggatcgaaacagcgctccaagtcttcaagttcagcatatagcttcattaaaaaaacaaaagctgcctgaaaggatagtttccttttgaggcagctttcagttcataaacttcgatgcgaccagcgctgcttaacgtaccagccagccgccgtccaccgccaagatatgaccgttcatgtagtcggaaccctgactggcgaggaaaaccacaactcccatcaaatcagacggatcgccccaacgacccgcaggaatacgcgacaagatttcttgattgcgactttcatccgcacggattggagctgtatttgccgtagcaatataacccggcgcaatcgcattgatctgaacgttatgaactgccagctcgttcgcaaatgccttggtcaaaccagctaccgcatgtttgctcgctgtatacggcggaacgaacttgccaccctgaaaagcaagcatagaagcgacattgataatcttcccgcttttttgctctaccatcacctttgccacttcctggctcaggtgatatacggcattcaggttaatctccatgacagcgtcccaatcctcatctttatactccagcagaggggcgcgacgaatcgtacctgcattgtttacaaggatatcaattttaccgaattcattgacgcattcttctacaatttttttaatggattctttctctgtcagatcagcctgataaaaggcaaccttcacacccgttggctccagcaagcgtcttgtttcttcatattcatcattgttagctacaatgaacagatttgcacctgctttggccaaagctacggaatatccttgacccaaaccagtgttgcctcctgttacaatcgccgttttaccttttagactgaaaaaatccaatgaaaaattgtccagacccatgcctacgcctccatcacaaattagtataaaaacctataattcctgaagcctacagcgctgcgcgtacttccttatatttagctacataacgtgctgcattttctgtgatcaagtcataacgaccttccttggctggagccgtcaaattacccccaattcccacggctacacatccgttacgcagccaggtttccatattgtccagatcaacgccaccagttggcataatctgtacatgaggcattggacctctgacggccttcacaaagtccgcccccatcgcactgcctgggaacaacttcacgacatcgctacccaatttcatggcttccttgatctcattcagcgtcatacagcctggcatataaggaatcgcgtacaaattgcatagcttcgctgtttcttcttcaaaagaaggactcacgacaaactctgctccggcgagaatagcaattcttgccgtcagtgactccagtaccgttcctgcaccaatcactgcctgatccttaaattcgtctctcaatcttcgaatgacctgatctgcatccggcgtcgtaaatgtaagctcaatattatccaagccgccttcaatgcaggctttggacattagatatgcttcctccgccgtgtttccccgaatgactgcgacgacacctactgaagtgatatgttccaaaactttctttttcgtcatgttcctgatcctttccacgaatgggatgaccatgtaccctcagccacttgcagattcacgccccaatacactgattggattaacgcaactcgctcatggcaacctgatccatgtctttgtatgttttattttcaccggccatgccccaaatgaaggtatagctacccgtagccgcaccgcagtggatagaccaaggtggagaaataacggcttcatcatttttcatcaccagatggcgcgtttcgttcggttcacccatcaggtggaacattctcgcattctcatccagttcaaagtagaaatacacttccatacgacggtcatgaacatgtgtcggcatggagttccacacactgccgttctccaacgtcgtcatccccataaccaattggcaactttgaatgccttcatcatggataaagcgacgcaacgtacggttgttggctgtttcctgcgaacccaaactttcagacggtacatcggcaaaagactgcttcgtcgtcggatacgtggtatgagccagggccgaaacgatataaaatttcgcaggcttttcactggaatcgctttcaaagatcaactccttgccccctctgcctacatagagacagtcttttgtggccagctcgtaagtttcaccgtccaccttgaccgtaccgctaccgccgacattaaaaatgcccagttcgcggcgctccaggaaagtttctgctttgatttgatcgttaccttccagcgcaacagatttattcacgggataaatgcccccgataatgacacgatcttcatgcgtatagaccagctttacctcctcaggtacaaacagttcctggatcaaatagtgctgacgcaactcttcagtcgtaaaatgcttggcatgttcgggatgagttgaataacgcatttccataaaaacattcctcctgtttagataaacttttttatcaacggaattgttataaaagcggtttctaactctacttcttagctagaattgtaataattatctaagagggtgtcaacccaaaacttcactattcctagaaaaacccttagtacatacgaagttttacacactttttaccttttgataaacaaaaccacatttttttatctgtattacctaaaaagtttttagccaatatatcaacttcatcattgtgaaaaaccgatttatgtgataatttcaatttattcagttggtgcatgcgcttacagattaagtttactaaacataaggaggaatacaaatgaccgcaacattggatgctgttaccttcggagaaccgatggccatgttttatgccaatgaagcaggctctctggatgaggtgcgttcattcaccaaagcgttggccggggcagagacgaatgtttcagccggtttggcgcgtttgggtctacgggcgggactcgtgaccaaactcggcgaggatacgttcggcaagttcattgccagtgcgctacgtgaggaagggatcgacacacagaacgtcatgtttaccaaagaccactctaccggaatgctgattaaatccaaagttacaagtggggaccccgaggtggaatatttccgcaaacattccgccgcttctacattaagcatcgctgattttaacgaggcttatttttccagagctcgccatctgcattttacaggtatttctgtcgccctctctcctgagtgccgtgatttcgcacgtcatgcgcggcaatttatgaaaaaggctggtaaaactgtatcctttgatccgaacctcagacctaagttatggcctgacacgaaaacgatggtggaggcgattaatgaggcatctgaggggtgcgactggcttctacccggcattcatgaaggtaaaatattgacaggctacacctcaccggaggatatcgcttcgttctacctcgaccgcggcacctcgctggtcatcatcaagctgggaaccgaaggcgcctattacaaatccgcagatgcggagggatatgtcaaacgtttccgcgtagagcatgtcgtagataccgtcggcgcaggtgacggatttgccgcaggcgttatcagcgcgctgctggagggcttgcccctggcagaagcagtcaagcgcgggaatgcacttggtgcgctggctgtcatgtcagccggagatatggatggctatccgacgcgagccgaactggaatcctttttgctcagtgccagcacgaattagtccggtttcattcccagcatagccttcaccgctattagcgcaagctcaacaaggccgaaagaagtcggccttaactttcaatagcccgtattcgcatttgtgtgacctgagcagcatacgcatactcagatcgtacaaaggaatacgggctatttttataatatatgacacattgctcgtctacagcgttttgacggattctccccgattgatatccggcacaaatcggtaaataatcgggactgattcgccgccttcctcaatgctggacagcagtgtttttgccgcctgcttccccatatccgcaatcggttgtgtaatggtcgtaatcggcggattgtaaatatgggcaaactccgcatcgtcaatcccgataatggacagctctgccggaatacgtatacggcgggcattcacatactttaacacctcagccaacacgatatcattcccggccaacagcgcagtcggcggctccggcagttggaacagctccttcagcgtccgctggatttcttctctcggcacactgtgcatatattcttcacgagatggcaagccatgctcctccagcgcctttttgtatccgctaagccgctccactcgtggagtaatccgattcaggccaaggggcaaggtaatcagcgcaattcgctcatgcttgtgagccacaagttcctgaatcgccaacttaaccgccatttcgttatccagcagcagactgcgcgtattgacaccgtccaccaagcggtctaaaaacaccaatggatatttctcacgaatgagctggttgtaaatgtctgcatgcttgcctgtcgggaagatgatcaggccatccacctgccgagccttgagcatctcaatatactgaccctccttgtccgggttttcatcggcgttgcaaatgatcacctgaatgccaaaacgttgcaattcctcctcaatcgcacggatagactggatcgaaagggtatagtcaatgttggctacaatgacccccaccataaacgtccggttttgcttcaagctgcgggccagcccgttaggctgatagttcagctcttgaataacctcggcaatccggtctctggtctggtcgctcatatatttatatcgtttgttcagaaattgcgagacagtgcttttagacactcctgccttctgggcaacatcttcaatcgtcggcttcttcatcggtacactccttgtctttcatgtactgcgttagtgcaacaaaagtatatcttttttttagtaaatttaccacacttcaatttatgaatgccattatgatataagtcgaacttcaaagttgcctatcgtgccaccgtgtagaagtatggttctccagcagcaaaaagaaggcagttcaagatgttctcttgaactgcctccgcgtacacaactttatcgaaaagctaggttccagctggccctaaatgctgctcgacatcaatgtgccggaacgggcgttgcagactgatctggtgtatcgtgctcgaccagcgcatgcttttcccataatcggcttttccagcgagcatacatgatgacagcacgagtccattcatcagcagcaatggccagccacacacccgcgagtcccatatccagcttgaacacaagcaaatagccaagcggcaagctcatgcaaaccatggagatcagacccataaagaccgggaacttggcatctccagcagcacgcaacgagttaataatgacgatattcgtggtccgaccagtttctagcagaatgctaagtaaaatgacctgcgctcccaaacgaataatttcagggttttccgtgaacaaaccaagcaagggaacacggaaaaagatgaccaccgcatcaataatcacggtcacgagtagcgcccatttcacactggtcagtacacgtttataggcagtatccttctgtctggctcccacgagtcttcctaccacaatagccgtacccataccgactgccatactgaacaagtaaatatagcttgaaatattattcgcatattgacgtgtcgccattgcttctgcgcccagataagtcacgtacagtgtgaagatgagctgacacgactgatacataatggactccagcgcggatggtacaccaatgcgcaatattttagaaatgaattttttggacaattggacgtaatatttccactcgacacgaacctcagtgacccggtacatcagccagaagaagatcaggagacaaataaagcggctacctactgtagaaatagcagcaccttctactccaagtgcaggcatcccccaatgcccaaaaatcaaaacatagttgccgaccacgtggatcacgttcataaaaaccgatacatacattgtttctttggtaaaaccatgtgtacgaatagtcgccgccagcgcattaatcaatgcttgaagaaaaatggcacctccgacgatgctcatataagactccgcgtaagccagaatctcaccctggacattcagccattgcaacatgtgcgtaccaaatacgagaaaaattacgctaagcaaaagacctaccatcaaattcaacgtaatggccgtacctgtaacctgggccgcttcgactagtttcttagaaccgatatattgagctacgacgatagcagcgccgttgccgataacctccagtacaaggatagcaattgaaataatttgattggacgcgcccacacccgacaccgcattatcagatacagaactgatcatgaatgtgtcgacgctccccattagcataaacagaaacaattcaaggaaaataggccatgttaaacggaacaaattcagttccttagcttcggacaataccgaacctttttttagtgctctggttgtcattcattcacctttcttcatagatttatttaacgatcaaaaggtatgttagcacagtcattctgaaaatacatcccgtttacgtaaaatgatttgcaaaatgcgtaagaattcatttatcaccctctttataattgattatcgaactttattgaaacaggatattgcaagaatatatcagtagtctggtcttttcgacgcaattatgagctaaagagtataatagaatacgagcctgtgagcattgccgctgacaggttgtgaagattgttgtatgcttcctaagcataatttgtgaattaaagatggaatatataggatatccatagggttaaaaggtaataaaggaggcttttacagatgactcaatcatttcaagctcttgtcgtcgatcagacacaggacggtgaagttcaagcagaggtacgttctctggaagctagcagtttacctgctggagaagtattgattcgtgtcgcttattccagcatcaattataaagatgggcttgctgcccgcaaggatggcaatattgtcaaagcctatccgttcgtaccaggcatagattgctcgggaaccgtcgtctcttcggaggacagccgctttagcgaaggacaagcggtgctcgttaccggatatgggctgggtgtgtctcaattcgggggattcagccaatatgcacgtgtgcctgcggactgggtggttccacttccaaacggactcacgccgagagaggcaatgattttcgggacagccggattcaccgcagccctgtcgttatatcgactggaacaaaacggcgttactcccgagcagggcaaggtactcgtcaccggagcgacgggcggcgtaggcggggcagccattgccttgctgaacaagaggggctatcatgtggtagccagcagtggtaaagccgatgcgcatgattacctcaaggcgctcggagcagccgaggttatttcccgcgaggaggtctacgacggtgcggagagcgtccgcccgctgggcaagcagctttggcaagcggctgttgatcctgtaggcggaaagccgctcgcttcgctgctcagccagatcgcctacaacggctccgttgccgtgagcggcctgacggcaggcaccaagctgcctacgacggtgctgccgtttattttgcgcggcgtaagtctgctgggcatagactctgtcttctgcccatacgacacccgcgtagcgatctggaagcggctcggcagcgaatggaagccggaacagctggagcagctcgttgagcgcgaagtcggattggccgacctgccaagcgcgctcgaagacatccttgcagcccgctcgcaaggaagaacgctagtacggctggttgactaagcggcgtagtccgcaagctatccattggcgtgttttcgcgtgaagaagtgtcatcccttagggtctagcttaggaacatgtaagaagcctgtaaatctgcaattttgagatttacaggcttctttttttcgtgtggtacatttgaagcagacggtttactttcgcaaccaaatgaaccttttgagaacctcagttgttatatagataaactgcacgagaaaggagagcacctcattggagagcaatcgagagttgtttgatttgtatcaacgagatgtataccgaacctgctactacatggtacataatgcatcggatgcagaggatttaacgcaggaagtgtttatcatcctgtttcgcagcaatcgtgaacagatcgaacaactaaaagcctggattatgaagattacggtcaatcattgtctgaattaccttaaacgccagaaaagcctgcatttgaaggtatcggctaatccctatctatttaacggggcggaaggtaaacctgtagacaggctggtggaagaacgcgaatcggcagaggaatgggccgtttatatgaatcgccttccggccaaaatccgcgctgtgctgacactccgctatatgcatgattttacgctggcggaaatatcaaagctgctggaaattccgctgggaaccgtcaaatcgaggactcacaaaggactaaagttattggagcaaatattgcgggatgcaggggtacaaattcccgagatggaaggagagaactatgaacaacatagaaaaggcattgaagcgcaagttaaatgatgattcggaaatggcctatcctgacttcggtgagatgtggaaccggatggaacagacagggcatactgcccctacgctaaccgacacttccgattcattcactccccaccgacacagaaactggcgcaaaatagctattgccgcctctctaagcgcacttctggttgcagttcctgtctatgccgccatccactacaactgggacaatctgctacgcggaagaagtggcatccagacagcattaaagcaaaacctcgggcaaccgctggagcagtccgtgaccagagacggagtgaagctaacgctgcatacagctattgtcgatgagaaccggaccgtgattctgtacagcttggaggtcggaaaacgagcagacaacgagttttggaatgtcaaaggcgtatcgctaaaaagtgctgcgggggaaagcagtgcaggggaatataacttccagcaatgggacccgaaaaatcaacggtacaacgggtactttgaaagtgattggacaccgcagcaagaaacagagaacgtgcagctgaccatagatcatatagagctcaccagcgttcaggaactggatttgccgctcgatattcggtcgcctcaaatacagacgttcaagctggatcgtagcggcttacaagatatgaaggtacaggtattcgaacaaggtaaggacaaactgatgctgtcctcagcgattaccttcgattcgtccataccaaagagatgggacaatccacaaattattgcctacaaaggcgacgagcctgtgatgtcgcagcctggaggggcttttggcaaacccggtgataacggggagtataccgcacagcaatattttttcaaagcagatataccggaaggacagactgctttcaaactgcaatatgcacaaactgagaaaagtatacatgaacccataaactttgatctgcagctaagcaagaagaaaatggaaagcgggacgattaaaagcgtactgaacactccattggagaacggcaatccgaattttacgctagaacaaatgattgtcacacctacacaaatccgtgtcacaatcagaagcgaaaagaaattcgccatgttaccttatcaaaagtactttctttctgtgaacggcacaacattagaaggtagtcgttggtcttcacctgatcaggaacacgatctgaacacgatccgttttgaacgaccttccaatcttgtgattaccaaggacactcctattacttttacaggcaaatacaaggttacgacccattcggatgacaaaacgccacagcgtttaactgatatttctgagcaaaaacagacactaacgacgcaagtcggtggctatcctgtgaagtggacctactacaaacaaggatcagacttattcgtagaaaccgaaagcgaggatgctcactttggagggattaaccagacgcatattggcctgggtaaagaacggattatcggcaagccgatcacagccaatttttccggagacggcaataacaaagcagtggatgtctacaagaacttcaaagggaaggaagcttctatctatatgttctactatacaacggacgacccggaagcagagacaaccgtacccttgcagcctctgacaagcaacagcgaagcatccaaatagcaatgctataaaaagagggtcctctatacctgtgtgaaccgtggtataggggacccctttttattttcctaggaaggcacattctgcctgaaacgattgactcccgtcctactttacagaaccttgcgtaacgccattgatgatccatttttgtgcaatcagatagacaataatcatcggcagcaaggccattagatacgaggcaaaggccaaattgaagtcggtattgaactgcccctgaaatacatactggacgagcggtagcgtatattgctccgcatcgctaataataatgagcggcagcaggaagtcgttatatgtggacagacaagtgagaattcccaccgtagcactaatcggcgccatcagcgggaatataatgcgccaaaaagtaccccatgtcgtcgcaccatctaccgtggccgcctcttccaatgccaccggaatggagcgaatataaccgacatacacgaaaacattaaacgccaaaccatacaccgtatgcagcataatgagacccaacagattagtcatatgaaggcccgaggccagttttacaatcggcagcatgatgatcgggaacggaataaacatggcgctcacaaagtaaaaatataatcccttaaaaaagcgtcgctgcatattacgggcaatcgcataagcgaccatcgaattggttagcaaagttaatacgaccgtcgatgtcgtgaccatcacactgttctgaaaagcgctgaagaagttggtcatttctacggcacgactaaaattttcccaatgcagctcggtcggaaaggcaaaggcggaatgcgccatctgttcgggatttttaagtgctatcgttaccgtcatatagagaggaaacaggataaatattgtccccaacgctactagaagcagcacaggccagttggtacgtctgcttgttttcatcagttatccatctcccttctctggaggaatcgcagctgtaagatggaaatgatcgcgatcacaataaagtaaataacagagttagccgactgataagcaaattctccgcctctaaatcccccggtgtatatcaggtgggaaatcgactgggtggcccgtcccggcccgccattcgtcaaagccacgatctgatcgaacaccatcagggaatttttcatcgccaataccatattaatcgtgaaaaacggagcaattaacggaaaagtaatgctccagaattcgcgccatttacccgcaccgtctaggttggacgcctcatacagacttgtcggaatggtttgcagcccggccagatagagaatcgtattaaaggcaatcccctgccatacagctacgatgacaacccccacccaagccagttgttcgctgcccaaaatgttcgtcgacaatgaggtaatacctaaattttgcccccaaatcgtaaacacgttcgagaacaagtaattgaatatgtaacccacgatcaacacgctcaaaatattaggcagaaaataaataccgcggaaaaagttacgaaaccgtattttagcattcagccctagcgcaatcagcaaactaaggatattagtcgcaatggtaaccacaatcgcaaatttgaaagtaaaccagtatgcgttccccacattgtcgtcctgaaacaaattaatatagttcttaaacccgacaaagtgatactgatgaccaaagccgttccagtttgtaagcgaataataaaagccctgcaaggcaggcaaggtcaaaaatacaaaaaacaatagcaccgccggcaccgtcatccagtaaaaagtcgttagtcgcttattcatgtctcctcctcctctcctatcggcggttagctaccttattccattcacggtcgagcttagctagataggcgtcgatgtctctgttttgcaggaaggcctgcacaatcgaattcaattggaccgccttgggaatatagtgatcggcaaaatcaacgacgcggcccgatttaaaatacggcaatagctctgccacactcggatcatcctgcgtgactcccttcaccgccgaaaacagcgtttgctctgtaatgtattgcttgctgttctccggcttcaacaagaaggcaatgaactcctcggcttcctttttatgcggagtgctctccgatacggctaatagcgtatctataccggacaccagcttgactgccttttcgtcattccctgttggtaatgggaaaaatccaagctccactttcggattcgctttgcgaatttcagatatggcccacgagccctgaatgtacatcaatccctgcccgttagcgaaggcacggttaccatcggcatagtttttgccaaaattatcaccatgtccgtatttcagtagctccagctgcttttccgcaacctcgcggtacttgtcctgaaaagcgacctgattttcacgcctttgcaggaaaaaatcaatgcccaccagattcgggcccagcgcattaaaggggaggttcgtttgccaatcatctttatatgtaaaatagaacgggatttttccagcagctttgatcttttgcgccgttgcaatcagctcatcccacgttttgggcacccgtaatcccatttccttaaaaagcgttttgttatacatcacaccattcgcattcgcagcataaggaattccatacacgggatcgaccccggttacatccttaagcattttgaggtaaatcgggtcaatcgtacgtggcaattctgtattcgccaggtccgtaaaaatatcactttgcgccaaaatggagtaggtatcggtggccccaagccctacaatgtcaggtacatcgtttttgacaacccgggtcaataagacagtctctgcctctggcgggttgacctgtgtcacttcaataccgggatgttcctgattgaattgagagattagcttatcgaatgaacccttggcctccggcttgttttgaaaaaactcaattttcaccttacccgaagcatcgcccttgttgcatgcgcttacaaaaaaagccaataaaaggatcgccgccagtgtagacagctttttgacccaacaccacatgctcatacctccttttcccctatgtcaatctatgcgggactagacaattaatacccgtcccttatggaaaagaaacgatactgctacaacaatctgataacaggaggaaccaatgttaaaaaagatccaattgaccctcaaacggtcggttggatctttcttttacttttatgatgttcaggttacaagtcttatttttaaacaatctttttttcccatcgtgtaaaactaataatgatacttaccagaatcaatccacctgcacacatccaaaaattaaaagaactgtctactcttaaagcaagcattatttgctgaaatgggtccattaacataatgaggggcctaaacaactcaaagagaaatacggataagataagaatcactatataagcaaacagtggccgtgacatgaacaaacatacagcgctactcaacatgagctttaccaagcaaaccagcgttaataccaaataaaacgaaaggatgtagggtacggcatctgatggggaagaggcgacggatgaaccatatttaaaaaaagtagagctgtgtgggaaaaacaaccatccggcgaatacacctataagcaagcttgtcgccataaaaatggccgttgaggctgatagtgcgagcaacttggcaagccaaaaatgaaaacgtcgatacggtcgtagcatatatagcctatatgctccagaatagagatcgccgcttaactgatccacgtacagaatgggcaggattgctgtaactagaaataaggcaacctcactcatcatcagccacggcaggttcagattatttacgaccacagttccttcaccaaaacgtaagaccttcgtacccgttactttatggctccatataattgcaaccacgatgaatatataggctatatataataaaagagtggatttgcgattccaaattcgttccatttcacttcgccagattgccagcatgaggaagtccccccctaatacagataatcatcagtcacaaaacggcggtatgcgccccaagtaaacaagataagatatagactaacaacggtgataatcgccccattcacagacgaattgcccattaaggacctatctaatcctgtatgctgcatatatggaataatcataaatgcgatcagattgtataggtatgggatatgggaaacaaaagaggccaattttaaatataatgaatcaaacaacagagaacacagattgtataccatacaaacaccgatggcatacgttacacttttgctatacatagcgacgaaacaatagaaggagcatattgctaataatgaggcaagcgcccaaccatagtatttaagcatctgcagtccttgagattcggacaaccccgcatcacttacatcatatgaaagagtccatacttcaacgatcacctgcgatgatactgcaaatacaatgagaagaaacaaaatagtagcatttaaaaccagcagtttactccagaaaatctgcccgcgggtaaatcgacgcataaataacaaccgcagttgcccgctttgaaattcctctgtgtatacagcagcagctaaagcagctacagctatgttgcatactaaaaacaaattctcacgcagaccagtaacgacaaagtttaaagataatacctcaacaggaaccttcatcgtgcgcaaaaaatatactcctgtcgaacaagcaagcagcggcgtacataacaccatgagccagaaccactttcgtctccataatcgctcgaactcactgtatattaatgatttcatagtcccatcaatcccatgaaagcatcctctagccgttggccgtcctctactagttgatcagcaggtccctgccaaactagcctgccctctttgataacaatgagttcgtcacacatctgttgcagttcatccaacagatgactggatataaaaaaggcataattcgctgaatcacgtagctgaagcacgatatctctcagctcccgcattcccataggatcaagcccattagacggttcatccagcaataaaagctcaggagcacccagcatggactgcgcaatacctagcctttgcttcattcccagcgaataggttttcaccttgtcatctccccgtgtttccagtctcacctttgtaagcaactcttcaatatgtatctcccgatctgagggcacaatctcagagtgtaaccgtgacaaattgcgcaaaacctgtctgcctgtcatataatcaaaaaagaccggagattcaatgatagcccccaccttggacagcgccttttcccgatccgtctgtacatcatatgaagctatctttacagagccgctggttggctgcattaatccggtcatgattcgcatcattgtagttttaccagctccattaggtccgatgaatccatatatcttccctttctgaagcttaaaggaaacacggtctaacaaatgccttttccccattcttttcgttacctgactgacctccagtaaggagtctgacatactattccctccatccataacaaatcacaacaaagttccaacgcgtgcatttgatatgtaagatcatgatggacaacacagacttctcttaacaatgaaacatattatttattcaatttaaaaaatatcacatgttgcgaaatgcaaacaactttctttatatgtaaaatataataataacgatacatcaattccatttatcttaattaatggtcattaattttcgtgatgatctctttgtctttacactgcaaaaaaggtagcccttcagtaaatgttctacctcagggctaccctctatataaaataaactattttctatccagtaactactaacctgtcacctactccagttcaacccactcgccaagcaatacatccagctccgcttgcagtcgctcacgcgcgtcccacagctccgccatgtgtatcgtgtcgccgcttgtgccgagcagctccagctcggcatccgccgccgccaattctgcttctttggcggcgatggtccgctccaaccgctcgctggatgcagcgggcgtgcgtgatggcttcgcggccttcgcttcgcgtgccccagacccggcagcgggcgagcccaagcgacctgagcgtgcacggctcgcatcggctcccgtagtcgctcccatatgcgcagccgcccccatgccattgctcgctgcactggaatgtacagctgtgcccgagccagagccgccaccggatgcggctctgcttgcagatgtcgggcgtgtcccggtatccccctcgctctgtagacgagcgttctccagctcacgcttcttcgctcggtactcatcaaagctgcctagataaaaggtcagctttccagcctccagctcccacacgcgccctgccagcttattcacaaaatagcggtcatgtgaaatcgccagcaccgttcccgtgtaggtgtccagcgcttcctccagcgcctcgcgtgagtcaatgtccagatggttcgtcggctcatccagcaccaacaaatttggctttttcatgaccagcaacgccagccgcaagcgggaccattcgccaccggacagcatgctcacgggcttaaacacatcggcaccgtaaaacaaatacttcgctagcaacccgcgtgcctcgccttcttccacccctgcttcctccttgaagtaagcaagcacagttgcccggctattccgttctctttcttgctgcgccaaatatccgtactccacgcgcgcaccccactggaccgtgcctgcatctgcgctttcctgaccaagcagcagcttgagcaacgtcgttttacctgacccattatcacccagcaaggccaccttttcgccgaattccagactgcccgttgccccgtttaatatctggcgctctccataggctttaacaatttcttcaaactggagcacccggcgaccggaacgatcctccagctttaagtgaaattccgccccctgcgggtccaatacaggccgcttcaccagttccatgcgctccaacgccttacgaatggaggccgcttttttgaaaaacttttcgttatcgccattgcgaccccactcttcaaaacgccgaatggcctctttcatctttttgatccgcttttgctgttccttataatcttcaaattgtagtagcaatcgttcttccttttccttcacatagccgctgtagttcgtataatacgtaaacgcctcgccatcctcaagctcaatcattttaacggcgacccgatccagaaaataacgatcatgagatacaaccacacacgcacctgtatagccctgcaaaaattgctccagccattccagccctttcaaatccagatggttggtcggctcatccagcagtagcaaatccggtcgtccgatgagctgtgatgccagcgctatttttgttttctctccacccgacagtgagccgaagctgcgcgtatacatacctttgggaatacgcagcccatccgctacctggtcaatgtttgcatccatttcatagccgccattgcgttcaaaccgttcctgcaaggcagcatacgattgcagtagcttctccagaaggctcgcatccgctgccacaaccggatctgacatttcccgttccagtgtggtcatctgattgcggcaatccttcagctcacgataggcgtaagccagcgtttcgtacacggtgaagctctcaaactccgccggaatttgcggtaaatagccgattttcgtatccttggcgatgacgagctgcccttcatctgggcgggacaaacgtgcaattaggcgtaatagggtggttttaccgcttccgttacggccgatgagccccaccttttctcccgtatgaatatcaaacgatgcaccatccaaaatcagattggcagcgtggtattttttcaattgttgaccgtttactatatacatgttcaggctctcctttatttaggaagacccttacccgggtaacacaaaaagagccgcaggagcaaccccgcgactcttcggaagatacagaaatccgttcgagttaaggtaggcgtcttctcgcgatgtttacaaccgtatgattaaaattggacatacttctcccgttgtatggaaaagcatgaacaatgccagccatagcaatcggcagctggctaatacggttgttcagcatctcgtgattcacctacctcacctccttcttcataattgtgtgtagtataacatgtttgctcgtattatgaaagaggacgatggtccatcgaactatgaaacagaatggtgctctctgacagcctgcgaagtcccggctctggtaatcgaaaatacgccgcagacaaaagcaacaatcacaaatgccccacctacccaggcgttcgtggcaacagattcactattctcaatcactactcctcccaaggcagaaccgagagcgatcccgacctggagcgcggagaaattaaagctttgctgaatactacccgattcgggtgcattttcaataagataactttgcatcgggggcgacaaggcccaactcagtatgccccagataatcagtagcggcgcaaatacataaatcgagtgaattgagaatggcagcaagaacatcacggcgataaacacgcctacgacgactagaatacttttcgctgtgccgaaccgatctgccaaagagccgccaataaaaccaccgctcactgccgccagcccaaagacaaaataggccacactaacccatgaagcgttcaagcccatcatattttctaaaaacggagtgaaatacgcatataacgtgtaatggcccgccagtgtcagcgtggtcaccaaatgagcactgatgactttaacattttttaaagatttcaactgatcacgcataggtacaacatgttctgtcggaatccgctccataaacaagttgataacgatcatagcaacgaccgtcaataaagcaatgatcaggaaaagcacccgccagccaaatgcatttccaatcagcaccccggctggaatacctagaacgatggaggagctaacccccatggagatgacaccgaggacacgggcctgataagccttggacaccactttgactgcaatggtcagtgacaatgtaacgatcagcgacccgcttgcagcggtaatgatacgggatacaaacaagactgcataattcggactccagaaggccagcagacttcccagaataaaaataaacatcgaccacaggtacagtcgttttcgttcaattttggctgtcaacgccaacagagttggcccagcaatagcatacacgagcgcatagatcatgataagctgtcctgccgtgcttacggagacattcaaatcctgtgcaatttggggtagcacgccaccgataatcagctccaccagccccaccgtaaaggtcgcaatcgttaaaataactactttgaagttcattacattagctcctttgctgtcatgtaaattccctcgtattacgcaaaaaaatcctgaccacaagaaatgtacaagacgtacactttttgtaatcaggatttatcggttcctggtagagaccctcaaaccatattattgaggttatacaaatggggcattcatttattacgcattcacgaaggttatagctattactataaaggagcctgtggctaagttcaaccccctacagccgcaaaaattcgctcatagcatgatctgacagataaggtaggtactcatgaccgtattcgtgatacaggagtatttccttgtctgatacgattttattgtacaccgcaaactgcgtggaaggcggacagatgatgtccgacagtcctgtcacaaacaacacacgaccacgaatacgatctgccaaatgttgaatatcaatgtagcctagtcggtgaaagagctcctcctcgcgcagatggttcggatcaaaccaacgaaaataataaaccagttcttcatatgcagatgtagtggcatccagcatccaggctcttttatagtccgacagaaacggatataccggaactgccatacggacacgcggctccaatgcagcgcaggcaaccgtcaaggcccctccctgggagcagccaaatgcgccgatccgttcagggtcgacctgctccatagacatcagaatgcgcaccgtctgtaccgtatccaaaaatacattgcggtaatacaaccgatccgggtccgggtcgtcaatccctcggatgatatggccgcgtaccgtcgttccctgaacctgcaaattgtcctcggacagcccaccttgcccccggcaatccatggccagcacagtgaatccgtgtgccgcatagcttaccttgtcgaaccagtcgccactgtcgcaggaatatccatgaaacatggccaaagctggcccttgttccgtaaggtgcttgggacgagccagcttcccatgaacctttgctccgcccactccagtaaaatatagatggtaacactccaccatcggagagacaaaatcagcaggctccagtgtataatcaagcggctgccgctccagctcctgtaatgcccgttcccagtatgcgtcaaaatccggtggcttcgggttactccccatatatgactgcaattgctgtaaagacatatcctccggcattcaagttcctcctacatccggcctgactcacggtcgtctgcgaccacttcatccgttgcgatgacatacttcataatgtcggacactgtcgtgtatgcaatacctacatacgtgtcagcggctccataataaatcgcaatccgcccggtgtccgcatcatgcagcgtagcacacgggaacaccacattcggcacaaaaccccgttcttcgtaccattcctccggagtcagcacgaaattagaggaacgatatttaactttagacggatcatccaggtcaagaacggctacgcccatactgtaaaccagcccattgcaagtgcctgtcaccccgtggtagaacatcagccagccctctgtcgtctcaatcggagccggtccgccgccaatctttaccgattgccaccagccctgtccgcccttgctcatgacatgacggtgcttgccccaatagaccaagtcaggactttcactcagaaaaatgtcgccaaacggtgtatgtccgctgtcgctcggacgggatagcaacataaagtttccgtttagcttgcgaggcaacagcacaccattacgattaaacggcaggaacggattttccaatcgtacaaagcttttaaaatccttcgtttgtgctatccccaatgctgcaccgtaaaaatctgtacaccagatgatataatacgtgtcctccacgcgaaccagacgcggatcgtaagcataatttggctgataatctttcccttcctcatcaaccaaatgcaaacgttctgtctcaatgtcccaagccaacccgtcgtcactccagcctaggtgcaaatgcggacgtccattaatcgtttcagcccggaatactcctacaaaccgtccctcatacggagctactgcactgttgaaaatacgggcaatgccaggtaccggattccgtccaatgaccggattctcactatgtctccataccggagcctcactgccttcaggcttatcctgccacggcatttccggcagactacctcccacaattcgtacgctatctactcccaaatccacattcaatttattcatacgtgtattcccctctcaccgagatatttgattcaccaaattttctatttcgccattgttctatttcaccgaaccctgcgcgaaaccgttatagatatatttttgtaatgataaaaacgcaatcagcgtcggaataatggcaatgattatgcccgcgctaatgacttcccattgcgagccatatggccctttaaacttgaacagcgccgtcgatatgacctgaaggcttgttttgggcatatacaggaacggggtgtaaaagtcgttgtaaatattaacgcccttgataatgatcaccgtcacaatggcaggcttcagcaggggcaagataatgcgccagtagatcgtcagataggaggccccatccagcatggccgattcatccagcgccaccgcgatggaatccagaaattgcagaaaaatatacaccgcaataatatccgttcccaaatacagcaagatcgccgcccaaggcgtgttaaacagctccagcttgttgattatttggaatgtcgacacctgtgtcgtcacccccggaatgagcgtggcgagcaagaacgcacccagcatgagacttttgcccttaaatttaaaacggttcaaaatatacgcgatcatggaaccggtcaacgtagctccgatgatcgaaatcaacaggataaaagctgtgtttacaaatccggtcagcatatttccgttgataaaggctttggtatagttagcccaattcagccagtttacggggggagtcagaggactggttgccgcatattcagccttcgtcttcaaagatgcaaacaaaattacgacaatcggtagcagtgcaatgaacgcacctagtagtagcgcggcatacttgatgctgctacccagtattcttttcagcttatacatgattagtcctcctctccccgaattagcaaccgttgaagcagcgtaacagcaatcacgatcagcagcagaacgaccgccatcgctgaggccaaaccgaccttgctgtatttgaatgccacatcaagcgtctgaatgacgaatgtttcactgccgttggagccaccggtcataatatacgggatgtcgaacgcactgatcgccccgctaatcgccaagatgagattcaactgcaaaatccgcttgatactcggcaaaataatagagcggaattgatgccagcggttagccccgtctatatcagacgcttcatacagatcactggatatggaggaaatcgcaccgagaaacacgataaagttaaagcccatgtatctccagatcgacgtgccagccagcgaaatattgataatctccgggttgcccagccacagcttgacatacgaacccagccccatcgcctgaagcagtgtatcaagggtaccgtctggcttaaaaaagaatagaaaaataaaaccaatagctaccccgttcatcagggaaggaaaaaacaaaacgcctttaaagaaatttttaaaccaggtttgaaagctaagaatggttgcaaaataaagggccagccccatctgtacaaaggtggctacaaagtaatacagactgactttaaacaccgagaaatactcggggtcggtaaagattttgatatagttttcaaagcccacatattccagacgcttactataaccgttccagtccgaaaagctgtacttaaacatattgatcactggcaagtacgcaaaagtgatcagcagcgctagcggaataaacgaaaaggcaacaataatcgccaatctttgtttggagtagctgagattcgaaaattttaacatgctgcacctcctggctgtccgtccatctactattacgtcgatcctttcttttcgtcagttcagatggctattttgcttcctttgcagccacttcagcacgggccttcacccatgcgtcgttcagatccttcataatggtgtcatacgattccgggcggttaccgactgctgcctcaataatgcgttttttgaagtcaggctgccacaagccgatttctccctttttgtcgattttatcgacaatcccttcctgtccttttggagatggagtaagcgtttcaaaaacgactccctgatcttcgtattgtttcaaaatgctaggcattggggcacccttcagcgggctaatgctacctgcctgctctacggcatagttggacttttcggtaaaccaatccacccaggcacgggccgccggtttattttcactgtttacgttaataccgaggttaaaatcaccagccagaggcacaagcaccttggaggcattcgtcgggaaaggcataaaaccgatatcatccttgttagaagctgtgcttttgatctggtcaatcgcccaagagccaagcaccatcgtaccgattttgccttgagcgagatccgccttggaggtctcccaatctgtagtcgttggatctttttcaatcaggccttttttagccgcatcgtacaggaccttatacagttcatagtggggctggcccttcgtgaaattgtcatctgtattcggttgtgtgacattcacatattccttcgtacccgccaatgttgccagactagactcccactgggtcagtgcccaaccagaggcatagttcgtaaacagcggtaccgccttggttttgtccttaatctgctgtaacgctgtcaggaattggtccggtgttttgggaagctgcgtgattcctgcgtccttgaacacctttttgttataaatcacaccagagtaaaccatcgcaattggaataccgtagctgttatgatccaccgtacgttcttcaaggccggtatacttgtttttcatctcctcataagtacccagcggctcgaaaaagttgggcagctcttcaactggaatactgccaggaatcagcaaaacatctccataatccctggtccccatccggattttaatttgaccctcataatcggccaatgcctgaaaattgaccttcacgttcggataaagtttgttaaattccttggcgtaatcctgaaatacggtatccacaatatcagtccgctgtgtgataaccgtaatttcaccttccacacccttcggatcagagctggcagctggctcatccttctttgaggtacagccagtaaacagccccgctaacaaaaccacggatagtaatgacatcaaaaccttggacaacttcatgagacgacccctcctgttgttttcaaataaggttatcgttaaagtaacaaaatcattttattatgttagcgcttactgtgtcaattacaatattctttttgtaaagtggaatgggtcacatcttatgaaaaaacaccaatttagcatggttgacagtttacaaacagctagatatgatactcctgtaaagttaacgataacttaataatttattttccgaaggaggctttgtctcttggaaacattactggacgaaattagacaggaatggaaggaacacatactcccattctggcttggactgaaggatgagacacacggtgggttttacggcgaggtggacgtggatctgcacattcataaccaagccgacaaaggagggattgccactgcacggctactctggtcattctcggcggctgcccgtgtaacaggggaagatacctatgcagaagccgcacgacatgcattcacattcctgcgagatcacctgcttgatccattacatggaggaatgtactggatggtggactacaccgggcaacccgtggacacgtgcaagcatgtatacgcgcaggcattcgcgatctatgcgatagcagagtatgcacgtgccacagacgacccgaatgcattaccactagctatggagctgttccacctactggagcaaaaaggatatgatcccacccggcaggcatacggcgaacaatatgaccgctcgtggaacatgcagcctaatgagctactcagcgaaaatggggttaccgcgcatatcaccatgaatacgcatattcatgttttggaggcgtacacccaattgctgcgcgtctggccaaatgaagaggttcgagatgcactgacgaacgtactggatattttatatcatcgtgtttacgatgcttctgctcgacgactgggggtatttttcgatcgtgaatggcgctctctgcttgacctgacctcatatggtcacgacatcgaagccagctggttgattgaggacgctatgagtgtgttgggttattacccgtcagaatacgtggatatggtgatggatattgccaatgcggtagcagagcgcgctgttcagccagacggatcgctcatcaatgagcgggaaggagagcgggtagacacctcacgtatctggtgggtacaggccgagggaatggttggtttttataatgcgtttcagcgtacaaaagacgaacgttttttgcaaattgtgaaaaatctatggtcctatacccggcaacatatcatcgatccgcgccccggaggcgaatggttctggtcagttcaagcggatggtaagcctgatgcgagagagattgcaggaccttggaagtgcccttatcacaacagccgattttgcatagaaatgctagaaaggatggaaaaccaatgatccatagcaaatataatgagctgcggttgcagcaagaggaactgattacacgccccaatgaggttaaaactaccttttataatggtatctacgaacgctacatctacccagtgctcacacgccatcatgttccacttcactggcggttcgatctggatgcgcaaaccaatccctttttcatggagcggctgggtgtaaatgcggcattgaatccaggggcgatctatcatgaaggaaaatacattcttgtttcgcgtaccgagggactggatcgaaagtcattttttgctttggcagagagcgataacggcattgatcaatttcggttcattgacgctcccctcgtatgggaggatatcgacccggaagaaacaaatatgtacgatatgcgattggtaaagcatgaggacggctggatttacggtatttattgctcagagaaaaaagaccctgacgcgccaccccacgatacctccagtgctgtcgctcaggccggactggtccgcactcgtgatcttcgtacatggacccggcttcccaacatcactacccagtccccccagcagcgcaacgttgtcctgcaccctgaatttgtggacggtcaatatgccttctatactcgtccccaggacgggtttatttccaccggttcaggcggaggcatcgccttcggcctgtgcaaagatattacacaacccgtgattgaacacgaaaccgtcattgatgagcgttgttatcatacggtgtacgaagccaagaacggacaggggcctgccccgatcaaaaccagtcgcggctggattcatatcgctcacggggtacgcaatacagccgccggactacggtatgtgctgtatacctttgccaccagtctggaagaccctacgcgcgtcatcgccaagcccggtggacactttctggctccttatgatgaggaacgcgtgggcgacgtttcgaatgttattttttgcaacggggctgttgttaacgagcaagatgaagtctttatttactacgcgtccagcgatacccgtattcacgtagcgacgaccaccatcgctcggctggaggactacaccttcaatacaccatccgatcccttgcgctctctcggcagcgccgctgttcgccgcgagctaattcatcacaatgaagcgctattacaagcacactcccgtccttcccagcggacataagccgcaggctttatcctgcttgcggaaccatgtatactatccatagaacaactgttacccgcaggctaatagttgttctatgggcagctacgctgctaagttttttggattttacaggcggctaagctactgatatattccccagcattttgcatccattctctggattaggcaaaatgcttatctttttaaaattggaaggcggaacaggaatgaagagcaacgttacgatgcgggatattgcagataagctgggagtaagcagcgtgaccgtgtcgaaggcgctcaatgacaaggatggggttagcgaggagctaaaagagcgtattaagacgctcgcgggcgaaatgggttatcgtttcaataccgttgccaagtccatgaaggagggcttcacctataacataggtgttgtcattcctgaacgttttactggccccggccaatcgttttatctgcacatctaccagcaaatttcacgagcactggagccatacggctactatggcattcttcacatccttcatcgcgaagacgaagaacagcttaatctgccacgtatctattacgaccgcaaggtggacggcttcattctcctgggtcaagtgagcaagccatatatcgagctgatacaaaccatggatctacccaaaatgtttctcgatttttatgatgaacatgccgatatcgactccgtggtgacggataatttctacggagcctatgagctgaccaactatttgatcgcccaggggcatcgtgatattgcatatgtaggcaatatctattccaccagtagtattcaggatcgtttcctcggctactataaatccttgctggagcacagactgcccctccgtaacgagtgggtgctcagtgaccgggacgacgaaggtgcttttgttgaaatagagctgcctcagccgctaccgactgcctttgtatgtaactgcgatcaggtcgctcacaatctggtacacaagctcattggtctgggataccgcgtgcctgaggactgctctgtggtcggatttgacaacgatgtatacgccactcttattgttccgcaactgaccacagtcggcgtagacatcgagcagatggcacgtactgcgattgattcgatgatgaaaaaaataagtcatcccggcggccgctttggtcgagtcctcgtacagggtcatattgtatatcgtgattccgtacagcccatccagagaccatgatcaacacacactttacttggggacaggtcacccctaccccaatattccacaatcaaaagccgctcagcatgtcgctggagcggcttttgacgttcataaattctgcagtatgatctcgtactcactttcaatggtggattttgcaaaatcctggattaggagcgctgggcgacaaaggaattgcccgcccgattgagaatcggcagcatccgcatttcctgccccattgaggcttggcaaaatggacaagctggctcgttcaaaaaggtgaaatccgttcgcatccaaccgttgcaaccctcgtttgtacacgaccaaatagccgtattttcctctggaatgatttccggggcctggcgtctgtacatctatatcccccctcggttttttatagggtaatatcccctgtcggcttactgttaattcccacctgtgcgggtattaatatgctccaacctccaaaaaatatgcgcaatttaccaaaatgtttatttacggatagccttagtccagaagccgccatgaaactgcttcggctctaccgtaatgacaaaagccttagggtccagctccagaatggactgatacagcttattctgattttttcgtttagccaaaatttccattaccaggcgctctccatcacgtccactgcccagccaggctgtaacgccgtatcctttgtcccgcagcgcattggcaattcctccattgatctcattgctgatcaccttaacggtgacataaccgagcgctattttttcctcaatccatgctccaataagaatgcccaatgcatagccaatggcgtatactgcaagacttgccacttgatccaggtacttaagcacaacattcaagcccaatacatagaccgtaacttccacggtgctaatgagcgcagcaatgtacttctgtcctttcagcgtcagaatcatgcgcagtgtatacgccgatacgtaaataatttgaataacgagaataaacaataaaattttgagcatgcgctcactccccacttcacgttctgatttaatccgtatccaacattatacccccgtctgtgatatacagcctctggtttcgtattaccctcgctcgggtaatgactaactacagcatgctgaatgaaagttcgatcacataaggagggctataacatgaaggataacggaactagcgataaaatcaaaggtaatgtgaacaaagccaaaggtgaaatcaaggaccaaatcgggaacgctaccgataataagtcccttcaagccgaaggcaaactggataaggtcaaaggccatcttcaggaaacagcaggcaaactgaaggacggcaaataatcctgaatggataacctcgacgcactgttttaccaacaagtctcgctgtcttgtgcagcgggcttgttttgtgttgttcggatacttttggaaaaacttttgcgcaaacagggcaacttttacggttgctgttgcgtctaaccaatataagcacaacccataatgactctccaagctgttggattttgtaggcattaatgttactctagtctatgaaccaggctataattcttaaataaaggggtagaccaacgaatgaaatcactgaaatctatcaaaaaacctgtcatcatcactgccgtatccgccttggccatatccggggctcttttcagccaatccacatatgccgcacaagtgactaagccgatccaagcagtatataacaatatcaaaatcatctacaacggaaccgaggttccttatgatgccaaaacagaaccattcctgctggatggcgtaacgtatatcccactgaagctggcaggtacagctttggataaaaaggtaacatgggatggcacaaacaaacgcgtagtcattgccgacaacggcgtcccgattgatcaatctacagtgacggcgttgaacaaccagattacgacgctgactcaagagctcaacacagcgaaagcagcgaacacaacgaaggacgctaccattgctcaattgcaaaaagacaaccagacgctaaaagatgaagcaagcaaaaatagctctagctccttgaaagatcttcaaaagaagctgaacgatgatcacagggatgactacaacaccaactcggatatcactctggatggtaacaaaaacgatattacggtgaccatcgaaatgacaaaatccagatggactgagttatctgacagcagaaaggaaagcttcctggaggacatcgtggaagatattttgaaagagtataaagatgccgatgtagagggtacggttaaaaactccagtaatagagataaaatggcgaccttcacaaccaacagcagaggagatgttactttgaaggatgtagcttcttccttggatgcaagtacgattcaacgtgatttggttaatagatatggcaattacgctggcgttggctttgatttcacagtaagaggcgacagcagtgaagctagcgtggatgtatatgtaaagactgacgcttggaacaatacacttactaatgcgcaaagaaactctcttatagagaatgttctttatgagcttaaaaacagaaactcggtatctcgagtagtgggtaaaattaagtctagcgaaaacagcaacacgataacttcgttctaaatcgcacttttttcaaaaaagcgacaaaggcccttaagcctttgtcgcttttttatgatgtacaagcaacatacattccactacttaattaatctgccaacagaagtaatatattttatataatcttcatccgcattggttgtatcgatattcattgtataaaccaaattaccaggactggttattttaactttgtaaaacatactgggtttagaataaggatatacactataggtccctttgctataaacaatcataggattaaagtcaatttgcttgaaggcgggcgataagtcgctcttatacgtagcatgaatattcaatacaccttgcctttgatcccagccaaaggaaaaaagatcaaatgcattcgcgtcaatgacttgggccaagtcttgtcccttgaacctcataagaactggactttctgtaaagctatcatgccttagcttcaataagccacgcttggaatcccactccatctgcgcatctgtatctttcaacaaaatggaaactggtaaaaacatcgcgttgcttttcatgatggggactgtgtccattgtcactggcttaccgttaaccgatatttcgggtgatccgatcgtagtcgttacattacggcctagcaaatcaacagaagccgttttgttcgctgcattataagttactttgccgcccagtatatcttcagccgcttggagtggtataaacagtctgcccttcggatccacaaagggaggggcaggataagtgtataaaacgtaatgatcattgacctttaggtgtataggggtctgagcttgagctgatgttgaattggagaatgcggtaacaaaacttagtacaatcataacactgattaattgcctgattttcataatgccctcctagtgattttgtttagattcaaaactaaattacggagaagaggtacagttgagcaatcataaaacggaaaaacatctgccaaaccacattgttgtaagtttcacccaacaaaaagggaatgacagatgctattcagtatattttagcttgagccatcgtttaactattgttcttaacggtttggatttctgatccacacacttgtatcaaaatgagtaatataatcaataggccaatcaatcgtaccgaaccactgacttccatcccaaaaagagtaatcccgatagttatcccatggataataattatccgaattgaatttcgagactaccaaatctgaaaattctccaccgatagcacttccatagatattgctgccatcaaagttatctttcgctattgctgtcactctcttaacagacatagacgataggtccgaggaattaaaagaggtttgcataacgacgatttgattgtagtaggctaacagataagcgttataggtactattatcaatataaaatttaactgaattatatccctccccatttacccacgaatctgtagaatattcataaaatccatttttaatgtatcctaagtatcttttttggcccgtttggaatgaaaatcccccctcaactttcttcccgttcttcgaatcaaaaccgtaatacacccatggctgttcgtttgctcctagatccctaacggttggtaaaatcacacgtgcattgaccccatcaaagccatcataatccaattgaacccttgagaaagttcccgttgtccctccactcacttgcgatggagtgggattatttttacttgatatggaaacatcatgattgttgcttggttcactcaaagagtttgttttcatataagtagcatccgttacactatcttcttttgattcaactttatccgccatacctacataacctttttctgagctgtatacttctccatcgagcgtaagatatatgtattccgatttgttaagcttctccagattttgttgtagatcactattacttttactctttagtgatgtactatccgctgtattcagcagttcagcaatagatgctttcggattaacagcgatcttgtgttcttgaagctcatggactatggcccgctgtttaagattttcaaaaaatgaagcatcgtacgtactaggcttcgattccgcataggcgagacttcccgaaagtgaggagcacatgagaatggttgctaaccccatgcctaaaaacttttttttcctaaacatacacaaacctcctagttatttttcgaaactagcatacctccataaatacataacgtcaaccataatttataaattttacctaaaaagagagcatagtattttacatatcatagtgtatagaagggtcaactacgtatcaaaaaagaaagtgtggagctgtgccgtcaaaggcgcttagatgctgagatcttccttatagctatataattcataaatacattaataatattcataaatataaaggtatttagcattgaaagtagaatatatcactgtattccaatttagaaaaggggataatgtatatgatgagaagcttcgttaaacgtagagtcaggtcgagcattgcattaacattgacatttttattggcaatcgcaggtgcaccattaggtacaatagacgcggcggcaacggtgccagaccagaacaataagcaggatgcgccaaccttctctaatgtatcggttcatgacccttccattgtcaaagacggtgacacttattatgtatttgggtcacacatctctgcggcgaagtcaaaagatcttacaaactggacttcttttgcaaacggttacactacgcctggaaacacactttacggggacttatcgaagaatctagctggatctttcgcttgggcgggtgagaatgatgcggacagtaagggaggattctcggtatgggcgcccgatgtattttggaatgagcattatgtcaatgaggatgggacaaaaggggcatatatgatttattatagcgcatcttccacctacattcgttccgcgatcggcattgcagttgcacccaaaatcgagggtccatatcaatatgtggataccattatacacactggttttacgaaggagactgcattcgataaagatagcaaggtagataaaaaatggacaaatacgccgattcaacaactcattaaggaaggcaagcttgagggccccagaccgggatggtttaataccgatggttcttatgcgaaccggatgttcccaaatgcaatcgatgcaagcgttttttacgatgcaaacgggcgcttgtggatgacgtatggttcatggtccgggggaatatttttactcgagctggataaggcaactggcaaacccatgtatccaggtaaagatggaactacggaggacggccgtctgattgatcgttattttggcattaagatcgcaggtggatacggtgaatccggggaaggtccgtatattgaatacaacccaaaaacgggttattactatttgtatgtaacctacggcggtcttgcagccgacggagggtataacatgaggttattccgttccaaaaaaccgacaggaccttataaagatgccaaaggacagaatgctgttttgccggcaaacaccaaaaatacaacttatggcaacaagttgataggtaatttcttgttcgatagtaaaataggcgaccccggtacaggcactggctacggctatgtttcccctggacacaattctgtatacaccgatcctgctactggacaaatgtttgtcgtctttcatacccgattccctcagcagggagagacacatgagctgcgtgtacaccaaatgtttatgaatcaggatgactggcctgtcatagccccttaccgttacggtggcgagacgctaacaaagctggatgagaaacaattcattggcgattatcaatatattaatcatggcagtgattcttcggctacgatcaagaatacacaattcattcagcttagagcagatcataccattcaaggcgatgtacaaggaacatggcgcaagtcgggggatgcgaatatccaattaacaccggatggtgctgtgttggatggggtgtttttaagacaatgggatcaggttacgaatcaatacatcgtggcgtttacagttttatcgaataaaggtgagatggcttggggcagtaagcttcctgatatgaccgatacgacagtagtggacagtgtatatcgtgagttagatcttggcgatacaagtcgggtgaccgctagcctggatcttccgaaggaaggcagtcggcaatcccggattacctggaaaacttcagaccaaagcgtcattacggatacaggtgaaatcaagcgtccaggaatcggagaaaaggctgcatctaccactttgacggctaccattaccaaaggagaacgtagtcgggacaaagtttttaacatcacggtatccccttatgagaaggcaacattgactgcgtcatacacatttgaaaataatctagaggatcagcaagatgcttttgctaatggcgaagttatcggtgaccgaatcgatcgccagggaggaagtgtatcctacgctgaaggcgtaaagggccaagctatagtccttgatggaaagtcaggcattgctctacctgaaggactcatatccagctcagcatattccgtgtcactgtgggtaaaaccaagcgatttaactctgcatacaccaactttctttggagctatggatagtaaccactggattagccttctgcccagaggacccgagaaggataatacaatggtctggtccggcagctcactttggtataccggcagtactggcctaaagatcaaaacaaatgaatggacccatctcgccttcactgtagaacgtggggtgttagccgtgtatgtgaatggcgagcttcaatttatcggctcaggattcccagatgtctttacctccaaatctggaacattcagcttaggtgtcaactggtgggaccctgcgttcaaaggatctattgatgagctgagtatatttgaaggtgctctcccccctgtacaagtggcagagttagcgaagataaagtgaattaagactaatgaaacgtaagcaactctagtgtcgaaaagaaaaactacaaaaaaagagagcactaaatagcgctctcttccaatgaaacatataaaatataaggaatattaataggccaatgcaaaaagtcctttgatgtgggataagtaacggatgttactgccttccttcatcaaagtagctacagcgcctttcagttgggtgccattcgcgcctacagtaccgatcgcgtctgttctgcccaagctgcccagtgtaccggagaatactggtgtaaagcgttccattttcgctccgttgaaataagcgaagatgttgtaaccaactaattcgcccatttgccaagccaactgtgcagttggagggtatggacgctcgccttcacccgggaacaccactgcgctgtcgccagcgaggaagatgtcttcgtgagaagtcgattgcagtgcaccattcacagttgcgcgaccacggtttacttcgataccagatgcgccaaccagtgcattaccttgtacgccgcctgtccagatcagtgtgttcgttttgatcgaacgtccgtctttcaagagaacctcgtcagctttcatttctgtaatcggaacacccgctacgatttgaacgccacgtttttcaaggcttgttactgcacgatcaaccagtggttgagggaagcctgccaaaatagatggtccagcttctacgcaatacaagttgatatcttcgtagttaatacctttttcgcgacaaattacaggcaatttgtcagcatattcacccaccagctccacgcctgtcagaccgccaccaccgataacgattgtagcgtctgcttggttaccggattgcttgtaagcatccagacgagcttccacatgtgcgcgaatgcgattggcttctgccactgatttcagcgtgaagctatgctcttgcagtcctggaataccaaagtaagccgtttcgctgcccagggaaataacgagagcgtcatagctcaacgtagcgccactggccaaggttacttttttatcgtcaggcttgatttcggaaacagtatccactttcaggataatttctttgttacgcagcagcttttccaaaggaagcgcaacagctttttcggcaattgtacctgccgccaaacggtgcagttccgtaataatttggtgcgacgcaaagcggttaaccactgtaatggttgcttggctagcgtccatatgctggcgtgctgtaagagcggctagcaatccgccgtacccgccgcccaagatcaaaatttgcttcgacatgtccatcctccgttctcgatcaggtaattatttgctttcgcgttggcgctcattcagaatatccaggaaagcctggctgaaacgcagcgttttttgtacattcggatctttaagcattttgagcaggccaaacagacctacactgccgtccgtagtttgtacacggtcatttgcttcaattgcagcagaagccaatcctttagccgaatctgtaacaggcttcacaaactctcccatggagcttttcatatctccgataaagacagggtcagtcgccagactgcgagctacatcataagcgtcggtcatcaaagtaaccatctcagtcaacttgggcagattttctaccagcacggtcagcgattgctgaacctccggtttcatcaattggtccaatacatcccgagactctttggtagcttcctgtgttactgccacctcttgttggttttcagacatgcgtgaacgtcctcctttactgtgaaaatagaagtccattcctttctcgtaacctgtatccataaactctagcaataaaacgttcatcgaattcacgcccttaaacatgcaagaagcacagctaaaaccggcctataccctacagggcaagactgatttatcgcagatgccaattgtatattgctcagacggtattctgttgttactgctgcggaatattccacgaagcgctccttcgtgactacaacaggccgaaacggaaccctatacctctatattacacctttcacgacacaatcgtcgaagaaattttaaatttgcacaaatttctgcaaaatttttattgttattttagataaaaattagaataagctcgatttttgtccaagtttcccttaaaagaagggtcatcttatgctagaggagggtaataaagagagtgagttttagttcgataatatgaaaataacacaaaatatattcatacggaggttttaaatgatggctaaaacatttggagatatggttcaagaagcgaggcagcacgttcagggcattgattcacaggaggcacgtcagcgaatggaggcaaatccagatacattcgttatcgatgtacaggactcccatgatgcaggcgcttgcggtctgattcgcggaagcgccaatatttcattgggcatgctgcccatccgcgctgacttggaggttccacaggatttgcgtgacgaacgtctacgtgaccgcaaccgcccgattatcaccacttgtggggcaggcggacaagctgcattggcagcttatacactccagcagatgggctttaccaatgtagcttttatcgaaggcggaacaacagcctggaaagaatccggctttgaagtagaactgtactaagggatctacgctccaagagtcgccctacgtatgtagggtgccttcagaagcgtcaggattatcaggtgcctcgaaatcatcaggagacggctgcggtacaccagactcaatgaactcatctacatcacgggcagccttaacttgattgcattcattgcaagcacatacacaattgaccggcgtggtgtgccccccttttgcccgaggcagtaaatgatcaatcgtgtcaccgtagcccccgcaaaaaaagcaagtataacggtcacgcttaagcacatattgacgaaattccttgttgctatacagtctgcgcacggtgtatggattaacaatcaccgccatacgctctctgaccagggtcatggccagatcaagctcaatctcttgatgccagcgtctcccctggtcggttttgcctctcagccgaatcatgccattgcgattgagccgcaacgcccgggtatccgcaggcttcagcctgctaagcagatgccgaacccgttgtcggtggcgttcacgcgctttatccgtgatcggcttcctgcgggggcgttgtgcctccataggtagcgacgcctctaggctgtgcgcagccgtatttgcttcaaggctatgctgcatcacgggagcagccgaggggttcgttttctcgccggaaggagcggacgtagccgcacgttcttgcgggcccaaccctcggcaggaacggcaaggaccacgccgggaataaggaccagcccggcgacccgttctgcgctgaaagtccgttaaaggtttcatctcctgacaatacgtacattttttaatcagcggtttgcttgcttcatccttgttctgctgcggttctgtcacgtccacacctcctttcctctgttgctcgcgcttcacagtttgcccaaaacccgaactattgttaagttagattcattttaccgttttcacgttctcttttctagctacccgagtcgttgtgaacactcaggtataacaaattttaatgattcagcatacgttatacagcgatccttgttcttcattcagcatcatattgaccgtctgacgtttagcccccctcacttggtgggtaacttgttatatatgaaggagggacgtacatgaaaaggaaccatacgatgatgcaatttttcgagtggaatgtcgaagctgacggttctcactggaaaaagcttacccgcctggcgccggaactgaaggccaaaggaattgacgcgatatggattccacctgtcaccaaaggccaatcgcccgaggatacgggatacggcgtctatgacctttatgatctgggcgaatttgaccaaaaaggtgcggtgcgcaccaaatacggaaccagggaagacctgctggaggctgttgccgcctgtgttcgccacggcgtgtccgtctatgtcgatctggtcatgaatcataaggccggcgcggatgaaactgaagtattcaaggtcgtcgaggtcaacccggataaccgcaatgaagtcatttccgagccctttgatatcgaaggttggactaaatttacgttccccggccgtcaaggtcagtattccacatttcaatggaactttgaacattttaacggaaccgattacgatgcaagccaggaccggacaggaatctaccgtattttaggtaaaaataaaagctggagcgaaaatgtagatgatgaattcggcaattatgattatttaatgttcgccaatattgactataatcatcaggatgtgcgcaaagagatgatccgttgggggaaatggctagtagatactctgcaatgcaacggattccgtctggatgcaatcaagcatattaatcatgaatttgtacgagagtttgctacagaaatgattaaaaaacgcgggcaggatttttatatggtaggcgagttttggaaaccggatctggaatcgtgtcaaaagttcctggataccattgattataaaattgacttgtttgacgtatccctccactacaaactacatagcgcttccttgggtggcaaggatttcgatttaagcaccattttcgaggatacgcttgttcatacccatcccctgaactcggttacttttgtcgataatcatgattcccagccgcatgaagcgctcgaatcctgggtggaggactggttcaagcctagcgcctatgcactcatcttgctgcgcaaggacggttatccctgtgtgttctacggcgattactacggtatccagggacaaacgcccgtgaaaggcaagcaggctgagctagacccgctcctatatgcccggtaccataaagcttatggtgagcaaaaagattatttcgatgatccccatacgattggatgggttcgtcaaggcgtgcctgagctggaaggctccggatgtgctgtggtgatcaccaacgcaaatgacggagaaaagcgcatgttcgtaggcaaacaacgtgcaggggaagaatggatggatttgaccggacatcacgatcataccgtaaaaattgagcaggatggctacggcatatttcccgttcgtgccggcagtgtatcggtgtgggcacttcccgcagaggaagacagccaggaaacagaagaagaggaagcgaacgcttaatctatacccaacacaaagaggacaggatgcgaggaagcgccctgtcctctttgtgtatggaaagtcactccgttaccttgctttggttggccacggcctgcttcttagcctctacatgactcggatcaccgagataaaaacgccggatgggatctatatgctcatccagctcgtacaccagtggaatgcctgtcggaatattcaaatccagcaatgcggtttcgtccagattctccatatacttgattaaggcccgcaaagtattaccatgtgcagaaatgattactcgatcctttttgagaatcaatggtacaatccgctgcttccaaaactcaccgacccgatgcacggtgtcctccaggctttccccaagcggcagctcttctggcttaatattacgataacgctcttcccgatgcggactccgctcgtccttctcatccagcatggggggccgcaccgtcagactacgccgccagatatgaacctgctcctcgccatattgcacggcggaatccagcttgctaagcccctgaagagcaccgtaatggcgttcattcagcttccatgacttctgcacaggtatccagagatgatccagctcatccaagatgtgatacagcgtgcggatagatcgttttagcacagaggcgaatgccaaatcaaacgtataaccagcctccttgagaatacgtcccgcctcaatggcctcatgagtcccttgttcagtcaggtccacgtccgtccagcccgtaaacaggttttgtcggttatacacgctctgtccatgcctaaccagcaccacttgatacatgcactcactcctctcctgtctgtctttatgttttacccaacttctatgtatttaacgtaaaatgcaatttttaaaccgtctatttaatacaaaaaaggacggcattcagccatccttttcttcttaccctgcacttagtccctcttactgaatttggccaacagatccagaatccgtacatacagccatactagagtcaccagcaatgcaaaagcaccataccattccatatattttggtgcgccttgatctgcttgctcttcaataaaattgaaatcaaccagcagattcaaagccgcaatgatcacgataaataaactaatgccaatacccagccaacccgtttcatggatatagggaacattcataccgaaaaagttcaaaataaaatcaaccagcgtcaccagaaaaatcgccatcgtacacaggacaacgaatgagataaagccgcgtgtcaccttgatgattcgctgtgtgtacataaagagcatcaagaacaagatacccacggtcagcaaaatggcattggctacaattccagggtactcatactccataaaagctgaaacgccacccaaagcaaaaccactcagaatcgcatatacaggagagagtaacggagccgttttgggaaaaaaggatatcgcaagtgctacgcctgccataccaataaagcctgccgtcagcaaggatagcacctctacggttccttcgtaggtcatgtaccaggtaatacttccagagacgatgagcagaaccagcagaagcaacgttttgttcaccgttcctccgatggtcatgcgttgttcacttgcttctctttcatcttcgcgcaaaaagatgtcatcacgtaaaaccggattgctaaagctcatacagggtactccttttcgatgttgttgtttgctatgctatatgtatatatcggcacaatatgaaaaaagtttcagaaaatttcaaacaaaaaaactctaaccttgccatacggcaaagctagagttagaggatcaggtcgttacaggttaaaaatcagctgtcgcaatctggatcgtacccgtagctgctccagctgcggtagtctgcagagcagctaccagcagtaaagcaacctctaacgtgaggctgttagttggggggataacataagtgatcacaggtgcattgacacgagttacgacaagatcgatcggtgccggaccgttattattaacggtaattgtagcattcgcgccaccgttcaagttttcaaagtatgatttaccaatattagctgcgagagaatagaattgctgaggtaatagaatcgccataggattcacctcccttgcgcttgatagtgtattctatgcttccaatctacgagcgtaacgttaagtgactcagtaataagacacaatttgaaagacttatagattaacgtaccctaacctatgcaaaaaaggagttgccctctcagatcctttgcagaatctgcggacaactccttactaaataatagaagtatcagacagtataaaagcagttagcaggattgtatgttgcctttgataccttattgcacgtcaatgctcaattcctgcgaaccgaaacgagaaggcgcggaaaccttcacgcggatattgcccacctcccccgttgtacgaatccagaatgcaatgcgtccaccaattaagggtaagcttgaaggaccgatcaattgacccactccctcgacctccaccgaaactggatctgcatagaacggcagggcattgccgtattcgtccagcgcatccactactactcgggttacgtcccaatcgccagcttccagcaccatatcatctgcagctacgcgtagctctgtcggcaccggattacgtgaatagtttctgcgtatcacttcttgcccatctacgtatccaatgaatacagcgtcttcccacttcatgccccagtggcctgtcagctcatcgatcacgacaggggggtgaggaagcgccgggtacttctctcggttcggacgataaacacctttgcgctcatgaccgtagatgaactccacctcatcgcaattggtgaacacaaccagcggcacgatgcctccaatattccgctcaccacgcgaccagtaagtgaccggctccataacgatttcctgttcgacgttcttctggctccggtacacactcgctgcaaatttaggcagtcggaacatatccatgacaccgtggtagcagattttatcaccggaaccaaaatcagcatgcgtgttatagtcaaaagcacaccaaccaatcgccccggcaatgccctcatcggcataggaagcattttgcacccgcgtatggcgcagtgcatgctccattacccgttcctcctggtcaaaacgcttggttgggtacatatgcccgttatattccgttaccagataagggaccggatgatccagctttgtaacgagagacggctggcgcaagcctgtcgtttcgccatctacgccttctgtatcgtcatacgtatcaaaattgcggatttccttcgccaaatattttttgtgcccaccatcatgaacaaaatcatttatcgtatatacatcttccagcagctcactgcctacaatataacgcacaccacccgtagcacgggtcggatctagctttcgtgccagctcattggtacgcgtgtacagatcatggtcatcctgcgactcattaattcgtacgccccagattacaatggagggatgattacgatcacggataatcatgtcctctacgtccctcaccgcctgctccttccacgcttcaccgccaatatgctgccaacccggaatctcttcgaaaacgagcaatccgatctcatcacagcggtctagaaaatgacgggactgagggtagtgggatgtccgtaccatattcagccccagctcctccttgagcacatctgcatcacgacgctgcgctcttttgggcatagcataaccaacgtacggataggactggtgacggttcaggccgagcagcttgatcttccgcccgttcaagtaaaaaccgtccggctgaaattcagcctcgcggaacccaaagcgcacggtcacctgatccaactcttctccgcctcgtagcagcgtcagcttcgcttcatacagcttgggatcatctatatcccaaagccgcaggccgcccagctctttcagctccagcgttacttccgccgccgtcaccgctgccaactcggtctccgcctttacgctcgctccgtccagcaattgcagcgcgaccgtcaagtcgtcctgctgatcgccgatgccctccaactccacgaccacgcgcaccgccttatttgccgcaagcggctccggtgtctgaatgaatatcgttccaaggtgtacaggctccactattcgcagctgcacttcgcggtaaataccgccataggtcagatagtcaatgactgccccaaagggagggatgtcgtcccgttccgtggaatcgacaatgactgtgagcacattggagccgccatactcggcaagttcggtcaattcaacactgaacggtgtatatccacctttatgctcccccgcttttaccccgtttagatatacctgggcataggtcatgactccttcaaaatcaacatacactcgcttacctttggcatctgccggaatgttcagctctcttttatacgtagaaataaactgaaatgccttgtcgtcaaaataattatacggaagctctacattggtgtgcggcagctgaattggctcataccgacttgcatcaatgcctgcgcttacttcgctctcgacatattcaggaaggtaaaaccattgatcattcaacggcaaaatggtacgcatgggcagtcacctcaaccttttattttccactcttataccatagtaaaatatttaagtaaaaatgacgcgtaaaacttagtaaaataaatataggttcaatgtaagcatttccaagacaattgtcaatccatttttgtatctttttataatcaaaaaaaacagccccggaaggcggggctgtccaaatccatagcgtcgattttatttggcatcggtatgcagcggcgcactgctgttgcgaatcattagctcggtcggaatgatgaccttgcgccccacctcgtttgcaccgttgcgtactgtatgcagcaagagctgaacgcccgtttctcccatcagttcggtatgcgttttgactgttgacagagatggggtcaaatattccgctgtcggaatatcattgaagccaacaattgagatacgttccggcaccgcaagctgatgctgctccagcgccttcaacaccccaatagccaccgaatcgctcgcgacaaagaaggctgtaggcaggttttctggtcctgccagaatagccgcttccatcgcacggaagccgtctgccgctgttcctccgcacacatgaatatcatccgacgtgcatagcctatgctgttcctgataccgcaaaaacgtctcatagcgggcatctagctcgacttgttcggaatcatgggactgctcatccttacccatacctacatatccgatgtgacgatggcccgcgcccatcaaataatccagtgcatcagccgcagcgtgagcaaggtcaatgaccacatagtctgcccctgtacgctctaccggatgatccagaaagacgcaaggaatgggcagttccagcatacgttttacctcttcgctgctaaaatgccccagcacgatcagtccatgtagcccttcggataatgccttcagtgtagttaggtcctctcttctgaaaatacgctccagctgcgccccgctttggcggcactctttttccacgccaaaccgaatagatagataataagggtcttccagttcctcgtacgcactaaaccagtgcactatacccaaccggatgggtccctctgccttcttgcggggctgacgaccaataccgccatttttacgtttaaccgtcgtatatttcatgcgctcggcaacctcaaaaattttacgccgcgtttcctctgatacagacagtgtttcatcataattcagcactcgggagaccgtggatatcgaaacctctgcctcctgggcgatatcttttaacgtaggcattgcagactcctttaatcgttttactttatttttacttttattttactattatcttactcgtctcccctgtgcaacacaacccgtcattcctaaaagggtcaaccatttttttcatattataagcctaatcatgataaaatacgtaccataatagaaatgacactaaggaggatacacacatgaaacaggaactaattgaccgcctaactacatatgttcaggtagatacccaatctgatgaaagcagccacacttgccccactacacccggacagctcacattgggcaacctcttggtgggcgaattgaaagccattggtatgacagacgtaactattgatgataatggttatgtgatggcgacccttccttccaatacggataaagaggttcccgtcatcggttttctcgctcacctcgatacagctaccgaactgactggcgcaggggtaaagccgcaattgacggagaactatgatgggggcgatatcacgctgaatgcttcgcttggtgtggttctttctccacgtgagtttcccgaactgactcaatataaaggccacaccctgatcacaacagatggtaccaccctgctcggtgcagacaacaaagccgggatcgcagaaatcatgacagctatccactacctgattgaccatccagaaattcaacatggcaaaattcgcgttgcctttacaccggacgaagagattggaagaggaccggaacgctttgatgtagccgcatttggcgctgaatatgcctatacggtagacggcggaccgctcggagaactggagtatgagagctttaacgccgcagccgcccatattaccattcacggtgtgaacgtgcatcccggtacggctaaaaacaaaatgatccacgctgccaaaatcgctatggagctgcacagtcggttacctgcaaacgaagccccagaatatacagacggatatgatggcttctatcatctcttggagtctacaggcacggcagaacaagctaagctatactatattatccgtgattttgaccgcgagagctttgaaaaccggaaagcttatttaacaaatgtagtcaaagagctgcaggccgcatatggagaaaaccgtattgcgctggaattgagagatcagtattacaacatgaaagagaaaatagagccagtcaagcatatcgtcgatgtcgcttatgaagcaatgacaaagctgaatatcgaacccattattaagccgattcgtggcggtacagacggttcacagctatcctacatgggactgcctaccccgaatatttttacaggtggggagaactaccacggtaagtttgaatacgtgtcggtggacaacatggtacttgctaccaaggttattgtggaaatcgcacaactattcgagcaacgcggcaagtgaactacctatacacagcactgacacgttaagattaaatagaaggcatatcgttccttaatggaaacggtatgcctttttttctgaagctttcatttccctttaaattttcaatatctttataacttttatccgtctttagaccgacaactatatacgagactataaaaaatatatctagtaaagaaaggtaggttatctatttgaatacaatagatgcattaattgcagccattccctacatacaacagattatgcgtgagaaagtgacccttgctctcttcgaccgcactcatgtccttatgtatacccaatcggagggtatggacctcggctttgaaacgggctcggagctgctcgaagactataaagattttgccatgcttaaaaatggacgtgagcccagcctgacccacatccctgctgaaatcctagggtttcctcttgacatgatcagtattcctgtatttgacgagaaaggtgaagtcatcgcagcatttgcggcctcttataatttgactaacaaaaatcaactggatcaaatcgtatccgagaacctctccatcactgagcagctcattgatatggtacagcatgtggcggctcattccgaggagcttcaggcaaccagtgaacagattttgaaaaacacccaaatcgccgtacaaaactcgggtaaaatcaatcaggtagctgtgttcatcaaggaaatttctgatcaaaccaacctgcttggattgaatgcagcgatcgaggccgcgcgtgtcggagaagcaggtgcaggctttggtatcgtcgctcaagaggttcgcaagctatccgtagaatccaaaaaggcgacggtcgatattgaaggagcccttaaggatgtacaaaactccattcgtcaaatggagcaggaaattgagcaaattgtttcttcttctcaggagcaggcgactctggtaggctctttcactgaagtgatggagcgtatgcaaaaggcgagtgaaacgatgcaacatctggccagtcacctgacttcgtatgtcgtaaaataaatcttggcataaaagaggggagcacactgatcgcaaatgcgtaaaagtgtgctccttttatgtacaaaagccctatcgggcttgaaggtctaattctgactcaagcagtataagaaaaaacaccatgatttgaaggaattacagggtctaaccctcccaaaatatttcccaccggaagagcaatactaagaaacgccaagaccatagttaccgagattaatgcctttttcattatgaagcccccttaataaaatggtttggtattgctctcgctgtgatggtgttgccaaatctcgataagtctcaaacagagcaaccagtgtcctgaaatcggcatccgcttctacactggcagagaattgcagagaatcaaggacataatttaaggcaacagaatactgcttcttcttgaaatggtaaatggccaattggttgaccagttttaaataatatacgcggtttgctctatcttcataaccttcaaatatcttaatatcatcggcaaaatcgttcagcaggtcgtctatattccaattattcaggttagctgcttcggcaataccaaccaatcctggaagtagctcctcgtcattgtcgtgaagaaattgaacgtactcaggcaaaagttcccttctccccgaaagtaattcaatcgtaaataaattggccttggcgaggaaacggaatctctctacttcttcgtgaccgctctgatccagccccataaaccaacccatttcgctatacttcataatatagtttctggcttcctcatacttgcccatattctgatagtaaatagatttcgccaaataactgtaagcataataaaacactagcgggtgtttggtgtccaatgtctcatacttgccgtctgcagcatttctcagttgggtgtgatacaggttttcagccaacgtatgcagatagtctgctactttgttcgcttcatcccaatcattatgtgtgtagctgattctaaacaactcacaagctttatcgagttcgtggctgtccgacaacaaataaatggcttccctttggttcaggacctcttccactaaaacccgcctccctatcctgaaaattgcgattaccccttagcacagcggctactcttcagggtagttatactcttagcctccattttttgtataccattatattacaaatatagtcaaaacctaacttgaagtcaattcaatcatcactaccttctttttttgcaaccttacattgctgtgtacggttatcggttacgaatagttgactccccttatagaaataatgctaaagaagacaaaatgtaggctctctcatggatggtttttatgatgctatagtatcgtgggggtaactacgttacgaattagtgcgtacttttcaaccgggtagctgggccttacaatcaaacctgtgcatgaaactaaagtatagattgatactcaacagagcatgtacctgttcatcaaaatataaattcacttaaggagtgaagttaataacatggaacttcaattggctttagacttagtagatatcccgcaagggattgcattggtaaaagaagtagagtcgtatattgatatcgtagagatcggtacgccgattgtcatcaatgaaggacttcatgcagtaaaagcaatgaaagaagcattcccgaatctgaaagtgctggctgacctgaaggttatggatgcagggggctatgaagtgctaaaagcttccgaggctggtgcagatatcgttacgattttggctgtagctgaagatgcaacaatcaaaggcgcagtagaagaagcgaaaaaacaaggtggcaaaaaaattctggtggatatgatcggtgttaaaaacctggagcaacgtgcgaaagaaattgacgctcttggcgttgactacatctgtgtgcatacaggctacgatctgcaagctgaaggacaaagcccattcgaagcactgcaaaccgtcaaaaaagtcgtgaaaaactccaaaactgctgtggctggcggtattaagctgagcacattggctgaagtcgtgaaggctcaaccggatctggttatcgtcggcggtggtatcactggcgaggacgacaaaaaggctgtagcttcccaaatgcaacagctcatcaaacaaggttaaccccaatggaaacctctcaatatttatctgaggtactcaaggagctacaattggttccacaattgatcagtgatacggaatcggaacagctgatccattccatcgccgttgccaataaggtattcgtagcaggtgcgggccgctcagggttcatgattcgctcgctggcaatgcggctgatgcatatgggaattcaagcttacgtagtcggggaaaccgtaactcccggtttgggcgagggcgacctgctcattatcggttcaggctctggtgaaaccaagagcctgatctccatggcagaaaaagcaaagaaactcggagcctctctggcgctactaaccacttctcccggttccaccattggcaaactggccgatatcatcgtcaagctgcctggtgcggccaaggacccgtccaacaaggactaccagacgatccagcccatgggctcattgtttgagcaaaccctgctgttgtacggtgacgcattggtactcagaacgatggatctgcgcaagctgacctccaaatctatgtttggtcaacacgccaatttggaataaaactgtaattcctttacgatagcaaagcaggctgttctttacatgtcacatgtgaagaacagcctgcttttatgcttgtataaaggcgatgttcgatacagcatagaataaggcaaaacgagcccggcatgtattcaaaccatttattcgttgttccctgctggcaacgacgggactttggacggatcagcaagtgcccaataggcatatttggcctttaaccgttcgtcgaatagtagcggcttatccagccgggctatcggaaacgtgctgagccacgtatttccatcatccgtaccccaaatcgtcacattgctgatatgttcctgctgtcttgaaaacatatcgaacagcgcccgatagcggtgagcctgccggatcagcatagattctggaattgtttcatagcgatctgtgtcattggaataaagacccatatccagctcggtaatttgattatccagaccaagtgaagcaaacttttctatggactgctcaatctcgctaatagcgggaaactccaggcggatatgcgattggtgacctaccccgtcaatcggtacacctttagcgagcagatcacgtaccaaattgtacagaaaatcccgtttcttcggctcatgcgtgttgtaatcgttaatgaatagccgtgcgttcgggcccgtcacttccctcgtgacacggaatgccttttcaatataatccgtgccggtaatctgataccacttgctgcggcgcatgccgtccggctgatcaggatcaatgacctcattcaccacatcccaatcggtgatgacatttttataccgggctgcaacagcgcgaatatgcgtctccagccgatccagcaaaagctttttattttcagtagtcggcgtcatcggctgtccattcttatccttgaacatccaatccccagtttggttatgccacaccaaagtatggaagcgaatttccagtccatgctgtctagcaaactgcacaatttggtctgcttcctcccaatggaactgtccctcggacggttgtaaggagatcggcttcatcgcattccctgcaacgacgctgttaaaatgcttctgtaccaactctccgtaagccccttcggtctggaaggcttcaatcgccgtgccaatgctaaactgtcccccatataatccatacaaagaaggaatgtccttttcaatagccagcggtggtacaagtgacagctcgaaatcatccatataaaaggaagacgttccttctaccgtttccaaatacatagaaacagtgtctgcatcatgcgcaagcgtatacataccagacaaatgcatccatccccctgtcgtagtagccgtgtcgcctacaacagtttcatacgcactatccccttgatgatcacgctgtacgctgagcctcaccttggcaggctgctcacccggcgccagcttcacccaggcactgaccgtatatcggctgcccttttgcatcgtagcagtcacatccagcttgggtccggcatatgtcttttgtctgcctgttgtcagcagactgtatgagccgcttcgtgcatcggcgtccgaaacctgcacggtctcggcacccatacgggacacccatccttgagccgtaccatcttcaaacccggatacgataccattggccggctccggtggcgtcttcgatacctgtgttatttctatctcatccacatagtaggcctgcgcgggattcgagctttccacatacagcttcaatgcatccatccccccggtaaaagtatatttcccctgaagtttgatccacgatgtatccgccgtctccgtctgcgctaccgtcttccatgtcgtagtcccgcctgtgggctgctgctccactgtaagtttaaccatgctcggaaccgcagaatgaccatccagcttcacatagccactaatttcatactccacatccggctgcaacagcgacttcacatccagctccgccccgttccaagccgctgtacgagcggttgccttcagactgtgcgtgccgccatatgctgcttccgtgacggatgcaatttgggtataagttcctcgcggcttccagccatcgctgtttccttgctcaaatccatacgttccaatggtcttatggatactacccgccgatagcaccatatccgaaacgggcggggaatgttctatagacggagctgccttcactacagacgctccccaccaaccgacaggcgataacaacagcgctccagccagtaccagacaaaaaggcttaacccaacatgaccgcaaagcaatccctcccgtattccaatttttggaattggtatttggcaccattggttttcatttactatcctttgacaccgcccaaggtcatacccttcacaaagtatttttgcaaaaagggatacactaaaataataggcactgaagcgacaatcgtcatcgtggcccgaatcgaggtaggcgtgaccgacttcgccagattttccgaaccagcgaattggctcgcatagtcctgaccgttaacagacgtgttagaattttgcaggattttcatcagctcatattgaagagtgctccattgctcatatgatgaattgtacaaaaacacatcgaaccaggaattccattgtgccactgctgtaaacagcgacaccgtcgccagtacgggaacacacagcggcaaaacgatgcgcataaaagtggcaaactccccagccccgtcaatacgcgccgactccaaaatcccttccggcaatccctcaataaaggagcgaatgacaatcacattaaacaccccaatcaatcccggcacgacatatacccagaaagtccccagcatcccaagctcacgaatcaggagaaagttcggaatcaatccaccgctaaaatacatcgttaaaataaaagcaatcgaaacaaatttgcgcagcacatattccggccggctgatcgtatacgccaccatcgcgcagcaaaacaccgaagtcactgtacccacaactgtacgtaatacagaaatcagcgtagcatggaaaatcgtcgcttccttgaacacaaattcataattactccacgtaaattcacgcggccacaaatagatcccgccccgaatcgaatcattcgcttcatttaacgaaaccgccagcgtatttaaaaacggatacagcgtgaacaccatcaggcagagcataaacccgatattgcatgcatcaaaaattcgatccgagggcgcccgaaatcgcccgtgtacggccttccctttgcccatgactttcgctcctttctaaaaaatagtttaggcatttggatcgcgcaccctctgctatctccttcgaatagcacagtcctaaaaaacagcctctaatggctgatagcgaagctgagccaaccataatggcacatttacccaaggaagcgcgagtcacgcgccttccttaaactctccccttgccactaccctcagttctcaaaaaaagtgactttacggcgggtagcagcggagcgggcggaattgttctgaagaagcggagcgttcacctttatccccggattttaacctatgatctttattccaataagaaaatacggggataacagcgatcggaagaacaatccgcacgcgaagcggccgtccccccaccataactcactctttcttcagaacaatctctcctcccctaaccgcttcgcaatatgattggcgctaaacagtaagatgaagctgaccaccgttttgaacatcccagcagcaatggaaagcgagaaattacccatctggataccatatttcagcacgaaaatatccagattctccgagtaatccacgttcatgccgttgcccagtaagtattgcggctcaaagccggattccagtaaattgccaatgttcataatgagcaggatgataaatacaggcttcaatcccggcaatgtcacatgccaaatccgctgaaaacgccctgctccgtccatctcggctgcctcatactgcgagggatcaatcatcgtcatcgcggccaaataaatgatggtgttccagccgacatttttccatacctccgatgcaccgagaatgccccaaaaatagcttccctcgcccagccacagaataggctccttaatcaaccccagccacatcagcacctcattgatgatgccgccatccgcagacagcgccgtactgatgatgctagccgcgaccacccacgaaataaaatgtggcagatagctgaccgtctgcacgacccgcttgaacatgatctgacgaagctcattcagcaaaatcgctaatgttatagcggtgacaaagcccagcaccagattaataaagctcatcgccagcgtattacgcatgacccgcagaaagtgttcatcctgaaatagaaaatggaaatgttttaatccgacccattcctgatcgagcaacttgcgggcaggcttaaaatcctgaaaggcaatcgtccaaccccagatgggcaaatacttgaagatgaacagccagattaaaaaagggacggacatccataccagtgcccgttgctgattcagcttgtgcataaatcccctaaatccagttcgccgcgaggacggcaaatgatccgaggagatcgtgacaggtggtggtgacgagtggcccatagctgcttcctcctttattttttaccgggattttcgatttttttggcaacctccttcgtgatcagctcctcatacgcctttacatccagcttgttgaattcagtagtgtattcattccaaatcgcatcaaactgctccggtgcagacagcaccaaacgcgggaaatatttgcgctgtaggtcccccttcttttgctggaagagctgcgcggttgagccttgagcaatcggaatactccaggccggataccatgggcgctcgtcaggtgcggaaaacatttgcgagaaggactctacaccatagacttttagtagctttttatctccctcggtgtaggacatacgcgcaacctcaggctgccgtccggggccaaccgagttgccgtcaggcagggtagaaccgctaccgtatcgcggccaactgtattcaaaatatttgaacccaaatgattcgcggaacgcgtcctgaccagtctgcttaatttgctcctcagtccggtaaaagcgtccttttttatctacatcataggtttctcccttgattccccagttggataatatctggttttcgtcggtcagcaggttgtcaaaaaatttgatgatacgtaccgggtccttggcactgaccgtaattcctatgcctcggttattaacgaatgatgaaggatcaatgtactgatcctttatattctggtcgtatacaacaggcagccctatatactccatatcatcattgcccgattgcttggaagcctcttgcagattattcagggcctgccccgcctgccagcggtagtcgaaaaagcccagcaccttacccgaggtcagctttgccaaatattgatcgtaattgtccacaaaggacgatttatcaaataggccctctacattgagctgatttagctctttcagataccgctttgtgatttccatatctccataatccgtggcccggtgtgtcttcatatcaataatcgtgccgccatcattcggatagcctgccagatgcatcggcgcgttcgtaagagcataaaacctatcctgcgtggttaacgccaggtacccagtcaagccctcatctgcatgctttttcgcatagttacgaatcagagctaaatactcgtcaagtgttttgatttttggatatcccgcttcttttaataccctgcgttgcacccaaaaggctccttgctctaagttaggcgcaggtaaataatcgcctaccaccgcacttagcggcagaaagtaaatgttcccatcctccgccttcatcaagttgtagtacggtccatatacacgcttaatatttggtccatatttgtcgatcaaatcattcaggggaataaaagccccggcatccagcagcttatcgatcgtgccatccggtactatcacatccgggtaatcgttactggcaataaatgtaccgatcttcgtattggaatcacccaccaaatgctccagcttccaatttacccccgtctgatcctccaggattttgccgatccgcgtttcattggtattaatgtccctccccgcagtagcattaaaatacgtgaatgtgaccttctccttgctatctcctgacgctggctccttgcccgagctccctgagcaagcagcgatcatagacgccatcataaccattaccagagtgatgattccgaaccttttgcttgtcatgccagaccctcccctttcgccctcttttgtcgattgtgtgtgaatatcgtgcgcacgtacctcaagcactgggaatcccgcacaccctaaattgtaagcactttcattttataaaatgctgttcatttcgttcacctgtcaatctaaaggtgttacttagaaaactataggtaaaggtccttcaaagcaaaataggtactgctctccacctcactcccgatccacaggaatcctaattcgaatctccgtaccctcgccgggtgcactgcgaatggcaagctcaaagcggctcccgtagtaaagtttaagacgatatatgacattttgtagacctatacgctcacccatttcttcctgcctttgcatgtaaccatacaagcgttgtacctgttcctcagacatgcccaccccatcatcccgaaccgttagaaacagttgtccttcctcatgctcaaaatgaatctcaatgcgtcctccatgctttagcggctcaatgccgtggatacttgcattttcaaccagtgtcagcgcgaccattttgggaagcagattgtccaagtcttcagagcgagcctgcacttcgtactgtattcgctcaccaaagcgatattgctggatttccagaaaacaacggatcagctccagctcctcccgcaaagtaacccgatccttgttccacaccagcgaattgcggaaaatccgtgccatgttatgaataatgcgcgctgtctcatcctcatgcttcatcaagctccgcatgcgaatcgtctccagtgcattgaacagaaaatgtgggttgatctgactgtgaagtgcattcaactgggcatgcctgcgctgaatttccagattttttcgctgtatatcggccatatagacatcgttaatcagtcgctttattttcagcgtcatccgattaaactcacctgttaattgcccgatctcatctcgcgactctataccgcgaatcagctcaaaatgctggtttttcacctttttcatgtgctttaaaatacgatgaatcctcacgttcaacgaacgtgtaatccaaataatgattaatgtaggcagcagcatatttacacaggttaacaagagcacaaaattgcgggattcctgcatttcatacagcactgcatctctcgataccgcagccacaatgctccagccattcagattgctcgtaagcacataattcgtcttgaactccatcgtgtcctcgggcagcttgagagtgttataggctacatgtttgtggtttatatccactttggggtccgttgtatattcgattccccctcgttcgttcagcagaaagagacttccctgcaaattcaggttattgaaaatctctcgaatggacgacattcgcagttctattttcagtattttttcacgaccattttgggaataaaagtagttcatccgccgaatcaggctaaaagggtacatctgttcacctgtgctgtcatcggtacgtacaaatataggtttggactggcgtccaggcgagattttggtataccagggcaaacttttgactccctcatctataaagctgattcccccggaattcagcagcgttgaattattggtgtagatcgtaattccacctacggaatggtatgcaggactgtaagtgttgttcaagatatgacgtaaataagagtcataagcttcgatatagtcagcagggtggggatatgtttcttccaatacctcattgagctgatgatccgtataaaagatagacgagatttccatcgcatcttcaaattcacggtaaaattcaattttaatctgttccaatgcgcgcgaaatatcctgcatacgctgttccttcacgttttgcgaggtgacatggtaaaaaatcagattggtcagcactacaggcgtaaaaacacagagaaaataaagcagcagcattttatctcgcagtcgtacatgatcaagagtcattctcagcatcttcattcgccggccctctctgactcgttgccaacaatcaggctgttgcggtattcgcttggtgtgacatgcgccatcttttcaaactgggtaacaaaatagtctgaactgccgaagcccacgcgctcagcaatttcataaatccgcagatccgtctgccgcaacaagcgtttcgcctcctgaacacgcaatttcagcagaaattcgttaaagtacacaccatacgtttttctgaacaattgaccgaggtataccgggttcatgtaaaagcgagccgcaatacttttcaggcttatattctcggcggcatgctgctcaatgtaagcacggatgtgctggatgcctccctgctgacaatccttgcgcagaactccaatataccttccactttcctctgcaaaagctgtaaacaatcgctgtagttcacccagggacaggttcatgtcctgccagttcatcatcggttctagtgactgaagtgagcgctcatctccctgcatgttttgaatgacccgaacgatactaagtacgcactgatgcagactcattttcatagcctcaggagcataacactcctcccgaaagctgctaaataaataatccacggccacacgcagctcatccaaccgcagttcctcaacttgttccgtcaagcgatccagtacgtcctgagggatggtcttatagtgaagtggtggcatttccttctgtagatatacaacaataccgccatggtcataaatgtatttatggagcactgcctccttcgcacaggcataggactgctggatatcctgcaaccgattcacaggctttcctgcatagatgaaaactcgacttcccagctgatcttttagtgtcttcatcccctctatctcgcgttgtagcgctttcataaaaacttcgaccttgccttcaaaacactccaaaaggaagtccggtacgataagaccaatccggttacgatgctcatgaacatagagagagtacttgccatccattaaccgatgaagcgcttgctctataagctccctgaattggaaaagcgatagcatgatattattgtcacctgagcgccagggatgttggtcattcagctcgacgagtacatagtacatataagtggcttccccaagccgtagctgctgctcccactgtgtcaccactacatcatccactgggttcatcatcacagtctctaacagcccacctgcatggtgattctgatatcgttgcgcattctgctgttcacgatgcagtctttcactcagcttgcgcaatgtagccgaaaagtcaccctcatcaatcggcttaagcataaaatcatgaaccccatagcggattgcctgctgcgcataagcaaaatcactatagccgcttaagataataaacgcgggatgttctgtactctgttcgagcacagactgaatcagctctaatccgtccagcacaggcatacgaatatcggtaatgaccaggtccgggtgaatacggctgattagctccagcgcatcctcaccgttatcagcttctcctacgacttcaaaaccacaggcttgccaatccatgagttgaagcagccctttacgagtaaaggtttcatcatccaccacaatggctcgatgcagcttcataacacgcttcctccttttgaagtatgcctattttattattttggttaactattccaatgatctcagtcactatggtaatgtaaaacatcaggaattggaaattttcgttacgcgtattatatgacgaacagaggggtgcaaagcatgcgcacgccagcggccaagccaagcagcaaatatacaaaaaggagacgaatccctgaataggggttcgtctccttttttgctattgcgtaaaaagctttattctcttattcgtgaattcaggctatcgctcagcgatgatactgaccgcttgcagatggtcggcgtactttacaaactgcttgcgcatacccataacccttgtccgggcagcatggttacgcataaggttaaaggcaattttcccaaatctcaaccagccctcgtcctgaatgatacgtggcaaatgcaataagtgcatgggaaccgtatagattttaacgaccttaaagtcttcctctttcagtaactcttcccactctgacaccgtcaacggtgtcgcattaactctcatggctacagccaaatccttgtaaatttgttttctgagcgtaggctcaatatggttagaagcaaggcacatctcatgaatagcatacttcccacctgctttcaaaagccgcctggcttccgaaataatctgcgccttcttggcccttgtgtgcatcgtcagcatggcttccccatataccaccgtcgcagaggcatccggcaacggaacctgttcagcatcggcaataatgacttcccgatttgctccgcttgcatacgtttttacgatagaagccgccttctcattctgttcaatcgcaatataacgacggggattaagccgcagtgtgatttgggcagttatacccaatccgggggcaaactcaataacctcatcctgcccggttacgtcaagtccctctatcatccaacgtgtcgtttttaaccctccgggcctaagcacgcgcttaccgagacttgctaatatccagtgccctggcacctgtttgtaatctactgtctgcattggctattaacacctcttcttaaaatttgataatgatattcattatcaatacgagtgtaaaaaaataacctttttctttttttgatatgagcatgttgcattatgcaatatctatatattgccgatcggagacccgctcttacgatttatgccaatgccccatttatacaatgatggtgctgtgtcctcttttatatgttctgcgcatagctttcgcttggcgtttgggtcaacactacatgcagactggaattcgcctctgcaccgccacgataggaaaagtgctcatcgcccgtaacatgaatgatatccccttggacaacttccgttgcttccccgttcacagttacagtcccgctgccttcaagaacaagcaaatatacatttgctcctgggtgattatgtgttggcaactccgcattaggagtaaagttgagaataaaaattacattgtcagcttccttatgcacaattcgttttgtaaacgcagcttccttatattcctgaaattgaatgaggtttgattttttcatattggttcacgctcctgtttgaaattaaatttgcttaagatggatgaatacctttattgtattggattatttcgctcgacttgtgattgcaatcacaaaactaaatttaagtaaaaaatacttttaattatttaaaaatttgatttcaatcatctttttcaccgacacatccaactagaatcggattatgcaagatgctaaaacaataacaagcaggaggttattcctatgaagcccggattcaagctggcaaaggatatttattgggtaggaaaaattgataatcgtgaggttccctttcatcgtcttctactatcaaagggtacaacttataatgcatatctattaaaaaccggaaagccaaccattgtggataccgtggatatggcgttcggtagagaatttgccgaagctgtaaccgaattgatcgatccattggatattcaatatatcatcgtcaatcacacggaaccagatcactcgggcggattggcggcacttgcttccaaggcaacgaacgctacgattgtctgcactgagattgcagttccggaaattcaacaaatgtacaagcttcagcatcgcaacttcctcgtaatcaaggatggggatcaactggacattggaggcaaaacgctgctgttcaaagaaactccttatctgcatacagaagaaaccatgattacgtattgtatagaagataaaatcttgttcccttgcgatattttcagtacacacgtggctgtagagcatctatttgccgatgaggctggttttgatatcaccgaggactttatcggatactatcaggctattattcatccacatcgcagatatgtgcgcacattaatcgaagctgttgccgatctggatattgagatgattgcgccttcccacggcttcgcgatccggcatgatattgccaagtttattgatttgtacgcctctatgagtaccgaaaccaaggaagataaaaaagtagcgattgtctatgccaccctaaaaaataatactaaaaaaatggcaaacatcctgaaggactgctttttggagaaccaaatccaggtggagctatgggacgtggataaagcggatgaaacggaaatattgaatagtattgcctcagcagatgctgtgttcgttggtagctctactaaatatgccgatatgacgggcaaattggaagacctattgcaacaaatgcaaaagatgaatctggaaggcaagctggctgctgcctttggttcctacggctggagcggggaagccattgaagttgtacaggattacttgaacggtactaatatgaaggtgcaaagcacttcagatgtaatcaaatcaacgggtatgacccatgtggaattcccggtacgtattcgtttctctcctacagaagttgaaaaagtgaaaaaaattaaaaatgccgctgaatttgtctcagatctactgcttagtgttatttaaaacacagtagcgtatagcgaataggagagatactgaatgggtaaccaacattacgttattatcggaggcagtgtcgccgccgtcaacgcggcaaaagcgattagagatcatgatgagctggccgaaatttctatttacggggaggaagcatcctttccgtataacagagtcaaactttccaagggactatttactgatttgcacagtgacaaaatcctgatcaaaaaggaaaaatggtttgccaatcaacgaattcatgtgtattccggcatcaagataaccgagatacattcagaggattgtactatcaaaacaatagatggacaaaccgttgcttatgacaagctgctgctgtgtacaggagctcacaaccgtaagcttgtgctggatggggcttctctaaggaacgttcacaatatccgttttcgacaagatgcagatagccttaaagcggaattgcgacagggagaccggatatgtatcatcgggggcggtattcaaggcgtggaaaccgcctggtccttccagcaagccgggtatgctgtaaccatactggaagcttcgcatcggcttatgccccgccagctagatgaaaaggcctccgctattttgaccgatcaaatgaccgaacggggtactcagatccaccttgggcaaggcgtaaaacgtattaaaggcacagatcacgtagaaggtgtggaactacaggacggctctgttatcccttgcgagcatgtcgtgtactctatcggaattgtaccgaatacggagcttgctcaccaaatcggccttgatattggacaaggcattctggtgaatgcgcagatggagaccagctccgccaatatctatgcagcaggtgatgcagccgaatttcaaagtagagtagatgggttatgggaaagcgcaatggagcagggaaaaatagcaggcgctaatatggcgggcgcatccgtcagctatcagcgtcccctctctgtaaccctttcaaactgctatgaatctcctctcttttccatcggtctggtagatgaacaagtctgcgacaccagcctgattattaaaaatcgagcttcttatacacgtatgtttatacaaaacggctctatctgcggcgttattggctttggagatgcccttgcttcactaccatacaaaacagccatcatgcagggactcaaaccggacgcaccagagcttacaaaaattttgaatgacaaggagaactagagatgaaaaaatacgtttgtcagccctgtggatacatttatgatcctgctatcggtgaccccgatgaagacgttatgcctggtacagcgtttgaggatcttccagaagactgggtttgtccagtctgcggtgaggatcaaagtcattttgccccaatagatgatacagaataacaaccatgcgctataacctgtagtttccggcttatgaatggagtgaatgaatgtgaatgcgatgtcctgtccctgccagtgcgaaaaggagccctgtgctcgcaaagtgcctatcttttcctctttgtcctgcgaagatttgtgtaaggtcagctccatgatccgacaccgaaaatatcagaagggtgaagccctgattatcgaggaacaagcatccgatacgctgtacattattaaaagcgggcatgtcaagctgctgaagatgacgcctcagggcaaggagcaaattctgcacattctgacaactggcgatttttttggcgagttaaacatatttaacagcgatgagctgagtaactttagtgcgtatgccttaaaagatactgatatttgtatgctcaccaaggatgatatggagcagttgatccgcaacaatcccgatatctctttgaagctgctcaaaaccattactaaacgcttggcacataccgaaaacctggctcaaagcctagctaccaaagacccggaaatccgcattgcctatatgattcttgagcttggacataaatacggcaagccggacggctcctacattaaaataaatctccccctttcacgcgaggaactggctaattatgtgggtgtcacccgcgaaaccatcagtcgcaagttcggaaaatttgaacagctggggattattcatagcaagggtacaagagagattaccatttgcgatgtacagaaactgaacgaatatatggattgagacacatagatacaatgttactctaacatgaggacaacaaaaaaccgcttctttaacttatggattgcagttgatctatcaaccacttccatttcgttaaaaggcggttttttagcatattttatactccactaactatcaattgtcgtgttcacaccttgggaagacgctccccatgcaggctgcgctgaaggaagttctggcgaaactctgtctgtggaaggagcagtctcaatcgtggtcgatttggagcaatcccacactactttgaccaaatacccaaacaacaacacattcaacaatgatgtcacacacaaaataataccgtattgatcccgagagttggagctatagaaaatatcaaaggtgttcaggaaaatcgtaagactgaatccacccgcaagccacaaaaatctgcggtctcgtaaatacagatacgccagtacagctaacgcggccgcagggaacaagtaccgttcatgcatgctggaagcgaaggtaaatacacctgcaatgagcaccagcgcagctgctgctgcaaattgtggtttgcgactgcggatatacatccaccatgtaaatagagtcaccaacacaatgcagatcataccccatgtatggtaactgaacaggaacaatgttgtagtgtcctgcgtataattgccaccgatcaatgcaaaaaagttatacgcgttcaccgaagcatacggatactcgccgaccgttcccttgtataggtcaagtagccataacggctcttgcccccacgaaaatggcaatatgaccagaatggtcgtcacaacggcaccgccaatggacaacagccaaggttgtattttacgttgtctcagcagctcgaagaacaaaacgggcccataaataattccctgcggcttcatcaaaaccgctaccataaacaatacggttgaccagccgacccggttttccacaagcagcacaatcatgcccacaatcagcatagtaaagaaagaatctacctgtccccagaaggtcgaattgataaacaccgccgggttaaacacatagaatatagccaatccaaggcttattccatagttgacccgtttgctcgccaaccggtacagcatgtacgctgtcacgatatcggctaatatattgggaagccgcagcaacacggacatatagggactgaaagtatccgtagtgccgattttgccaatcacatataaaatataaatatagaacggcggataatcacttgatccgttcgtgtaaaagcccgataagctatccgctgctgtcgtagcccagttccggaatagcattaaatccatgtgacccgaaatccatggggcgatcgccattcttaaaaagaaacccacacccagcacagtccacaacatcagtcctcgattacgttccccgagcttccattcacgagcccgaaaccggtacgcaataaacacgaacgcaccgaagaacaaagcggcgaaaatcgccagcggagtagcataagcagatgaggagttcccacttccactaccacccataccaccgccaggaccgcccatgccagatccgttaccagacatgccaccggggcctctgtgctgtccgtctctggcaacaccactgccgcccgatacagacgtatcattcccggtcgttgtacctttgtcacccgatgtcgatgtcccctcagtggaggagttggtagtttggtctgtcgtcccctgattcttgctgtcagcgctattcgccgaatccgtccccctcatacctccgccaggtccgcctcctcccccaaacccgccggatggtccctgcctaacagccgcagactgggacgcagaactacctgaataactccataacgaaacgacactagcgacagcacacaatatgagactacatagaagtatatatttcagaccgttcgctttccaaacgttcaaacccgatgcacctctctctgtttctattttcccatattgtatctgtcttagcttaggactttgtgagttctggctgaatgttggctgaatacgaaatcatcacactgaagattgtcgttccatctccataatcgccctttccagctgagattgtggatgcttcagcatgttaccgtgaccgacagctaataaagatggatcgaaactcgccagcttcttaagccttcccgataccgctataccacctcgggtctgaaaggcgtcgcctgcaattagcgctcgggtgcgagtatccaaaaatgccatcgagcccggcgtatgtcctggtgcactgatcgccaacagcgaacctacatgatccccatcctccagtaaaacgtcaggctgggtaaggatatgcttcggtacatcgcctcgaataggagtatccggttctcctgcctccaacgatacatcgccctgtagcagcggtgcgtcccgccttgaaatgaacacttgcgcgtcaggataccttgccttgagcttatccaacgcacccacatgatccccatgggcatgggtaagtacaattcgaataatcggctgcccgatctgcgccgcagcctgctctataccacgggtactgtatggcaatccggcatctaccaaggtgagcccctctatctcctccaccaaataacagttcaccgggaacagccggggcataaacgtcaattgatacacatgctgcacctgaacaatacgcatttatctcatctccttgacttaattataaactaattatattagtattataaataatataattagttttaagcaaatacttttgctgctattcagctggagttggagcttggaactgctacggggacggtcgtactgagaaaacagcaaaaagcatccccgggactctgcccccggggatgcctctcaaaacaagaattaatcttttcctcctgttattaataacgaagccttcttggctatttcctctttatcaaacagagtaattccagatgcccataaataaccagcctcatgtatgatgttggcatgaataggtaggacatctttcaatcttcatccgtaattacagccggattgcctcagcaataggcgtactgccagacaccagattaattgcacgatgatacgtctgctgttcctccagcgctgctaccaccgctgccgccacatcttcacgagaaatggtgtggctggtgagctcctcaccggtagcaacttttccggtgcccacatcatccgtcaggccacccggacgaagaatcgtgtagtccaggttgctcgcttccaacaggcggtcagcgtaatgcttcgccacataatacggtttaatggattcaggccactgctcccgattctccgcatgtagggcgctgaccataacgaagcgctggatacccgcttgttcggcggcttccatcgccttgaccgctccatccaggtcgataagcagtgttttatccgctcctgtttctccaccggagcctgctgtgaacacgacagcatcgctgccttttatagctgcggcaatatcaccaaccgtcccttcgaggtcagctaccaccgtttctgctcccaaacgttcaagcgcttcggcctgatccgaatggcggatcaacgcctttacgcgatgcaatttattctgccccagtaggcgaacaagatgtctgcctacttttccatttgcgccaatcaccagtacgttcactcatacccctcctgtattcgcagtctctcatctacattatacagatgtattttacccttcgggtccgcgacgcaatcatgttagctgcatcaggttgaaatcagacttctttggtaagctcggcatctcgcttttgccgcacacccagacctgccaaaaaggtagccatcatcacctcaatactccgatccacttccacaggtaaaccaaagccgcccttttgttcaagcgaggcgaatccatgaagcagactacggaatcccctcgctgcatgaatgcaatcttcttccttaaagccataaccactggacaggacggtaatgaccagctcagccacgcgatccgcagcctgcctcatttcggtatcatttcggtcagttgcatacagcatcgcttcatacaaacctggtcgctcgcgagcataccgcatatacgccttccccatagcgatcagcgcatcttcgcccgctctaccaaccgctgcgctcatcaaagcttcctccaactgttcgaggctgtgcaatgccagtacttggcgcagtccgttcaatccgttcacgtggttatacaaggacggagggcgaatgtgcagcttttgcgctagcgtggtgagcgtgacatcccccatcccttgttcattggcaatatcctcggcagcccgcaggatatcttgcagttttactccgtttctaggcgacatcatcctgtctccttccatcgaatttctatgtaatccggttccttatgcatatactgagtcgatccagattctattttaactaatcctgttagtttatacaaagaaaatgccttttacaacagccgacctgcatcgaacctttatagaagagcatagcgggcattactgatataacaaaaaaataagatcataaacggaacggatctgatccctttctcgatcccttacaaaggagctagctatatctatggaacccaagccacttccagctattgaattcaatcacattatcaaatatttcaccgggtctggacagcaacgtgctgttctgaacgggattacggcaaaagtctcccccggcaaaatcaccacgttggtcggtccatcggggtctggtaaaagcacgttgctttcactgtgcaacctcctaatgacaccggatgaaggggatatccgtgtcctcggcaaacctatatcggagtgggagatccctgaactgagacggaaagtagcattggtttttcaggatgcccccatgcttcagggaacggtcctatacaatctccaaaccgtagaacggctgcacggtacagtgctggatgatcctgccggcctgttggaacgcgtaggacttactcgcgacctgttggaacagaaggcgcaggaactgtccggcggacaaagacagcgcttggccttggcgcggacactcgcgaaccgcccggatattttactgctggatgagattacttctgcactggaccctacctcggtcaaagaggttgaggaactgttgctgcaaatgaacaaagaagaaggaacaacgatgatctggattacgcatcatatggaacaagcccgcagggtaggccacgaaacatggctgatgatcgacggaagactgatagaacaagaggatacggagacgttttttgatgctccacagcatagtgagacccgcaggtttgtagcaggggaatgggtatgacgattgttgccttgattctctctctcggttttgtatttatcgccatcgtcatatccaaatccttcaaactcggtctggaccgagacataatcatcgccacaatcagagcgtcggtccaactgctggcgattggatatgtattgcatttgatttttgggatgcaaagctacggatttatcgtattattcattctgctcatgattaccgtagcctcacaaaatgttgcgcgcaaaggacgatttatccccggtctcatgtggaaatcattcctgacgctgctgtgtgtggaaatcgttacacagacattcctcattggcctgcatatcattcctgcgacagcccggtatatgattccgattagcggcatgatcattggcagttccatgattttgtccagcctgctggtgtcccggctcaagtcggaagtcctgctacgcaagccggaaatcatgctcattctggcgttaggcggcacgcctagacaagccatcttccctatactcaaggattgcatacgttccagtatgattccaaccattgaggggcagaaaacgctggggcttgtccagctgcccggcatgatgaccggacaaatcatcgcaggtgccaatccgattgccgccgtgcgtttgcaattgctcatcgtatttaccaccatgacctctgctattttgaccagcgtgctgctcagcctgttcatttatccggcattatttaaccgccagcaacaactgcacacagaagcatgggaacgctaatcaggtgaatatccccagttatctatgatttcgcaaaataaaagagacatgtttaattcctgacacagaggttaatagatacacgtacccgctttactaaaattcgatgaggagtgattgaacatggctaacaacaaccaaaatggcaaaatgagtcgcgaagaggcaggacgtttaggtggagaagctactgctaaaaatcacgacaaagaattttatcaagagattggcgaaaaaggtggcgaagccacttccaaaagtcatggcaaggacttctaccaggaaattggtgaaaaaggcggcgaagccacttccaaaaaccatgacaaggaattctatcaagaaatcggacgcaagggcggcgaagcccgtggcaactcagaccaaagtgatagcgacgggaaaatgagcagggaagaagctggccgtaaaggcggcgaagcccgcgcacgtcagcgtagagataactgacaatagggagtatgtggtcggtgcaattgcaatgtagaggcacagactgcatataaacatgaagtatagtggacgtttatgttataaaagcctatctgccggaacaacggcagataggctttttgtgtgaaagttactttcgtcaaccgatcatacgccttacaatatacataaacaggttaaataaccaatcatacatattttattacaaatgaacgaatggattataggaggtttgcgcgaatgttgattacaaagaataaaacggctgcaactattctaagaattatattttttttactgattttcagctggatttattattattcaggtcatcactcggcagaaaccgctaaattagttaaaactacagatgattacttggtcatacagagagatgcttctagcggaggtgaatataaagaattatatatttccccaaagtctgtgatccctcctctggttataggcaaacaatattatttcgtgtctgatcaaaggtactttcaacacccatatatccgttatgtagaggagtaaacagaacaagacaacaaggactaacacagcccttggttaaagcttcatggatacaaaagagtgcatgcaactcaaatcaaatattcctgcattccgactgttaagatggagtcgaaaggagggaaccctcgtgtacgaatggaacgaaatggtgcagctcatgatcgattggattgataataatcttacttcagcaccttcgttgctgagaatgtccagtcagttaggctactccccttactactgtacaaaacagtttcattctcttacaggaatgacgttaagggattatgtgtggatgcgccggattagccgtgctgcactggaactccgggatagcaatgtccgcatcctcgatgttgccataaagtatgggttttcttcacaagaggcttttacacgggcatttgtaaaagcgtttgaggtaactccggctgtataccaaaaggagccccgacctattccgctgaccattcgcgttgaggtgttctctccttatcattaccatttgaaggagcgggataagatggttaaggatcatttgcaagaagctgaagtcaaaatcgagcatataccagcacacaaatttattggaatctgggatacttcttctcgaaactacggtgatttctggagaaacggtcacaattgtgatgaaatttgcggaacattggaaagcatgtctcatctcaagcttcccgaacaattgggccaaactgcgggctggttctatcaagatggtcagaaaggctacctctatggaataccggtcgccgctgactacaatggagagattcccgcaggaatgaagtgtcgggacatccccgaatcagattacctggtgttttttcacccacccttcaattatttaaaaaacaacggagacgttatgagaatggtggaggagaaggcttggaactttgaccctagcagcctagggtatgaatgggatgaggaaacaaagcaagattatcagcggcatttcccagaaagatacggatacgcagtgttacgtccagtgaaaaaagtgtagagaaaaagaatcccaagaagccgctacgatcaggatgctgttcatcgtcttgctaaagtctgttgaaaaataataacagtttattactaacgggttccatcttgaggtgcaatacacatcgaattgacattgtggacacaatacgatgtaaatatagaataaaccgatcactgaatcatacagtgatcggtttattcttgatcagcatttttattttgcaagtaactatcaatgatttcaacccaatccggtaacaacgccacatgatgttttatcgtttcactatctgattccaatacaatcacgccatctgagctgctgttgtcaatgacaattaaatgattgataagtttaagatgtaagagaagattgtccagcgaggtctgatgccgtcttataatatcagcggtatcaatgtggtgacccccatttcgaactcgtgcagcaactcgctcgatattaagacgataatcaccaaggcccacataaaacataataacttcaaagcccttttcttttgccattcgcatttgtcgaatcacattgccaccagcaagtgtcgtctctacggtaaaatctcgtttatttcttatacaatcccgcgctagcttaatcgcttcctttcctgccgatactttgtgtcgatcagggttttcacgatcaatccctcgcgctaacgcatctggatcgatattaacacttacaccaagtttatcaacgattagattacgaattgtactcttaccacttccgttgtttcctgcgaatacaaacatagtagcaaacggctcactcatgataaaatatcctgctctttaattcgttcgacttgaccattactatactctttaacaaattgaccatccggtgttttgtagacgatatatgtgccatttgctttagcgtccagttttgctctatctccagttagtttgattagcttgcctaggtcgtgtgtacgattcattcagccatcaccatcccatacaattcatatatcgagagtatatcacaaatcgaaaagtctgaaagaatccagcgtcactcaaaaccacacgaataccgtacggctaaaaatcgtgataagtaaataggatcgaaatatcattctttttaatacattttaataaataaatttggaataaatgctaccttcagcttttttattcgtctattacaacaaatacaattgcggaggtacaggcaatgaaatcttttcgtttttggctagtcctaatctcatgcctagttattactgtaaattttacggggtacgacgactacaatatactattagctattattagcccgttggtttggatgtatgaatcatttcgatttgtgcgagaggcagacatccccataactattgtttacttcactacactaattttctggtatctcattggatacgctttggactgtttgattagaaaatttaaaaattaaaatcacttgaaattaccttctaaattgtcgtctactttgtcaggctcgtactcgaccgttctgtagtcaggtgatgaaggaatcatattgatcacaacatttctcatttgtagcttgtactttccttcctcaaaagcaagaatatgcttaatggaaggtaactccatatcctcatacttcgttatagacgaaacaacaatcttggaagggttagaatcatccacagacacgatacgataatcaatcggtgttccctgggcttttagaaaatcaagccgtgcccgttctgttttaaagcgataatcatcagacagtgaaagcatcttatcgtaatcgcgactcatagaagcgttcatatattctgaaaatgtcgagacagcagcctctttgggcttatcgggaagtttataagattccttatctcctccaaaacctgtagcaattacggtcaaaatccctcctaagacaaccaagcaagccaacttattacgcgatacaatcctcaataaataaaaccccctttgttgtaaattttaccacctattttcaacgtatctcaacttaaaaaggcactgtaaaacgcagcataacttcttgtaaaatcccattcatttaaatccaaggccattcttttaatataattttattttaacgtaaatactcactgaatacctttgttaccttatgtaatgtcgtcttcccatcctgtaaactaagttccattaagcggtaaccgctggatcatagagaggatgagatatttatgggtttggataatagagtttttgcgatacaagctggtctggacggacgtgtaaatgcagttatagatcaaacccttgccgagaagcgcctggtcggcgcagtcgtcatgatatatatggacggttcacccgtgtatgtccgagcggcggggctggctgatcgagaagaacaacgtcctatgcatgaggatgctttatttcggctttcttctgtatccaaaccgattgtatctactgcggctttggttttggcagcccaaggattgattaagctcgatgaatctattgaacgctggttgcccgactttcgtccccgattaatcagtggtgagcagccctccattacagtacgccaattgctgacacatactgccgggttgacctatggctttttagaggaagaaggcggcggcccctatcatcgtgcaggcgtatcagatggcatggatttctcaaatcttacgctggaagagaacttgcaacgtttggcttctgtgccactgttatatacaccgggtaaagcgtggggatattcgattgctactgatgtgctcggcgctatcattagccgtgtatgtggcacaacccttgatgcagctgttaaaaagctcgttacagaacctctcggtatgcacgacaccagtttcgcggtcgccgatgctggacggcttgcggctccttatgtcaacgatatatcagaaccccggcggatgagtgagcttgaggttgcgcaggtttttgaaggcaccgcaggacttcgctttcagcctgcacgagcctttgatcccacggctttccactctggtggctcgggtatgattggcagcgcaaaagatttcatgcggctgctggaaacactgcgaaacggcggcgatccgttactttcagaggaatgggttcgtgaaatgggcaccatccagaccggaaacctccccttggcaggctggccggggcggggctttggactaggattcaccgtactccaaaatcccgacgaaagtggaacagcagaatcacccggaacgtggcgtctcggaggagcttacggtcattcgtggttcgttgatcccgcactaagacttagtgttgtcgcctttaccaatacagcatttgaagggatgtcaggtccgtttacaaccgagctttgccaagccatttacggtagctcaaatagggtctaataaagtgggggttacatgtttatggtctaccggcgaggacaggacaattaacgtggtagagtgcccgtgctttccacactcatccccgaactgctccagcttgagcatagactcaaccatgactttcagtaagtaattttgctcgccgctgattctatggcactcaatgacttcaggtgcagattggcaaaactcaacaaatgaattgcattgattcgtgtgcacgagcacgtgagccatgatcggctttccgactttctcatgtgaaactatggcacgatacccggtgataatacctttatcctccatgcgccgcactctttccgttacggcaggctgggaaagcccaacctccttacccagctcggtcatggagatacgcgcctggttttgtagacacaacaaaattttatgatccacttgatccatcaaaccatcctccttaagttcaaggtaatattacaaaaacacaattattattatgtattatttcgaatatcgccttattattttatgatttaatgaaatattagcatgcaaaatcaaggacgtaaagcaggaagacgtggagagggaatgaaaccaatgaaatatagtaagcctctgcttttcattgcgcttggcctatttggtgtatacacgattgagttcggtgtggttggcattttgccggtcatcattgaacgttttcatattacggcagctcaggccgggtttcttgtcagttcatttgcattgatcatcgcgctgttcggtcccttcatggtgctattgatgtccaggtttaaccgcaagcgaatcatgacaatgtcgttgtttgtttttgccataacaagcttgctgtcagcctatacatccaacttttatctactagtgattttacgtatcattccggctctgtttcacccggtgtatttctcgcttgcctttgtcgctgccactgcgttgtatcccccggaaaaagcaacgcaagcttccgccaaggcctttctcggcacgagcatgggaatggtactcggtattccaattacggcctatatcgccaatcaattttcatacgaggcctccttctggtttactgcggtagcgaatgggcttgcagggatcggtattttatttatgctgccggatacaccgcaagccgaaatgttctcctatcggaagcagcttggcattttgcgtaaagtatcgctgtggctcaatatcggggcggctacttttatttttgcagccatgttctcggtgtatagctattctgccgaatatttggggcaaaatacagggatgagcagcaaggttatcagttttctgcttattattttcggcatcggcggaatgctcggcaatctgttggctggcaagctcatgggcttgcataaggtacgcaccgctctttttcatccagtagtcttggggggcacctatttgctgttgtacgggatcagttcttcatttatccctacgctcttcatcattatcgtgtggggggccgttcataccagcggactgattgtcgcccagatttgggtgattgatgaggccaaagaagctcccgcgtttgccaatagtctttatatctcgtttattaacttaggggtatcactgggctcgctggcaggggggtggtttattgccagagcggggatccatgggacgctgtggagcggtttgctgttcgccatgctggcgatggtatgcatcgggtctaagttgatttatccacgtattttgcgaaaatataaaggattagatgtgcaaagctaaagagttgcaagagggccaagcctgttatcataaaaaaccggttcaacactttgtatggtgttgaaccgatttttgtttaaagattgattcctgcctgtcggattagatcatgcccagcgatcacgatgcttgccccttgctttgctgcttctatggctgttgccagccctatacctgcactgccgccaatcacgacgacacgttgattatgtaaattcatattattctcagctcctttataagtgtaatatcataactatttttaagacatactcatttttattcgtttgggctttcctgtaccgtgcttttgcgataggatgtcggcgattggcccgaccagcgcttgaactgtctgctaaaatgcgcaatatccccatagccgagcatatcggcaatttgttgcaccgaccattgcggatcagccaacagcaacttggcctcatgcagcacaagctcagatagatatacacggggagatacgccgaaaacgctacggaatacacgattacaatgggacacgctaatacctagctcggatgaaatcccctcgatcccatcctgtttttccaccgatccgacctgtccataaggctgattcactctcccctgaagacgactggcaatctgatgggcaagctctgcctgcacatatccacgccccggcagatgggccgcttcactggatacagcctcccacaatgttgcgaacagttcaaacacagcagattgaattcgcatacgctttgccaccgaatcactacctactcctatgtcttctggcgttgaaagatcgagcagcttgctcaacgctggtcccaactgccctgctactgttccctcgactggaaacagcacctgctccagacgactcagcagcgagagaaacagcttatcatcaatgtcgaaatgcatgcaaaaatacgtaaatccctctccgttactatggctggagtggacaatacccgggcgtagcagcaccagatcaccctgtcgctgggtatagctgcgaccatccacaaccatgatctgttctcccgcaagcacgatgttaatttcatattgaggatgctcgtgtggcggatagctccattctcttccgacacttcgtgtatgaatggcaaacaaattgactgtggtccgcacatcaggaaaaaagaactcctctccggcagctgcaaggtctggatgatgaggttgcttcggtaaacgtggtgacgacatgttttccctcctggttacttacatggatatactccagtatatcgctttcagcgcgatttggataaatagttgagcgatttgacaatggttccccgccacatgacatgctaggctctaagtgaagttatcaaagttaaaccttactatgaaaggggtttcattatatgtcgaaaaatatattttataacacgcagcatgcaccgatcggttctttttccagctttacgcttgggtttaagggcaatcgcggcggactcggtttggagctaggcaagcctgccgatgaaaatgtatatattgggctgcaatccagagatggcggatcatacgaggcgcttcccttttttgcatccacacaggatgaaagtgcccgctacgacgtggagaaaaagggtaaacgaacggaaccacagcttatggcctttgccgattcagacattacccgtgagctaaaagcaggaacggatacatggcaggctggtgatttgacattccgactgtactctcctgttcgcccggtgcccgagccgggaaccgcgggtatggatgagctgcgagcagcgttggttccggcggtattcgctgagctaaccgtcgataacacgcaaggaactgcagcacgaaaagcttttttcggctatcagggcagtgatccgtatagcggcatacgcattattggagaagatccgcgtagggacgctacggattctaccccattggagggaagactcacaggcatcggccaagggcgcagcacagccattgtgaccaacagcagtgaagcggtacctgccagcggatttgcaatggagaagctgcttggggagaccatggccgagaatttatcctttggcctgggcgtgacgggtgcgcttctgatggacgttcccgcaggtgagaagcgcacgtataccttcgccatatgcttctatcgcggcggcatcgtaacgacaggcatcgaagcatcgtattactatacccagctattcaaggatattgaagacgtggggagctatgcgttgaagcattttacagacctcaccgcagcctgtgttcaggctaatcgctggatggagtcggccaacctaagcccggatcaggaattcatgctcgctcaggcgatccacagctactacggcagcacccaactgcttagtcaccaagcggacggagaaccgatctgggttgtgaacgaaggcgagtatcggatgatgaatacactcgatttgacggcagatcagctctactatgaattgattttaaatccatggacggtacgcaacgagctggagtggtttgtccaaaggtacagctatcgggatgaggtacgctttccgggagaggaaaagacctatccgggtggtatcacgtttacgcatgatatgggcgtggccaacgtgttctcccggcagggatactcctgttatgagctggcagggattgacgactgcttctcttacatgagccatgaggagctggtgaactggctttgctgcgccacggtatatatcgagcagacacaggatcagtcatttacaacacgcatgctgcctgtcttgtgtgactgcttcgaaagcatgctgcggcgggatcaccccgacccggcacaacgaaacggcttgatgggcttggacagctctagaacccggggaggcgcggaaattacgacctacgacagtctggacgtatctctgggtcagtcccgcaacaacatttatctaggcagcaaatgctgggcggtatatgttgcactggaaaaaatatttgcctcaaaagggcttaactccctctcacaggaggctggcttacaggcggacaaatgcgcagccgcaatcacagcacatatgacagacaagggctatattcctgcagttattaaggaaggcaatgactcgcagattattcctgccattgaggggctgatcttcccttactttacaggatgtgaggctgcgcttaagcctgatggacggttcggtggatatatccaagcactgcggcgccatttggaaactgtactggtaccgggagtttgtctgtttgaagacggaggctggaagctgtcctcgaccagtaacaactcctggctgagcaaaatctatctgtcacagtttattgcccgcgagctgctggaactgccttgggaagaagctgggcaggccgcagacgctgcccacgtctcatggctccttcaccctgaagaatcctattggtgctggagtgatcagatactctccggtattgctcacggcagcaaatactatccacgcggagttaccgccattttgtggctgtatgaaggcaacggcaaccgtctgactctccctgaacatatgagtcaggatcaggaacagcatgcctgaggatcatcttcacctgccaaaaggaggctccaatatgagcaagcttatggatatgccaaaagagagcggctatgcggcttggctgcattacagccgcaatagtaaggtagaaaagctgcccgcttggtgcagggtcatcgtggtccatgagacagatgaagtgcttcaatcggctgcgagtgagcttcagcacggattgacctccatgtttggacagcagccgaagatcagcgccgttcctgtgaatgcgccattcattgcgctgggtacgttcccagcgcatcctttggtcgcagaacgattcagcgcagaggaacaggcagaagtgggtgcagaaggctaccgaattcgcgggatagagatgccagatccggcatattcagcttcgcatggtaacgatgagttcaaaggacaatacgttacagtcgcagggcagacctccaaaggcgtattgtacggagtctttcatctgctgcgctacctgcagggaggactagatgggaagttgaagcccaccaccgaatcattgcacgcccccattctagaccaattatccaaccctgttaatcccatccgcatgatcaaccactgggataacatggatggtagtgttgaacgtgggtatgcgggcggatctattttctacgaaaataatgcctttactacaagtatggagcgcctgcgagactacgcccgtctgctcgcttctgtaggcattcaagcactatctatcaacaatgtgaatgtccatcaggtagaaaccgagctgattacagatagattcctaccggatgtggctaaagtagctgcggtgtttcgcgcctatggcatacagatctacttgagcattaactatgccagtcctattcagctcggcgggttaaccacggccgatcccttggaatcagctgtagctgaatggtggcagaccaaagcccaggaagtttacgccgccgttcctgatctgggtggttttgtggtcaaagccgattccgaaaatcggcccggaccgttcagctacgggcgccatcacgccgatggagccaatatgctggcagatgcattgcagccctatggcggacgcgtgatttggcgctgctttgtctacaactgcaagcaggactggcgcgatcgcaagacggatcgggcccgcgcagcctttgaccattttaaaccgctggatgggctgtttcgggaaaatgtcattttacagatcaaaaatggtcccatggattttcaggtgcgggagcctgtctcccccctgttcggtgcgctagaatccactcaggtactgctggaatttcaaattgcgcaagagtacaccggccaacagaaacatctatgttaccttgttccgcaatggaaggaggtattggattttgacacctacgcccgaggaaaaggctccaccatcaagcgtatcgtgagtggcgctttgcattctcccaagcataccaactatggaatagccgctgtatccaatatcggtgcagacaccaattggaccggacatttgctcgcccaatccaatctttatggctatggtcggttggcttgggacccggacctgtccgcagacgaaatcgctgatgagtgggttcggctgacgtttggcagacaagggaatagcgacggcgacacagatttaatttctagcattaagcagatgctgctcgattcatggaatatctacgaatcctacaccgcccctctcggggtcggctggatggtcagtcccgatcatcactatgggccggatgtagacgggtacgaatattctatgtggggcacctaccattttgctgattgccgagggatcggggtagatcgcacgtccgcaaccggaacgggctatgcaggacaatatttttctcccaatactaatatctacgaatctacggacacctgcccggatgagctgcttttattctttcaccatgttccttatacacacctgctccactccggccaaactgtcatacagcacatttatgatacccactttgaaggtgcagaacgtgcaacccttctccgagacacatgggttagtctacgagggcatttgagtgatgccatgtatgaacaggttctgaagcggctggagcatcagactgagcatgccaaagaatggcgggatcggatcaatacgtatttctaccgtaaaagcggcattgccgaccagaaggatcgccctatttattaagcaagctgtctcctcttccatggaaattaaagttttataggacaatggtaacttaaagatactgataaaatccttacttttggcagcatccgatttaaaaatataagataaaaagtgattagctgttggaaatagaccatgttttacctggactgaatctcatatgtggacgactggttttgactaagactcttcaggtttcaaaaagatgacttctgaattcattagaagtcatcttttttagtatctattgaggattatcatagcagctgctcttaagggacatcaattattgacttcgagttttatcaatgagcaagcatgctctgggggggtgtaatacatacctcaatgtcagatcatctgttacacgttccttgaataaccgacttttaattttaaaacgttagttgtattctttaatatcactgacactttcttaattaacaaaagagaatggatgtgagatagagtgaaaatacaatcgataggattaccaaactataatattaaaactgctacaaacaaagaaaacaagggtttagaaataattcatgctgaacagttttggaagcggaatatttttggatctaatgttgtcattgctgtgttagataccggaatagatatgaagcatgaagatctacaaaacaacatcattggtgggagaaatttcacttcaaactatgacaatgatccgcataactatcaggatggcaatggacatgggactcatgttgcaggaattattgcagctaacaataaaaaagttaacattggagttgccccacaagccagcattctcattttgaaaacgttaaccaatgacggagatggagatattaataatttaattgaggctatctactacgcaatattatggagagggcccaacggagaaagagttaacattatgacaatgtctttgggtaccaaaaaggacaatcctcttctgcatgacgctattcgctatgcagtgggacacggcttgtctatagtcgctgcttccggaaatgatgggaatggggagagtgatcgggaatataggtatcccggtgcttacaatgaagtgatagaagttgggtctatcggagcaacaaaattaatttcaaaattttccaacaaaaacgaacaacttgacattgtcgctccgggtgaagacatatattccacattccttaataataaatatgcttcttttagtggtacatctatggcagtccccttcgttgctggtgcgttagcattgatcatcgaagaaggcagaatcctattcaaaagggatcttactgaaccagaaatttatgctcaattaattaaaagcagttcgctgctctttggaaatccagctatagaaggaaacggaatgctgaatttgttaaagagctttggataagttgatctaaaattaaaaacttatcgcctgctaagaaaaacgactcatgacctggttagtgtgatagctatacaagagaatcagttcatgagttgctctcatcaccgcaaaacttctgtaaaatggtcttataaaggtatgtttctcacaactactctaagactgtaattacacgattttttaaaagcctctaggtatgttttaagttcaagttatacactctggacgtaagacgttagaacactagtggcttccaaaaaagtcgtcattacttgttaggaactcccttcctcaagcagtagaactccaagtaaaacttaaatattcctctctcgttttttgaaatgctccaaatacacgagttcctttttttaaaatgctgtgaaacgattcaatgcagacattgtcataacaattcctttttcggctcatgctgcctttcatgccgttttcacaagctttttctggtgttcctgagctgtatactgactgccgcgatccgaatggtgcagaacttcactggcaggatggtgagccaggtaagcacgctccaatgctgaaaggaccggttcctttgttattctggatcccatttggaagcccagtttggaattcgttctcactttgtatttcttcacgattctggattccatagctgcttcatgatcttcgctacaatcttttcaaacacgtcaattcccagtttaatgaaataaatggtagatctgctactagcataaagtcgtctggattgaagaaacagtcgtctgattttctgctctacctaacttcttcgtttctttcgctcactttgagaggattagttctgcagctaggtatagtaacctcttcgggagacatcgaaccatgcgcacacctttgcaaccgggcactgagagcgatattgatgcgtgcaaagattagctccagtattcggcaacccaacaatacaatgtgcttgcggaaatcccagattacgtaccacttaggcaacagctttcccttcttcttgaatcattgggacgatctgagctttgaatactctatcaacttcccatcactaaagtgattgggaagtatgcatttaaaaaaaaccgaattccgtttgtcttaaactaataaatattgggttgttatatctagtacataactcacttttatagttgtaacaaattaaatcgaaaggagaaattaaattatgaatgagaagaaaactactcagacaaatgcttcccagcaagagcaagtgcagattcaagcggaaattggctgttaccaactgcctaaatgctgtggcgtcggacctgactgcccagcaacatatcgcggtgtgtttaagaacaatccggtcttttattcatgcggctgttcaccttaatgattagcttttgataagatttgtgcgttatccgcctttatatttcaattttagaggagtgtatatagttatgatgaatataattaatggtcgacctatgacaataatcgaaacaaccgattttttagcagaacttacaaatagccctgattataagaaaatttctaaattaattaatacagagtattcaaaattttctcttgaaaatctaaaaatcaaagctacttttgtgagtgacttatatacaacaaacaaaaaattaaatgtaggaaaaatgatttatttcattagtgaagataagaaacttgtattccatgcctttggttataatgaaattgacagtacagaagttacttactcccttggtgtagatattttagaggggaacgaattgaaacagttagatgtgaaaaaagggagaactcacgtcactaattcaccttatgatggagttgatctagacgtagatgtggaaactccaccttttcatgacgagacatacacccccggagaaactaacaataaaattactactgcttgggatcctacggagttttgtgctcctggtggttatcagcattgtggtaaaaactgtggatacaatatggctagaggtgggggcgcccccattaacgaattagatgaatgttgcgtagcacacgatcgttgctgggcaaatttcggcgagggtaactgcgagtgcgatgggattctcgagaactgcgctcgcagatatagaactcaatattatattatagctaatgccattatcatttatttcgaaggatgctaatagataatacttaaattgtataaatatctcctcttcttaatatagtactatccctttcaagtagagactcaaaaaaccttatgtcacatgaggaaagagtaaacttgaaggggatatttccatatagaaagggtaatttcttttttagaagaagcagaataagagcaggtacctttccctactatttattctgggcctcagctgatctttgtaattttttaaaaagatttccttacagcttgttgcgagactcccagtcctctcgctacttgggcaatcccttttccttcaccctgaataattatcagtcggaggacttaaaaactaactcatggacacccctcaaccaagtttgattgtgtctccattccccgtgtctaaattctagtcaaatttccgttacttcgcacttttcattacttatgataaatggacagcagtgcacttggccacagtggaatttagcctctaataaaaactacctacatcaccgaatactctaaattaaaaattattatatgacggattgtacttatgaagtgcgacacctactggaataaaaggcccatggcctgacactctagcgcaaactgtatgctggtgtgttgacgagtatctccttagatgctagggcacagaggcaaacggaaacaaccgacagagaaacgtgggaagtttgcggtaggaagtcaattcagagtgcgtcaaagaagtatgctcttgggagcctttcgtactgggaactggatacggtaatacccagtcgtggggaaagtaaaaactgcttagctaccttcatcaaactgaagatgcgtctataatccgcgatagaggtgccggatctcataggccttgtccatggagattacctttggcctagtcgctttctagcactcttccggaacgtttcaaagcgttacagctactccctcctcggggaaatggttttgcttgttacacgagcctcgaagcgatccaccacctcaggtctatttcagacccttacttcatggcaacaagtatctacgagaaagcaaacgatttgtttcaagaagtttcccctaaaggcagtgaccttactcaaattacagatgaaatactagagcatgttcgtcctcatctacaacctccccaacaatatctggactggaaaatcaatcacgaacgatttacagaggagctgttgcactagccttgacaatccatcatttaatcattgttatctttcttcactcttaccgtttagggaattcaaattgagctatttcgattgtgctatgatgaaggaggaatatatcgagattcatctacacaaatgtattttgataactttatttcacatgaccggaccataagcttaatatttatttctttgggaccgtcacaacaatcggaatgtaaataaatttaaaattcatcagtaaattattatttactgcaactttttcctgtcttcattcgtggttgtagtgaaaggaggaaagaatgaacctagaaactctttactccagctactttaacgacttgtatagatatctgctttccctctcctgtaatcatttcgttgcagaggaactagtccaagaaactttctttagagcctttttacatcttgaggataatgaaattggaaatattaaggcttggttatttaaagttggataccatgcatttattgatttcacacgacgaaaaaacaaaaaaaatgcgcttattgaagaaattaagggactagaattattggataacaatactccggaaaatcagttcatagagcgtgatcaattaagccagttaatacaatcgattcatactctacccgaaaaagaatcccaagccatccttttatgtgatctacatcaactcaaaatgcacgaagcagctgaagtgttgggattaaaccttaatactttaaaaagccatatttatcgtgggaggaaaaagttaaaaacgattcttgaaaaaaggggcatactacatgaagaaggataacgataacgaacaatttctcgataaaaaaagtattaatagtaatttaacacctaaagaagatcaagagggaactaatgatgaatataataagttgtttaaaaaagctaatttagatctagggacccctttacactttgaagaaaaaggttcaaaaggcattataaaattagcgaaataccaagcaaagataagtacaatcctcattgttctaaccattttactattaattgtacctgttctaacactttgttcctatttatactacggaacagggaaccgagctaacgacttgttagacaccactaagaatttaatctacgtaactgaacctaacacaatgttagaagaagggtttgataccagaattgattttttttctatggacgcgaattttaacactttaaaacgtgtcgggaagcaaagtcttaattctgaggcaatcaaagtgcattacacaatgaaacaattttctgctgtggaacggcaatctaaaacaagtatacctgtatctgagtcaaataagaatcatttcattttcccaagtaacaacctgaattttgataaaaataaggagtgggaggttttaaacggtttgccttctgggtctgtcgccgaattgtacatttctttcgatgatttgtactctccccaagaagtggaacacaagctccccaaaagtattgatactctgtggcttgcagtaaactcaggagtggaaaactcacaaaatagtgaaataattcctttggggtaccctacgcattctgataccaatttattttctccgtttttcggagctaaggttgctaaacaaggaattcaacctatatttcttaaaattgttgaacagttggctcagcgacaaaagctaatttccacttttccaaactaccagaatacatctttctctaaacgtttggattatataaagaaaaatggaatactcacctatggagtcgtcgttacagggccatctgaagaactaaaaaaacttaaaagtaataaaatggtgcgcacaataaaagttggggaggtagagttatggaattggcattattaaaaaataaaaagggaacccttttacaccccataacaggaatgatatctttcttgtgcggtattttttcattagttgaattgaatattaactatttatttctctcttctttttttcttcctcaagcactatatagcataccagtactaggaattttttcgggaatggtagcactatttacaagacgatctaaaatgtatgcatggtgggggattggactgaatatttttgtactcctcttctctttcgtgatactaatacttgcttggtcaattaatcctaaaccatgataaaacggcggtaaatgattcacattttatagattggtttattataaaaccataatacgaatgaattgttatacacattaccctaattactagcttaattcgcattcaaacaaaactaaataaccagtcgccgatagatttcaggcgactggtcgcttaaattgaatatgttttgatatcccactcaagacattcccggcttacagcaccagacttaattatctgtctcttcattttttttatttacaaattcccaaaaaccaggcactgatttcaaatcatatctatagattgcctcaattaattttaagcttacttcttgtcttaagtcattacgatcttgaggttttgtctgtgtaagagatttttgaattttgggattgaatttttcaataatagttgctattgctcgtgcgtctctttgttgtgctttcttaattagattcataaaagagttcactgcttctctccctttcacataatgaattacttgctctatttttcccgagagtattgaggattgatgccattgatcataatagattggactgacactgttattttaaatgattgcaatatttcactttgagcatctttccattttacgccaaaaaatctctgagtttttttaatgctctagttcttgtttttgaaacagcctgctgtgatacgttattatttttagcaatttcagtgtccgaacaattcataacatatgaagcactcaaaatacttttttctttttccgttaataaatttatcgctttatgtagctttgaactcgttaccacatcttctattttaactgttcgcttatccttcaagaattcatattgtgtacatacatccttaaaaagattgtgtgaatcctcttccggtattaacacgtttctttttcggattcttctttgtttcttgtcaaaatctatcgaagcataatgtatcaaggatgatatataggttgtaaaacgaagttctaaaaagaattgtttgaatttttcatctagttccttattattagcatcagatggaaacataatactttccttgaataaagcatagtgctctgggtcattcaaaaactcatttataattttttttcttgaaagaatgctaacaatttcagtaaaatttagtatataagagttcataatttccctcctaaataaacagtatgtttaatcaaagtgatacaacttgccgaaaccacaaccataaatgtctaaaaagatgtttttttaaaaaaattgttaaaaaaccttgtgaaaggctttagtattgagaatatttgagagagtgaagaaaacagactgaaagtggtctgaaaaaaaacttttcgcacacccccaaaaggtttagttattctacacggctgctaatattacaatttagtatttaattggtatatataaaaatcaataataagaatatataaaaaatagaaatttaaaagctttgaatatttatcacttgtgattaactaaaaaacaaaacatttggttcaggttttgaataaaatgtttatgagcgttagctctttgagaaatgaaaaaagccgcttccgaagaggaagcggagtttcgtctatatgatttaagctgaacttataagtactactactcagttagatatgccccttttcctccttcctaatatcgcttaattaaatcctataatcagggcagaaagctcggaggtaatactttaaaagcggccttctcgcttctgtaacactattgtgcccatccgtttaatctaaatttaaagagttcaactcatataaatataattcacggtttatttacttgataaaggaaaggagcactaatccgtacaatgttcaggattaaagttacaaccacaaattgtgacacctactttatcgtagcaagcggattcaatttttttaagatgataagcatatttctcacatatctcttggtaaaacaaaatatcactagtattttcagtttcctctatttttttgctcagctttaatagttcaattttaaaattatgatgtcttgatctccaagcgtgcaactcttccaacaggatcgcctccaaaatattttatgtttaataaagtggggcaccggactgatagaacaacctaaaaaatagaaactattttggggttgtactttttaaaactactatcactttacttatcaaacaccaattaagtttgggggtatagccaagaggctaaggcaaaggtctgcaaaaccttcatccccggttcaaatccgggtacccccttgctaatttaattcgatgggagagaaaggtaaatgttaaatgaggtacttatctacacaaagccaaattgtatattttgccaaaaaatcaaggagtggatgggggaaaacaagatcaattttactgacattgatattaccaatataaatgatctcaagttacttcgtgaaattaaaggcgtaccctacacaatcataaagagatctggtaaagaaacagttatctgcggattcaatccaaacaagcttagggagacgcttctataatttcaaaatctcttctgaagggaagatatctatgagtgtagaggcaatgatttcactaattacaaatgttggatttcccgtttcgctatgttttattcttctttggtacattttgaagactctaggagaaaaattggataagttagacaactcaatgaatcagcttaatactacaattaaaaagattagcctgttaagaaactctaaaaatgaatttgattcaaaaaaaaattcacttatgtgatatcagcatcctaatggaaaatcatgcagacaccttccaagtaagctatttctgagagaaatgtctgtcaattatattcaatttcacataatatatattactcgttagtgaacacactccttcggagaggttcgtgtaaaacgtggaaacttcactcttctcaaagacatctagatcagcttgtatgagcagctaaatgaaaggatgtatgaacaggttctgaagcggctggagcatcagactgagcatgccaaagaatggcgggatcggatcaatacgtatttctaccgtaaaagcggcattgccgaccagaaggatcgccctatttattaagcaagctgcctcggcaatactttcatacagactggaacaaggcttctctacgcctagattcgctttctcctatactggcattgtctatccacacatcattaaaaggcatgcgtcttactcagacctatgccttatttttttgcctggaaacttttaagcacacggttgcttacgtaaaatgtcatatttgtccactctgagtgtgcaataaattcttctttttatgcaaccgcttgctttatactatttttgtagacgtttacaaaatgttgtcgaattagactatgctttggggaggatgatcggtttgaccttgtatcgaagtctatggaaaaaagggtgtatgcttctactaagccttgtgctgtctctgaccgccttcattggctcaccctctaatacggcgagcgctgcggttgcagatgattttcaggcttccgttatgggaccgctggcgaaaattaatgactggggttcctttaaaaagcaactgcaaacgttgaaaaacaatggcgtgtatgccatcactaccgacgtctggtggggctatgtggagagcgcaggagataaccagttcgattggagctactacaagacctatgcagatgccgtgaaagaagcgggactgaagtgggtccctatcatctcaacgcataagtgtggaggaaatgtgggagatgattgcaacatctcgctgccaagctggctgtctagcaagggcagtgcagatgaaatgcagttcaaggacgaaagcggttatgccaataacgaagccctctctccattatggagcgggactggtaaacaatatgacgagctgtatgcctcatttgctcaaacctttgctagctacaaaagcatcattcccaaaatttatttaagcggtgggccctctggagaattgcgatatccttcatactatccggcagcgggatggagttatcctgcacggggcaaattccaagcctacactgaaacagccaaaagtgcgttccgcactgccatgaatgaaaagtatggatcaatggataagattaatgcggcatggggtaccaagctgagcagccttagccaaatcaatccgccgaccgacggggacggattttatacgaacggcgggtataattccacgtatgggaaggattttctgtcgtggtaccaaagcgtgcttgagaagcatttgggcgtcatcggagcagctgcacacaaaaacttcgattctgtgttcggtgtccgtatcggagccaagatttccggtctgcactggcagatgaacaatcctgccatgccgcacagcacagaacaagcgggtggatattatgattacaaccgtctcattcagaaattcaaggatgccgatctagacttgacatttacttgcctggagatgagtgacagtggcacagcaccgaattattcgttgccgtccaccctggttgataccgtctcctccatcgcgaatgccaagggtgttcgcctgaatggtgaaaatgcactcccgacaggcggcagcggcttccaaaaaatcgaggaaaaaatcacgaagttcggttatcacgggtttacgttattgcgcatcaacaatctcgtcaacaatgatggctcaccaaccggtgagttgagtggattcaaacaatatatcatcagcaaagccaagcctgacaataatggcggtacaggcaacaaagtaacgatatactataaaaaaggcttcaactcaccttacattcactaccgtccggctggtggtagctggactgctgcaccgggtgtgaaaatgcaggatgccgaaattagcggctatgccaaaattaccgtcgatatcggttctgcctcccaattggaagccgcttttaacgacggcaataacaactgggacagcaacaacaccaaaaactactccttcagcacgagcacttctacgtacacgcccggtaatagtggcaatgcaggaacgatcacttcaggcgctccagagggcgtgaatcccggggatggcggcggtacaactaacaaagtaacggtatactacaaaaaaggctttaactcgccttacattcactaccgtccggctggtggtagctggactgctgcaccgggtgtgaaaatgcaggatgccgaaattagcggctatgctaaaattaccgtcgatatcggttctgcctcccaattggaagccgcttttaacgacggcaataacagctgggacagcaacaatactaaaaattaccttttcagcacgggaatttctacctacacacccggcttgaacggagctgcaggatctatccgaacgggggcaccttcaggaagtgccgtcagcgtagtgacttccacctacgcaaccgacctcaacgaagtggcagggtctatccaaacagaaaaactttcgggtgtatccttaaacgtaagcacttctacctacacaccccatgttaacggagttgaagtaactgctcaaacggaggcgctttcgagcgccttcactcctatagatctgaataccctctccaagcccactccccttggcacagactggagcaaacagagcatttattttatcatgacagaccgatttagcaacggagatacatccaacgataattacggtggcttcaattccaacaacagcgatcagcgcaagtggcacggtggcgattttcaaggtattattaaccaactcgactacattaaaaatatggggtttaccgccatctggattactccagtaacgatgcaaaagagcgaatacgcttaccacggctatcatacgtatgatttttatgcggtagacggacatctcggtaccatggacaagttcaaagagctggttggtaaggcacacgacaaaaatatcgctgtgatgctagacgtagtagtgaatcacacaggtgattttcagccggggaacgggttcgccaaggctccttttgacaaagcagattggtatcatcagaatggtgacattacagggggagactacaactccaacaaccaatggaaaattgaaaacggtgatgtggctggactggatgacctaaatcatgaaaaccccgctaccacaaatgagcttaaaaactggatcaaatggctgcttaatgagacaggcattgacggactgcggttggataccgccaagcatgtaccgaagggttttctaaaggattttgaccaagccgccaataccttcaccatgggtgaaattttccatggcgaccctgcttatgtgggggattacacccgatatctcgatgccgcattagattttccgatgtactatacaatcaaggacgtgttcggacacgatcaatccatgagaaaaatcaaggagcgctactccgatgatcgttactatcgcgatgcccagaccaacggtgtatttctcgacaatcatgatgtaaaacgtttcctgaatgacgcctccggcaagccgggtgctaactatgacaaatggccacagctcaaaactgccttaggctttactttaacctcacgcgggattcctatcatctatcaaggcaccgagcaaggctttagtggcggagatgatcctgctaaccgggaaaacgttgtgtttaacgccaatcatgatctgtatcagtacatcgctaagctgaaccgtgtgcgcaacagccaccctgccctgcaaaacgggagccaaaaggaaaagtgggtagacgactccttttacagcttccagcgctctaaaaatggcgacgaggccatcgtacttatcaacaactcatggagcagtcaaactcgcacgattggcaacttcgacaatctgtccaacggtacccgtctgaccaaccagctgagcaacgactccattcagattaacaacggttcgatcaccgtgactctcgctccaaaggaagttaaagttttcaccaaataagttacaccgaatattcaacactgtaccatctgtccataaaacaaaacaggcacctgacgaagcgtacacttcgttgcaggtgccttgtttatatataaacaacgtgggattacttaggcctcagtagccacgttgatattgttcaggtatggaaggctcttcgccgcgcagcgtcactgctgcatgaatcgcccaatatggatcgcgcagcaatccgcgtcccacagcgaccagatcggcatcctcgttgccgataacggactgcgccaaggctggctcatccagtgcgcctacagcgatcaccgggatgttcagtgcctcgcgaatttggcgtgcgaacggcacttgatagcccggatagttgcccggctttctggcgccagcagggccttccccgcccgagctaacatggatcacatctacgcctgcagcctgatatgcacggctcagctcaatggcatgatccacatcgtacccaccatctacgtattccaccgcgctgatgcgtaatattaacggcatacccgcaggcatttgcttgcgtacagcctgaatgacttcaacgccgaaacgggataaatccttaccgtactcgtcgtcccgcttgtttgtaactggcgaatggaattggtgaatcaagtaaccatgtgccccgtgcagttcaatcgtatccacgcccgcttgaactgcacgccgggtagcgtctgcgaatttctgcaccatgccacggacttcctccgtcgtaagcgcgcgtggctgtttataattcgcatccgggtatgcaatcgcggaaggagcaactggctcagctgcatcctcagctttacggcccgcgtgagcaatctggatgcctaccttggacccgtgcgcatgaatgccgtcaaccagctttttataagctgggacatgctcgtctgaccaaagacccagatcataatctgtaatccgtccatccggttccacgtccgtcatttctataataatcaggcccgtgcctccaatagcccggctcaggtaatggacatgatgccaatcattcggaatcccgtccttggctgtcaccgagtattggcacatcgggggcatcaccacacgattctttaattccaaatctttcagtgtatacggtgtaaacaacgaattcgtcaaaacgttcatctcctttttatcttcgtcacataaacgaaaaatacgctccaaattacacggtctattaaaaacataatcggcatagtccaaacggaataaaagagattcctccaacgggggatctctcacatttgcaacttgcagtcattatgtatgtcgtatggtgtagatatattgcacacaacctattatccacaactcaataactttttgcaagtaaatatttaaatattattaaatatttttttgtccttcccctctccgcctcctagctataatacaaaaagacgcccttacggacgcctctgcaataccaatcttattgtgctgaacctaattgtacccatgccttctcaatctctgcaaccgcctgatccttgttcatgttaccgctgatatatgcctgcatcagctcgccaaatttttggtggaacgtatccagcgagtagttaacagacagatcaccggacttcgacgttttcaaaatgctttccatttccttaggcatttccagatcaggaagcggtgcatccttaattggaggaatcaccttcgctacctgggagaaccagttcttaccgtattccgaagtgtacaaccagttgaaaaattcaattgtttccttggatacttcggaatccttgttgatacgcagcgcctgatccgcaccggtaataatgaccgattgatccgctttgtcactcaccggatatcccatgatgccaatcttgagatcaggattgatttttttgattgcttcctcatcccatgcacctttacccgtcataaacgcagcttttccggatgcaaaatcacttacttccgcattgctgtcccgttccagtggcttatctgtgccatgtttcaccgtcaaatcaatgaagttaaagaagttgttgtacagcactgggtagtccttgatttttgctttgcctgcgataaaatcactaacgagctgcttcggttccacgcctgcatcctgcgcggcagcatctacatagtgttggaagatatgcttccatacccaccactctttatatgcgttggcaaatggagtaatgcccttcgcctctagcttggtgaccgcatcctgcatttctgcaatcgtcttcggcggggaggttaccccagccttggtaagcaaatccttattgtaaatcagcgtaaacaggttcccttttaccgggagtcccagcactttgccgtcactggagctcatattcgctcgaacagcatccgtcatggctgctgccagcggctcattggtcagatcagcgctataatccgcatacgtgtcgatgtcgcctcctgccgtcgtttggaatacatccggtgtactacctgaggctattttcgacttcagaatcgtgttgtagtctgcctgcatgatctccagattgatcttcacgttaggtttgaccttcttatactcctcgatatacgcgttaaaagcatcggtatactctggtgaagctgtgaacatgtttattgtaaccgttttcaaatcttctttgccgccagcactttctttcgacgcatccgtgccgccgttgcttccacatccgctcaacaaaccgaccgtcaaaagcaaactgccggataacgccatcatcttctttaacatggatactcccccatttgtttgtgatcaacgtccatgcgatcattctaaaaaatatactcccatttaaaaaggcagattagtgaagcgttaagggtaaaaaagtggtttattgcaggctcacgcgatactcagacggtgacacctgataataattacggaaagccttactgaaataatttttatctttgtagccgagcatatccgagatttcctgtattttcaggttagaatcacccagcagctccttcgccttgtccattctaaccttctgtacatattcgtgaataccgtaaccaaactgctgtttgaacagcttcatcaggtattcccgactcaaaaaataggtttcggcaaaaaacgaaattttgatatcctcaaaataataacggtcgatgtgtcttttgatgtccgtgatgtcaaagggctggttccctgattgagtatgttggaccccagcaatgtaaagctccagcatccgattcaatctctgaccgtagtggacaaagctcgtaaaatcagcagacaaatcctcttcacccacgtactccggttcttccaaagctctatcttgattcaacactgacgtagacgcacctaactcaaccgcagcttctctcagtaaaaaatggaactccttcatcattcgatccgcatcctgtaaacgaaaaatagggcctgatgccaattgtttcagcagatcgcccagcagtacttttgcccggttcgcctgacctgtctgagcatccttttggatcgacagcagtcgctccgtccatgacatttcctctaacgtaactatttgccgtggcactgtatgaagaatggattccccctccagcttcaacacatccgtgctgtgaatgagcgtcttggcatccatataagcagacgctagctccaatacatctgtgcagagcttacccaatccggcaactaccaccatgctgaacagcccatgcaggttcgccaccgccttctgtgtcacttgtgccaatagtaaggccatatgttcttcttgtcctggggccaaggtacagatcgaaacgacctcccgctcccgtcgcggatgggagaagctaaaacaactcaaccgttcatctgacgtctgagctaacacattggtcacggcaaaatccatcagatcggcatcgccatgaaaacgcgtcctgtgaatctcatccctgttcagcagccgcagcacaatcaccccaaagcgattccccggctgatccgctccgatcaatgggagcaacgctgtattggcctgccttttaaagctaccgtccaaaatggacaaatataacttctctttcagcttcggcagtgacatattcagtgtaatgttctggctaatgaacttgtttttgctttgctctcgactttccagaatgtccactgctttgcgcagtgcctggttcagatcgtgacgattaataggtttgagcagatagtccaccacccgggattgaatcgcctgccgtgtaaattcaaagtcattgtagccactaatgacaatcgtcagcaggtggggatatgccttttcgatggcacgaagaaattcgataccgttcagctcaggcattttcatatcgaccatcaccacatctatatggtgctgacccaacagctccagtcccaaccttccattcgtcgcctcataaatatgttcgatgcccagaccgtcccagtccccgataatacgaatggcttcgcgcaacggctcctcatcgtcaataatcaatacgttatacatgaatacttcctccccggggaatttgcattctcatttccgttcccgtttcatccgtaagtatgaataatcctgcctgatctccatacaaaagcttcaaccgtgtgttcagatttttcaaaccaatatgctcgctctcccgttcttcccatttttcatggaatgaatccagcaccattttcagcttgtcctctgaaattccaggtccgttgtccctgactgtaattgtggcatttgtagaactcgattcggctgaaatgacgatcagaatatcacttgatactttttccaacgcatgcttgatagcgttttccaccaatgtctgcacagataatctcggaatcggcagctccatcagcgtttcttcccataccacttcgacccgcagtctcgctccgaaccttgctttttgcagacctatataccgctcaatgtgcttgagctcttcgcgggcagctacgatatccttgccgttgatggaataccgcaacgtttgggccaacgcatccaccatatccgccatgtcgaacatctcccgctttaatgcctgcgtggatatggcttgcagggcattgtacagaaaatgaggattaatttcagcctccaacgccttgagtatggcgttcttttcgaccagcttcatgcgatagcgctcattaataagttcttcggttctttggaccatttcgttaaaatgcagcgacaaatatgcaatctcgtcatgtcccttcacaggagctgttgctccaaaatccccggtgctaaaccgcttcatctgggtggacagcttatgtaagggtcgggtaatggcgttcgaggtcagtgtcactaatataatagacactcctaaaaataaagccccgatggcatagctccaattccgtgttgtcgtagctgcttcataaatctggcggtatgggatgggcttaatgagctgccacccatctttttcaccagcatcatagacgaccaaatactcctgatccccactgctatctgaccacgttactcgcccgcttcctcccttgccgatctgtgtcaacactccagaatcacgcatccgctcatatagcggaaagctgttcacataaaaggggactcctttaggactcattagcatcaattgatcccctttgccgagtggaatgttctgcatgatttcatccacggcgctcgtattgtaataaaaagacagcaccgcctgcggatggcgggatgcaatcgacctcaacactcgatggtatgccataaagctcgcttgtggcgccacatagcccatatcagagcgggatcctacaaaggattgaaatgattcgttcgtggtactagccatcgcctctttataccaaggaagcttgggaatatctgtgtttattcctttgcgcaccgtaatgttgtacgtctccctggtaaccacatagtattgatgtcggtccgccacgtacagatagatcgcttccagatcattacgtgaataaaacatgctgcgcaagtaattttcaatgaccattctcgaagcatagtcctgattctcattggcaatggcgttcatgatatcgttataacgaagctgcggaagagccaactgctgcattccctccaaataatcctccaaattctgattgaccagcaacagattattggtcgtgctggcgatgctatggttaaccgactccttttcaatcatctgataggaaataattgtgagtgagcccaccaccagaataatcaccgaggtaaaaagtagaatgagcttgttcactaatttttgcgtgattctcctccacgtggagcgaagaaacgttcctacacgctctgacatcatgataatcgccccttttgaaagcgtacacatttttaccctcaactgttttcttaaatccattggtccggccctaggggctatcctatactttcattatatcttaaacagcttggagagaaagagcggaaaatgttgagaaaaagaggtgcgttatgctgaaaaaaaggggaactcggggcgacaagggcagtaaactggaattcggtttattcacactgcccgtaatcctgtgcattacgattgcattttatattccgtttttgatgacgatacgctattccctgacgaagtggaacggcatatccaaacatccgaaatttgtaggtctggataacttcaagcaaatcctgcttggagacgccaattttgcacatgcagcctggtttaccgtcaagtatgccattctgtacattgtattggtgaatgtgctggccattttgctggcgctcgttctcgatatgaagctgaaaagctcggcttggctgcgggcggctttctttatcccgtatatcctcagtctcgtgattgtcggctttatatggaaattcatcttcatgcaaggctttgagtcactgggacacagtacaggctggggcatcttccagctaagctggctgggtgaggaagggctcgcgtttatttccattttggcggtatcgatctggcaatccattggcttttacatggtcatttatattgcaggcttgcaatctgtgccagaggatttaaaagaggctgccattgtcgatggcgcggggccgattcggagatttttcagtattattctaccgatgctcgcaccttccattacgatctcagtcttcatggcactgaccaactcgatcaaagtgtttgacgtcattttatccctgaccggcggtgggcccggtggtacaacatacagcattgcgtatgatatttaccgggacacgttccagaacaatctgtatggctacggaacagccaaagcattgattttattcgttgcagtcctgatcattacgattattcaattgtctattttcaaacgcagggaggttgaagcctgatgcaacgcagccgtacgggacgtattttgctagaagcgggcatgattgtattatcattgttatttttgtacccgctgtttctcgccattaacaattcgttcaaaagcttcgctgaggtcatgaccgacgtcattgcgctgcccaagcagctttcgctggataactacgtatatgtatggaaattcattgactatccacgcctatttctgaataacaccattatcaccgtcgtcggactggcaggtatcgtactgatatcttctatcgcggcctacaagctggcaagaaccaaaagcaaatggagctccgtgatttacatgctgtgcattatgccgatgctgatcccgtttcagtccatcatgctcactgtcttgcgactggcaaaagacttaaatctggcagatagcacttggggacttggcttgctgtattggggcttcggcgcaccgctggcagtgtttatctatcacggcttcgtgaaaggtattccggtcgagattgatgaaagtgccaagatcgatggggcctcgggcttccggcttttcttttccgtgattttccccttgctgaaatcagtcactgctaccattgtcattatcgacgtgatgtggatttggaacgattttctgcttccgcttctcatggttaacggctcacctagcaccaagacgctgacactggccgcctacacctttgtcggacagtatacgtcagactggcaatacgccatgaccgcgatggtaatggctgtgctgccttcgatcatcgtatttatttttctgcaaaaatacattgtcaaaggcgtcgttgctggagccgtcaaaggctgagtcaaggaatcgaagccagatgcaaaaaagaggacttgcgtgttgttcgcgcaagtcctcttgtcttcgtgatatccatcatgggcttctgtacagtattcattaagccttaaactggcctagcgctttcagcatctcttccatagcaagctgtaggtcagcagagcaggcattcagacggttaatctcttccatctggtcggaagctgcaaccgacacttcctgtgagccgccgctcgtcctgcgggcgatgacaataatttcagtagcagaagcggtaacttcctgcacacctgctgacatttgttctgcgattgctgccatgctttcgatccgttctgcaatgtgagtgcttctttctacgatctgttcgaagctgtcatgtgtctcgttcatcatccgcagcccgctgtccacatgcgctaccacatgtccaatcgcttccgccgagcgctgtacatctccatcaatgttttggatgagctgcgccacttgacgggaggctattcccgattgatctgctagcttccgcacctcggatgctacaacctcgaatcctcgtccctgctcacctgcgcgagcagcttcaatagaagcattcagcgccagcagtcccgtctgttcagatattccctgaataacctgcatgattccggtaatttcacctgattgacggtgcagcgcttgaatcagagcatccgtatgctgaatggacgaatgcagctctcccatctgttccaccgtgaggcgcgcggtttccgcgcctgcctccgcctgctgcttggagtagatagcagcttcggcaatctctgaggcgttttccgcgacattctgaatgccctgagccatctcttccatcgccgtctgattttccaatacgcttcgggtctgcgcttcggctccgtctgcaacctgccgtatggtgtctgcaattctatttgcctctctcgtcgatgcttcagcaatgacggcaagccgtcccgttgaatcggctaccgctccacaagcatgcatgccctcggaaatcaaaatgcccaaatttccccgcatttcattatagttggtactcagccgcccgagctcatctttgctttgatcatgcagaacagaagtgaaatccccctgacctgccttggcgagcgcctggcctacacggcccagcctgcggtttaccctgctcatgtaccagagaatcacggctagcgacactgcaatagcaatcacaatcacaatcataaattggcggataaacccgctaatgatcccgtcaatgatcgattgcgatgcacctacatacagaatgccaatcacagcaccgtctgcactacgaatgggtgtgtacgcagcttgatacgttttaccaactactaccgcttgaccataatagggttgaccctgctttaagacaacggtagccaccttctcggatactttcgtgcctacagcgcgtttgccctccagcatgacattcgtcgctacccgttgctccccttgaaagaaagtcaccgtatcgcctgttgccccgccaatttcatcgacgatttcttcattattgttaatccgttggcttcccttatataattgcccgtccttgatctgccatgccccgctatatttgtagtccagcaggcgggttgccatattcaagtcatttttagccttttcggtagcaaaagcctcaattccctcctgcattcggctagtaacaacataagcaattacgacagacaacacaaccaaaataccgatcaccataccactaattttagtgcctatccctattgtccgcatgtattggatacgtcctctctaatctgacgccatgccgccacaactctatacaacttaagctcaatctgttccatcatggatacttattttatcgtacaaattacctaaaattttaattatttatcgatttgaaaattaattcagttcttatcaggtgtattggtgttgccttccttgacaattcctcttaataatgatttactaattttactattcgtaattattacgattaagtaaaacaaagaaagcacctctgctttcctatctcgcatgataaccactacagcacattcgacatttcatgatactttcgaagggaagagtgattacgttggcaaacgctatggaattggaaaagaaaataccggtcacggtactaagcgggtacctcggctccggcaaaaccaccctgctgaaccatgtgctgaacaaccgggaaggcttgcgggtagcagtcatcgtcaatgatatgagtgaggtaaatattgatgctgatctcgttcgtgaaggtggaggattatctcgtgtggatgagaagctggtggaaatgtccaacggttgtatctgctgcaccttgcgggaagatttattaaaagaggtagaacgactggcactcgacaaaaggtttgactatattcttatcgagtccacgggtataggtgagcccattccggtagcccagaccttcagttatgtagacgaggaaaatggaattgatttgaccaagctgacccgactggatactatggtcaccgtcgtgaatgcaccggaattttggaaggacttctactccagagacttcctcaaggatcgcggacaggaagcggcagaggaggatgcacgcggcatcgttgatctgctcatagagcaggtggaattttgtgatgtgctgatcattaacaaatgcgatctggtatcccctgaggagctagaacgactggaaaaagcgttacgcggcattcaaccaaacgccaaaatcatccgttccgagtacggtaaagtggacccaaaagagattttgaacacgtatcgcttcgattttgaaacagctagtcaggcggcaggctggatacaggaaatgaacaaagaagagcatgtacccgagacagaagaatatggcattgcttcgtttgtgtacaagcgcaaaatcccatttcatcccgaacgtttgttgaaatggctggctcaatggcctgctgaggttgtacgctccaagggattggtgtggctcgccacgcagaaccgcactgcttttacattcagccaggcgggtagctccaaacaattcgcacgcgcaggactgtgggtatctgctttgactgaagaagaacgccaatactatctcggtgaagattttgaaaaaacacctgactgggacgaagagtatggtgatcgggttaccaaactcgtatttattggcatcgacatgaaccgggaagaaatcgagcgcaccctggatgagacactgctgacccctgaagaaatggagcaggattggcgcaagcttcctgacccgtttacgaaaaaagtataatgagattataaaataaaaagcgccttaagtgaggaatccccccctcttaggcgctcttatattatttatgcttaacccattgtgcgctatcaaccggccaaaaaatcacatccgcacggccaacaatatctttaatagagacaaagccaatagcacgactatccctactattattgcggtggtcgcccatcacaaaaatatacccctcaggtaccttggaatcggttatggttgcatttggaaaatcaccattgttatatagttctcccttggcgtgcgcatcctgaatagctccctgaatgtatgactcctctactttcttaccgttcacataaagattgtcgccttgatactgaattgtatctccagccactccaataacacgcttaataaagtctttttgttcctttctcacatggaatacaacaacctcactcggcttggggtcacgaaaatcgtaaatcaccttgttcacgaccactcgttcatctgtcttgaaattcggttccatggacgctccctcaacaataaatggcgcaaataatagccaacgtataatgaacacgagcacaatggctacaataatggccttgagccaatcgatcatctcatttttcactcgtggctgcttttcctgcaattgttcgacagttgaatccgtcaaatgatttccactctccatgcgctacacccaccctttcccacagttttcattcctattatatgtataatgtttaagtataatcaaattttcccagtgtggcaaaactacaactatagttgaaacaaaagtgtgaactttttttcacaatatcataaaaacagtaaaaaactgttgatgcaaacgttaacatatattacactgtgcatatacttcttagagcgttttggactaatggtagatcaatctgttcccccaggaggtgtcctgtttttagtggaaagacagcatgagtcacttttatagatgctatcttcttttaaaatatgagctcaaatagggaggaaattacatgtttaaacgaaatgatcgtccaaaaaccggctttaacgctctaagactcggtgtttcttttgtttttgcttcttcttgccttattggaaccgcttacgcagatacgttatccaacgacaccccttcttccgcacttacagaagaggcagttagtacaaccgactcaaccaccgtctccacaacattagcggcaggagatttgtatgtggcgccaaatggtaacgtgtccaatccgggtacaatatccagtcctaccacgctcgaagcagcacttacacaaattgctcctggtaaaaccatttacctgcgcggtggtaactacacctactcctcaacgattacaattcagcgtgaaaatagcggcaataacggctcactcaaagggttggtcgcttacggtagtgaaaagccagtacttgatttctctgctcaagcctttggttcagccaatcgtggacttcagcttaacggagacttttggctggtaaagggccttgaagtaaagggggccggagataatggtatctatatcggcggcagcaataaccgaatcgaaaacgtggaaacccaccacaaccgggatactggacttcagcttggacgttactcccctaacgcttccaatagtgagtggccatcgaacaatttgattttgaattcttactctcacgataacgctgatcccgataatggtgaggatgccgatggcttcgctgccaaattgactgtgggatcaggcaatgtgtttgataactgcttggctgcgtacaacgtagacgatggctgggatttgtatagcaaaaccgaaacgggtcctatcggcgaagtaaccattttgaacagtgtggcccaccacaacgggcagaccgcagatggaacgtctaccgcgaacagcgacggcaacggctttaagctgggtggagacaaaatcaaagtcaaccatattgtgaaaaacagtattgctttccagaacaaaaaacacggcttcacctacaatagcaaccccggcagcattacgttgaccaataatacttcgtgggacaatggacaaagtaattttgcttttgacaagggtgatcacgtgttcattaacaatctttcctttgagggaagcgccagtgacaaaacaagcggtacagatcaagacaactctagcgtttggtggaaaaacaaaaaatcgacaaatgccaaaggtctggtagtcagtgcagacgactttgttagtctcacgccttccatcactcgaagtgcagacggttccatccagctaggtgatttccttaagctggccaaaggaagcgatctgatcggctcgggtactccgagcggaaaaaatataggggcacgttaaaagccccgcctaatcaggacgccctggcccatctaccaactcagacaatcttgcataatatagcgaccggtgattgtcctcataaccagacaaaatatgaggtgaacagatcatggaacgaagaatcacactgaaacatacactcgcctatggaagcggtaacatgctaggaagtggcgcacttgctattagtggtgcatggttaatgtacttttatacaaccttttgcggactgtctcccgttcaggccgcggccattttctctgttgccagcatcatagatgcagtcagcaatccgatcatgggctttatcagcgataactttcaccggacccgcttgggccgtaaattcggcagacgacgctttttcatcatgatgggtatcccgctgatgctcgtgtatccgatgctttgggtagatgggttgggcttctggtattacctgagcacgtacgtgctgtttgaactagtgtatacctctgtcatggtgccgtatgaagcactagcgtcagagatgacccgagacttcggcgcacgctccagattgactggatggaaggccatgtttggcaaaattgccaatttcgctgccgcttttatccctggtcgctttattgccgagtatggcaaagactctccattgcctttcttttataccggtctcgtttttgcagctattctgctgattgcgatggcattcttgtacaaaaactcctgggaacgtccaagtgaggaactgcaaaaggaactggaaggtgaagctccgctatcctttatagattcgatgaaaaagttgtttgtcgacatttcctctaccttccgagtcaaaacgttccgtcatcatctcgggatgtacctgggcggcttttcagctgagtggctgtttacttctgcttttacgtactttattgtcttctccttgttccaaagctcggagatggtatccaatttgaacagctttaactctgtcattcaattgatttctacctatttcttcatccaattctgcgtgcgtaaagggttccgtatgcctttcatcgccgcactcgttgtcgtttgctttagcgtagcaggttatggcctgctctatataacgggagcctcgaatacgatggtatggctatatgtcatcaccctgttcatggggcttggtactgggggcgtctactacattccttggaatcaatacacgttccttgccgatgtggatgaagcgttgaccggccgtcgccgggaaggtatttatgcaggtatgatgacctttgccggaaaaatggtgcgggccgttgtcgtcttcattctcggctgggtgttacagcattttggttttgtatccggggctgatagtcagcccgtcgctgctcagcacgccatcttttatgtacttgtggttggtactatcgttctcgcgatcatcggtatgattgcttctgtcgtgatgaagctggatattgacagccacaagaagctaatcgccgaaattgaccgcctcaaaaacggtggctccatgaaatcagctaaaccggaagcccagaaggtattcgaggaactgacaggtttccattacgatcggtgctggggtaacaataatgtgggcttcaagaacaaacccgttgaccctaagacacacactccatctatgtaacaacaataacaattacagattaaacatttactaaagaggtgactgtatcatggcaaatccaacatcacaaccaaccaccagtcctacaaaaacagattcttgggctgtacgtatgagcgattccgttctacaacggagcccggaattttacgaaaaatgggaatatgaccatggcgtgatttacagaggtctggaatgggttggcgaactgacaggcgatcccaagtacatggaatttataaaaaaacatatggatcattttgttgacgaaaatggcgtaattcagcgctataaagtagatgagtacaatattgaccacgtgaataacggcaagctgctcttctctctgtatcgtgccacaggagatgaacgatacaaaaaggcagcctaccaattacgaagtcagttggaaaaacacccacgcacaagcgagggcgcattctggcataagcaaatttatccgtatcaaatttggctcgacggcttgtacatgggtgccccgttctacgctgaatttatccgcgaattcggagatccgtcagagtttgacgatgtgaccctacaattcaagctttgctacaagcatacgcgtgatcctgaaacgggtctgctctaccatgcttgggatgagaagggtgagcagcattggtgcaacccggaaacaggctgttccaaaaatttctggggacgctcgatgggttggttcgttatggcactcgttgacgtgctggactatattccagaggatcatgcagaccgtcctgtcctgatcgatatgctgacggaaacactggaagccctgctgaaagtgcgtgataaagaaagtggagtcttttatcaagtgctcaacctgggccatgtgaaaggcaactatctggaagcctctgcttcctgcatgattctttatgctattgccaagggcgttcgcaaaggctatctgccagagcaatatcgtcaagaggcagaaatcatccgtaagggaattatcgatgaatttatcacgattactgaagaaggactcgtaaatctgaacaaaacggtgcaagtaagcggtttgggtggtaaagatcgtcgggatggtaccttcgcttactatatcagcgagccgattataaccaacgatcccaaaggtatcggagctttcattcaggcgatgggtgaagcagaacgcatctaaaatacgcgaacgatataccttaatagcaaaaaggacggtggccatcagccccgtcctttcctcatttatgcctatcttacttacttcataactttaaattcatatccctgtttcttcagatattctatgatttgcggcaatgctttggctgtttcttctttaccataggtgtcatgcatgagtataattgctttttctcgacctttgactgaccttataaactggttgattagtgccggtgctttcttggatcttccctctgcatccttcgttaatacattccagtccacctgatggtaatccttttgacgcaaaaccttatccagagcagccattccctgttgatctcttctgttccatgtcatgtgccccccagggaagcggatcattctggtggagaattccggccccagaatactttttagaacctgattgttcttctcgatctcctgcataacatggtctgtgcttacccgcctgttaggatataaatacttataattatgagagtacgtgtggtttcctatcgcatgaccctctttaacaattcttttgataatgttcctggtatgttcattttcatcggcttcttttcctacgataaaaaaggttgccttgaccttctgctttttcagaatatccaatatctgaggtgtgaccgtcacggatggtccgtcatcaaaggataagtaggccacttttttaccatcagctccatcgggcatttgtcctaacatttgctgatttaaatatttttcaacaaaggcaccgtcttctacatcgggatcgttttttggagaggccgctttaccctttgcccctgcgctggatttaacgtttgatgatccggaatccgtttttttagcaagctcctgggtcggcgcgtgtggcttgctatccgaaacctttatcgcaatgaaagtaatgcagcctgccacaaataatataatagcaatcagtatcagccttcttctgttcctcttcaagcggtgctcactcgttctactatgtgaatagcccttttccattagcttatgtacctccatactaaaataagaaaaaccaccggatcagggttggtgtacacaccttagaatagacattggaaaaacccttaggtttagccgatgaaaatttagggatgcgcttcaaccagaggacaacctactcccggtggctttcttgtcttgcatttacataattatgagtatcattgcagtttattacgattgcttcgtgagggcctgagccaacaaggacgcataagctttagcacctttaggttttaaatgtactccgtcatgctcgaaataggagtttttaccagagctggctccataccagtcaatcattgtaattcgcgggtcctgggacgctgcttcggcaagatgcttgttcacaatactctcccacggccgaggcacacgggtattcacaagtataatacgcttcgcatccttcaggctagccaacagatcggataactggtccttggtgaaagcgccgttcgtgcctagctcaataataaccgtcttaccgagctgtccgttctgtcttagctgctccagtacggcaggcgcctccgccatctgacggccgatccgcccatctacaacagctcccgggaaggattcctgaatgtacgactgtacatccaacatgacagagtctccaatggcggtaacactcgagccatcacctgtcataggcgtagcttctttgggtttgtctgcaggttccgacggtttcgtaacatcgtccgtagtaccagcctggaccgccgtattcttaggcgtctgggtttgagacgggactggggtctgcgccttgctgccctcggacccttgcagcttgatggcttggggctccttggaagccacggataccgttccgtgaagcggcggcatcgcctttgcctttgcgactggattctcatcgcttgatgccgcctgaatcgttgcatcaggagaagccacgtacaggtggacggtacccacgagaatacctacaaacagcacagccgctgtagttgtaggcatccatctccaccgtgcctgtctacgaaccgcagaacggattcctgtgatccagtggcggaatcctccatggcggatcggctcctcgatatatttaaacgagagagacgccagcaatacggtagctagcaattgtaaaatgatgcgcagcacatgcacgccatcggtatctacctgaggcgtcgttagcgtgataaccggaacatgccacagatacagtccgtaggaacgggctccaatccaacgtagcggcttgattccaagcagacgaccaaggtggcttaccggatgtgccaacgctgcgaccacaatagcagtgactaaagctatgcccagtaggccgccccggtacagagaggggtcatattcattcgaggcccacgcccagtgacaaagcaacagcaagcttattgcaccgatgctgtccagaagcatacgcgccttagcagaagcttgctctttcagcttgccgcttggccacaccaaggccagcgctgcaccaattagtaaagcaaatccacgcgtatccgtgccgtaatacacccggctcgggtcgcttcccggtacgtaaatcacggccatcaggagcgcagatattaacgccagacaagtcacccagcctgcaagcacaatacgcttgggcatgaattttagcccgagcgccagcagtaaaggccacaggatataaaactgctcctccaccgccagcgaccacagatgcccaagcggagaaggggggccgaaactttcaaaatacgaaacctgatggaaaataaaccaccaattactcatatacaccaatgcggcaggaacatctccacgcaaggccgttagccgtgacggatcgaagagcaacgagcacaggacgatgacagccacaaccgtcaacatggcaggcagcaaccttctggcacgacgcagccagaaatctttcattttaaaactatgatatgtatcccactgactaaccaaaatatctgtaatcagataccccgacaacgtaaaaaacacgcctacacccaacaaaccacccggcaaccaatccggattcagatgatacacaatgactgcgatgaccgccagcgctcttaaaccatccaaacctggcatataacgacgttgtgacgacaaccgattagacttcatttcagccgccgtccttcttgcaaattcaagctccctgtctgtttcaatgctcttctgccctttccctctcctgcacatcgtctgcgatgccctgtagccttttcattcattatataaaacttcataatcgtaatgatttcaatgaagttaaaattaatgacaatgtttttattatatcattcctttccacagttaggtaaccactgatagatatacaaaaaaaggcatctcttcccttaggaagaaaatgcctttttattagtattctattctcttaaaatttgatgatacctgaggtatgaaggaagaccaacaacatcaggatcggtgcaacataccgaagaccgaataaccatacgttgaaccagaagggtttgatgttcgcatgctcagccgcagtcttccaataataacctgtgaatataacaatcaacaaaccgcctaacggtaagaagatgttggatgcggtaaagtctacgaaatcaaagaatgatttatcccctacttttagttcaggcaccagccccatggacaatgcagaagggacgcccagcatcaagcacaggaccgatacgacgataacggagcgaacccggctccaacgcatacgctccatgacataggctactggaacttccagcaaggataccatagaacctaatgcagcaaccgccagcagtacgaagaacaaaccgccgaagaatgcaccaaaaggcattgccgagaaagcagccggtaaagcaatgaaaaccagcgatggtccttgagccggattaattccgaaggagaaggttgtagggaaaataatcatacctgcgataaacgcatagattaaatctccgccaccaacggccagcatagctccacccagcgattgacggcgatctacgtacgcaccgtacgtgatcataattcccatccccagtgagagtgagaagaaggcatgtcccaaagcaaccaatgcagactctatacttagcttagagaagtcgggattcagaaagaaggatacgcccgcaccagagcctggcagcataagagcgttaatcatcaacacgagcaacaggatgaccttggcaggaatcaaaattttattgaacttttcaatcccgttcgataccccaagagttaccacgactgctgtaaatgcaaaaacaactaacagccaaaccaacggcgcatagccggaggaaaaagaagcgaactgtccagcaaaatcattattcgaaaacagatttccgctaaatgcctcaacggcataatgcagtgtccagccccctacaatggcatagaacgacaagataacaaacggcacgataacaaacatgatgctcatcttgccccaaatcggatgaccgcctacttttaccattgcagaagcagcacttcctcgacctgcacgaccaagtgcaagctccgctaaaagtacaggcaaaccaacaagcaacaggcagacaataaacaataagaaaaatgcagctccgccatattgtcctgtaatatacggaaatttccaaatgttacctagtcctgccgcactgccgatcgccgccaatataaatccagcagacgagaagcgttcatttttatcagacaggctattctgccccttgctcaaactcattatatccccctcattctctctacttacgcataaactgagcatgcgtacataaataatttttactcattatagcgtaagtaggatgtaaggtcatgcataatttttcactattaccggatttattttcataatgttcggtatctacaaaatacaacagaaaactacatattttcttcaacatccttctttattatggtctctcccatgcgattagatactttttgataaatatacgaaatcgccaacagtacaacaccaaaagagaagtaggctacaatcgtgcttccagtcgttaacagatgtagatcatacaacagcagcttacctgtcgacagcaaggtcaagcccaatccaaatctgcgaatgtagaccactcgcttgaggaagccgtatacaatatacaaaatggctagtagcaaatacaccagactgaacacaagaccagcatcccccagacggaactgaactccgagaaaggccgttatgatgcccagcaaatatacacccataatgaccggatacaactcgttacttctataatgtcgggtcatcagtgcgttcaggaaatccctgctgctgaagaataccagcacattaaaggctgcgagtaccaccaatgccacataatcagcagccgtattttgcgcataattttcatgcaaggtcggaaccgttacagtaaccaccagtgccagcgcgtagcctatgacgtacaacgccaagctgtagtatttaatcacccgatcatacagcaacctcaccttaggcaggaaataagccaacaccagcgatatgcaggcatacaacaatactttgtacaaggtgtaatgagcaaactcgtcggataagacgatgttataccaatgccctgcttcatacaaaaggtagaaatatacgttcaccaaagctacatatttaaatccttgcatgatatgcatttcgtacaactgattgtttttgaaagcattcggacggctaaattcaatcgcatagaagacggtaacgatcaacattcccagtgtaatgagcgtatatttgagtccaaaataatccgtctcaaatcctgacaacagatatatagggaaatcgacgaaaaagaatgcgcctagacacagtaataaaatgccccagcccgctcgttccaattccttcaaccggtaacggtgtccatataatgtaagaagaactgcttcgatcaaccaccccatagataaccatctaactccaaactggaacggaatcatgaggatggcaaaggtcaaagaagtcgcataaaataatattttggtttgtttctcctctggaatatatcgacggacccattgtcccagacctccgtacaccaagcaaaagaccagagccagcaagcctttataatcatccaggcctgcatcgccgaatagagaatacagaacggaacagctcacgactgtattcagagccaataaggagaaatccagccatgacagttttgtttttaaacggaaaggcacccacagtgtcatcccgaggtacatcgcaaatgtaatgactgcatacagcatgctcgctacggtgctttccgataaccacgccagcacaatcatcaagggcgtattaagcagaaagctgatatattgcacgacgccccaccgtttgcggaaggatacaagcagaatcagcaggtttaacaggaacaaatagcccatggcgatatacacggcgttcccttccagcccgttggctgccatataagaaaagagcggaagatacccccctactaaaccgaaagagcatatcgttcgggattcataccttaatgacagtagcacagcggtcaccgtaacgagtacggacaagcctatgcctgtatacattcctatgatttctaacaaaaagtaactgtaaaaaatcgatccgtacagtacagaaataccgccgcccaaaataccgagcgcaaaggtctgcttctgcttgcggtacagccattcgccgcctcctagcatcagcgctcctagcagaaagaaggccacgcccttcatatttcctgtgaaccagttcgaatatgagtatttaaaagcggctcccacacccaatataatgagcaaaatccccagcttgttgatccagttcaagcctagcttcatttcaaactgattttgcttcatgcgcttctgtatcgtttcctcgctgatctcttcttctccgagttgcttaaactcgcttgccgtctgatgaagcaattggcgctcggcctcctgaaaccgctcgcgttgttccatgatccggtcacgaatctcctctgagaacagtcgcagtctggcgacgatctcgtcctgatcttccttaagctcatgcgtagtttgctgaataagttggtccacccggtttttagccccatattcaaaggatgtcagccgatttctcccttctgcggttctggaagcaaaataggtctccagcttttcacgtgaaatgcgaatcatattcgccttttcactcagcatttgctccgtcagcgcagtgcgcagctttccattttcctgctcaatatgtcgtactcgctcttccaagtgaatgcagcgagcctgataatcctcgaacttttttcgcagaacctcattctccaaaatgatatctgaggcttcatagtccgcgattaatgtttgatactccttgagcagcttgttctgttcttggcggatcgtatgtaaacgatctttaaaatcctccatgttctcctccattgctgtccattttggtaatcattacattttacatgaaattaaaaagtcattatagagactatagcccattttggacggtaaattggggcttttacttatatattcttccagtttcatgatcgcagatgaagtagaatggatatacatatgaaaaaaagcctacctttccccttcgcaaacatgaaatccaaattgaaaggagatatacatgtattcagtaagcggtactatagctttgatctcaagcatgtctatgttttggcttttatactatttaagagtcacccattcctcagggtttaatgatgctttttacttatttccacttatcttaatctttctttgtatttatttttattggaaggatcatgatgaaaaaagtaagtcataaaaagaaataaagtagagtgtgtagttcagatttatctaagcgttctagatttccacaaaaaaagaaagaaccctgttaggattcttccttacacaaaattaatactttttcatgaaagtcgtcacaggctttagagctttctgcatgtcacttaaaattagctttcttattttttgtaatgagtgtaaattttaacgattgttattcttccttaacataagtacgtcatatgcaataattactttggttttatctgtagcctctggaacattgtaaaccacttcattctttgactgaagttttttcacaaataattcatccttcgttttgattctgtcaggatgactgagaggggaaaagaagtgatgaatattgataatctccaaaagttgatgtgcgcaaccttttggattataataatcatgtttatattttttggatatattacataaaattataaaggatgatgacaatgaatagggctgcgacaggaacaatattctgttttatatctgctatattgtattcttcttattatctttgtgcagcaattacaggagccgggcagttaaatcctttttatgctccgtttggttctttaaaagtttttgccgtaatggctttgattattggagtagcttacttaattataagtgaatatggatatttgaaaaaaaagaagaaggcctaggccttcttcttttacattataacttaataatttaagtactagagccttctttctactactgtgacaacaccttgtactttaccacccgcaagtttaacaggtgatttaatggtaacatttttgatacgctctaataccgtgcccacataattataaccaactagatcccctctaactactttataaataggggtgaattgtagtttcgcttgatatccaggctgaacagttagagaactattataaagatgggtttcagtagtcgaccagccacctcctagaacttgagttactgcgtcattccatttagcggaaatggtcatattcgcactccacgaaaaactttttgaccaacctaccatttgcgttaatgtggtagttttacttgaatttttaatatagtcagttatatcggttttctgatctacttgtaattgttgaggataatatgcggattgaattaatttacgcttaaaaacaaagtcaagaccagtatcagccattggactaatcctatttccgctatcataaacttgagctgtgactgtctgtggctgttcttgagaaaggagcctttgatactcatttaacgagatttcttccaaaccactctctgtagttatgtaggctttaactacttcaggctgtgaagtagctgactcactaacagcaacattagaattagttacctcagcatttgcaacagatacaaccggaacagaaaatagagctaatgatagagcaaacaatgcaatacttttctttttcaaagcaatccctccaataatattattttatagaacttttttgcatagaagcttacaaaaaaggtgactaacaacgctaataaatatatgagtatgtaatgttatgtaatcgagtaaaaagtagagtgaagaaatttgcatgagaaaccacatagccaaaaatatttaattattattataatttttaatcaaaggaaatatttacaataatgattgtatcacaaaacttctaattacctaccataaaattcaataatcccctataaatgaatcccctctcctagatagctaaccttccaaagcttttaacaagatggaattgccatttcctttaggtcaaaggatagattttagattcgttaggacgaatcgttattcctaaagaaatgcggatgtctatggggatagatgttggcgatcctatagaattttatatggatatcgaaacggtttttttgagtatgcgaaagtatatcggggtcgcttgtaacctatgtaatgctgatgaagatctgacctattttagggattcacttttatgtaagacctgtatacaagagttaaaagaaaatatagccgtaagccgcactcctgctccaatggctaagaaacctgtgcacaaaggaaagagagtaaaccaatcatcacaaaaattaatccaacacctaagggaacttctgcatgagcatccccatgccaagcagggcgaatatgcacaatggcttggcgtgtcacaagtccgtatatcgcagcttaaaaagttgttgtagcttgattaacctgccgaaaatccgtatactaacaaaaaagcaaacgatattatgcctgtgaagagcatccaactcggaggcgtttacgccaaggaccatacgttagcgtaggatatggcgatatgtacctaagtaaaccggacccgcccgttacagcggagcaaagtggattggagagtcatgacatctgtcatgctgtccggtcaatttgggtggcaccgcgagatcaaagcgctcctcgtcccatgtggatgagggcgctttttgtatttttatccgaaaaggagtgcggtgtcatgttggatatcaaatggatcagagagcatcaagagcaagttcagacagcagcagacggcaaaggaatacaggtatcggtcgtggagctgttgaccctggatgatcagagaaaacagctacttcaggaagtcgaacagcttcgacagaagcgtaatcagtgtagtcaggatattggcgcgctaatccatgccggcaagagtgaacaggcagaaggggcaaagcggcaggtcaaagaaattaacgaacggctagatcttctggaagccccgcaacaggaagtagaggaacagtttcaacagcttttgcttctgatgcctaatatcgtatcgccagatacgccacggggaagatcggatgacgataatgtagaactggagcgggtcgggccagttccaaacttcggatttgaaccaaaggatcatatggcgctcggtgagcttcataagctaatcgacgtccctcggggtgtcaaaacagccggtacccgtaactactatctgacgggagcaggggttgcagtgcatcgggctgtgcagcagcttgcggtggatctgctgactgcacgtggtttccagttactggacgttccactgatggtacgtgcagaggcgatgcgcagcactggtttcttcccgctcggactggatcagacgtaccgcatcacaggagaggatcagtggcttgtaggcacttcggaagtgccgctagtctcgtattacagcggtgagatcgtggatgttaccgacccgattcggctggctgccgtgtccgtatgcttccgcaatgaagtcggctcagccggaagagatgtgcacggactgtatcgtgtgcaccagtttgccaaggttgagcaggtcgtcatctgcgaagccagcctggacgcttcggagcagatgtttcaagaaattacgcgcaatgcggaagatttgcttcaacagctggagctgccttatcgcaagatggctgtctgtacaggcgacatggcgcaaaaaacctacaagcaggtggacatcgagacatggatgcccagccgccaagcttacggcgagacacattcgtcgtcccagctgcttgatttccaggcacgccgttccaacatccggtaccgcaatgcggacggcaagctgaaatattgttacacgctcaacaacacagcggtcgcttcaccccggattctgattccgttgctggagcatcaccagcaagaggacggttcgatccgtattccggaggccttacgcccatatatgccgcgaggtatggaatttttgcgtactcccttgttatgaaaacaggagcgcactttgaaaagtagtacccaatgagcaggattttcgattataatcatcgcaaaaaagacgaaggataaatatccttcgtcttttttgatgtttcattgtgtcattgtgcttctgcttcccatgcgctggcaggaccaaagaattcatagtggatatccgaagtagggatattccactccttcaacaggccgtataccgattgcatgaatccctcagggccgcaaaaataatattgggcgttccgatccggtatcacggattgtaaccaggccagatccaaacggccttccttgtgaaaagcctgtgccagccgatcctgctccgttggtctgctgtaacaccagcgaactgcagcctgtgcatgtgtggcgaccagcttttctacctcattacgcaaagcatggttatccccattgactgctgcgtggacaaaagtgataggccgatgcggagcagatttcaccaaagaagccagcatactaaccatcggggttagcccgaccccaccgctgatcagcacgacaggtctgcgatctgtccgatccagcgtaaaatcacccgccggtgcagatacttgaagcacatcgccctcttgcacctgctcatgcagatacacggatactttacctgccgggcgggactctacagcatcctcacgctttacagatatccggtagtgagattggcctggcgcatctgaaagactgtattgacggatgtgggtattgtgttcgcccggaatttccatctttaagctgatatattgtccaggctcgaattcaggcaacacctgcccatcctgcggcaccaaataaaaggacgtaatttggtcgctttccttaacctttttctgcacaacaaagctcttaaagtctgaccagcctccctgctgctgtccagcctccttgtacatttcagcttccatgtctataaatacgttagcgatcacaccgtaggcttcggcccatgcggcaatgatctcgtctgtagcagcatctcccagtacgtccttgatcgcagcgagcagatattttccgacgataggataatgctcgggcttaattcccaaactgcgatgcttatgtgcaatctggcgtaccaccggaataatttcctccaggcggtcaatgtgctgtgcagccgcatatacagcattggccagcgctccctgttgacgtccttgcttctgattcgcgtgattgaatatattgagaagctcgggatgggcctcaaacatcatctggtaaaaacgcttggtgattgtagttccgtgtacctccaaaacaggtacagtcgatttgatcgttgcaatggtttgctcacttagcatctttgtatccctcttctctccaaaataagataacaaagggtatttcaacatatgtcccatttgttaatcctcaatttaaaacccagtatacccacataaagtaaccgtttatgtgattccagtcactttaaatttgaaataatgtgaacgtgtcaatgacaaaacgcacaattacaaacacttcccacataactgacgagctttcaccatgctaaagacctcaatttattccacttgtaaacgcttccaattaagataaaatcgaagatgaagtgccggacaagccgtttcggcctatcctatccgtgttaaaggaggcagatgatatcgtgaagtggatcaacagcagcaaatggttagccgcatggatttgtatcctattcgcagtggccagtgcgggtctttaacccgatacagcacatgcccatacaacaggcgttacgcaagcaacctacgggaccgaggtgaaccaagcgctgaatggtttggacgtcgccaatgctgaactatccctgagcgcaacagcaagcacagccattacgaacggaacggattggaaagacaccgcaggtaacccgattcaggcgaacagcggtaatattctaaaagtaggttctacttattattggtacggcgagcacgccgaaaactggaaatttgaaaaagtgaacgtatatacctcaaccgatttgaaaaattggtccttccgcagcagtattctcaccaaagattccgcccctgagctgaattcgagcaaaattgagcgtcccaaagtcatctacaacaaaaccaccggaaaatatgtactatgggcgcactatgaaaatggcacggactactcactcggtcgtgtagccgtcgctaccagcgatacacccgacggaaattttgcctaccaaggcagcttccgcccgctgaattacgagtctcgggatatgacggtgttcacggatactgacggtagcggctaccttattacagcttcccgtaaaaatggcggcgccaacgatacgatggcgatcttcaagctgacagccgattatacaggcgtacagtcgttcgttggctggatttttgaaaatggctatcgcgaagctcctgctgttgtgaaaaagaacaatacctactacctgttcacctcgcaggcatccggctggtatccgaatcagggcgcttacgcaaccgccagttccataactggaagctggtctgctctgtcgcccttcggtgatccggcagcttacggctcgcaaatccattccatcgccacgattacgggtagcgcaggaaccagctacatctatatgggcgaccgctggaatccgctcaatctgagcgatcacaaattcatctggttgccactaactctgaatgactccaataaaacagcaaccctgaactggtacagtagctgggatctggatgctgcgacaggcacagtaatcctaccgtcccttgtgaatcacgcacagggcaaaacggcgactgcgagctcagccgcatccagttctccaacttcactggcgaacgatggcaacgcccaaacctcgtggaaagctacttccgcatcctggcccgcttggtggcaggtcgatttgggtagtaccaagaccatcagcgaagtggatatttcatggtttatgtacaaaggatctgaagcgtattacaaatataaaattgaatacagcacggatggagttaactactccacgattgaccgcacaggtaataccacgtatggttttaccagtgacaaagttagttttcaggcccgttacgtacgaatcaatcttgtaaatgcggtgttatttaataatccaaacaactggtatacccctacggtgcatgaagtaagattgcttggcaattaacttgcttcattaaaaaagaacatggcaggagaatcccatattagataggcttcttctgccatgtttgctttaccacctatttcgtactcattcgctcaacgtacccgatttactgtggtaaacacaaatttatcataccgatgccgtgagaatgagtattcaaacggtatacccgtatccagataacctacctgctcaatttctaaaaccggatcatccgcaccacaatccaaatactcccaatctagctcggtcgacttggacgcgcggatggtacgatgtgaactgacaatattaaggcccagctcctccttaatatgtttgtacactgagccgtgcaacacctgctcggtaataccgctgatcagcttcgtaggcatgtatgtgcgctctatcacatacggttcgccctctacaatacgcagacggactacacgatacacaggagaattggcatcaataaatagatgcgccgctacctcttcagatggaaattgaacgtcaaaggctatgattttacttttgatttctttcccgcgcagtacgtttgtcagccccagcatttcattcacaacgacattaaccgggccattgtagatcgatttgacgataaaggttccgtgtcctcttttacgattcaacagcccttccgacaccaacgtatccaatgccctcttaatcgtcatccgacttacccggaactcactggccagtgaaatttcatcgggaatcggatcatcactgctataggtcttgtctataatacgcttcttgacctcttgtgcaatccgttcgtatttgttcattggtctaccacctgtactaaaatttgttttatgtcagcattttaccaaaaacatcggtagcgctggttcttttggctctgcaggcggggacattgaggtattacggtataagtaagtataccgaacattatactttctcaccagcggcgtacagcacagttctatgacgatgatgaagaaaaaaaggcggtccagaggaccaccttagaatccgttattctcgatcacctgtttgaaccagtgcccactctgtttaacggatctcttgccaccgttctgaagatcgacagacacaaaaccatagcgatttttataagcattcgtccaggaccaattgtccataaaggtccataagtgatagcccttcacattggagccctctgagatggcccgttgaacccacttgagatgctcacggataaaatcaatgcgatagtcatcgcggatcataccctgttcatctctgaacttttcttcaccttgaacgcccattccgttttctgaaatgaagcattcaatgttgccataattttctctgacattggtcaggatgtcgtaaacgcctttctcataaatctcccagccccgcatctcattcatcttgcgaccaggcatgatgtaataatcgaagaaacgttccggcacaaaaggtgcatctgggttcggcagactttcacgagccttgactctgcgcggctgataatagttaatacccagcaagtctacagtgccctggcgtataatctcccgatctccgtcttccatgcttggtacatatccctcttggcgtaacagctccacgagcaaaggattgaattctcccgtcacagatgggtctaagaaggaacggttaaagaacgcatcgcatatttcagcagcctgcacgtctgccggatgctgactacgcggataagtcggcgtcaggttcaaaataattccgattttgcccttataaccgccttctctgtaagccttaatgacactcgcgctcgataacaaggtatgatatcccacctgtacggctttaccgaaatccacttcattcggatagtggaaatcgtacagatagccgccttccaccgggacaatcggctcgttatgcgtaaaccatttggctacacgatccccgaatagctcaaagcaagtgttagcgtaatccacgtaagcttcgaccgtctcccggttcacccagcctcctttttcctgtaaagccatcggcaaatcaaaatggtacaagttcacaaacggctcaatacccgcctgatgcaactcttcaattacggcattatagaattgaactgcctgctggttcaatttacctctccctgccggaaacagacgcgaccaggaaatagagaaccggaaggagttgtgaccaagctctttcatgagtgcaatatcttctttataacgggtatagaaacgggacgtttcgccaggtccaacgccgtcataaaaacggttcggctcctgctcaaaccaataatcccaaatgttcggtcctttgccgtctccctccacggttccttctgtctgggtagccgaggccgatgagccccaccagaagtcggatggaaaacggtattgaatggtttgctgctctatatctttcatttcggtatgattcacagctctactcctctctcttttgcatgaataagttgctaatctagcagcttattcacattacattccaacagtttgatccttacctgcaatggctgtttggttaagctcctcttcctgctctttacgaacgttcatccgatcaataatttttaggaacgggaaccagatgacaaagacgacagccatattaaacaactgcagtacgcctcccatcagagatcccgtagccatcattccactaaagaacaacggcatcgtccaaggaacctgtattccgtttggcggcggtacaatcccagtagacatggcgaagtaagtaatcagcgtaacgatcattggagcaatgacccatgggacaaaaataagcggattcatcacaaccggcaaaccgaatatgacgggctcgttgacattaaacagacccggtccaagggccagcttactgacctgcttcaattgcttactcttcaggaagatcagaatcgtgagtactacggccagtgtcatacctgtaccaccgatacctacggtataaatatccacaaactgcttggtgataatatgcggcagttccgctcctttggagtacgcttcgtagttttcaagtgccagcgtattccagatcggttccatgactgagttgataataatctgaccatgaagcccaaagaaccataaaagctgaacaaagaaaatagcaattaatgtaggtataataccactgcccaagtgcaccagaggtgcctgtacagcatgataaatcagatcatgcaggttattatgaagagtcagtgtaactacaacattaatgatcaaaaatatgcccaatgtgatacacgccggaagcaaagcggcaaacgatttggcaacggctggcggaacgcctggaggcattttgataacaatgttccgctgtgtcactcttcggtaaatttcagcagctataaaagcaacgatcatgccaaggaacatgcctttggccccaatccgatccaacggaatgacaccagcaatcgtggcaccgctttcttgtgtcagcacaaacggggtgagcatcaagaagctgaccaacgcgatcatgccaccgaatatgggctcgaccttataacttcgggataaataatagccgatcccgacaaccacgaataaggtcatgatgttcagggtggcactcggcgcaatgttcagcagactgttaaaagtcgcataattaccgtcgcccatccaatcttttagaaacggcagattgataataacgacaatgatagagccaaaaactgttaatggaaatgacaacataaatgcatcacgcagtacagtaagatagcggttgttgttcagtttaccggcaataggtatcagtatccggcttaatttctcaaacaaagcctattcctccccgcgaagtgacttgcatcaatagggttgcaagcttttcatgtcccaaatttcacaaacttacatgttccgttataaatttctggatttgaacagctccagcaattctagaaccagatccttcatggtaaccgtggacatcagatgatcctcggcatgcattagaaggagcgagaaaggagtttgggtacctcccgcttccttcttaaccatttgaaaatggatatcatgcgcagcacgtaaatcctgcttggcttgtttgagcagttcgtccgcaccctctacattctcatttcggtattcggtcagcgcctgaatcactttactgcgagcgtttccactatgaagaataagttggaaactaatttgctcttccgtcagttcggctatattgactttatccatttttgcgttccaccagcttcactgcttgctcataggctttcttaccgtcaaccatcccgtaggccatcatgtcaatcacttctacatgaataccatattgggctgcttccttttccagctgtcctttaagaaaactcatttgcgggccaatcaatactgcgtcagccttagccatgtcttctgccgcctgatcttgacctactgcccaaatttcagcctcgtctccgatggacttagcataatcctgcatcttagtaaccagcaaacttgtagacatacctgagctgcacgccagcaaaattttcttcatgattgttccttcccttcaaggtctgattggatgttaactactagaaaacgtttacagcgtaattataaatccagttttttgatttgtctatacatttaatatatatgtatagactttttttaaaatgacactgtttcttcactttttttcttgaaaatgaacgtgatctcttatctttaatctctcaatagaatcgattttcacaataagaggttctgccaaatgatatgttattcgattctgtaaactgttaacatgagcttacggagtaaacttgattgctcctccgtagccaaagaatagctgaggtgagaagagatgagtagagatgagaagagtcaaagtaaaaccaagcaagagttagaccgggtcgtgttcatcggccgcacgtttgaggagtacgtccaaatgttcaatttgcaaatttctgaacttgtaggcaaaaagattttggactgtcctgcgggagcatgttccttcaccgctctgggcaccaaagcctcgctggacatcaccgcaagtgatatcgcctacgatcacaagattgatgatctgaaacgcaaaggcctattggatattgagcatgcaatggaaacgctagaacgtgcaaaagataattatgtttggagctgttatggagatctgctagatcgtttgattcttgagctggaggcagaaggcttacgggtgacagaggccaaggttccgtatgagtttatgcgtaacggcaactctctgttaagcatacgaaagatatagggcaggtttaggtgtagagggagcaagctaatcgcttgctccctttctggttatcgagatgaaaattagaaaaatttagaatattaagaaacattcctacatttttatcgtctatattatggaataccttacgtatgaaggtaagatttttcgaagcccaaagttaaaaaatcaactcacaaaggagcttatgcatgttaaaaaagttaggattagctgcattaattctggttactagcctctccgttactggaacaggctgggccgcatcccgcacaacaaccattgaagtttctaaaactgctctggattacaacgttgcccgcccgctgagcgatggtgcttttcatgatggcttattggctgctgaaacatctgctggaaacctcgtgtattacaataccaaaggagagaaagctttctcacttcccgccgagcttaaacccattggtgatttccatgagcaacgagccgtagtcaaaaatacaaaaaccaatctctatggatacattaacaccaaagggacactggtcatcccttgccaatataccgaagccaatttcttttccgaaggaaaagccaaggttaccatagcagacaccaaagaaaatgcaattatagatcgaacgggaacaattctttctcattttaaagaaaatggggattcagaatatatatttatggacggtctggctcttgcctacgctcccaacactggcaagatcggttttgtgaatacctctggtcaactagcgattccctataaatataaatacagtcgtggtttctcggatggcttggctattgttcagaatagcaaagggctatacggatatatcaatacagcagggaaagaagttattcctcctcaatatcaatccggtggagacttctcggaaggattggcccctgtgcaaaatactaagggaaaatggggattcatcaacaaacagggaaaaatcgcgattccctttaaatttacagatgcccaggattttagtgaaggcctggcgagtgtgaaaaatgcaaaaaacgaagtcggatttattgataaaaacggagcattgttcattaaatatcaacaaaaatttgacgttacctctccattcaaggaaggcattgctttagtcggtaaacaagcaaactcatctgtctcggacggaaaattcggttacatcaatcgccaaggccatttgctcactaaacttgagtacagagtggaatcctcctccttctccaatggctatgctgttgcttttatcaagccaggcaaagcgtttattgtatctaaacattccgtttcaaaataaacaagacgaccccggaggcagattgagtagatctgcttccggggtcattagatttccaatatcttgtatacaattagtcgtgtgtgtagaattttaccccaggcagatctgctgccacccacgaataattaatggtattactgttgtaatttttggtccccgcctgtgcaacctgtacctccttcaaaatcgtgatcgatgaacccttcggtctgacaacgaccacatgaccatgcccatctgcttttttgattccgatggtaggatacccgagatttgctcttttttgagcatcctgaaaggttacagtgtaccatcccggcgcattgttgcccagtaaagcatcagccatttgattggctaagccacttggcagggaagccgacatcgcagacatcacatcttgtgcaaaaatattacacttcgttccacctactggcgaatactttttgttcgtttctaccttaaaaccgtcaattacagatgcgtaagtacttgcacttctagccattgaaattccccctgaatataagttgtagaggaaacgacggagtcgcttgaacatctgaatggctccacattcattgatgttggcctcaattccctctcaactattagggtgatttccggcttactttaacaacgtaatactacaaaaaattaacttcattctcataactgaaggctttcttcactgattacggttggaacgataagctcaggagtagtcgtaggcttagcttgtgttaaatagtctgctgcccccatcatcagagcgatgccgataaataacacgatccaattacgattctttttcatcatctgtacctctcattcttcactccgcccgttcagccacttgaaccaatggagcagatgactgaatcggtattcatgctgcgaagcgtacgtccatacttctggctcttcaccgggctccttccagacgagcatggaaaagtgaccctcttcctcgctcgcaaccgacagcagcgaaagacgatcatccccgaatcggtatggagccgattccacccagtaattccgcatatcgctgatccagctgcggaactgctctgtacctgcgatccgcaggacttcatcaggtaggagcagatgctcgtcgatatccttccaatctcccgcatatcggtaccgcgctgccagcattggactgagtggtcggattttaccgggagccaacgtaggcatataggcgacgggaacgaccggaccgatactctggatagcataagaccgagcttcctcctcactcattccgtaagacatagcctccacgagaaaatcgttccgtcttacaccaaactgatgctgatactgtgacatttcatcctgtagctccagtaccataccctgtgccgtttctgttccgatcattcccaaacacctctcattccaaaatatagtcgtgcaattcccgttgcgctcgatactttgcccaattgaattcaggccaagccgattcttctctcgtcatgctcgtcaaacgggcttgtaaaaactcatctagtgatccatgttccttacgactaaagtcaatcagtagcggaatcgcgtctgccgatagctcactcaaatattccttatctatcaccgatgtcgtgcgataccgttcgagattattttcagcaatccgtatatcaatgcccacatagttcacgacgacataggcgaccagagcgagtacaatataatatttcgccaacggcagttgacgaaaatgaatgcgcattgctgcaataagcagtagcaagcccagaaaaatcataaacgcgtgtaccaaatagcgggtgtacgtatagccgtatgcttcttcgtacataaccagccgggtatatcccgaatacagcatcacacccgaacaacccacgagtatgtacagcaggccactgttcattttttgcactatacctgagccaaattcagtccacttcaatacactgatcatcagcacaaagttgatacctgttaccataaccagctccccgaatcctcttctcgcatattcggcatacgaggttccttcgggcagagcaccttcccatgcaccaaacaaatatccgaactgcaacacgacgaatacaacatacaccagattcatgacaatcagcaccgtagcggtaatgacagggtcaaatttaatcgcgaccggctcgtggtaaggcaccgttggtcggtcaatcatcactgaagagtgaccatcatactcggtggtttggccattcgtgcgctcatctaacccgtgccatgattgggtctctctcagcgtattacgcggagcaggctgtacaaatccccacaaataacagaagaaacagaaggtgaaaaagcaggtccagatcagccgcaacatgccattcccaaaggacagcgttccgatccattcgggtactccagctaacaacttttcgaacatcccatccgccgaagccagcagagatatgataatgaacagtagcggcaaggcaataagtaaaccaatcatcactttgcccaatacacgcttacgctcatcctttacattccgaagggctactgtcttgaccatccgaaagggggtcacgatatgacgaaagttttgataaaaccaatggcttaacgcctgaccaataataccgggttctgaccagccatgccttttctccccaaacagcagcaccatatgtacgctaatcagagcaggtatcgccagcgcatttaacacatacaggaccggattattgaacagcgcgtatgtcaatgccagcatgaaaatgatcacaaacagcaaacgccctatccatgatctggactggaaacgatctcgattaaaggcatacatataggcgtaaaacccaataacaaaaattggcatagacacgcccagcccatgtccgtaaaacagatattgatgaaccagcgccaacacaattgcgccagcaaaggcggacagaaacgacgttttcggcaaagacgttccattcatcttgtcatgcatggtaaatacctccacaaatatgctttataacccttattgtagatgataaaataagaagataaagagaaattaattcaaacaaaatttcctattttataaaagtgacgacgcttttaatcaaatatggaggaaacggagcaaccttgaatgaaactccatgcccaatttttacggcttcactcccacgcagctgacgacaaggacgataaccataccatagagacgacgctggatgagcttgcggctatttttgactgtactcaccgcaacgccctgatgatcattcagaaaatggagcagcatgactggatacaatggactccccggcgaggcagaggtcgccgctccagtctgcgcttcctcattcagccggaagacattgccgtgcaatccatgatgcaagccatagaccgccatgatatcaaacgcgctctggatgaaattcgagttcattcacgctcctccaccatgcaggagcatttgcaaggctggttgctgaattattttgggcatcacgcagaggtgcgcagtgatcagcagcagatcgacacgctgcgtctgcctattcgccagcagctctatacgctggacccgttgtacttgaactggctcgccgagtccttcgtatccagccacgtctttgatggtctggcccgccgggcgaacgaaagcggcgagattttgccgggattggcgcacgcttgggaggtggataccactcgtacacagtggacctttttcctgcgtaaagaagtgttgtttcataacggaaaaatactgaccgctgaagacgtcgtctatacctttgagcgactgagtcgggcgccgggaaggagactttaccattttatcgtccggcaaattcagcacgtccaggcgctaagtccaacgatagtacgcttcgtactaaaggagccgaacgagctgtttctatccttcctgtgtaccagccgggctgcgattgtgccacgtgagcttaatcaggtgggtgaagccgcctttggcatccgccctgtcggtacaggggcattcaaagtcacggaaatgaacgaaagcctgtgtacactggaggctttcgcaccttattttcaaggccgggctcatctggaccgagtggaaattgtccaactcccatgggcgactaagctggaatcgtcggatacggaagacaccgcttcttcttttcacattatccataatcccgtatcggcgggagatacggataccgcatggagccagattcactcggcggcttcggtacgcaaatttatcacatgtaatacacacaaggatggaccactacgcaatccagaaatacgtgcccgcattgtagcatgtctggatcatcgctcccttcctccagcagtggattcatctaacgattcttatgaaccactggcggcgctgcaaattgctaccattcccgagtataaagcagacgcagaccgggttgcggctcagctcgaatcctgtgggtatacctgtaacatcgtggccgcatctatgaacgaattcaaaagctcatctatccgtatggagtcagacttaatcatcttttctctctttcgtgaccgtgatgagcaattacgcctgtttgacttgtatctcaatgtatctgggcatgtggagcctcatagccgtgtggatatcgaaagactgctgcgtgaaattgcacgggaggccgatcatactgttagggcgcagcaatttgaacatatcgaaactcggctcatggatgagcaccagctgcatattttatatgaaaagcccgttcagacggcctatctcccttctgtgcgtggcgtatcttttaacagtcagggctgggtggatctgcgtcatgtctggtttccgcctgctcaacttccagctccccactcttgacggcaaaagtgctccttcaaatgcacttccacatcaaaaaaaggtatcctcttcttcataagagaatacctttttgaatgccgctttctagatcctctaagcggatggttcaagggatgaaaaagcccatccccccaacccatgactgtggacgtcgctaggatcttccataggggggggaacgggtgaaaaattcaataggacaaaaacattaaatgcgagcagagaaaaaacgatcttttttatcatggatgtactctacctctccaagtaagtttttatattcctctttgtcctcagaagtggcagtatgccgatacttttcaaatagtcctacacatttgattgtgacaggattaccattcagcatgacggaataagaaagactctcaagcaagaatttcatgcctttggtataacggtgtttgttgagatcataacaagccatctctgccaaaaatcgtgcataaagatctgctgacatttgctccgtataggtgcctaccttgacatgttgatctgcaaatgcctcaatttgtttttcaaagtgcaacagtacatgatctacattaaaatcataacggttggccgctaccataattttatgcaaccccaccagaatttcgccttcgttttttttcaaataatccacatattgtggaatcacatccaggctgcctgacatcaactgatacaaatacccgttggcctcagcccagttgctacaaagggccttcaaacgccgagcttcttccgtatcctcttgcacccagctcaaatcagagtatagcgatacatactccagcgccttctgataatccccgcgctcatcccacaccccggcacgcaacacgtaagagtatacaatatacataaacaaaggacccttaggttccttgccacgctctgatcttctggtattcccgtatttttgttcgtattgtaccttggctttttgagccattttttcagcaaaccattctactttatcccaacgccgcaaggaagcataggcattagccaggtctcttaaggcatccagttggtctgcttcacccaatcgctccacaaagctttcaaagtgtgtggctgcccataaattttcgtcttggtcatcgccaacggcaatcgtaaataaacggtattggcagagcgccagacgctctgaatgttggtacttctcactttccgaaacatttttataaataattgccgcagcctcgaacttaccttcactgaataattcttctgctgtctcaaacaaagctggggcgtatatgagatagtccatcataaactccacgacttgcttaatacaatccagtttgttcagctctgcacagcgatgcaaaaagggacgaacccgtcgccaattcggtgccgtattccgtataaattcatcaatgtataactcatagaggctcccttcttcaagccccatgcctgcaccaatccgatccaacagcagcatcgcaatcggacgattaccgttaataatggcactgatcgttcctgcattaatacctgtgttctccccaaacttactaatcgtaattccttctcgtctgatgtactgctccagctctgcgcgaattgtggttgtttccttcaaatcaggcacccccagggattacttgcatgattacaatacaaaaaaagaaaattcccgtgaatattcccttaattatacaaaagaaagcccacttagccaaccgctcaagtaaatttatatcaaaaaattcaataattctccgaattgccgtatactacggggaggtgagccgaacagctacacccaatcggtacgcaggaaaggatacgacaaatggacaacacccctacaacagaacaagagattgcacaatggatggtcgcgcagatccgtgaagtgggcaccctgaaacaagaagatgcaattgcatatgtacgctctgagtatggagagcagtatgtgtttataagcgagcatggtcatgtatctctggaaaaagaaatcaaaaaagcattccgcaagcttcatggtggcagaattgcctgggatcgtgacggatttctctgggcctggacttaacaagcaaagcatctgccctaggcaggtgtttttttaatcatttatccatatattctctggagtcggttaatttcttccttcacaaactgtcggagtgttacaggctccacaacttcaaccctaccgatccaatccatagcatcgcgacaagccgcttcataactatacatgttgacccttagaatgaaatgactgccttcctgtacagactggatgatttccattcttttcgctataattcccgcttgcttcttattcgttcggatcaaaacgggatagtattctttctctgtacaaagctgcttaaacgcggtttcttgcctcatccaatgatgttccagcgaaaaataatggatgatgaatattggaatattggggacgggattcggcgcgtatcatgcctcactgttaaacaaccatcccaaagtaaacagaatcatggtatttggaaggaacgaaagcaagctgcaaaagctgaaagaggagctaaacgtagaagtcacacaaaatatagaggatattctgctggacccagacgtggatatcgtcgatctatgcctgccctcccagctgcataggtcctatgccgtggatgcgctgaagcacggtaagcatgtattttgtgaaacaccggtttgctttgatctcgaagacgctcttcttatgcaacaagctgagaagcaatatggcaaaaagattctggtcaaccagttcattaagtttgatcccgcctgggatcatgcacttgaatgctttggcggatattcggaaagcctgatttcactggaatcggctgtacaagcgctgaaagtggctgttgagattaaaggcagactggggcaaacccagcgttaaccccgtattttttcttatgcctgttcttatctaccaggatacagcttcctataaggaagctgtatccgcaggcaaggaaacttcgtccgcatagttcgttgccataatcttggctacccctgccgggtcggtcgtctgccccaacgcccacatcattttcgtcaccagcgcttccgttgtcatgtcataccccggaataacgcccttctccagtaccttttgccccacttcgtaaatcgtcaaatccccgccctcataaggacattgagtagtcacgacaatactcataccgtccttcatcagctcctcgattttgctgatcaggcttctttctttaaaaggaacgccacccataccaaagccctcaatgacgatacctttatagcccaagccctgaatggcatcgaaaatcgccggattcgtacccggaatcagcctgagcaggaatacctccgaagcatacccgtcgttgtatgggtgacgagcggtaccgcgatttgcaaatacgccctccgtatagaccaccttaccgttctccacgagtccgatatacggatagttaatactctcaaaagcattatagctgcgtgttctgatcttcgagctgcggttgccgttaataattttgccgttaaacacgacaaaaaccccggccacctcgccacatgcggtcaggaatgagtcgattacattttttttggaatcgctgtgctccgccaaaatggaaacctgcgaacctgtcacgacgacgggtttgtctacggttcccagcatgaagctcaaggctgaagccgtataagccatcgtatccgtgccgtgtgcaatgacaataccgtcgtattgatcgagcgaacgatgtaccatccgggcgatagaagcccaatcctcaggttgtgtatttgtgctatcaatgctcatcagattatgggcatcaatctcgcaaatttccttcagctccggaatttccgccaaaatattttcagccgattgggtcggtgtcaggccgttttcctgataggaggaagaaatggtccctccggtattaatgaacaaaacctttttcatatgccaatgttccttcccgattacatcttcactgtattgttcttagaatttatcatgaataagtgtgataagctactttgtaatggaaaagaattggtgatatgaggggccaaaaaaagcacgacaaacaagcgcgggctttccttcctcctgcgacttgtctaacgtgctttttactataggtgcaatactctacagcgctgcacatacctataacccatccacgtacttcttatggggatacaggctgctcctgtggcgctctctgtaccaacgctttgcccagaaactgccgtgtccgttcttccttcggattggtgaaaaactgctccacgggcccctgctccacgatcacgccatgctccattagtacaacccgatccgctacatctctcgcaaaaccaagctcatgtgtgacaataatcatcgtattgccttcactcgccaccttttgaatcacggacagcacttcatccaccaattcaggatcaagtgaggatgtcggttcatcgaacaacaacacctgtggatttagtgctaaagcacgggcaatcgcaactcgctgctgctgtccacccgaaagctgggcaggataataggtcatacgatcctttaacccgaccttttccagaatgccttcactgatctctctcgcctgcttacgatccagctttttcacactggtcagaccaatcatcacattgtggagtgcattcaaatttttaaacaactgatattgctgaaataccattgccgttgccatccgtagtccgagaatgtccttttttcccgccttggcggcatcgacctttacaccgtcaatttctataacaccactggtcggctgttccaaaaaattaatgctgcgcagcagcgtggacttccccgatccgcttggacccaggatcactacgacttctcccttgcctaccgtcaggtctatgcccttcaacacgtgatgctgtccaaaatgcttatgaatttgatgaagttgaatcatacccttactcacttctttcgtaaattcgaatatgcttctccagcacgacaagcccgcgctcaataataatgcacaccaaccagtaaatcagagacaccgcaacatatacctcaaaaaaagccaacgctcgcgcgcccataattttagcctgtcccatcatatcgacgacaccgatcataaaaataaaagacgtatccttcaccgtactgatcagcgtgtttcccaaattgggcaaagcgaccgtcaacgcctgcggcaatacaattttgagcataatttgtgtttggctcataccgatggaattagcagcctcaaattgtccccggtcgactgaatgaatcgccgcccggaacgtctccgacaaatatcccccgaggttcaatgaaaatgagagcaacgcaaacagctcgggcggaatgacatagacattgaattgctgtaagaatccatattcgctctggaaataatacagaaacttgggtattccgtaatatacgagaaacagctgcacaatgagcggtgttccccgaatgtacgagacatacaacgtagacaatggcgccaagacaggcaccttgtatatccggattaaggccgtagctaacccgatgattccacccagcagcatggacacaaacgcaatccataaggtcacggggagatactcgacgatctggggaaggcttttcagcatataatcaagatcaaacagcttttccataggaaccccactttaccctttacattgttattactgaggaataaatcctccacctgtccactgttcagacaattttttcagtgttccgtccgctttcagctctttaataatcgggtcgattttagctttcagctcttcgccctgcttatcctttttgaacaccaggttgatgttatcgctttgcaccggctcacccacagcttccacctgcaagccttccttcttgatcgttgccgccgccataaccggatcattcacataagcgtccactcggccattttgcacgtcttgaaggttatcggacgaagtacctgtatcattgtatttcaaaataattttatttccgttctccgcattatactgttccagcaactgtgtgtaggagtcgcctaccgaggccgctaccttcttgccctccaaatccttgagggaatgaatatccgttctaccctttttcacaataataaccgactgagccgagaaataggactcatccgagaataaatacttcttctcacgttcgggatttttggcaacttcatcggcgatcatctgaactttatttgaatctagtgcaaggaatatcgcatcccagcccgaaggcacaaattcaatcttatagccgtccagcttcttgtcgatctccttgactacttccacatcgtatccagtcagctcgtttttatcattcgtaaaagcaaacggtgggtagtcattttgtgtgccgacatagattaccttatcccccgatgccgcatccttcgaggaacatccactcaaggcacccgttaataacacaagagataggccaatcgctgctaccaaagcagatttcttcatattatgacatcccctttttaatatccaagtaatttactatgattttatattataacgggttattcaaataatacaacaagtaaatttcatattgattatttagctatatgttgcacaaaaaaaggaccctcgcgggtccaatgtcatccatgaagcggaaaacgctctgctggatgttccggcaaaatggacgagatcaaccgtcgtacagccggatgagcagattcaaaaatctgatccttctcatcacagcgctcgatcagtctcccctgctccatcacagcaatgccatcgcagacagcataagctgcccgaatatcatgcgtgatgaacagatatgacaatccaaacgaagatttcagttctcctagcagggataaaatgtgcatctggtgaaccatatcgaggctgctgacggactcatccagcacgatcagctttggtttgagcgcaatcgcccgtgcaatattgatccgctgtaattgtccgccactgaactgatgcggatatttaatccgatcctccggcttgaggccgacccgttccagtaggctttcgaccgttcttttttgttcctgcaccgataaccgttcgtaattgtccaatggctccccaataatctgcccggcggtcaatcgggggtttacagcagagtagcagtcctgaaatacgacctgcatatcccgtcgcattcccctgcggacttgagggctcgcattataaatgtcctgtccctggaacagcacctgaccctcctgcggcttctccagccccagaattaccttgcccagcgtgcttttaccggctccactggttccaagtaagcctaggcaaaacccactctctatagtaagtgaaacgttagccaacacaggggggcgtagttcagaacggcccagccatttgcgccttccatagctatgagttactttcttcacttgtagcatacgcattcgctccccttttgaaagtgtaactgtcgaacaggcgactaaccaccttcctgattcatgccccgaatggacaacttgggtctgacttgtagcagcattttggtatattcatcttgcgggtgatcgaacaactgatggacctcagcctgctcaacaatacgaccctgctgcatgacagccacttcatccgccaattgggaaatgacgcccagatcatgcgagatcagcaaaatggacgtattgtattccgtacgcaagcgatccagctctcttagcacctgtagctgattgaccacatcaagcgccgtcgttggttcatccgcaataaccactgctggccgcaggcacatggaaatggcaatcatgacccgttgcagcatcccgccgctcaactgaaacgaataacgcttcatcagcttagctggatcgggcaaattcatattttccagagccgttatggcaagatcacgggcctgtcgtttggttaatccggtgtgcgtacggaccgtttccataaactgagctccgatcgtatacactggcgtaaaggcgctcatcggattttgcataataaatgcgatttccttgccccgaatacgccgcatttcctcggccgccattccgttcagttcacgcccgttcagacggacactaccttccacgtccatcgtctggcgatccagcaattggagcaacgctttacaagtcaccgttttgccgcttccactctcgccgacaagacccaaaacttgtccccttttcagctcaaaatgaattggcttcagcagagataccgccccggcatcggttttgagcttcacctgtaagccgttgacctccagcaccttcgccctgtcgtccatcgttgtaactcactcctgttttactgacgtttggcaattccgtatcggtcggacagcgcctcccccaatatattgaaggccattaccaccaccagaatcataacccccggatagatcattaattccggatgactgcgaatgtatcccgttccctcatgaatcatggctccccattcaggggtcggcggctgaatgcctagaccaaggaacgacaacgcggaaatatccatgatcgcccagcccatttccagcgtaccaatgaccacaatcggccgtagcacattcggaataatatgccgccggataatggcccctgaggaggacccactaatccttgcagcagctataaaattccgttctttcagactgacgaccatattgcggcacattctggcataatacacccactgcaccatcattaaagcaagcagcacctgcatgaggcccggcccaaaaataccgacaatgcccagcacaagcaccaaattcggaaacgccataataccttcgcaaaaccgcatcaacacactatcgacccagccacccacataacctgcaagcgacccgatcacaacgccgatactaagcgaggacaggaaaattaatgtcgcaaagccgagggaaatccgcgctccatacagcaaccgggataaattgcaccgacccaaatgatcggtccccagccagtattctttcgaaggtccctccagcttgtgcagtaaattgactttaaccggatcatggggagccagccaaggagctagcgccataatgataaaaagagcagccagtacgacagagcagaccacgattaccttttgacctttgaacattgtacgcaaccttatcatcactgctctgctcgtcccttcgatgaaattcgggggtccatatacaaatgcaccagatcaacgagcaaattgcatacgatgaacaggcatgccgccaaaaacacatagcattgtatgacgggaatatcccggttaaaaatcgcttccacaaaataacggccaaacccgggccatgaaaacacctgctccacaataattgttccggtcagaagcttgcccagattcatacccatacttgtaatcagtggagcaatggcaattttcagtacatgcttgagcatgatcacccgctcacgaattcctctagttctggcatactgcacatacgtttcctgaagctgctccaacacactggaacgcagcaggcgcgtatataaagcaatcagaaccagcgacagggtcaacgtgggcaacaccagatgctgccacgttcctcgcccctctacagggagccaatccaatcggacagagaaaaagaagattaacaaatatcccagccagaactggggtatagacgcgccaaaatatgaaattcctcgactaagcaggtcgatccagccatttttacgcatcgccgccagcacgcccagcggaatacttaccacaatagatagcaacatactgctcacagccaattcaaaagtggcgggcagccgaaccttgacctcatcccacaccggcttgttggttagatacgaagtaccaaagtccaattgactgatcctttgaagtgtatgcatatactgcgtcagcaaaggctgatccagcccgaactcatgtcttttctgctccagaatctctggagtagggtaaatatgagcagccgtcaaataggcctcggccggatcaactggtgaaatatgaatgagtgcaaaggtaacgagggtggcaaagagaacaataggaatgaccgctaccattcgcttcccgatatagctgatcatgagttgtcctcctatcctgtaaactaccgttacccgtcggcttcagctactttccgatttcaattccctcaaacggattttcatcccgattagccgggaatacaaagtttgtaatctttttctggtacactgccgttttcttaatatacgaaataggtacaatggcagattgctcctggagcgtcttcagaatcgaagcatacagctcttggcgcttggtttcatctgtcgatgagagcgcttcgtgtacttgctgatccaggtctttcttcatcggaagggcgctcagcacctcggaaattccaaagctcttcttagcaataacattaataaaggaatgcggatcataaggcgcaccatagttgtaccagaagtacagatcaaactggttggatctaaggcgcttaatttgaaccgtcagctccagtccggtcaggttcactttgacacccagttctccccattcagcctgaatggtttcagccatcgccttttggatcggatcggttttatcgaaaatcagctcaaaatctagctgttgtccgtctttttcccgtactgtaccgcctgcgggcagcttccagccagcctcatccagcaacgatttggatttttccacatcataaccaacaggctgtaagtttacattcgtatacggatagtttttggataaaaccgtatccgctgtttcctccagccccgaggttacaccttccaccattgcctgcttgttaaagccatgctggagtgccagacgtacccgaaggtctgccagcttgggattggatgagttgagcaacaggcttcttgtaccgacaggctcggacagcgtggtaacatactgattcgtgtcgcgaagctgtttgaaagcatccagactaatgacaccctctccataaatcagatccagatcgcctttttcaaaggccattacacgggtttcgccatcgggaatgatttttaccgtaattttatccacctttggtgcagtgccccaataatttggattacgcttaaaggttgcatattcatcttgcttgtattcatccagcatccaaggtcctgtacctacaggtttcttgattcccttggacgtatctccatcatccgggaaccccgcttcacctagaaaacggaacgggcgaacgacagacaaatcctgaagcaccgggtagtatggctctttgagcgtcattcggaaggtgctgtcatctacagcttcagttttgtcgagaacgcctactataccaagccagctgtgcgtcttctcatttttcataatagcgtcaaagttctttttgacaatggctgcattaaatagcgttccatccgaaaatttcacacctttgcgcagcttaaacgtatatatcttgccgtccttggaaatagtccaggattcagccaaagcaggctccagcttgcctccttgcttgtagctgactaacggctcatagaccatggattgtgcaaaaagttgggaaggattgtatacgtgaggattcatcgtaccaatgtcacgcggccacgatagcgtgatcgacttttcattggcagctccgtcagtagaggtggatgcaggtgcgttctcctgcttcgcgcagcccaaaacaacggataataagaggagcgctaccaacataagggtggcagtcttgcggtgtcgaacggacatcaatgtatttccccttttctatatatgtgataatgattatcataatcatatttagaataggtaccacgttctattttgtcaacaacattcgacaagccatcctcttatttattttaaatttgtagaatattaaatttatggcttaattcgccaacgtttgaaacagagcacgcgtgtactcatgctgtaacaagtcttcatcccattccttaaatatttccacgatctccccctgaaccataacagcaacgcggtcacaaaactgacgagtagattggagatcgtgagtgatgaataagtaggacaactcacgctcctgctgcattctcttaagcatgcccagcacggaaaactgcgttgtcgtatccagattggcgatcgattcatcgaacaagataatatcgggctccaccgccaacgctcgggcaatacatacccgctgtttttgcccgccacttagttgtgttgggtatttttccagacattccgtgtccagccccacagattccagtaaagactggcaaatatccagtacttgagcttttcgtccgggaaaataattgtggattggctcctccaaaatatctcgtatggtcatgcgaggatggagcgaggaagacgaatcctgtgcaaccaactggattcgcttgtacaggtagatatccttcatccttccggtgtgaatgggctggtcatccagccaaatctctcctgaggtcaacgactccagccctagaatacattgtgccagcgtgcttttgccacttccactttctccaaccagtccaagacattccccctgtcgtagctccagattcaccttcttcacagcctgttcgctatcttgcgtgctgaaccagccttttctccgtttacggacagggtatgctttggtcacattcttcaattccagcatcactggtgcatccttccttccgggctcatctccaacactcgatctgctatgcggctcatcccctggcgatcatgtgaaatcagcaatatggtgagatcaaagtcttctctcaactgttgcagcaatgccaagaccttgtcccggttgataacatccaacgccgtagtaggctcgtcggcaataaagaggctcggaccggagcttaacattgcagccagcagcaccctttgacacatgcctccgcttagttcaaaaggatatgacgacaaaatatgctcaggatttgcaaatccaaccttgcggagcagagagcgcaaataggcctcccgcactggagtagcgcctcctctggctatctccgtggcacggctcagcagctgccgcatccgtggcagcacgcccagcgggtggacttgctgcggtgcagtgtaggatgcgacagaatcagcgtgctccggctccatttggtcatgcggcatccgacgccgcccgtgcagtctaagcgtgtccatcagctgggcgcggacagtccggatcgggttcaacccgctcagcgattgttgaatgagcagggcaatatcctctcggcgcagcctttgccagcgccgttcctggaacgggaggatgtcttccccgttatagtagatacgcccttgcgtaacattaatacctggttccagcatgcctgcgattgcgtgtgcggtcaggctcttgccgcatccactcggtccggtcagggccacaatctcccctgaatatatggaaaagctcacatcacgcagcagtagtttgcccccgcttccgcttgctcctacgcctgtgcggcagatttccaaatgttccacgtgtaacaacggtcttcgccctgccacttgttctatcgtatccttgcacccaagggctgtttgatcctccactatttgtccgcccccttttccgaaaagcggtcgcccaaaagctggcaggcaagtacgaacagcataatcgccaagcccgggaaaatcatgacatgcggggccacctgaaaatacgaggttgcatcatgcagcatcacgccccactctggcttaggcggctgtacacccaatccaagaaacgacagcccagcgatcatcagcaccacgcgtccgatatcccataccgcataaaccaacaactgcggcaacgcttgtggcaatacataacggctcagtatacgtacgtgtgaattgccggataaacgggcatatcgaacgtagtcctcctgacaggctttttgaaccagactacggatataccggacatagcccgcccaccgtaccgcaataatcgcaagggtcatgttaacaaaacctggacccaaaatgcccacaattgccaccgttaaaataatatcaggaaaagccagtacgccgtcgattccccgcatgatcagctgatccacgcgtccgcgcacataaccaatgagcaaccctataggcagactgaagcataacgtagctacagtaattgcacatgcgattagcacgctcatccgaatcccgtaaattagccttgacattacatcccgacccagatgatccgtaccgaaaggatatttccgactgggtggtgccagacggttcaaaagatccacttgaagaggatcatgaggagcgacccatggagctaataacccaagcagcacgatcagaccaaacagtacgcctcctgccagcaagctcccttgaaaggaaagccgtatctttttcattttcagcttcccccttaacgcaaacgcagcctcggatctatcgccgtctggaccacatccaccaaacactgaactcctacaattaaaaatacggcgaaaataacatacccctgaatcaccggataatctcgctgtgtaattgcatctataaaatacttgcccaaccccggccatgaaaaaatggtctctacgatgacattacctgccagcataaatgatagattggtacctagcagtgtaattataggcagaaccgcatgcttaaatatctcaaaaaacaggatatgcatacgggaaaagcctcgagccttcgctgctttcacaaaattccggtcacccagctctagcatttgagcgcgtagtacacgggcttgcacagctcccaaacctgcaccaagagtcagcgctgggagcactaaatgtgtccaatcctcccttcccatggatgggagccagcccaagcgaacggagaatagatagatcaacagaaacccaagccaaaaagaggggatcgacgatcccagcagggcaaacagcctgcccaggcgatccagtggaccgctgatttttagcgaggcagccagtcccaaccccagcgtaagcaccgtcatgacggcaaagcccgcagcagctagctccacagtagcaggcagtctgttccacagttcggctagcacggattccttggatacatacgaggtgccccaatgccctgtgaacacatcccgcagccagttcacatattgaatatgaaacggttcgtttaagcccagttcctgccgtagcgtcgtcaacgcttcctcagaggcagggacattatgcgcggtgagcaaaatggtagcagggtcaccaggagccagcctcatcagtacaaaagtcagcgtggatacaacgaatacaatgatgagcagctgcgccacacgttccagtataaaacgaatcataggatacgccgctcgttattccgcaatatcggattgcgctgtaatgtagtaatactcgatcggatggggtgtaaaaccctctaccccttttttcacaccaaacacattgtcaggatgcacaatgaacgactgtggcaaatccgtattgatgatatccagcgcttgtagtgtcacagcattacgctgcgctgtatccttcgccagcttcaagctgttaagaatactctctagcggtttggaactataacggcttacattggcttcgcttttcgaagaataaaacatgtccataaaatattgcggctctcctgtatgagcagtaagcatactgtacatagcaaaatcccaatcgtttttggtcaacgcctcgtcgatattttccaccttgcgaatcttgacctggattccctctttcagcaattggctttggatgacctcagccataacagagagctccggacgctgaggaaaagtcagcagcgtaacctcgaacggcttgccttgcttagtccatgtcccttgggcgtccttctgccagccatccttcgttaacagctgatccgccgttccgtccagcgctttacgctcaactttaccgaagggaagaatgctcgggaacggactgcttgcttccgaaccgaagcccctcatgacggcgctcacaatcgatgtgcgtggaatcaggctgtccaccaccttacggttcgccgcatccttgaatactggggattccatattgtacacgagcatatgggtgcgcaaggagggagccgacagcacttgtagcctgtcgttctttttcagtacctctgcgttatcaaccggaatatccgtcgctacgtccacctcgccggattgcagcgccatcaggcgcgaattcccgtccgtaatgaacttcatcgtcgcttcagccaatcgtgccttctcgccccaatatccgtcataacgctctacgaccaaggattggtccttgttgaacgctttgattttaaaggcgcctgtcatcgctgggtagctctgctcatccttcatcgatgccacattcagtacaatcgtcgatggatcagctagattggacaccaacgccgcattcggctggtttgtcgtaatctttaaggccagcgggccgcttacatcaatggacttcacattcagtaaatccttcgccagatggcttttctcgatagagcgtagcaaagatgcttttacacttgctgcatccatactttttccattatgaaaagtgactttatcctgcaagctgaacgtccaaactgtaggactatcctgcttccactcctttgccagccaagccacaggctccagcttttcattcaaacgtaccagtgtctcacctgcaccggatcgcatcacatcccagctattatctccgtgcggatcaacacctgacggtttccatgtatacgccattaccagctttttacctgtcgctgtttgttgtgctgacgcgttctcatctttgccggagctattcgacgtcttattgctagtacatcccgaaagagccataactgccagcagcagcatcacccctgtacatatcaaccatgagcgcctgctatgattgctaatcattcgatgaatccccctctatcttgtaaaatcatataaacctaacgcaaaacgcgaaaaaagcattccggaccacttgatcagcagtcagaaatgcttccattataaaatgtcaaaacacacctcgaaaccaactccaaaaacatagaagggatcagatcggtttcagacattccgtatgcagcacgcctaaccacctccccagcatcccgtgggtctgacagtgatgtcaaaacaggcaggtctcctgactccaagcgtatctttcaggccttcccggttcttcacagttccagtggctgttctgaaagctccagcagtatcctgctgatgcctgtatacagtggcgggcccgtgtcggaatcaaccgaacttcccttttaagtgaacacgctcaacaactatccacatggtctcaacaaaaccccgtacatagagtcgtccggctcacacctgttttcttcctttatttctttccattacgatcttattttgttgtcacaggcttgtcaataaatgctgcacaataatttaaatttgaacaatatagtgagaatgaaggcaatggctattcattgcgtgcacgcaaatgaagtgttaaaattaggtatagaaataaccaccgtgtccgtatactaaaaagagccttcgccgcgccaacggcaaagactcttaggacttgaaaggctgtggatcacccacggcgcgctgcataactaatggttaatgcaaacgaaacccaccgttaggggccaacctaattacgcggtgggttttcgcttgttccgaaatttccgacgcagccagcgataaagtttacgaatactaaacaccaggcttagtaacgtaaccatccaacgcaacacatcgtagcacgacacaaggttgaccatcggcttcaccccctttcgggaagctgcaccgtggtccgaaaacatccaccactattcaaaatccataatttagattataccatgccccttcctaccactctagcaaattcttctagcgtataaactggaaaacacaccaaattagagctacccatttcatcccgcagcttcatctatatgtccccagacggcaagggtatctactatctggataactccatgccagaaagccggaaaagaggcatacgtcctctctccggctatctttatttattcctaatcatcaaaccttctgtggaacctccgaaaccgtcacgcttttgaccgattccccttgttttctcgtcaaaacaatgttcaagacaatcgctgtaatcgagcccgaaacgataccattttgcagcagcattttggcaaagctcggcagctggtcgaacatttgtggcagaacggcagagcctaggcccacggcaatactgcatgctgcgatcagcagattgctttccttccgcagatccacttctgacaaaatagacatgcctgatgcagcaaccgagccaaacatgacgatcatcgccccgcctagcacagcgttaggaatcactgtcgttaaggcagccagcttaggcagcaaaccgagaacaaccatgatcccgcccgcagcaaaaataacgttccgcgatttgacgcgtgtgagtgagatcagaccaacattttgcgagaaagctgtataaggaaacgcattaaaaatacccccaagcataatcgcaagtccttcggaacgcagaccattgacgatctgcttctgttccaccttctgatcaatcgctttgcctactgccagataaacgcctgtagactcaaccatactgacaatattgacgataatcatcgtacaaactgccatcatgctaaactctggcttaccaaaataaaacggctgcgcgacactcacccatgaggcctccgccacgggtgcaaaatgcaccattcccattccataagcaaccaccgtacccgcgaacagaccaataagcacggaaatcgagcgcaaaaagccttttgccaaccgattcacaagcagaataaccagtagtgtaactaacgccagcagcaaattgcgcggctgtccaaaatccgaactgccctggccccctgctacattgttcatcgccaccggaataagagatagaccgataatcgtaacgaccgaacccgtaacgaccgtcgggaaaaagcgtagcagcttgccatacaacggtgccgctaataccacaaatataccggacaaaatgatggcaccgtacgctgtcgctaaatttgaggtcgaagcaatcgcgataatgggtcctactgccgtaaacgtacagcctaaaatgacaggcagtctactaccgaaaaagcgtgtgcccataatctgtaataacgtagcaatcccgcaagtgaacagatcggcagccaccaaataagccatctgggctggcgtcaggtgcaatgctccccctacaattagaggtacagcaattgctccagcgtacatcgccatgacatgctggaagcccagcgcgaataacttttgtttacttagcatcccacattctccttaacgggaggaatcaccgctccagcttcctctataaaatgaacctcgcctggtgccatggaagcgatacgcgcaagagaacggacggcaatgcctctttgctccaacagtccacggccttcctggaagctcttctcaattacacagccaaccccggccagctccgctcctgcttccttcacaatatccgtaagtccaaccaaggctgcgccagtagccaaaaaatcatctacgatcagcacatggtcgctggcatcgagatatttttgagaaatgctcacctgataggtttcctgccgagtgaacgaatgaacctctgcgaagtatacctgctcattcagcgtgattgccttctttttcttcgcataaatgaacgggacccccaaggtaatagcagtagccatagcaaattgaataccactagcttcaattgtaagcaccttggtgatcggagcactgccgaaaaggcgtgcaaactccttaccaatctccaatgctaatgctgtatctacctgatgattcaaaaatgaatctacctttaatacggtgtcagataaaatttgtccctcttgacgaatacgttcctccaaagctttcattatgcgagtatcgctccttctgtactttaaaatagtataaaacctgccaaaaccaaaaaaggacaggctcccttgagttgtttctcaagtgaagcctgtccttggggttgtcatccctgacggattggcgcacaaataaatgcccgcattcatccaaagccgatgcgctatcactcatagtcggacgattacagtggtcatccggtagaaacttttgggccatatccccaatattatacgagtcatatgaaattgatatcttgtatactacaccctctggcgggcggtttcaagactatttttcatacagacagcggcatttggagaaccttcgacaattggaatatcgtaaaatcaaatcgacctttgttcaaggtatatatattgtgaggactttgcattatcctgattgtagaaaacagataaaaaaacaaaaatacatacaaaacaacacttaattttaattataaaaaaacaaaaataaaaccacaaatttcacttccgtttccgttgactacaaagaaaaacggaagtagtatggagttagttaagaaaacaaaaggcagactttcaggctgcccgtattttatccatgcaaggagatttgggtatgaataattatcttgctgttgatattggagcttcaagcggaaggctcgtaagtgcaactctgcaaggtgaccagctacacttgcaagagcttcaccgtttcaacaactcctttaccgaaaaaaacggacacgattactggaatatcgacgaactattgaatgagattattcagggcttgcaaaaagctaaacaaaaagggattcattcctgtacgctcggcattgatacatgggctgtagattacgtgctgcttgatcagaaaggtaaccgcattcatgaggtatacgcttaccgggatgcacgtaccctccatgcacccaacaggctgcaccagcacatcagtcgagaggctgtgtatgagaaaacaggcattcaggaattaaactttaataccctgtatcaactgttcgtccatgatcgggaacagcttgcccaggcggataaaatattgatggtccccgattatctgtactatcgcctgacaggcatcatgatcaatgaaatgacgaatgcgtccacgatgcagcttctcaacgtgaacacccgagagtttgatgaagacctgctctccctgctccacctgcaacgcaatcagttttcagagcttgccgagcctggacgggttctgggttctcttttgccggagcttgttcaaaaatacgatcttccggactgtcagatcattcttgcgcctactcacgatactgcatcggctgttgcaggtgtaccgtcacagcgggaagaaccttgggcttatattagcagcggaacgtggtcactactgggaatggaacgatccgaagccttgaataccaaggcagccatgcaggcgaactacacgaatgagtggggcgcttacggtacgtaccgttttctgaaaaatattatgggattatggatgattcaggaggttaggagagagggcgattccgcacatagctttgccgaattggccgaactggcttcagcagaggcaccgtttgtcagtctcgtcctctgtaaccagtcatcctttttaaacccggatagtatgaccgttgaaatccagcgattctgtgaagaaacaggccagcccatccccaggacgccgggtttactcgcccgctgtatttttgacagtctggccttaagctaccgcgatgccttacacgaactgcaatgtttaacagacgaaacgattaccagattgcacattgttggcggaggcgctaacaacgaattactatgtcagctaaccgccgatctcttgggaattgaggttcaggcaggtccttccgaatctacggccatcggcaatattgtcgtgcaattaattagctctggtgttcttgaggatctcaaagctgctggccgaaccatcgcccgctcctttccgactcggctctatgagccacaatcggtggaagacgtgcaagatcttttgggtcgctgggagcaccttaagatacaagcaacatcctctattcacatatctcaataaaggagtaaagccatgaacgaagctattgaagccagttataacgaagcgaaaaagctgtatgcccgccacggtattcaagttgacgacattttacggaagctttcacaaatcaaaatatcactgcactgctggcagggagatgatgttcagggatttctgttcaaagacaaacagcttagcggggggattgccgtaacgggcagctacccgggcagagcaggcacgccgcatgagttgcgtcaggatttagaaaaagctctatcactcattccgggtaaacacaaggtcaatttgcacgcaatctatgcggacaccactgaacaagtggatctggatcaactggagccacgccattttcagaactgggtagactgggctaagcagcaagggcttgggcttgattttaatccaactttgttctcccatcccaaagcggaagacggcttcacactgagccataaggattcggaaatccgtgatttctggatcacacactgcaaaaaatcacgcaggattgcagagcattttggaaaagaactcggtcagccctgtgtcacaaaccactggatgccggatggctataaagatactccggttgatcggttggctccaagagaacgtctgcgtgatgctttggacgaaattttcagcgagaaaatcagtgaagaatacaacatcgatgcggttgaaagcaagctgtttggcattggctcggaaagctatgtcgtgggctcccatgaattctatatgggttacgccctgacacgcggtaaatctatctgtctcgacgctggtcacttccatccaaccgaagtcatttcgaacaaactgtcctctgtgctgatgttcaccgatcaattattgctccatgtcagcagaccggttcgctgggatagtgatcatgtcgtgacgatggacgacgaattgctagacattgcccgtgagctggttcgcggtgaattgctttcccgaacccatatcggtcttgatttctttgatggaagtatcaatcatgtagcagcatgggtcatcggaacacgcaacacgatcaaagcgctgcttcgcgctatgcttgaaccaattcaagcattaaagcaggcggaagaggaacgggactttaccactcgtcttgctctggtcgaagagtttaaatcgtatccgtttggtgccgtatgggattactattgcgctcaaaacggcgttcctgttcgtgaggaatggctggccgaagttaagaattatgaacaacaggtactgctgaaacgttaactactgtactgataatgcttatattcatatcatccaaaagggagagattatccatgactactgtactggagaatcaaaaagaacgaaaatcgggactggatatcccatttgttcgcgagatggcggaaattacacaaaacatgtggaaattcggctgggatgaacgcaatggaggtaatgtaagctatattctggatgaagctgaggttgcaaaatatatagatattcatcaggtcattcggacgattaaacctgctttcccagtgaatgaactagctggtaaatattttatcgtcaccggatcagggaaatattttaaaaacgtaattgcagatccagaagctaacttaggagttcttcgtgtctcccaggatggcgagcagttggaagtcttatggggcctcaaacatggcgcagtgcctaccagtgagttgccttcccattttatgagccacattgagcgcttgaaggtcgatcctaaccatcgtgttgtgattcataatcatgccacccatgttattgccatgaccttcattcatagtctggacgaaaaccaattcaccaaaacgctgtgggaaatgtgtactgaatgtattgtcgtctttccagacggtatcggtgtaatcccttggatggtaccgggttccagcgaaatcggccgcgaaacggcaaaaaaaatgaaggatcatcgcgctgtattatggcctcatcatggcattttcggaacgggcagctccattgatgaagcatttggcctgattgaaacgattgaaaaagcggcgcaaatttatatgctcattgctcaccatgatattcagcaacggattacagatcaggaattggccgatctggccaaagccttcaacgttactccaaaagaaggaatcctgaacgtataaatataggctaatctttatctcataatacagaacttaaaaggctccatggatcgtctcaaaccggccatggagcctttggcatacctagtttcaattatataacccttaattccaatgaattaacttgtaattatgctttcctttatatacaataaaatcaaaattcccttatctccaccaaaggagaggtgacaagttatgaaaagagcaaaaaatgaagatcacttcgacatcgtggaagaccattatttcacagccaccgaattggaaaaatccagtgccgtttggcctgtcagactaggtatggatatttcgaaaacaagctaccatgtcggtcccaaggctgttccttatttttatttgatttttgtacttgaaggtcaggctgagtttatttataagcaacaaaagtaccgcgtccaaaagtctgatttattctgtttttttccgcatcttgcccatgaatattacaccgatcaggagcacccgttgcaaaaggtatggattgcctttgagggacccaagtccctcgcattgctggagcggatcggaattaatccctctacgccattgatggctaacgcaacgagcgaggaaatcctcagacttatctccaacctgttttccatcgtacacgacaacagcagacagggcagcgatctggcccgcttgattacactgcaccagatcttcgaggagttatcccgcaacacatctgatgtgctgcgcaactttgtatgctctgattattggctccagcaggggaaagattacattgaaatgcattattgtgaccgtgttacgattgaacaaattgccgagcatgtaggtgtggatcgtgcgcatttttcacgtaaattccattccaccttcctcatctctcccgccaagtatttgcaaaacctcaagattaacgaagccaaaagattactggagcagacgacttacaatttgtcgatcatagcccagtccatcggctataccgatatgtccaccttttccaaggcatttaagaaaacagcagggattccaccgcgtgagtatcgcttccgacatcagtcccggcaagagattcgtaccgtcaacgcttagtcggaatccagtaacgttaaagagagccgccgtatacggtgtttctctttttatgacctgatcctaattcccacttggttctgagccctttcaacgctataataggcatcaaaccaacaggaaaggtacgtgaaatccatgctgcgattcaatgcgatacgtacgggctatctgctgggcatctcactgatactggccgcaattatttattttttcgcctccaattggggcggactggatcggacattcaagattgtacttgctgctgcgcttattgttctgttctatggcttgtcttttgtatttgcacggatacgtgctgttcccggtcaacaagcttttctgtctaatatgtttttggtggctggctgtatagcctttggcgtttccgtggcattgctcggtcaaatttacaattcccatgcggacagctacggattgtttttcatttggtcggtgccggctctactgcttagctggattactcgctacaatcctttttatatgctgtcttatgtactaattcatcttggtttgtggctttatttttaccctacgatgcaaagtgtgccttatagcgagctggaatcgttgtccattgccggaatgttcggaatagtcaatctgctactatttttattgactttcctccatcgtatacattctgctccactacaatatatgagctttacggttttccatatagctatgttagcgatgaccaattcctttacatttgatgagtatggcatggtcatgaatgtaccgcatattgctgtgattactttaggattttatatatttatcaaggtgcggctgaataaaacgctactgaccttgaatgcattggcactttcggcgtttgctgtctttaaatttatagagctggctgaggcgtactcctcatctctgttttttgtttttggtttgatttttgtggcgttgctgctgacgggtaacgtgtggtttttccgctatttgaatcgtttggggaaaacactgccggattcagggacaacggacatcagtacatcaaagaatgaggcgaccgtccacgaggaacatggcagtgaatggattagcaaaaccgtatcccgtgtgatcaaagtggttggagtgctgatcggcagtatatctctcatcggattgattatgattagcacgaatgtaaaccacaccgaatatgtactgttggttgtgtcgttgctgcttatgattttgatgattgtcataccggaatccaagctggattcggtaatacgttatacactgctgaccatcagctatattacaggcttggcggccattctatggtcagatcagtcgctgctttcggtattatttctgatcgtttccatcgctggatggttccgctccaaggggaaaaggcagttgttttttgcctacacctttgtaaacctgaatctggcgaccattttatttcagcagtatcaggagtgggatggttggaactggacctataagttcatcatcttctctcttttcatcgtcaatgccgtgttatatggggtaagttactttatatccaagacggagttaaaagaacatctacggaatggctcattatttttcagcttgctgttcctgttttgggcgacgtttttcgaggatgtcgttccacactcttatatgttcattaacattttttattttgttatcgttaccgggatggtctttgcctttgcccgtctgaaacaaaaatcggaggccatcacgagcgttgtcttctggtttatttttatcggcttcaaatactatgatttattgtggacgctactgtataaatcttttacgctggcgctactgggcatcattgcgctcggaattacctggtgggcggatcggcgaatggcccatagcggcaaagcagcattcgatgccgatcaccgcagctttagctttatgcgcttaagcccgttactcatcgctattgtcatcgtgctacagctggggatcatcggctatcagacggcgagaagtgaaaccctgctcgccacaggggcttctattaagctcaaactagctcctgtagacccgcgctccctgctgcaaggcgattatgtggcactgaattacgacatatctaccccgccttacaagccccctcttcaggaggaggaatggagccgaggcaaggtcaaagtcgttctcacaccagatagccaaggagtatacgtcgcggatcgcctatatcaagatggtgaaaaacttgccagccatgaggtcattctaaatggacaatggtatggttcccgtattctgtacggtattgagaattatttcattcctgagggaaccggacgtactgtagaacagaacgcacactttgcccatattcgggtgagccgcaatggagacgcgctgctggaacgtttggcagaaagctgaccggatcggcgaaggcagtaaacaaagcaggctgaaccaagcccctccattactggagcacaacttggttcagcctgcttgtttttttcggaccatcgtttatctccgtttattcatctctcgaccatgatgctatttcctcaatatcctgcggctgagtccggcaacaaccgccaatcagacgagctcccgcttcataccattggcgggcactttgtccgaatgtctctgtacaagtgctgccgtgccatgtcttggtgaccgggtcatattcctcccccagattgggatataccaccacaggcttatccgtgtggctgcgtatttcgtgaataagcgatggaacgaatttcggcaaagtgcaattgattcctacagcagccacttgctcatgcccattcagccactcagcacatgtagcggcagactcaccattgctaatatgctgcccatcctttgcgctaaagctgatccaggcatacgtgccagggaattccttcagtaatcgggcgatggccttggcttcaaccagacagggtatcgtttcacaagctaaaatatctgcaccagcctcaatcagagcttccatacgcggcctgtggaactctactagctgttcctcgctcagcttgtaatcgccgcgatactctgatccatctgccaaaaacgccccgtaagggcctacagaggccgcgactagcggcttgggacgatgtcgctgacttgcagtagccatcacgtcagcccaaaactcatcgcgtgcctgcacagcaatccgtaccgatgattgaatcagctccagcgcctcattttcgcttaggcctcgtttaacatagccctcaacggtggcctgatagctcgcagtaattgcacagtccgcaccagcctcaaaataatctctatgtacgcgcttgatcgactccgggtgttcatggaggattttagctgaccataagctatcgttcagatcatgtccatgacgctccagctcggtcgccattgcgccgtccagcacgatcagctgaaattcgtccagtatatgttgtatcggattcatgcggcccctcctgctcgtcttttctactaaacccactaatcaagtgggttttaatgatttacattatagcacgaatgttgatgagcactcacaaagccaagaaataatcattccgtgaagacttcccctttcgtttcatttgccatctgatgtaacgtataaattttttaaattagtttcataagttaaattaattagatattgttctttttttcacaaagtcattttactataaaagtgcaaaccaacactttggccaaaagatcagggaattgcatcgtcacattctgcatcgtcatttatgtgaaaaaaggtacaagagagggttttatctatgtctttactagaaatgattacagcgaccttaacagataacaaaattgtcagttctatcgcttccaccgtttttattattcttcttggtttcttttgccgcaagaaggggatttttaacgcagcagtaggaaagatgttatccaaggttgttctaaccgtggctctaccagcactagcctttaattctttcatgcaggacattaatcctacaatgttaaaacaaggaatgaatgttttaatatggggagttctaatttatattattctcatctttatttctaaaccgttctttctgagctacaacaaggataaacaggatgttttgcgggtgttaaccattttcggttctacgactttcttcggaattccaattgtcggagccatttacggtcctaccggagtgatgtacagttccatttttaacatagggtaccgcattttcttatactcctatggctatatcaaaatgagcggcttaaaaatggagcttaaaaatctcaaaaccatgtttttgaatccaatcgttatcgccacgtttctaggcttgtttgtttggttgtttcaaggttatttgccacagatgagtgtagctacagaggatggggccattcagcagttcgcctttctgagaattgatcaaaccgctgtctggctgttcaagcccatgacctaccttgctggactagcttctccgttagcctggttatcgattggctcgacattaggggagatcagcttcaagtcggcagctactgataagacctcttggtattacagcatagttaaggtttggcttgtacccattgttaacatcgttttgctggctttgttgactgtatctcatattctgtcagtcgattctgtcgctttagctactattgtcatcatgatggctactccaacagctaccgtagccgcagcctatgcgatcagttttgataaggaagccatattgacctccaatgcatcgcttctatcaactattacttctgtcgtcatgattccagtgtggatcgttacgctcaatgtcattgataaaattggaattttctaaatcagggggaaaacaacatgttaaaaatcatttgctatggtgtccgttcttatgagaaaccctatttccaggatctcaataaatataactttcaactaacgctggtagaagagttgttaaccactagcaatgcagaattggcacagcatcacgatgccgttttgctaagaggaaactgtgctgccaatcgggaaaatatcacaaaattcaataaatacggcattcgatatgtttttaccagaacagtcggaatcaaccacattgatttggatgcctgcagcgaattcggaatgaaggtggcacgcgtgccatcctactctccgaatgccatcgccgagctctccctaaccttagcaatgatgctgttccgacacaccgcttatatgactaccaaaagctcgttcaaaaatttcattgtggacgagcatacattcagcaaagagattcacaattgtaaagttgggattattggggtcggccgcatcggtctgacggaagccaaattatttaaaggattaggtgcttctgttatcggctatgatgtgtaccaatcggacgcggccaaggaagtcattccattcacaaccttggatgaattactggcagagtgtgatgtcgttagtgtgcatgttccttatctgccgggacagaacgacaaaatgattaacgccagctttttagcaaaaatgaaaaaaggatctattctcatcaatacatcacgtggagaattacaagataaccaagccattttggacgctttgctcagtaaccatctggaaggcttcgctacggatgtcttccctaaagaagatgaattattctttagagcctttgaaccatggcaaatgctcccggacccaacgatccagaagcttgtggagctgtatccaagagttttggtaacgcctcatgctggctcgaataccgttacggcgttatccaacatgattgaaactagctatgacaacttccatgatatcgttacaactcattcttcagataacctagtcccacttcctgttctctctatgaaataattaggaagcccggtactcttgtgaacaaaaaaagaaccgctatttccagattacaatggaaatagcggttcttttacatcaggatttaactgatagagcattagcggcctgccaaccttgtgatattctatcgattcaaccaggaagccatcgtccaccaggaactgaatatatttttttaccgtgatacgggacaggtccacttctctggctaacgtttcaaccgagaatggtccgtccagctcttgaatactcttcagtatcgtagtcatggtcagtttggacaaatttttagacaggtttttcggtagattatgcgatggatgttcaacaggttttttcttctccacacccgtatactcttctttattaaaataatggtcaatgacagcttgattaattccgttcccttcctccatcaccgaggctaggcgctggattttctcaacagccagtctaaagcgttcgaatgtaaagggtttaattaaatagtctgcaacaccataaaaaacagcttccttcaccgtctgaatatcttttgcagccgtaattaaaataaccgaagcatgatattgatgctcctgcatatgtgataataaagttaatccgctttttccaggtaaataaacgtccagtaataccagatccggtttccatttttgaagacagtcctgtgctttcttgacggtatctgccttacatacaacgtccaaattgtccatgcgctcgataaactgttgattgagctcagcaaccatcggatcatcctcaacaattagaactttcattcatttgtcacctccaatgtacagggcaactctacataaatacttgttcccagacccggttggctatcaagctcaatgattccttgatgattttccaccatggtttttaccagattcaagccgtagcctctgtcttctcctttggttgaaaagccatgctcgaatattcttttttgcatttcaaaatcaatccccaacccattatctttcactttcaaaataaatacatttccctcacactcatagttcaatttcagctcaattttgccgggttcttttttttgtaagatggaatctatggcgttgtcaaaaaaattacccaggatgtgtatgacatcatgaacgatatcctgcatctccacattagagacattcgagctttctgcaagaagaaccgaaatattctgttcgcgtgcttcgttgattttacccataataaaacctgctaatgccggaactttaattctctcagtcagaaaacctacctcatcttgataccggtgatttagctgctgaatatattgactgacctccgcatatttcctcatttcaatcagcccggatattacgtgcattttgttcataaattcatgggtctgtccgcgaagggagttaatataatattttgtaccacttaactggttgctaagatgaatcatctcggattggtcgcgtaacgttgcaaccgctccaaaaaactcattttctatatatataggggttactgtcgcaatgacttctataccattcacataaaatgagcgatccttgatcttcttcttatcatcaaacactctcttgaagagcacgttataaaagttggtatctagctgctcgccaatcggggcttttatctcttggttcgccagttggtacttggcctgagcttctttgttcatgagcataattttcttgtccgccgaaatggctataattccttcagcgacctcattttcaataatttctttttcgcgcaatcgtgttgctatctcttgcggctcaagcccaaataaaatcgttttgattttctgagccagaatgatcgcgcccaaaactccactaaagagtcccagcatcagccccccaaaaatggtatactgcgcctgcatcaaatcatgatttagggttctcatggtcagccctacacatacaatcccaatgacctcatgctgttgattaaatatcggcgtaaaatatcggtaacctttgcccaaaatacctatattctcagaaaaatgtccctgaccggatagcgctcttctggcatcattcaaatcagagaacggtttgccaaccatcgttgcattcggatgagatagccgaattaaatcgtggttcagaatgactacaaaatccacattaacgttgtgcatgactccaagcgagtagtcttggatctgcttcacagggactctctgctcaacattacgaataacatcgttgtcactagcgaccaccttggcaatacccgaaagtttttccttcgtattatcaaaatgttggttaattacgaaattacgaatgagaagcaaggatataattaaggaaataataataactaaaacaaccaaaataataatcatgaattgtagcgaaaccttgaattgtcgtctcggcttcgacttacctattaaccgcaatcccatcacccagcttctttgtcaagctctccattaggaaaaagagcctatctctttccctataatcccttgttattcgacaccgtttgacaatttccttcttatttcgtaagccattcatcggctggaaaatcaaaaatttcgttcatcttgaacaagtgcgatattaaccactagttgaagcttggctatttcagtaaataaataaaaccggcttgtcttttaaagacaagccggttctatatgaattagtgtatgctaaaagatttcaaattcacaaaattccccgtatctcatccaatgactgcaccttttcccgctgcatccattgttcaagtccatgtaccagttcagcccctgcatgtaaatggacaaagttgtacgttcccacctgaatggcagcggcccctgccatggtgaattcaataatatcctctaccgagctaatcccgcccatcccgattaccggaatcgacaccgcctgtgccacctggtgaaccatgcgcaaggcaattggcttaattgccgggccggaaagaccagcatacgtgttggcgaagacactgcgacgccggcgtatatctattttcattgcagaaaatgtattgatcagcgaaactccgtctgcgccttcttcctcgcacataaccgccatctgcgtgatgttctctgcgtttggagacagcttgacgaccaatggaagcgcagtcacattgcgcacctgacgcacaacctcccgcgctacctccgtctggataccaaattgcattccaccctgcttcacattgggacacgaaatgttcaattccagcatatcgacgcctcttcgattcatcgtgcgtcgtttttgcgcgttttccgtaatcatcgctacggcctgaacatattcctccagattggagccgcctacgttggcaataatagccgtgttccagtgagtcatgtcatccagttcatccttcaaaaaggcggcaacccccggattctccagccctacactattgagcatgccggatgctgtctcatgtattcgtgatcccgtattaccagccttcggatgcagggttagtcccttgccgacgataccgcccaataattcaggagaataaaattccgcatactcacgtccgaatccaaacgtaccggaagccatgatgattgggttcttgaacggtacacccgcaatattacacgccatggagatcatcgaactccacctcctccaccgggaatacaggcccttctttacataccctccgattgcctccacgggtacgcatcgtacagcccaaacatgcgccaataccacaggccatgtgtctttcagttgaaatatataaacgggacgacgtatccaccgttttcatggcgagtgcttgcaacatcggagttggcccgcaggagaacatatttgcataaagcgtcggatcgacctgttcgacgatgcttccccctaccttgacctgtacagatgccgccacagcttcgaacgcttcaaccccgaaggcttgctgtgcaaaccccaggtaaacatgcgcatgcgggtagtactttgcagccaacagcaacggagctgtacccatgccaccgccgattaaagccaaactaccctctacctgcggaaaaccgtttccgaaaggtccttctaactgaatctcctgaccaggctgtaattgggaaaacaaatttgtcccctctccaacaacccggtacaaaaaggaaatactctcttccccgatatcataaatgctgatgggtctgggcagcagtggataacctgtcccgctgcgcagcatgtaaaactgccccatgttccctttaaactttccctctattttcatcacatagatgcccggaacgagcgccacattcgaaattacgttagccatataacccctccactaaccactcactataacgtaaaagcagcaactattacgtgactattttcacattttagggcaacgtttcgccctacgactcgtgatataaaaaagcgtactcctgttagagagtacgcttgtgtatttaactaatggcttcgcgctccgcattgcggctacccttggcatccttacggatttgcttgctgcgtagctgtccgcaggctgcgtcaatatcgactccatgctccagccgaacactacagctaatgccttgttttttcagcacatcatagaagcccgtaatcgactccgactcactccgctggtattggctatgctcatccaccggattgtacggaatcaggtttacattggccagattacgacgatggcccaccagctcagccagttcgagcgcatgctccttaccgtcattaacatccttcagcaggatgtactccagcgtaatccgacgatttgttttgtccaaataataatcaatcgcctgcatgagtttctcaatcggaatcgcacggttgatcttcataatgcgagtacgaatctcattattcggagcgtggagggagatcgccagattgacatgcaggtcggaatctgcaaattcaatgattttatcagcaagtccacttgtggaaacggtaatatgccgcggcccaatcgccagccctttgtgatccttaatgacccgaatgaaatcggacaggttcacgaagttatcaaacggttcgccaattcccatcacaacaacatgactgacttggtcgcccggacgttcctgatccagatacagctggaccttcataatttgctctacaatttcaccgctggacagatcacggctcttcttcaacaatccgctcgcacagaagctgcacccaatgttacatcctacctgcgtagtcacacatacggataagccaaacttatgccgcatcaataccgtctcaatcaaattaccatcctgaagccggaacaagaacttgaccgtcccgtctgctgactgttgcttcacgtgttcttcaagtgtttcaatggaaaagtgctctgccaacaggcgagtacaatcctcatgaacctctgccatcgctgcaaaatcagtaacccgcttccggtacaatgcgtcccatacctgcaatgcccgggatttcttatgtccatgctcgatgagccatgctgtcaattgatctagcgttaatccataaatggattcttttttcatgttcgatcctcttttcaaaacattcaaattcgtcttcctctatataaaactaagcacgcaccattcgtctcaaccatcattgcatcatagcatgtttaagctatctgcgctatttaagcgcctctttcattgtcccaaattttaattatgaacacaagggggcaggcacattgtttctccaaaatttcattgtgaaattatgtcttgaaaccaagtacaagccacattaaactaggcgacagaacctgttcaactagagcacgcaaagacaggattacagatactcctaatgatatgattacaactaaggaaggtgatgcggttggaatggttgcttcggatcaagaacgctctcgatctgatggaagagagaatgcagcagccactcgatatcgaggaaattgcaaaggcagcctattcgtctcctttccattttcaacgtatgtttcatatgctaaccggcgtcacggtagcagaatatgtgcgtaaacgtcgattgaccttggctgctcaggaattgagtctttcttccgccaaggtgttggatgtagcgttcaaatacggatatgattcccccgaatctttttctaaagcgttccggaaggtacacggtatttctcccactgaggccagaagccctggggtgaacctgaaagcttttccacgcatcaccttccatctatcgttgaagggagatcaggaaatggattacaaaattgtagagaaagcggcctttacggtcattggcaagtccattcaagtcaccactaagaacggcgataatcttcgagaaatcccaaaattctggaacgaactgaatgcggatggtacatcggatcggattcatgccttggggacaggcgacgatatactcggtatatgcttggacatgaaacatggggaggagacgtttagttacttaatcgccgcagaaggcagcgaagacgtagcgaccgcgaatgggctggaatccagaaccattccggcttcaacctgggcagtgtttacatccatcggccctatgcctcactcgatccaaaaggtatggcaaagaatttttcaggaatggttccctgccagtaattatgagcattcaggcggcccggaactggaagtgtacactatgggagattcacatgctgaagactaccgaagtgaagtttggattccgattaagaaaaagtaaacaaaccgaaccgactgccgattgcagtcggttttataccgtactacatttacatcataaggtgacagaaaacacaattccctgcatactcgctactctagctcaatgcaccgaggaccattccccaagctcctccttcaacacagaatatagccttgagcttgccagccttagcggatagtctgttgctttgcaaagaaggccgaaggtcatatcgatcaggctgccgcttaattccctcaccgctactcctgccgggataggactgaccagaatctgtggcacaagggcaatacccaaaccgctttccacataaaatttcagagccgtcatgctgccaatctccatcgtgtctagcgtggttattccatattccttcatgaccatttcaagtttgcgacgatatggacaggtggccgatgtaataagcaaccggtgcccctgtaaatcctctggcccaatgttttctttttccgcaagcgggtgattttcaggcatcaaaactacaaaattctccttaaataaaggttcaaaatatagctctgtgcccacatctggtgtggaacacagcgctaagtcaatatctcccttgagaatacgctcgcttaaggtaggggtattcccaaactcaatagaaacccgaatattcggataatgggttaagaagcgttttaaaatttctggtagtcgataactggcagtcggttcggtcactcctatacgaatgttacctgtagtccctctttgcagattgtccatattttcctgcaattgctccatatcctttacaatatgtagactttgctcgtaaaacatcctgcccgcttcagttaactttattttcttgccccgttcgatcagttgaattcccatatcggactccagcttctgtatttgcatcgtcacggtagattgtgcataattcaactcttccgctgcacgcataaaactcccgtaattcacaatcatttgaaatgttttaagcgttttaatgtccattctcagtctcctatatgcccaattaattcaattttattgaatcataaattcagttaattcaattatacagaacacaatacatcctctacaatgatacatatcagatcatattattttcagacgcaaaatgaactggttggagaaggagcgaatatatatggatttacatcaaaaagtagcactggttacaggtggaggtacaggaattgggagagccgcatgtatggccttggcagatcgaaaagctacggtagtcgtaaactattcccgctctaaaaacgatgctgaggaaacggtacgtatgatccttgaaaagggcggatgtgctatcgcattacaggcagatgtttcccaagatcaggaagttcgaactatggttgaccagattgtccagcaattcggtacgattgatatacttgtgaataacgctagcattacacatcacattcctatggatgatctggagtcagccacggaagaggtatgggatgatctatttgatgtaaatgtaaaaggcatgttttactgtgccagagccgtagctccttttatgaagcgtagtaaacaaggagctatcgtcaatctgggaagtatagcagggcaaacagggctaggttcctctcttccctatgcggtatccaaagcggccgtccacgggctgaccaaatctttagcacgagcactagcaccggatattcgcgtcaattgcatcgtgccgggagccgtagcgacaagatggtgggcaggcagggaagaacaaatgaagcaactgtttcctcatttgctcctacagcgcatttccacgcccgaagatatcgcgagcatgatctgctctgctttggaacaggaagccatgacaggccagattattacggtggacagcggacaaacactgtaaagatactgagacttctgggtaaaaacaagccgccttctcagacagaaggcggcttttgagctatcgtataacgtcgttgactacgttttagcttatagataccgcaattcgtgtacctttcacgaatttagcaaataaataccgaacaagcggccctacaattaagagctgcagagggaaagcaaaaataaaattcttaaaaactaaagataagtaatttttaaataatgaatctcccgaaagaccattaaaaaagtaagctgtccccaatccataaagtgacatacaaagaaccattccaatgaccatacagcatgaaagggacagaatcacaaatacctttttagatttgtcgtatggtaatgagaaggctatcttctttgctagtggaccgacaataaataattccaatacgaaagcaatgataaaacataaaataaattgaagaaacattacttttagagatattatgccaatcaagtcatttgtatatagattataaaatgtcatgaatacgaccatccccaagcacatcattaaaccaaaataaaaatcttctttcttcgttgttggcaattccatcatcccttctgtgtaccttggtaattatataaatagtcgaaacctccacataagtgaactttctgtgaactttatagtaagcgcttccctttatatatataagaaataggcatcgttcagctcaacgatacctcggaatgttgtagtcatatccctcaatgatctgcttctaaatctaagccaaatctcttcagctcaataaaaacactttccagtcgcttccctttttccgttaacgaatattcaactcgcggtggaacctcggcatatacctttctttctaacaggccgttatcctcaagttccttcaggcgtagggaaagcgttttgggactaatccccttcatggatttctgaagttggctgaatctcagtgttccttcgataagcagatcacggatgattagaaaagtccatttcgttccgatcaaatcaagtgtttgggcaataggacacggcttgcctggtattcctttggtcaattcaataggttcttgggcgtgcatgggaactcctccaaaaatcatctgttaaacccgacggtatcacaatagttccctttaggaaactatatgaattaaatatcactacttccctaaagcgggtcattccttcagttggagacggatcaagcccgcaagctattcgaaaacaaattttggggccaatattatgcagctaaatacggggcttcccaaccggcattattgatacaccttcccgcagcaaaatgcctgaaaatacgcgtaatcaattctatgatacggtcgcgcataagcttcctgtgaagcgagttggacttgcggaggatgttgcacgaggtgtactttatttgattcaaaatcagtttgtgaccggaaccgtccttcatgtggatggcggacatattttaacataaaagcttcgtcttaaatccgtcagtcatttaacaaaaaaaacggagaacgctcccgcatctttgcttgggcgttctcctccttttcttatcaatgaatgatttcaaaaactttatcctagtgatgaatacgacgtttgtttctcaaaatgttgcgaatcatcttgtgattggggagctgcctgaacaacatatgtccgggatgcggattggcctcgataatccagatttgaccgctcttttcaatagcaagatcgatgcccaactcgcgaaccggatgatttttatctatcgtgtcggcaatgattctagaaagctcgatgatctggtccagaatctctttcatttttattctgtcatttttaaagacccttaaaagcactttggacaacggcgccgcatgtcctcccttccgataattggtaacgacttttcgaggtgcagcgacacgaccggttattcctgaaatgacccattccgattccggcttctgcatatacactctggcatcaaaaatggaacctctgtacttggctaacttaagtccttgctgtaccaaataacgacgatgaggtctccgataggttctaactgctcttcttacggcgtgggatctaacgactctgcgactggagccacaacgaacctcatacttcctccccagctttttcgcacgtatgatgccagttcctccactcccataattaggcttgataaagactgtgcgataggtatccagcatccgtaaagtccttgcattactgatccagcgggtttcgggcaagtgagaacgtaaaatgggatgttgttgcatttccttgtattgaatcatctttccaatgggcacgaatatccctcgattctgttgggtttttgcacacattacatgaatatgcatctatattctatcttggtaacggcgaatgccacagtttgctatgaaagaggcaaatctcctactttctttaaggcgagtcttctttgatttcaagagagagatggacaatgtgttctgcatgacgaagttattgtaaatacctataaagttgatcctaataatatattagaccaataataattctggatatatgatgtattaaataataacgtgaggaggaacgttaacatgtctatttatgattttcaagcaacctcaattaacgggaaaccgattgaattctcagactacagaggaaaggttctcctcattgtaaacacagccagcaagtgtagcttctccagtcaattcgcggatctgcagaggctctacgatagacggagggagcaaggctttgaaatcctcgcgtttccttgtaaccaattcaatgaaaaagagccaggtagcaattcggaggttcagggattctgtcaaattaaccatggagtaaccttcccgctctttgagaagacagatgtaagaggctcatctcctcatcctttatttcaatatctgacccaacaggcaccgtttcaaggcttcgatacccaaaccaaagacggtcaatggatggaggatttcctgcgggataagtatccagaaatatacgctggcgacggtatcaagtggaatttttctaaattcttggtcgatcgcgatggccagataaaaggaaggtttgaagtaacaacggagccctgcgccattgatcctgtcatcgaatcgctattgtagtttttctgttcatttctttggattcttaaaaaaagagtatcaaatgacaaaaatgaatatttgtcatttgatactctttgtgttatcctgacttcaaggaggtgactcacacggcacttgaccgtgtccctatggaaaaatcctcagatgtgctaaccaaggaacagattctcattgctactgaagacacacttaggcgttttggtgtagccaaaacctccgtaaccgatgttgccaaaatattgggagtaagtcatggcaccatttaccgacactttaaaagtaaggccgagcttcttgaaggcgtgaccgagaaatggctgaacgaaaagattattggcccgttaacggaggtctgtcagaattcatctatactgggaacgccacacttaaaacgatatatacagaccttggttgaactcaaacagtattatgcccgcgacgacgaggaaatgttcgagatgtatacgagggtcaccgagcaagccgctgatttaatcgaccagcatatcgcccacattgtggatcatctcgctgatatcattgcacgcggggacatcatatcagatcagccagcccaactggcgcgtacccttttctatgccacagcccgttttcatcaccccgctcatgcttacgaatggaagagccctgtgattaatcaggagttttcggatgtgtggacgcttttagaaaaaggaatcacttaaaatagatatggaaagcagggctgaacacatatggagcatttggacggaaaaacagcaattatcaccgggtcctccagagggattggacgtgccattgccgagcaactggctgatctaggcgctaatgtaatcatcaattatgccagcagtccggataaagcccaagaagtcgtggagggcattatccaaaaaggcggcaaagccatagcacttcacgctgatctgggcaaaatgagtgatattgaagcattgtttacaaatacgattgctaaatttggtaaagtggatattctggttaacaacgctgggctgatgatcacccaacctctggctgaggtaaccgaagctgattttgacaaacaattcgcactgaatgtaaagggcactttctttgcctgtcagcaagccatgaaatatatggaggactacggaagaattgtgaacctgtccacatccgtaatcggacaaatgttcccggcatatagcgtatacgcaggtaccaagggggcagtggagcaatttacacgtcagctagccaaggagttcggaagcaagcaaattacgatcaacgccgtggcccccggtcctgtgaacaccgagcttttccaagcaggaaaaaccgagcagcaaatcgaaggcatgaaaacaatgaatgctatgggtcggctcggcgaaccggaagatatcgctgatgtgattgagttcctggtcagcgccaaatcacagtgggttaccgggcagacgatccgcgtcaatggcgggttcatctaaaagctggaatacatggaatggaggctatttacgttcatgatattacacaaaggcgagaccttatttcgacaaggagaatccggtcctttatatcacttaaagagcggcttgttaaaaattgtccgagtccatgaagacggctcgcaaattttagttaatgtgattgtgcccgatgaaatcatcccgcaccactccctgatcagccccaatccttattatggtacagcggtggcgttggtaacctctgagattggggttttgtcgcaaaaagaatggtatctaaagctggagcaagacccagctcaatgtcgggagatcgctttgcagctacaggacaaattgcgcatgatgcagcaacgaattgaccagctcaccgaggtgtcacctgccgagaagcttcggaagcttcaacgctggttccactcctacatcgcacccgccacgttaacggacgtgctgacgcaggaggaaatcggccagtttatagggctgcgtcgggagacgattaatcggctattgcgtgcttcaagcgctccttctgcaaaagatgatgacgataatgcatctcgatgagcgaaaaccattctccagcattcagcgcgccgaaactgggatgagagacggtagacggccctgttgatttcccaacggttggctcaatctctctcatcttgcggatcacgacgtttaatccctccacaatctcttctttgctagtgggttgttggggagtgtactgcggggatggtggaacttggatacgcattggtggaaagctccccagattaaaaatggccgtgcctgcctccgttttaactccggtctccccattaggctgtagacaaagatcaatgttcttaagatgcatatacagtgcagagttcaccaaatgaagatacatttgtccaagcgaccattgaccctcctgaggtgtgtactgcagttgctccaagctaaagctgtccaattcaagaagatagtgttgtgccgtttcttcgaaacgctgtaatgtttcagttgtattcatatattaataattgcccctctctatcaaagtagctttactatacaaaaatgctactgacagcattatgtcagtagcatttcaacattttttccacttccgtacgtatccgctcccggagcgactcaggctccagcacaaccatatccgcgccccatccaagtacccattgcagtaattcctccggctgtctgacgcggaagagtatatgtagtccatctgcacgctcctctatggcctccatataaaagttgttcgcttccttcaccttatctgcgatatccgaacgtgctagtatgcgaacagttacatgacggtcatcggtttgcttgtaatcctgcaaatgaaaatcggcgggcaactgaaacctgtcctccagcacgataagctcgtccatacgtgacagacggaaatgacgaagctgctgcctcaattcacattgcccaattaacacccaagaaccacggagcaggacaagaccataaggagcgaccacacgcacactttgacgattcccgtcagcctctggcattcttttggagtagccaaactgtactttccgtttttccaatacagcgagacgcagcgtttccaaataggttttctctctatggtttgctccttcacccactgcgagcagtctgatggtcgtacgcacccgggagacttccctgcggacgctctccggtaatatagcttcaatcttcctgcgggaggtttgcgccttgataccgtagtctgtatcaaatttttgttcgacaaaatccgttccgattagcaacgccacagcctcttctgcagtaaaactcaaggggggcaggaagtacccctccatcaaggaatatccaatgcccggtgctcctacaatcggtacgcccgattcacttagagcctgaacatcccgatagatggtcctcacactcgtttcaaatatggctgccaaatcctcggctcgtacaatatccttacgctgcaactctagcaagatcgctagcatacgatctgttttattcataccacggcccctctctggaaggatcaaaaatgcaaaaatgcagaaatacaaaaaagcaataagggcagtacagtcactgcgacttattgctcttttttcatatggaagttactccattacttaaaaaatactttttcgacgttatatttagccttttgtgaattgatgatgtaggtttcataaatttctcgctctactgcatcttccacaatacaaacctcaataatcgctacttcgttccgcttgtccttgatcggcgatacggtatcttcaaaatgttttttgattctttgtctcagctttcttgctttaccaacaaacagcaattcctcctgtgtgttgtagaacataaagataccagccttatctctagggatcaggtgaaagtcggtaaatccgtaaatatggctaagctcagggttaacctgtttggtaatcgtgatatccggagttggaattgttatattaatcactatgtcacttcctcattctatataggtgtaaatattatcacaaatcctgcggtaacaccatttaataatccttgccccatcacaagacagatcggtagaaattttataacttacctactatgcgagtacgtcggtttccgttacaatatgtcagtgtgattctggcatcggcagattgacgcgtacttgaacattattggaggcttctatttttttatgcaaaatgaatctcattctaacgtaaaaatcataacggccgatccgagtgcgatcggcctgtttggcttggctattgtaacgcttgtggcttcatcccaaaagcttggcctcaccgaaggcttaagcttcatcatcccttgggctatatttctcggtgcttttgcacagctatttgcctccattcaggatgcaaaacataacaacaccttcggcatgacggcatttggtgcttacgccttcttctggttggccgtagccagtagctggatgattaaaatgggcgtattcggctcagagctggcatctgctgtagatggcaaacagctcggctttgcctttgcgggctatctcatctttacgcttttcatgaccattggagcgatggagacgcataaggttttattctttatttttgtgttgattgattttctgttcctcggtcttagcttcgatgcatttggcgttgccccagaggtgttccataccatcgccgcttatgctgaaatgggcattggtctgctctcactgtatggtacaggagctgccgttctgaatgctcattttggccgtacattcctgcccgtcgggcgtcctttcggcatttttaagccacgtccttagctgtatatgtaaacctacaaagccgcctttcgcgccgatccgcgttaaggacggttttgtttcttttccatcactccctccgtatcaaaaaaatactaaagagagtcgtttagtgaatataaaagcccacaatgataacaatatacataaattgtaatcaaaggggtatttgtaaaaatgacacaaggcgaatctcgtaccacatttccgcaatttcccgaatcatattggttagcttcaactgacatccccaactttcccaaacttagtgaagatattcaggtggatgttgccattgtaggtgcggggattactggtattaccactgcttatttactttctaaaaaaggactaaacgtcgcagtcgtcgacgcaggacggatacttcatggaacaacgggccatacgaccgccaaaattaccgcacaacatgatttgatctacagcgagtttctttcacattttggcaaggaaaaaacccgactctattatgaagctaaccgcgatgctcttgaatttatcagacaaacggtagaagagtatcatatcgattgtcaatttacagaagaagatgcctacgtttatacatgtgcggatacgcatgtggaaaaaatcaacgacgaatataaagcttacaaggaacttggcatcccgggaagttatgtcgaacaaacgcctctgcccttttcaactaaagcagctattatgatggaaaaccaagctcagtttaatccgattcctttcttaaggtatctagccaatcaagtcatccggcaaggcgggaagatttatgagcagaccaccgttgtgggtgtggataagggaaccccctccattattaatacaagcgacgggcacaaaatcacctgcaactatgtcgtatcctcctcgcattttccgttcaatgatccaaacagtctttattttgcccgattgcatgccgagcggtcttatgtactagcggtcaagacggacaaaacctatccgggtggtatgtacctaagtgcggaaacccccaaacgttcgcttcgctctgtactaataaacggtgaaccgatggtcatcgtcggtggggaaggccacaaaacgggacaaggaatctgtactttccagtactatgaagctttacaaaagttcgcagagcaaacatttggattaaaggagatcgtttatcgctggtcggctcaagacttgtatacgctagacaaactcccttatattgggcaggaactatctagcatttctaacatcctcgttgctacggggtatagaaaatgggggatgaccacaagtgtagcggcggctttattaaatacaagtctgattaccagggaggaaagcccgtatcaggatcttttctccccttcaagatttcatatggaccccgacattaaaacatttgtgactcaaaatgcgaatgtggctaaacatttgattgctgggaaattggggatcaactacaaaaaagccgaagaactgcagcacgacgaaggggcggtcattcgggtgaacggcaaaagggcgggcgcataccgagacccacaaggagcattacacctagtggacacaacatgcacccatatgggttgcgaagtcgagtggaatgaggcggaaagaacatgggattgcccttgtcatggctcacgcttttcatatcaaagcgaagtcattgaaggtccggccaaaaaatcgcttggcaaggttgaaggggaatagcaccaacctttgaaggagactcaagagcacaggccttactggaatcgctcgctggtcttccaaaagagtccccctcgttcggtaacctaaccttttcatagctctgaataaacatagttacgctggacaacatacctttgagaatcataaaagaaaggtgatcctatgataagccaacagtctgcattagcggcgcatgagtccctagagatccacgaagcgctaaattttaaaacgttatgcttagccaagtccaaattaatgcagggcttggtattcgatcaagagctaaaggatttaatggaaaaagatgttcagcaatctatacaagctattgccgatttgcaagcattgtatgttaaagcaccgtttcaggcacctgttccagaattccgaccaacaccaattttaaattgaggtgaaatgatgtgacattaaatcagacccagtccgcaagaatggattatgtggatccaaaaaactcattaaatatgccggaaatggcagacatgacatttgcgatggactttctgattcgcgtcaaggaaggggttcgaaatacagccatagccttgacggaaaccgtctctccagatgccagaactctgttgcgcaatcaattgcatcaaggcatcgcgtttcatcaggaaatcactgatcttatggtacgaaaaaaatggtttcatccctatgatctgcaaaagcagtatcaattggatcaactatcagccaacaagacggtggacatcagtaaaatgaaactgttcccagacgataccacccgcaagggtatgtttgatcgcacgccggacgaacatatgggaggaaaccaggcatgaaagcagtgacctaccaaggtatcaaaaacgtggtggttaaagatgtcccggacccgagtattcataaagccgacgatgcgattgtcagactgacgacaaccgctatttgtggttcagatctgcatctcattcatggaatgattccgaatctacaagaggattatgtaattgggcatgagccgatgggggttgtagaggaagtcggcagcggcgtaaccaacttgaaaaagggagaccgcgtgatcattccgttcaacatagcgtgcggtgaatgcttttattgtaaaaaccaattggaaagccaatgtgatcattctaatgagcatggagaaatgggcggttttttcggctattcaggaacaactggtggatatccgggtggacaagctgaatatttacgtgtgccttttgccaacttcactcacttcaaaattccggagagttgtgaacattctgacgagaagctctgcttgatctctgatgccatgaccactgcgttctggagcgtcgataatgcaggggtaacggacggggatactgtcattgttattggctgtgggccggtaggtttgttagcgcaaaagttcgcctggttcaaaggggcaaaacgagtcattgcggcagactatctggattatcgtctgcaacatgcgaagcgtaccaatcacgtggagatcgttaatgtggaatcgcaagaaaacgttggcaactacctgaaggagatgaccaaaggaggcgcggacgtagttattgattgttccggcatgagcggtaaaatgtctccgctagaatccttggcttctggtctcaaacttcacggtggagctttaggaggattggtcatagccacacaagctgtccgcaaaggcgggaccattcaagttaccggtgtatacggcggacgatataacggttttcctttgggagacatttttcagcgaaatgttaatttacgtacgggacaagctcccgttattcactatatgccctatatgtatgagctgattgatacgggaaaggtggacccaggagacgttgttacacacgtcattccgttaagcgacgccaaacgtggatatgaaattttcgataccagacaagacaattgcatcaaagtggtacttaaaccttaactatatattttgaatggaggcaaacgtcatatggtgtatggcctgcatgaaacccttgaagtccatgaactgtcagcgttcaaggcagtatgtcttaccaagtccaaaacaatgcaagcattaatctctgatccgactctcaaagctatattacagcaggatgttgacttatcaacccgccaaatacaagaactcggcaccctcttagatcaagccatttcacaggaggttaagccatgaatacactgttggagcatttgaccggactgcataccttaacggaccaagtcattgcagccgattttctgaacgcggccaaaagcggtgtgagaaattacgctatggccgtaacagaagcgggaactccagaaattaaggcaattcttacaaagcaactggatgaagctattgatacgcatgaacaaatttccacatacatgattgaacgcggctggtatcacccttggaacgtaaaagagcagctttcgatggatctgcaaaatatcaatactgcattgcaagctcccgttttgtaaaaagataactttggccgtatgaaacccgcaaagccttctttcacgccgatccgcgtgaaagaaggcttttgggtttatctcattatcttcattattcagcttgccaattcggcatccgctctgcaggataccgaaggcctgctgccattcctttggggatgattgcgttaatagcttccatttcctgtgcggataaaaccacatcgacggctcctgcattttcctctaaatacgtaacccgcttggttcctggaatcggtacaattccctcttgcgcaagcagccatgctaacgccagttgagaaggtttgacccctttttgggcagcaaggtccttaacatgctgcacgagatccagatttttctggaaattctcaggttgaaaacgtggcacagagcgacggaaatcatcttctgcaaaatcatcaaacttctgaatttgcccgctcaaaaagccgcgtccaagtggactgtaggccacaaattcgatgcccagttccttacacgtcggtataacttcatcttctgcttcccggctccataaggagtattccgtttgcagggctgtaatcgcatgtaccttgtgagcgcgtcgaatgagcccaggagaggcttcggacagccccaaatagcggacttttcccgcctgaaccaggtcactcatcgcacccaccgtttcctcgataggtacattcggatcgacacggtgctggtagtacaaatcaatcacatctactcctagtctttgcagactgcggtcgcatgcctcttttacatattcgggacggccgcttacccccataaatgtgccatcttccccacgcataatagaaaatttagtagctaacactacttcgtcacggtggttccgcaaaacttggctaatcagtttttcatttttccccacaccgtagacatcggcagtatcccagaagtttatccctagctccagcgcacgatgaagcgttttgatcgactcctgatcgttcaactcaccgtaatattcggacatacccatgcagcccagacccagtgcagatacttgaaggtcactgttacccagttgtttctttttcatttgtatcactcctcaattgtcagaatagtcatcgcatttcctaatcactacgtcacattccgtatgttactacttaaagttaacttgaagtcaagcgttgtctggttatgcaaggggaattattatgtatgaacagaagcgcttcagtagcttctggacggtaggggaattcatttacaaagctaaggcttcttccgtaatctttttgatatcaatggatgagggcgtttcttccttaaccatatcgggcaggatattttccaaaaaataattaacgcagtgtaattgaatattcttgattttcacaagtgcattacggtacatgactataaattccttttcagtatttccccgctgaagctcagcaaatgcctcgtacacctgatccattttgtccgcaacttcaaggattaaaccttctacagaatcatctttaccctcccttagctgtttgcgaaaaatggctttaaaatcctcgggaatattctcttcaataaaatactcaaccataccttcttcgacctgctggattaatagccgtagttccttagaggaatgcttaactggcgttttgatgtctccaataaaaatctccccgtaatcgtgactgctcgtaatctcgtatagctttttccagtcaatactgacaccatttctttcttcaatatcagccagcgttttggcatattgcaccactttccaggaatgagccgatacgctgtgttcctcaaatttaaacttacctggacaacggatgattctttccagctcatttagcgaccgaaaatacgtgtgaattcccatcattgcatccatcctttaaattatatgagatagtcaatataaacccactataaacctcaactattaacagtagattatcgcaatatcaagttgagtccaccatgtagcacatacacaatttttgctatactctttataaaagaggagtttgcaaaatccaataagcgactggaatcgaattttccaaaaaccaaaaaaagtataaagtggtgaaatcgttgttcaaaatcttactaattgaagatgatgaaactttgttccatgaaatgaaggatcggttaactcaatggaactatgatgtgtatggcatccaggactttaataaagtcattcaggaattcacaacgataaagcctgatctggtcgtgatagatattcaattgccgaaatttgatgggtttcattggtgccgaatgattcgatcccactctaacgtccccatccttttcttatcgtcacgggatcatcctacggatatggtgatgtcgatgcagcttggagcggatgattttatccaaaaaccgtttcattttgatgtactcattgcaaaattacaggcgacactccgccgcgtatataattacaatacagaacccgtctccctgaaaacatggtgtggagcgacggtcgattatgaaaaaaatgtagtagccaatgaggctggctccatcgaattaaccaagaacgagatttttattttgaagttgctaatcgaacaaaaaaataaaattgtcgcacgagaggaattaattaaaagcctctgggatgatgaacgttttgtcagcgacaataccctgaccgtcaacttgaaccgcctgcgtaaaaaattagacgagctggatttgggccgtttcattgaaacgaaagtcgggcaaggctacatggctacagaagaggcaccttcctatgattaaaaaatatcttatagagaggcggagctggattctactgtttgtatgccagcaatttctgatcctgttcattgcttatgtggacgcagccattccgttaatgcccatcctttatatcgtcttcttatccatgatgattttcttggtttttttaatcattcgctatcccaaggaaaccaaattctatacaacactagaagaatggaggagccctcttgaactaacgggtataggcgaaccggagagtccgtttgagcaaatcattgaacaaaaaatcactgaccagaccgaacggttacaacagatcatctcgcaaaatcaattgacacttgaacatgaaaaagatgaactattatcctggattcatgaggtaaaaacgcctttgaccaccatgcatttgatgattgagcggttggacgataagcccctaaaagctcagttaacctatgaatggctacgaatccacttactgctggatcagcagctccatcacaaacgcatatcctttattgaaaatgatctgtatgtcgagcaagtgaatttaaaatctctggtttttaatgaaatcaaagcattacagtcatggtgcatccaaaaagggatcggttttgacatccaattggagcacatggaagtgctgagtgatgccaaatggctggcctttatcatcagacagctcttaactaatgccatcaaatatagcgatgccagtgatattatcattcacagctatgaacagagggatcgaatacagcttgagatccaagactttgggcgcggtattgatccgaaggatataccccgtattttcgagaaaggttttacctccacaacccaacattctgattatacttcaacgggcatggggttatatttaacgaaaaaagcagcaaagtccttgctcatacatatagatgtgcactccacactgaacgtgggtacaaccttcactttaatttttcccaaacgaaatgatttcgtgagcatggtgagcatgtgacagagatgtcacatgcttttatgtattgttcgcccaatcaaaggaaaaacatcggctctatttttataataaggctacaagaacaataaggagtgcatcgaagtgaatattttagaagcccataaaattcataaaagctacggtaataagttaaatatgcaggaggttttgaagggaatagatattcttattgaagaaggggaatttgtcagtattatgggagcctccggctcaggtaaaaccacactgctgaatgttctttcctctattgataaagtgagccaaggttccattaaaatcaatgatatcgaaatgacgaaaatgaaagaaaagcaactggctgaatttcgcaaacagcatttaggctttatttttcaagagtataatctgctggatacgctaaccgtgaaggagaatattctcttacccttatccatcaccaaaacgcctaaaaaagaagccaaccaaaaatttcaggaagtagctacagaactgggaatttatgaactcaaggacaaataccctaatgaaatctcgggtggacagaagcagcgtacatctgcggccagagcgtttattcatgagcccagtattatttttgccgatgaacctacgggtgcgctggattccaagtcggcctccgatttattaaataagctgggccagttgaaccaaaaacgcaaggcgaccattattatggtcacgcatgatcctgtcgcagccagccattgcagtcgggtcatttttattaaggatgggcagatgtatacgcagcttcataaaggcgagcaggaaagacaaagcttcttccaggatatcatgaaaacccaaggggtcttaggcggggtccaatatgaacattaatctgctcattctaaagaatttgaaaaaaaatctaaagaattattacctgtatgtttttgctctcatttttagtgttgcgctctatttcgctttcgtcacattacaatacgatccttccatggacgaagtgaagggttctgttaaaggggcagcttccataagggcagcttccgttttattggtcgccattgtctgcatcttccttttatatgctaataatatctttataaaaagacgcagcaaagaaattggcctatttcaattgatcggaatgaccaaaaacaaaattttccgcatcctgagtgctgaaaacttaattctatacttcagttccctgtttattggaatcggagttggattttccttttccaaattagtgatcatgatcttatttaagacgacaggcgtcgaagccattgccactctatatttctctaaccaagcactgattcaaacactcatcgttttttgtatcatctacctgttgatcatgctcatgaattattcctttatcaagagacaaagtattttgtctttgttcagagtgaactcaaccaccgaagggaaaatcaagaaaataacgatctatgagatgatcatcgggatcattggcatctctctcatcgctttaggttactatgtttcctccaaattatttggcggagactttacatccatgaatgaattgtttatggctatggtgtttattttgggcactgtcatcatcggaacactacttttttataaaggatctatccgctttatttccaatatcatcagaaaaagtaaaggcggctatttgaacattaatgaggtgctatctctctcatccattatgttccgcatgaaatccaatgctttgttgttgaccattattacaacagtatcggcacttgccatcggtttactttccttaagctatatcgcctattattctgcggatcaatcagctgaggacaatgtaccttcccattttgcaatgacgaatgaaccggatgctgagaaattcaaaacgttacttcaggagcatgacataaagtatcgtgagaagaaaattgaagttattcaagtcagtgtgggcacagcgcaaatcatggagactcctctggaagggttaaatatcggtgcgaattccatgacgttgcctgtcataagcgatcaatctgtggagggtacggatgtatctccaggtcaagcaattttaatgggctataatgatctgttacagaaatttatgtccttgaaaaactttggtccattggatttgaagggaaaaaaagaagtcatacatcaacaatatttgggtctaaaaaaggagtatgtgattccctactattttacagccgggggactacccactgccattgtagacgaaaccatatttgagcggttaaagaaagatgtaaatcctgagattcaaaggaaatcatccttatatattggaattgatatgataaatgcagaacagattgaagaagccaatcgtctctttgcagctgcggattttaatgatcaacaaacatcacgccttgaaatgagcagcaatcagaagcggaacatgggagtgatcatgtttgtagttggatttttaggactcacctttctcattacatcaggatgtatcctttattttaagcaaatggatgagagcgaagacgaaaaagccaattacaccgtgttaagaaagttagggttcactcaaagtgacctgcttagaggtattaaaataaaacaactctttaacttcggcatcccattagtgattggcctttcacatagctatttcgccgtccaatccggctggttcttgtttggaactgaaatttggatgcctatgatcatcgttatggtgctgtacaccgccttatattccatttttgggatactatccatcctgtattataaaaaggtcattaaatcagcattataatcggcaaaaagcaaaaaaagccccaggcgaaagcgctggggattttccaaatatttgagcattttcgttcctatgtgtacaataaaataactatcatcgtaaccccaaagggggagagcttattttattattaatcatcaatggcatcggcatcttagccaatatcatacttggttcctctgtaggcgtggctattatcgtaggaatcgtctttttcctgattggcttgcctgagtttaaaaaattgccgagacttacgaaagaggctaaaaaagatatcacctatattatgtcgaccctattaactcttgttatattcgtagttatcgtttcttggaacctccatacttcaggtgacctgtttcttgaaggtccgctaacaccgcaaatgaagtttcactggggacaaaaggtgttgatgctaggattactggagggtttatgggctgtcatcagcctaaaatggctgttgcccatcttttttgatccgctggatctcagtaagaagcaaatccttgttttagtgaacgggatcgtatttagtgtgggttcaggtatttatgccatgcttgaagcaagttaaaaatgcttaacgcaaaggttcaaaaccctctgcttgcttcagaattcgctcaatttccacgcatgtctccggttgtagcgtcacttcgactgctttcacattttcttcgatttgtgccggtttagtagccccaatgagtgcagcgctgatacccggttctctcagaatccaggcaagcgcgagctgtgacagggtgacacccaagcccttcgccaacttttctagctcttggacacagtttagaacggtatcgttcatgtaactgctgatgacattattgacagaggcatcagccccgcggctacccgtcggtaaaggctgtcccggcttgtatttacccgtgagaatcccttgagccagaggcgaaaatacgatttggccgatacctatctgcccggatacaggaagtacctcatgttcgatataacgttcgaacatattatagattggctgattggcaatcagtggccgcaaattaagcctttttccaatcccatgggcatccgtgagctgggcagcactccattcactgacagcagcgtacagaatcttcccctgagcctgaaggtcatcgagcgctcgcagcgtctcttccaaaggagtatccgaatcataacgatgacagaagtacatgtcgatataatccgtaccaagacgcttcagactcgcttcacattgctccataatgtgcttgcgtgacagtcccctgtcattgggaccggagtccatagggaagtacaccttggtagataacacatagctctctcttcgataaggcttcaaggcagctcccatagccttctcgccttctccccggttatacgcgttcgcggtatcaaagaaattaatcccgagttcaaaggctttggcaatacaggtatgagctgcttcctgctcggcggctgtaccgtacgtcaaccagctccctagaccgatttcactaattttaagaccactgttgcctacatttctatatttcatatctactccttctttcataagaggatcatatttttatattttaacatgtaaaccctttcattaaaacaaatgaggattttgcaaaatcctgaaataataaaggattcatggagttacatgaaggacatctaccatccaacctatttggatggtagatgctcatagcctcacaatcttaaatcatgtctacttgcttcctacaggaaaaagcgcatcatatgcaggacaaggcagtttatcgagaaactcctgaagctgcttcggtttatttttataaatatcctttagggaagtttcattataaatattgccgatgaccacagggtggcatagctcacagatcaggatgtccccgttcccgtgaagatggagttgttttttaccatcaacgcagttggagaaatagacacccggctgttccttgaagcccagtgcttctgcaaaacggtccatacaggtgaaatacaacacagtatcgtcctttttatgtgcaatcaggtcatgaacggaacgaatgagcgcttccttggtagaaatagcgttccagttcgtatgatccatcacgatactgttttggatttcatggatgcgcacaccgagttcatataccttttcactaatggctggcatgttgttctgcgtctctgcaaacagcaacgtctccagcaccgtttctagcttggcttcggtacataaccgaatattctgtacaattttctcatacatgcgaggatgtacatgataataggctgcatacttatcggcatccgtgaagttgaaggagatatgaatattggaaagtcctgcatcacgcagtttctcaattcgttcagggctgagcaagctggcattggtattaagttgggttgcgatgcccttgcttgaacagtgattcacgatgtccagacagtcctcatatttcaaggtcacttctcccccggacagtcgcacacgttttaacgttggaatgtcatcaataatatcaatgacttctttgctgctgatgcattgcccgtcgttccgctgatacgcacagcagtaatcacacttgaagttgcaattggaggtaaccccgacttccagtccctccagctcgtagatgcccggcttttccagttcaagtgctttatatttgttctctatactcactttctcatgatcctcccgatctcaggcttgtgtcttgaattcccttgagattatacagatgggagcggtttgtagatatgacattggtaacggcgggctacttgacaggagtaagaaattctttatctacatacttataagcctcaaataaaccttgagagccataaggtacatctaattcatgtccattcaaagtaatataggattgccctgttacggctaactcctgatgaaaaggatctatctttttaatattttctacatttgtaaatgaaaaaacccatatctcagcattcgtagctaagtcacccgctgcaatgactaactcgttagttccatcatgatcaaagtcgtaaacgctcgcttgaagcctatagcctgctttcaattccccaaactcgtcaaaggcttccgattctccagttgaagacaggtcgagcggccaacctgtagactcggaagggaataccaccaacattttcaccccgttaggatgatccatcccttttcataaatttcaaaccccgttcctttcacatttatcctactaaattccataaaacaatggtgctatgtaatttccgtagataataataacatatattgaatagtgctcttgaatccgacacatgtcctgtaattgtgatcaatatgtgaactgggcatacttctcattcccaaatccatactgaatatatctgttggtaatggaggcgggaattatggataaaaggatgaatctgcttatgttcagcggcgattatgataaggcaatggctggactgattctggcaaatacagctcgggagctggatgtggacgtgacgatgttttttgcgttctggggactatttctggttcgtgaccctgacaagatgacgtttgaagacaagacgatttatgaaaaaatcatgggctggatgactccaaaaggacccgaggagctgccattgtccaaaatgaattttagtggccttggcaagctgatgctgacggaaatgatcgaagataatgaagccccgaagctcattcatttcttgaaaggagcgcgaaagaaaaatgtaaaattttatgcctgtaagctatcggtcgatattatgggttttaaaccggaagaatttatacctgaactggaaattatcgaggccaaaacgtatctaaaagatgcgctcgaatccgatatgcagttgtttatataagatagacctactgccttatcccgcttttggatgaggcttttattgtgactaaatgatgacactcgcctattttttttaacccattcgggcctacctacgtaccctaagaagacagaacgacttgggaggcgccgtatgctcatggctcgaattggaagcagtaattgtaggtatcagccttctaacgaggcttatttccaaaggtatcgtgaaagtacaatcggatatcaccagacctttgaatctccatacgggcaaaaaaagctgatttatgcggattgggcagccagcggtcgtctgtatggacccatcgagtcgaaaatagcaaatgaattaggccctttcgtggcgaacacgcatacggagtctaatttgacaggaactctgatgacccaagcctatgaagaagcgaaacaaatcattaaaagccacgttcatgccaatgaacatgatatcatcctgttcgccgggtcaggtatgacaggtgcagtgaacaagcttcagcgactgttaggattgaaaatacatgaaaaattaaagcccttctaccccatcgcaaaaaaagagcgccccgttattttcgttacacatatggagcatcattccaatcatatttcctgggcagaaaccgttggagacgttgtatgtcttcctccgggtcccggcgggattgtcgatccaactcatctcgaacgactgctgcttcaattccggcatcgccctgtcaaaatcggcgcctttaccgcctgctctaatgttacagggttcgaagtaccgatttaccagctatctcgcaaaatgcacgaacatggcggcatttgtttcattgatttttcggcaagcgcaccttataccgagatcaacatgcaccgcacagatccccttgagaaactggacgggattgtattttcaccccacaaatttcttgggggtcccggtacaagcggcgttttaattatggattcgaggctgtgcctccattgtgctccagatcagcccggaggaggcacagttaactggaccaatccttggggtggatacgagtataaagataatgctgaagcccgtgaggatggagggacgcctgcctttctacaggccgttcgaaccgcgctctgcattcggctaaaagaacagatgggacagaagcgtctgttggagcgcaaaaaggaactgacatcattattactaaagagcttgagtaccataccagggctacacatcttaggaggaagcagccaagaacgaatgggaatcgtttctttcgttgtcggccatattcactataacctgattgtaaaactattgaatgatcggtttggcattcaagtcaggggcggttgctcttgtgcaggcccctacggacattatttgctgggcatcgacccacaaacatctaaacaaatgacagacctgatccatgcgggagacttatctcgaaaaccgggctgggtgcgtctgtcgctccatcccatgatgacgaatcaggaagtctcctatatcgcctcttccatacgggcaatcgtggaaaacatcatgacctggcaaaaagattatatctatcaaccagatacgaatgaatggcaatctatgaatgaacatcacaaaatagacatcagcaaatggttcaattttagcgattaagagactcctgtccgttcccttccttcaaaactctcatagaatattctgtaggattaatatatgaggaaagaagtgacgacaatgggtctcaattttcgcaacagtactaatgcggctatctttgtagtctttgcctacccggacttcagctgtactcctgttaactactctaaagcaggctggtaccgtgttaaccccggacagactgttcagttgtggagcggcttcgcaggagggaatacgttcttttattacgctgaagatgattttggacgcgaatggcggggttcatatttcactcaagttcctgagaatgccttcaattggtgctgggatacaggctgtaccacttgtagaagcgtgggactgcggagaatcgcagttagcccgttcgtcttcgactatactatcaactttgtaacgagcagcagtcaaagaaaacctgcatcttccacactccgcatgacattgccttccaaagcaacccaagagaaacctatcttgcgcagagttcctgctaaacctaagagactaaaacaaggtaaaaccctattgcaaaaacgcatcacgcataaaaaacggacaaaataaaaaacgatctaccagctcacatatagttttttagaacccaaaaaaggagcgacctcacccccatggcctgctcctttctcttttatctatgaggtaacccgcttatttactctcggattcccacttggatatctcttcacgcacccgtggtgctacctctgttcccaatagctcaatagctctcatgacatcatcatgcggcatcgtcccgacgggcacgtggagcagaaaacgtgtaatgcctacctgtttacgcagatggatgattttcttggcaaccgtgtcggaatcgcctacatacaacgctccttcaaagctgcgtgcggcatcgaagctggagcgagtgtaaggaccccaaccccgttcacgcccaagcacattcatgctatgctgagtagaagggaagaacttatccgctgccagctcagtcgtctctgcgataaaaccatgtgagtgtgatgcaactggaagcagcgatgcatcatgaccggcatgcctagcggcttttttatacagttccaccaacggggcaaactgtacaggactacccccaataatcgccaggactaacggcaatccgagcaagcctgcacgaaccacagattcctgattgcccccactcccaatccatacgggcaatggattttgaactggacgcggatacacgcccaaattgttgattgccggccgatgtccgcctttccaggtaactttctcggattctcggattttcaataacagctccagcttttcatcgaataactcatcgtagttatccaaatcatacccaaataacgggaacgattcgataaaagaaccccggcctgccataatctcagctcgtccattcgaaatgccgtccagtgtagcaaaatcctgaaacacacgcacgggatcatccgatgaaagcaccgtaactgcactggttaaccgaatacgttgggtctgcgcagcagcagcagcgaggataacagccggagcagatgctgcataatctttacgatgatgctcccccacgccgtacacatccagccctacctgatctgcaagcacaatctcctcgacaacttcacgtattcgttgtgcatgactgatgacctcacccgtttggggatccggcgttgtttctacaaacgtgcttatccctatctccacttgttctaccccctattttcatgccctattctcatacggctgctttcgaagccaatcattttaaaaaacgatatctttatattgaaccttttttgcatctttttcaagctctctttttctgagtctgaaaaccagccaagggaagtgtctagattcgccgcaggaaaagaagtctctttgtcgaatattgtatggaataaagaagattcccatcccacaacatgaatacaacaaggaggcacatacatttatggcttttgtcattaacaatttaaaggataacagcaatgttgccatcacagaccaattaggcggatttacggtactggaatacataacagatttgagttctacctcggtggaggctgcgaaaaacaattactatatgagcaaaagtaatatgcgccgcaaacaactcatgatcgaaatcaacaatagcgagattatgatgaaggcgggagccatgcaatatactgtgggtagcatggaaatgactaccggtgtaaaaggcgttggaggcttaatgcgaaacttggtgtccggtgctgtaaccgggacaggtgccattaaaccacactataaaggcacgggtaccatcatgctggagcctacctaccaatatatttggcttattgatgtggacaatgatgatattgccatcgaagacggcttgtttttggcttgtgacacgacgctagacatatccgtcgttgcacgtagtaatctttcctctgctgcactgggcggagaagggttatttaatttaagcgcccgcggaaaaggagtgctggcacttcaagcgccgatcccttccgaggaagcggtcgttatagaattgcaaaatgatgtgctgaaggtggatggtaactttgccctcatgtggtccaataccttacagttcaccgtcgaaaaatccgggaaaaccaaaatgggttcggctgcttccggcgaagggctggtaaatgtgtacaggggaacaggaaccgtatggttagcacccttataaacataaaaaaggagaagccccggcttctcctttcttacattttaattcttttttacaaactccgattttagcttcattgctccaaaaccatcaattttgcagtcaatatcatgatcgccatccaccagacggatgttttttactttggtcccgattttcaagacggatgagcttcccttcactttaaggtctttaatgaccgttacagagtcaccatcctgcaggatgttaccattcgcatctttgacgacctttacgtcttcactgcttgcttctaactcggtagaccactcatgagcgcattccgggcaaatgaaaagactgcgatcctcataagtgtactctgaattacattcaggacaatttggtaaattagacatggtattatgtactccattcattttcaaattctactgctatgctaagcttcctggatagaccaagcctgctccaagtctcccttggagttccctacaagtatattggataaacaatcacgattccactcatggatgaaattaatctgagttttgtaccgatacgtaagcgccctgcctctgaaaatacccaaaggtgaacatgtaactaaaacggatgctggcctctctaggcagcatccgttttagacataagcagtatcatatgttgaaattgtactctacggcacgtttattatgcttgggtttgcttgatcagttcactcattccttggctaagcggcgtaagggggcgtttcaacaacttctcgaaatcgttgcttacgacatccaaggctccttcacgaatcgcttgttgaatgccgaccacaatagggattgcaccttccgggactcccgcaccgagcataacctcggcatacgtagcatcatccacctgctgtacaggaacgtctttgcccagaacctcagccagtatcgctgcaaactcttcttgggtaatcggcttaccggagagctcgtatattgtattctcgtgcccttcgccagacaaaacggttgcagctgcttgcgcataatctgcgcgggtagcccaacctactttaccggaccctgccgaggttagccaaggagcccccgcgagtacggattggatcgtgcctgcttcattctccagataccaattattacgcaggaaggagtaaggaatgcctgactcacgaatgaactcctccgtgatgcgatgtacgggtgcaaggaatagagtgctgtcagcggcattggcagcgctagtataggcgatgaagcctactccagcacgtacagcagcatcaacagccgctttatgctgacggattctagtatcattatccccgtctgcggatataatcagcaatcggtctactccagcaaacgcctgatccagcgtctccggtttatcaaagtcgccatgacgaacgtcaacgccacgagaccttaagttctctgctttttctggatttcttacgctaacaataagatcgtttgcggagacaaatgtaagcaacgtatctgccacgatggaacccagttgccccgttgctcctgttaatgcgattttcatatgaaatcctccattcagatttttgtttacttttatatagtaactaaaaatataacacatgtctaatctagagtctaaaggtctgcttttcgggtaagagtgggtaacccaaactttccccagagaaaggaacctgtatatgaagaaagctatgatcattgtaaatccctcttccggcaaagaggaatccctccaacatgtcagcagcgtagaagaaattctacgtgatcaaggatacgttgttacggttaaagagacggcaaaggaactggacgccacccgtttttgcgttaatgcgtgtgaggaagcttgtgacctagtcgtttccatcggtggggatggcacacttcacgaaaccatcaacggcttcatggatcaagaccaccgtccaagactgggtgtcatcccccttgggacagtcaatgattttgcccgtgccttacacattccgctaagtcctgagctggcaatccgtacactgacttctacccgcgtgaaaaacgtagatatgggcctcttaaacggccgaatgtttgccaatgtggttgccacaggttcgcttgctgaatcgctatcagctgtatcatcagacgataaatccatgtttggcacgtttgcctacttcaaagaaggcatgaaagagcttatcagccatcctgcccactcacttatcatccactatgatgacaaaacctgggaaggcaaatccccactctttttggctacgttaaccaattcagttggcggattcgagaaactggctcccgatgcagctgttgacgatggtctacttcactgctttattttcaaaaacctcaatatattgaacaccgtgacggccagcatatccttatttttaggcaacctgaaggatcatagtgatatcgtttactttaccgcaaagcatgtaagtgtcagctccgcagaaccggtcagtacgaatgtagacggtgaggaagggccgtctttgcctatcgagcttggtattttaccgcgtcatatcgaggtaattgtgccggaagacgtttaagtaatgcggtgctggtcctcaagcttgaggatcatactcgctcaatttcccctcgtagatcaaatggaatcgatcactttgacgaaaatcatctggcgtaacaagagcgggcagtttgttccatatttttatgccggatcgctgtaaaatttccgcgacgaattgggaacaaaaataggaattgctgaactcgactggctctttgagtgcaataccaatcaaacccagtaagttatacatatatttttgacgacttcggataaatacatgtaaaactcgcttcattttttcaacttcacggtcggttacttgaagctcgtagataacacatgttgtattcggaaatctgctgtatgtacctgtcttaatatcttctttcacgaaaccaccatccagagggttattaggggtctttctcccgaagctgtataactccgaaagttcccggttgaaggaaatggaggcgtgattgtatggcgctctcgtatagcttttaatgactctcgtaagaaacgttcccgtattcgtaagcaagataaagacggattgatctgctaccatttacgaaatttccccttatcaagtttgaattattccttcataataacatagagccctaatggaaccctatttcgcgataagttggtgagtggtaatggatagttcgctattaacgttaatccttatttttacagccttattggtcatccatctgatttacatagtagtagtcaaaacacagccagacaaagactatgcagctattgggcttcgcatcaagacatggtggggcatgttctttatcttttgcttggcaactcttttcaatccgatcgtttcactgctttccttgatggcactcaccttttttgcgctaaaagaatacttttccatgattagatctagaaaagctgatcgcagattgtttctatgggcatacttggcgattcccgtacaattttattggatttatatcgggtggtacggaatgtttattgtctttatccctatctatgtattcttgctgctaccgcttccgcgattgatcaacaaaggaacggttggttttttgcgcagtgtcagctcgacccaatggggactcatgctgatggttttcgggttgagtcatctggcctattttcagtttgctacgccgcaatacggagcgaaacttgtactttttctagtggtactgacgcagctcaatgatgtcgtacactatctagcatcactctatttcggaaagcggaaaatcgtcccgacatccaattccaatataacttgggaaggctttgcattcgcttttcccgtaactatagcggcctcctatctcatctatccctacctgacgccgtttgacctgaaatttggaattattttcggcatgctgatcagcttgagcggtttcttcggcagcttaacggtttccgtgctgaagcgggatttattaatcggcgatgataataagttcgatgctttgaaaaaaagctacttaagccgggtggatagcttgacctacacctcgcccatctttttccacgtaatccgttatttttttgactttatgtaggatcaactgtatttttcttggaatctctctactctgttttccttcatcactccacgatactctgcttgcttctcacgttttcactttagttagtcggggtaagtacactatatcggaaaagtccttatcccttaaaaacaatcttgaggaggcattagaaatggcagagcacaatcatgttgtaaataaggaaggcgaagtggcattgaacaaagtagatgacgcattaaatcggatagacgacagcaaaaaggatgacattctgagcaactttgattcattcaaaagttatttgagcgacaagattgaaatggctcaaaatattggtctgaatgaagaattgatcgcaaaagcagctgagaagatagctggatatctggcagccaaagaagaacctcgaaacagcgaggagaagctcctccaggagctgtggaaagcgggagacaaagagcaacaacatgcgcttgcccatatgctactacgcatggcacaatcctcgtaagaatacatgctttaggaaagagaggctcccggctgaaacttcgggagcctctcttctttaattcaagttcttatcgctttgaattaatgcacctgatccagcaattgatatgcttcttccttcgttttaaccgccaggagcgcttctctgaaatgatcgtccatcagcttacgcgataacatttgcaatactttcagatgcgcattttccttgctattgcgcggtacggcaatcatgaagatcagttttgcttcacttccgtctgcactattccagtcaacaccgccctgcttgatgccgaagaccacgcttggcttcaggaccgcttccgatttgccatgaggaatggcaatattcattccaatgcctgtggagccttcttcctctctggctaatatcgcctgtttgaaatcactagcagagcttacggctccagttctctcaagtgctccgatcatttcatcaaccacagcatctcgtgtcgttccttccagatccaaattaatcagatccatcgttacaatatccgtcagcttctcaatgtgaatggcttgtggagaaacggctggcccattatttgtaacagttgttgaagcagatgactccgtagcgtccgttgtagtaatcgcagattgtccagcttccccagcagcatccggagttacagttgctgcaatatcttttttcagcaagctcactaagacaaccgatacggctgcgccgacaataacggcgataaagaacataagcacatggtctactgcaccaagtacagctacaatcggtccaccgtgagctaccttgtcacctacattccccaacatcgcaatgactgaaccgaccatggatcctaccatgatactaggaataacacgtagtggatcttgcgccgcgaatggaattgcaccttcggtaataccgaacaaccccattgtgaatgttgccttcccagcctcgcgttccgcaggtgcaaatttacgtttgttgatcatcgctgcaagtcccatcccaatcggcggaatacaaatcgcaacggcgattggccccataatttcataattcccttcgccgatcatggccgaaccgaataagaaagcaactttgttcacagggccgcccatatcaaaggagatcatcgcacctagaatcaatgccagtagaattgagcttgtaccttgcatacctgcaagccaacctgttaaagcttcaaacaattgtgcgactggagcaccgattacaaagacaaagattaatccaacaattaacgatgccaatacagggataataattataggcatgatcggctgtaatgctcggccaaccttgatttttcgaatcccaagtgcaacataacccgccaggaaaccagcgataatgccgccgataaatccagcccccgcctcacttccataaaaactgccgttcgcagcaatgaatccgccaaccatacccggtgcaagccccggtctatctgcaatactcatcgcgataaatccggcgaggatcggtatcataaaggtaaacgaagccgaaccgatatcctgaaccgtcttccagaatgaaccgtccggtataaccagaccgcctggtgtcttctcaccgccaatcgtcaacgcaatggcaatgagcaatcccccaatgacgatgaagggtaccatataggatacaccgttcatcaagtggcggtagatgggattttgtttcggtttgttctcctgtgagctaccttcggcagaacgtgactctgcttggtacacaggtacattacccttcatcacccgctggatcaattcttctggacggcgaatgccatcctgtacgccaacgaccagcagtttcttaccgacgaagcggtctttaaccaccgttttatccgctgcaataataatgccgtctgcctcacggatctcctgctcggtcagttgattttcgactccaatggagccttgtgtctcgaccttcatctcgacgcccagctttgctgctgccttttgcagattctcagctgccatatacgtatgtgcaattccgttaggacatgaggtaatcgccaatatcttcatagtcattccccttctctctgttgtttccgcttacattgatagtataaacgcctatcttgctgttatcggacgaactttttaccggaactttcggaaaaacggaattataccaacaaaaaacaggacctatctataagtcctgttccagagcacagcttttgatttcagtttatcccttcattctccctaataatctcatcgcatcggtctccttagataaggcatgaaccaaagcaggctgctcactgatcagggacaactccttaaataactggcgcatttcttcccgcccatcctgtttgaccgcaagcaagaacacaagctctactttctcggttccccaggtaagcggctgcttcaaggtagcgattacaatggaggactgccttatccactcagaaccgccatgcgggatggctatgcctcccccaatcgtcgtggccgacattttttctcgcgccagtacgctgtccacataaccaggctccacatatcctttgtcctccagtatttgcgccagcttggagatcaattgttccggatgctgcacttcctgctggggaaagaccaaaaaaggtgttgtatatttaaaaaataccgattcttctgctgccctatgttccggctcatccagtcgtcggatcacttgctccagtcgacgttcgtccttgacatccagcaagggagagacgagaatgtgcggaatgttcatctctgggagatctacagtggtaatgacgagatccacctcctgggctgccagatagtcctggacttctgctttggaaagggttgtctccacatgtacagccggaaatttacgttccaccttggtgcgtagcagttgggacataccgatgcccatgtgacacacgatgatggctctctggggatgactctctttctggtgcaatcgctccacagaagcctgaaaatgcagcgttaaatacgccgcctcctcctcggggaaggatagccgggtccattttcccacctcctccagtgtaataataactcggtcgaacatgtaggggtacatcttcttgatctcggccagcataggattggacacggtcaatccatattgaagacggttcagggtcgtatataaatggacattcaaccctttcagtaacatcttgtctttagaaaaggcaatcatattcagctcagacatccgccggactaactgctcaatcaactcaggcaaaagcgggtggctatctgccagctcaccttgttttcctgttcttccctcctgctggtaacggaacttcccgctaagcaggtgcagagttaaatacgccgtctcttccttggaaaaaggcacagcaaacaacttttgcaactgctgcaaaaaagacgtagcccatgtaaattcgcgtctctcctgcaaaaaggcaatgtcctgcttggagagcgaaatgggttgtcccatcttggttcgtttgaccattaagaggatatgcagcatgagagcttcgaaagcttcgtcagtaaagctgagctcatggcgtttttgaaatgcttttaattcatgatttatggttgtaatctcgtgcgattcaaactgtttgcgcatcatctgtcctgttaactcaggactgtcaatcagctggttcatacgcgccaaagcgatgcgcttatttttctcagagcctagaatggtcaatccaacgcgctgcttggtaatcaaagccagatcaaagctgtgcagccagccatcgatcttctccatatctctacgaatcaccgtcttgttcacataatactgtgaagctagatcctggatggtcacaggcttggcattcatcaagagccgataggcgacatgcagcaccctttcctcatccgactcatgttgggctgtactctcgtccgcatacagtcgatggaacaattcattctgatccgcttcacccatctccagataaatgccgcgtcccggccttctcaccagattggcatcagaatgcttgacgatataatcttcaattactttcagatcgttgcggatcgtcttttcagagcagtcggtcagatccgccagatcctgcgctaaccacaaccggtccggttcagttaacaacatgcgtaaaatttccatttgccttttattcattccattctcccatcttccaaaataaagaatgtccagggcatttcgagctatatttttgctggttttgtgttgactttaagtatactccaagtagtacatttaaagcatggtggccgccaaattcaagaataatgaaaagaggaatcgctcatgatcattggaaaaacagctcttattactggggccaacaaaggcatcgggtatgaaacagccagacaattggggggtatgggtcttacaatcctgattggctcacggaatgagcagagcggccgggaagcggtggataagctggctaatgagggagtagaagcccaattgattttgttagacgtgacgaatccaagtactattgattccgcagtccaacagatcaaacaagaattcggttcccttgatgtactcatcaacaatgccggcatatctttaggaggagccactcctccaagtcagttctctttggacgatttaagagaaacgtatgaaacaaacttgttcggtttggtcgccgtgacgcaagccatgctacctttattgcaagaatccccatgcggtagaatcgttaacttgtcgagtggccttggttctttaacctttaatagcgatcctgagcataagcatgcccattttaatttgcttgcttacaatagcagcaaagcagcggttaatatgttcaccgtcacccttgccaaagaattcaaagactcacctctcaaaatcaattcggctgaccctgggtttaccgccaccgacttaaatggctttacaggaacgggttcggtacagcaagccgctgctgtcgttgttcgtttagccactttaaatgatggagggccgacaggaggatttttcgacgccaacggagaagtaccttggtaactgctactaaggagctgaatactttgcaagaaattccggagacgataacctctattagccaagccgcagaactaacaggtttaacagaagataccatacgctattatgagcgaattggcttgctgccttatgcggaacgaaaggctaacggccacaggttctacagtagagatcagattctcggaattatctttttaacccgattaaaagccactgggatgaccctagaggaaatgaagcattatcgagaactttcggagcaaggtaacattacccttcctgacagatactccttacttgaaaaacataatcagaagattcaacaagaaatttccagactgatggaaacccaaaaaattattgagtataagctcaaccattatcgtgacctctctaccaatcctgatcttagcgatacgaattgcaaccctataacacccagcaccaatccccttttttaaggggtttttttattttcagcgggagattgatggagctctcttaattccctataatccaaatatagcatgaatttctaggggggaataacgatgatcacctatatgagatgcaacgatgtcagcatggaacacattttccaagcattttcgcttgggttctcggattattccattcgcccgaccacggatcaggacgatttcgcagcacgtttttttggtcctgagggtaatacacggaatcactctttccttgccatggatgaggatcaaccgatcggcttaattctcggcggtgtccggcagttcgacgggtacaagaccatgcgttgcggcacgctatgcatcgctccggcttaccgcggtcaggggattagcaacaagttgctggaattacataaacaaacagccatctccgcgggttgccagcagctatggctcgaagtcatcaaggataatcatcgggccgtcaaattatatgaaaagcaaggctatcagccacgctatacgctgaaatactacaacggcactctgccctccgccccacccgctgccctctcatcttcgtatatttttaaggaagttacatttgatgacatcgcagcttttcgaaagacccttatcgactgccacatccattggcaaagtgacacaccttattacgccaccagtagacaggaagcttttctcggcatctacgaagtaaatcaaacgtgcctcggcatggtgagcatgagtgctaagggtaaaatcaactttctttgggtcgatcctaagcatcgcaaccaaggattaggatgcgccctccttcatagagcagcagagatccaaaagattgagaaggtgtacatctgtctgtccgacaatgactctcttgaaggctttatccaaaaaataggtctctcgaaagactccattgagcaatatgaaatgggtatgctgctgaaggtcgatcatgttgtacaatgatcaaccttcttcctatccatgctcccctgcttgattcacctaatctatcatttctgagaacgattgatatactctgatttgaccaatgcgcacatgtaaagatcatcatatttccctaacgtaaattcatattgggagaggagcccttcttgccgaaagcctgctttttcaagcaaccgcaaggattgtgcattctctggctctactagcgcctgaatgcggttcaatgagagggtattaaacccatagtcgattacagctgcaagtacctccgacattagcccttggccccaataggctctggacaattcatagcccatttctgcccggtgatgacgttgatcccagttatgaaatccgcaagaaccgatgattttaccttcatttgtttgaatagcccagcggattccctgatctgtctcaaaaatctgatcataccaactaatctcatccagcgcatcctgttcagactcaaacgggctcagtccataaaacttcataacctgctcatctgaaaagtattccaacatgtccttgctgtccgtcgctaccatttttcgtaatatgagacgttcagtcgttataaccggaaactcacctttcacattctcacctcttgctgccttgttcgcttttgccagctcttcttgcatacccatacctcccgagttcaataatcacttatcgttactttcttcttccaattatagaggaaatgggaggaagggatatttataataatttctttgtttatagaatgttttcctaaacatggattataaaatgaccgttaatataaggagtgtgtttttaattattaagaagaggtgtattttttggacgaacagcacatatcacacaatccgcaggaaacttcaagacagacgtacattcagcatggtcaaaattatggagtagatccaaacaggatggcggcgttatcaaaaacatacgggaattctactctgtttagacggtggggagcaacagtttttgattgcatattttttgtaatcgggtatatttgtttttttatttctgtcattcaaataacggacagatggtctttgcctttagcgattgcaatccgttgtattctgcttattgctttcttcagctattatttacttttggaaggttacacaggctatacgctgggtaagttcgtttttcgtattcaggtggttaacggggaaggaaagcctcctggttttcttaaatcactcattcgtacgctgctcaggctaatcgacaccaatccattgctaatgggtgggatacctgctggtatcagtgtgttagtaactgcatcaagacaacgaattggagatttagctgcaggtacatatgttgtaaaggtacgggatttagagccgattagcaaaaagacaatgaaacgttcgctctttatattttttaccgcaatggtgatcttgggagcctcgtttgtaaatgctatttttatacttgcagacagttacgtacctcctgaagttccggtgagcaagaaagagcaaagctatgtaagtaaagatggacgatttcaaatcacggccccgctggactggtcaacagacccggaccgtgaaggaaaggcagagattgcaatatttaatccgtacatccaaaagtccgttgtggtactatcccactcaaaaaagcaattgggcaatataactctccaacagtatggtaagaaagctgaaaataacttaaccaaagagtggaacctgtccagtgtaggacctgtctctaacacaaccatttatggatatcctgcccttgagttcgtgattaaaggcaagaaagatgtggacaaatatgttacccatgtagcgattattgagaccgaaagtaattactaccaggtgcttggatatgcaccagcgtctaaagatgcccgtttaaagaaagaactacacgacataacctatagcttccgcgaggttcgtcattagacagcgtggctggcaataaaaaggatagacacaaaaagcaggtgctcctatgagccctgtttttttgcgtacaactatactcttccttagattacactcaatacaaaaatatataacatcgtctaatggattatcataatacgctgcaatttcacatctatgataaaattgactgacatgttcggtaatccgccttatcatattgttcagatgcacaatgaattgaaaaccctttcattaaggtggtacattaaaatacgctatatcactatagataaaggaggaatccggattttgtttcagctctccgaaaaacaagcccaagacatcgtagacaaaatgatgaaggatattccatacaatatcaatattatgaatgaacgaggcatcatcattggcagcggcgagagtgaacgaatcggaaccattcaccaaggagctgttcaggcgctcgaaactgggaaaatggttgaagtgtggcaggacggccactatgagaaaaagggaaccaatgaaccgattgtcattcatcatgagttagttggtgtcattggtatttcaggcaatcccgatgaagtgcgtcctttttgcaatattgttaaaactacggtgtctctcctgattgaacagcgcatttcgctggagcatctggcccatgaagccaatcgcaaaaaatctgtgctggaaatgttgttaaatcatcaaggagcctacacacaaaaaataaaaaaagaagcagctcaatatcacattgatttgcttctaaaaacttcggctgtatatgtaaagtatctgcctgctgatccagctcatttagccgagttgtccaatatattcatgcagcatccgtcctttcgtatggaggaagactgctatctcatcctgatacaaaatcaggagccgacagacaaactgctagagccacttgtacgcagccatcccgatgtgctgattacggtcagcagacaggagcacaacattgcggatgtttatatgcaagccaagtcagctatgaatgttttactggctttgcgcccgcctgtgcaaaaaatttcttttgcggaagtcgagtttctggtcaaattgagtcaaacgaacctgacgaacacgatctatctggttagcaagctggaagatactgtggatttgctggatacgctacgaagctttattaaccataacggcagtgtctccttcaccgcagatgaattaaatattcatcgaaatacgctgcaataccgcctgaagcgtatccataccttaaccggtaaagatccccggaacctccttcagctttttgagcttacgcatggcttattggcactgtatcaatgaactgctgtttcacgccagaccatgcgccagtaatatcatatttccgctcgccgtcactcccaaattcctcagtcaatccagctttggctaagttcgggattacaggcgagcgctcgtattatatcgtatttgtatgatgccgttttatgtttataacccacttctccatctgttcatttctcgctgaactgaagtactcttgcgatattctcgcacgtacgctctacgttttgcggcccttcggccagcagcttaccgagctccgaggctcccggcacgatgccaaacaccgcatcgatcccttccttgtacaacgtgtcgatcccgtccccaatataacctgcgaccgcaatgacctttttaccagactgttttgccgcctgagctactccataaggagttttaccgaatttggtctgaaaatcaataccgccttcccccgtcaaaacgatatcggcagtggcgagcttttgttttaaaccggtgtattcaatcacaatttcaatgcctttttgcagcgtcgcctgagtgaaaattaataggcccgcacccaatccacctgctgcgcctgcgcctgggagatcgcgcacatccttgcccagctgctgtttcaccacatcggcgtaatgagcaagattggcatccaattgctgcaccatctccggggttgcccctttttgtggcccgaatacttgagatgccccatgctctccgcacagcggatttgtcacatcacaggctacaatcagttgtacctgcgacaagcggccatccagtgatgaaatatcaacgttggccagctcgcccagactaccgccgccgcgcggaagagtattgcctgttgcatccagaaatctggcgcccagcgcttccgccattcctgtaccgccatcattcgttgcgcttccaccaatgccgatgataatttttcgaattccctggttcagacattcacggattaactcccctgtgccgtaggttgttgtctttaacgggtttttgttatccttgttgaccagatggattccactagcagatgccatctcgattgccgccgtggtgccgtctcccagcaagccgtatgcagcagttacaggttctccaagcggccctgtcacctcgatataacgaatctgcccgcctgtcgcatctaccagtgactgcaccgttccttcaccgccgtctgccatcggtacgtggacataattcgccgccggatagaccttgcgcagtcctttctccatcgcgatacacacttctttagccgtcatgctttctttaaaagaatctggtgccagcacaaatgttttctctctcatcttctcaccccatcgtgaatattaaagtaaaaatccatacataattgtcgctacaattgccatcgttccacccacaatagcttcgtaaggaatcaatcccatccgttgtttaatgctcattttcatgctgtctgccgtgacgtgaaaatagttgccctgcggcaaggaatcaatgactgtagctcctgtatgcaccatcacagctgcagcgagtggggctgttcccatgttcagaatggcttccccaaacgagcctgttgccaaaataacgcccgtcgaggtggacgccgtagcagctgccatcagaatacctgcaagcggtgccaaaaatgtaccggaaacccccgaagcttcaatcaggccaaccacctgagcagacaagttggaggcagagatcagacccgcaatcccacctgcaccgatcaaaatcagcacggtcgccgtcattttattcaaaccggaggccgaatacttcaggatattgcgcccttgtcccatggccagcatacccacaatcccagcgatcggcaaaatgtacattgcatccaccttgaaattcgaaagtgcttcaataccagagatggaaccaatcgggttaatcatcagcaaaataacagctaccagcggggctacaatcgcccgtcccaacgccgggtatttcgatgtatcgacatcactgtccatgatatcctggtcggacaccttcacacctttggttttcaacaaagatgccaccaaaacagtcatgattaaaccgcatatcgcaggaaccacacccgccaacatcacgtggcttaaatccagattaaatccgcgcgccgctgcaatcgtattaggattgggagagatgatgttccccgcttttccgcctccagacaaagccaacaggagcgccaacttggaaatccccattttgttaccgaccgacaatgcaataggtgccacaatcaacacggcaacgggaataaatacacctaccgccgtaataatcatcgtcgccaaggctagtgcgagtatcgctttactgccgccgaacttctttacaatagcctgcgcaatcgtctccgctgccccggattccatcattacacctgccaatacacctgcggcaagcacacgaatgaccgtccccatcacactttgcgtaccgcttattaacacgctgatcgtctgttccaaattggctccgcctaataaagcgcctacaatagctcccaaaaataaagcgtaaaccggattcagctttcttaatatcagaataattgcaatagccagccctgccagagctcctatccaactgatcgtcaatccttccatctgtctaaccccccgggcaatttttgattacgctttcattatatcgattgccgcacgttaaaaatattgaagaacagacgaaattgattgtgcatttgaacaaaaaatccgaacttcaattggaacctttacaaaacaaatttaatgaatacgcttgcaaatttaaaatttcagattataatacctgtatacaagtatacttgattaattgagaaggtgaaatgatggtcgaatcagaattcctatatccctccaaatggcttttaaaagcctcagctggtgatcgcgtaacatccgagcttagaatgcgcattatttctggcgggattgaaagcggtaccatattatctgaaaataaactagctgctgatttcactgtaagtcgctcacccattcgtgaagcgttaaaaatactggcatccgaaaatatcattcgattagaaagaatgggagccgttgttattggcctatcagaaaaagaaatagaagaaatttatgatgtccgtctgctcatagaatccttcgtatttgaacgtcttgtaaagatggacactaatgatttggcgaaggaacttagtaaaatactcgaaatgatgaaagttgccgtcaaatatagtgatgctgatgagttttcatatcaagatgtcttgttccatgaaacgattattcgtgcagtcaatcattcacatattctgatgatctggaataatttaaagcctgttatggaaagtctcattcttttgtcgatgcgtatgcgtttcacagaaaagtatgaagattttacacggattataaacaatcacgaactttatattgaagcaatcaaagtaaaagatagagacctcatgatcaagtctttacatgaaaactttgatgatgttcaaggtaaagtagaagacctatggatgtcacaacaaatgctatctaaaggagtcgtgcaacaaaatgactaactatatgttgggtgtagatatcgggaccacaagtacaaaagccgttctatttagcgaaaagggccaagtcatccaacaagagaatattggatacccgctttatacaccggacatagcgacagctgaacaaaacccagaagagatatttcaggctgtcctacaggccatttcgaatatcatgaaacatcactcacaaaaaaagctatcgtttgtttcatttagcagtgccatgcatagtgtcattgcgatggatgaaaatgaccgcccactgacgtcttgtatcacttgggcagataatcgaagtgaagcatgggcacataaaataaaagatgagctgaatggccatgaagtctataaacgaacaggaacacccattcaccccatgtcacccttaacgaaaatagcctggattgtgaatgaccttcctgaaaccgctgtcaaggttaaaaagtatatcggaattaaagaatatatttttaaaaagttctttgatcagtatgtagtggattattccctagcttctgccatgggcatgatgaatctagaaaaattagattgggatgaagaggcattaaaaattgctggtataacaccttctcaattatctgagctcgtgccaacaaccaggatatttaccaactgtgattcagatttagcaaaaaagatggggatcgatccacaaacatcgtttgtcattggagctagcgatggagtcctttctaatctaggtgtaaatgcgatacgaaaaggcgaagttgccgtcacaatcgggacaagcggtgccattcgaaccattatagacaagcctcaaacagacgaaaagggaagaatattttgttatgccttaacagaaaagcactgggttattggggggccggtgaacaatggcgggatggtccttcgctggatccgtgacgaacttgcctcatcagaagtagaaacagcgaaaaggctaggaattgatccatatgatgtactaaccaagattgctgaacgtgtaagaccaggctctgacggattgttattccatccatacctcgctggtgaacgtgcgccattatggaacccagacgtacgtggctcattcttcggtttaacgatgtcacataagaaagaacatatgattcgcgcagccctagaaggagtcatttacaatttgtacaccgtatttttagctttaaccgaatgtatggacggtcctgtgacccgaattcaagctactggaggcttcgcaagatcagatgtttggcggcaaatgatgtctgacatattctcatctgaagtcgtcgttccagaaagctacgaaagttcttgtctaggagcttgtattttaggcttgtatgccaccggacaaatccagtcctttgaagtcgtttctgaaatgattggcagtaccaacaaacatacaccaaaagaagaagcgaccaaggaatataggaaattgctgccgattttcattaacctatccagagtattagaagatgattatacacggatttccaattatcaaagaagcttaattaaacactaaaaagataaaaagcagggggtaattacaatgccattagttatcgtagcgattggaattttagcattattagttttaataatgggtttcaaattgaatacctttatttcattaatcattgtatcgttcggcgtcgctttagcacttggaatgccattagaggaaattgtcaaaaccatcgaagccggattaggcggaacccttggtcacttagcgttaatctttggacttggagcgatgttaggtaagttgatcgctgattctggtggtgctcaacgaattgccatgaccctcgtagacaaatttggtgaaaaaaatatccaatgggcagtcgtagctgcttcattcattatcggtgtggcgttattttttgaagtaggattagtattgttaattccaatcatatttgccatttcaaaagaattaaaggtttctattttatatctcgggattccgatggttgcagctttatccgtaacacatggtttcttacctccacatccagggccaacagttattgctggtgaatatggcgcgaaccttggtgaggttttactttacggtttcattattgccattccaaccgttattttagctggacctgtatttactaagcttgccaaaaaactcgtacctgcatcatttacgaaaaccggtaatattgcctctttaggtgaacaaaaagtatttaaatccgaggaaactccgggatttggtatcagtgtatttactgcaatgctccctgttattttaatgtctattgctacggttattaccttgcttcaaaaaacaatgggatttgaagatagcagtttactagcagcgatccgttttattggtgatgcatcaacttccatgttaatttccttactggtagctgtgtacaccatgggaatagcacgaaaaattccaatcaaaactgtaatggcatcttgtacaacggctattactcatattgggatgatgctcttaatcattgggggtggcggcgccttcaaacaagtactgattaatggcggcgtaggtgactatgtagctgaattattcaatggaactacattatcacccatcttacttgcctggattatcgctgcaatattacgaatttccttaggttctgcaactgttgcagctttaaccaccgctggtttagttattccgatgttaggacaatccgacgttaatcttgctttagttgtgcttgcaacaggagcaggtagtttaatagcttcacatgttaacgatgctggtttctggatgtttaaagaatattttggtttaagcatgaaagaaacatttgcaacatggacattacttgagaccatcatttctgtagctggattaggatttattttagtactaagtttattcgtataaatcatgattcccgggcggtagatccccacttatttttcttagaatcttctaagcctataagtgaggatctacggcctattcatttcaaataaaaggagcagaaaaaatgtccaacacaattggtgtcattggtttaggggtaatgggccgtaatattgctttaaacatggctggtaagggtgagcaagtcgctgtctataattatacgagggatttaacggatgatcttgttaaaaaaagtgaaggtcactccatccacccctactacgaaattcaaaattttgtttactctttaaaaactccaaggaaaatcttccttatggtaacagcgggcaaaccagtcgattcggtaataggtacattagtacccttccttgaagcaggcgatgtgatcatggacggtggtaactcccattacaaagatacggaacgtagatatgatgaattgaagtcaaaaggaatcggttatttaggaatcggtatttccggcggcgaagtcggggctttaaatggaccttcgatcatgcctggtggagataaaaacgtatatgaaaaagcagcttctattctaacaaaaatagcagcccaagtagacggagacccttgctgtgtttatatgggtccaaaagggtccggtcactttgtaaaaatggtacataacggaatcgagtacgcagatatgcaattaatcgcagaaacctatacatttttaagaaaaaggttacgtttatctgtgaatgaaattgctgatatctttgaaatatggaatcaaggggaactaaaaagttatttaatccaaatcacagcagagattttacggaaaaaggacgatgtaacaggcttaccactaatcgatgtgattcttgataaaacagggcaaaagggcacaggtaaatggacaagcattcaagcaattgacaatgggatcccatcatccattattacagagtcattgtttgcccgttacatctcctctttaaaagaagaacgagtttatgcagaaaatattctaacaggaccagggattgatcagcgaagtttagataaagatgtgtggattgagtacattagacaagctttttatatgggtaagatttgtgcctacgcgcaaggatttatacaatataaaatgacttctgaactttacggatggaatttacctttacaggatatagcccttattttccgtggtggttgcatcattcgtgctgaattcttaaacgtaataagcgaaacatatcaagaacagccgaatttggccaatctattaatcgccccgtattttgctgaaaaggttaaagagtatcaaaaaggattgcgaaaagttgtctgtgagggtattaattctggcacttcgtttccatgtttaagtgcttcacttacttattatgatagttaccggacaggcatttcgaatgctaaccttttgcaagcacaaagggattattttggtgcccatacttatgaacgaagtgatgcagcagggtcctttcacacaaactggcagtgatcgatagtggtagtaaatctccagtgtctatactatttcatctcatttttgaacgattgaactcgttgcttctgttgttccttttgcctcaccatgtcctgcaccaaataggttcagtaccaccacgccaataacaattaaagcaatacctgcgatacttcctgtattgattttttctttccaaatcaatactgaaataagcgttgtagcaacagttcctacacctgaccagatagcataagtcatatttaaggggagcgtcttaagggataaggagataaagaagaaagagatcacgaacgccacaattgtgaataaagtcggatacagtctggtgaaaccttctgaagctttaagcattgaagttccaacaagttcaccaacaatagagattgccaagaaaagataagccattattcattctcctttatatatgttttcaattctcccatcattttttgcctcatttcttcattgggaggagcaagcccaaacatttcagcaaaccacaaaccgtctatagctaatcggactatcgtggaacgaacggggtccaattcgtcgttttcaattttattttggatattctcatactcgtcctgaagtaattttagcatgtgagggttcgtaaactgtgctgctgagagagcggtatacaggtcacttgcattccgatcgccagaaaatgatgtattcatatacgcgcgagtccatcttcctttggaatgcatatcgttttctgctctctcattaaattcggagacaaagctggtcgatagttgttcaaccattcccaaaatcaattcatctttattcggaaaatggtaaagcaatcctcctttacttattcccgctttcttagccaccgcttctaacgttaatttctctactccttcttcgtgcacaatcatcgaggccgctttaagaattaattctctttttaatgcttttttagttgtattcatattgatcacccctctttactataccgtccagacggttttatttcaagtgggttaaagttatggattgggtatgtaagcctaattgagttggattaggttttgatacgttaggtttaagctaaataaaaagaagccttgggcgtataacatttcagccaagacttcgtcaaataaacatctacccagcccagacatttggcaaaagttcgcatctgttgggttttaagtgccacttatagtttaactctgcacatattgtctcagccattggagcgcgggacgttccgtgccgttagaattcagcagatgtgtgttcggcttccaagtttgtccctcgatatacccccagagcgtaactcccttcaccgcagaatgcttccataataccggaaatttctccttgtatctggcaagctgggtgttgtcgtctccagttatatccagttcggacacatagattggcaatcctgttgccgccagcttgttcagtacagtgttcatcgtgttaactgaaacagtgtccatgctaaactggtggcattgaataccaattccgtcaatcaggcctctgctcttgagctgattaataatattgacatattggtcggttaacgagggatcgttgataattccatattcattaatcatcagcttggcatttggaaaagcttgtcttgcctgttggaacgaccatatgacccaatcccatccggtcgatccgtcaccgcctatggcattgcggaaggatggcttctgatgcaggggctcattcaccacatctataaactccgcattcggatagcgttgacctgctgctttaatccactgggttacttccgccttctgatcaacagccgacagtccgctaatccaacctggctcctgagcaccccataccaatgtatggaacttgaacgggaagccattgttacgggcataattgtaggcggtatccgcctgcgaccagttcatgttgttacggctgccttcaaccgacccccatttagtcgaattctctggcgtcacctggttccagtacgttccgaaacttgcagggacactaccagcaatgatattcccgaggaatttgccaccgttcgccatactggcactagccgggtttatcagaactgatgataacaacacacccgccaacgccaagctgcttaccaacttgcccactttaaatttcgacatacaatctcctcctcatacgtatagtttttaatattcctatctctaaataaatcgcttacatttccaattataagaatgaaaggttattgtccgctacatgtaaaagtaaagattttacccgaaaaactttacatcattgcggggtggctgaacaccctggtgctcctttaacacatcgtttcgattaaaatctagccagaacgatcatttattgataacacgatagaggtgacacttacactgcttaagtaattcggagtgaattcaatttttacgaacgggaatcactatacgacagtttaaagggcacccaatcgggtgccctttgtgtgtaacacatgttttcacatatgctgatataaaacatgcgtaacaattgcggataaggatggaagttttattaatgcccgcgatgtttttctttcgcttttttctcctttaattcccttatccgtgccttcatggattccctttgctgtttagagtaagcatgtttctccaacttgcgcttctcatactctaactttaaggcctcttgtgcgttggaagagacccccttctgccttaattcatacgctgcctgtcttgctagccgcttcggattgaccttcttcgtttcagaccactttatagccacctcttgtgagagccgaccaacaagttcccacatttcctcacggataaaatggagaatttcctcgtccttaggctctgtaccaaagatgtgcctagctgccttcaatttcccttggtcctgctcttccacgactccaacccaatactgtccatcatgataaactgtaagcttcattttaatccccctcattttaaatcgaaacgatggacatcccgagggggggaaggttactgacatggtactcttggaatctgagagtcattcatgcgtctggactaccaaccagactgtgttttttcgtcccagaaaaagtatagttgccttactggaaaacagcaagacgaaaagattaattctgtatgaaattgtaaaccgctgatatgtattagagtgaacctggatatagagtatactatatgagtataagttcgatacacgatgacattatatatgtaatggtattcaaatacagcgcagaagaggttgaaaatgagtcagaagcattttacagattacgcattaagtgaagaaattgtaagagcgctgaatagcttgggctatgagacgccaacagagattcagacggaagtcattcctgttgcgcttgagaagaaggaccttgtcgccaaatcgcaaactggtagcggcaaaacagcagcatatggtattccactttgtgagctagtagattggaatgagaataagccccaagctttaatcctgacgccaacccgtgaacttgcattacaggtcaccgaggacatcacgaatattggacgctttaagcggataaaagcgacgcccctttatggaaaacatccttttcatatccaaaaggccgagttaaaacaaagaacacatatggctgtaggtacgccaggacgtgtactggaccatattgaacgaggcacgctatcgttagatcgaatggcctacctcgtgattgatgaagctgacgagatgctgaatatgggctttatcgagcaagttcagtcaatcattcaggccctgcctagtgaccgggttaccatgttattctccgctacttttcctgaggatgtagccagactgtcacacaagtatatgaacgatcctgttgaaattgaaataaaagcaaccggtataacgaccgctacaattgatcactctcttattcaggtgaaggagtcagacaagctggcactactgcaagatctgctgattgttgagaatcctgacagctgcattattttctgtcgtacgcaggagaatgtagatacattattcagatcattggctgatctcgaatatccatgtgatcgcattcatggtggcatggagcaggatgagcgatttgaggtgatgaatgcattcagaaggggtcaattccgttacttgatcgcgacagatgttgccgccagaggaattgatatcacgaatatcacccatgtcattaactacgatatttctcttgagaaggaaagctatgttcaccgcacaggacgtacgggacgtgctggcaaaacgggtaaagccatttccctcatcactcctaaggatggccgaagattagctgatattgaagcatatattgggttcgcgattccgcaggtaaaggctccctcagaagaggctgttgacctccgtagagaagattttgagcagaaactgcatgtaaaaaccgcactcaaaaaagataagcgcgagcaattaaaccaacagattatgaagctgaattttaacggcggtaagaagaaaaaacttagagctgtcgacttcgtgggaaccatcgctaagcttgacggggtcaccgcagatgatatcgggattattacgattctggattatgcgacagatgttgagattctgaatggtaaaggtccactggtgcttgagattatgaagaatacaaccgtaaagggtaagctgttaaaggtacgtaaagggaataagtagaagatacgcagcataaaagagagtgaggcaatcccgcccagcatagccgatggttttcgttagctatacgggcgggattgccgagtttatctcttgatcgtttaattcatctttccattttgaatttgcaagaaaatcgtatgctctcttggataaaaccatatcgtcatcttcacctaatccataggttattttgaaaaagcactcctgaatcgtttcagagtttacttactattgcgacgtctaaagttattaaaaatgtaatgtctaaatagaacaattgaaatctcgggtagcaatacagcaaatatgtataacaatataatgaatggtaatgacgaaatgaaaatttcagcgccctggtttgttttcacacgttcaactagcagccaccacttaggtacggatatattccgcaccaagacattagagatgattacataaaaagtatttttccataacagacaaaacaaaattgcaataatggccggaacagtccatgaacctatcatatgaccattacttaatataacaaatgttataacaggatataaaagtgcaactaccatttggactcccctattatcataaaacttcatttcccatccccttttttctttacaatctatttttaaatttttggataggcatatttattattctatttatttccacaataaaaatccaagctctatgaaatcaacaacgttggtgataattgttctgctttatcgtattctcttagagggttgatttaatacttaaaaaattttagaaaagatgtccctttggttcatcttcatttgttatacagatatagttttctttttaatcagagggggtgcctaaatctttgaatgaggaaatcgaatatagaattaaacgggtccaagctggcgagatccaggattacgcctacattgtaaaggagtatcagcgtcagatttttgtgtactgctggcggatattaggaagtgagcaggaagcggaagaggctgtacaggatattttcgttagtgctttcgagaaaatcagtatgtacaagcccacagtgggcttctcctcctggctgtataaaatggcttatcatcactgcctgaacctgattcgcaggaaaaatctacagcgcaaatttaaaattaccctgttcaactcaactaacatgacttcagacagcgctgcgcaggttatggaacgtcagcttttcagtgaaccgctaagccgggcattgggccaactgaatgcagaagaacgaaacctgctggtgctacgcatttttgaagaaaaatcgtttggagaaatcggggaaattatgaacaaaagcgaggaagctatcaagaaaaaatacggcagaacaaaaacaaagctaaaaaaaatgatggagcccataaaggaggacccaaaatgcgtgaattacaagacagaactcaggaacaaggtctgaaatacaccgatttgaaagacaaagactttaaaaatatggacatgttgacggagccagagaacgtcttaaaaatacaagcctttgacgtctctgacaaagtgatggaacaggtctaccaaaaggtaaaacccaaaaagggactcatcgtaaaaatgcgtcttcaaccgcgcatcaccgctcctattatgatcttactttttgtattgggcgcctctgtgactgggtacgccgcttcgcaatatctggaattacgtaacagcaaaggcgatgtcgtattaaataccgccaaaactcctgccgaaacggacgcttcccaaacgtatacaaccacctacacacagtggaacgaaaaggtgagagaccgtctacagcctggagagtatgccgcctattacgttaaggacgattctatgaatccaagaaattcgtctaatcctgtcctatttgcatacaaaccgactgaactttctagcttcagcagtctgcaggatgaaatcaagcgtacagaagccccactattccacaatcctactcatctgccgaatggctaccgatttgatttcggatacgtctatccagtcgctgcatatcctgggatgatgaacaaagaggaatatcgggctttaacggataaactgatgcaacaggccaaggccgcaccgaaaggtgaaaatctgtttattcaaaagctgagctgggacaagtcagacttcacctttgcccggtatgcaagaggaaatgactatgtaaacatcaccgtcaccaagtacgctcccgaagtcacaaagacgaccgtgatgcaaaatgaacaggattcggctgaggaactgatgatcaaaggaaccaaggcctattacatcagggcaagcgaaacaagcacgcccttggaggtagggaaaaaccgactgggttggcttgatgaaaaaaggcgtttacactacaacatatcggataaccaggacagcccgctgagcaaagaagacctggtaaaaatagccgaggatttgcttaacggttcaccgcaatagctataaaagaaaagatttgaagagagaccatccttttttaagggtggtctctttttggagaatagtccttataccttttcctcacaaactattacggcatgttccacaatctttttacctcaactaattcctgatcattgaattccattctgttatttgaaaagcatctgacttgcctttatcagtcaaacctcttgttctttcatttccttccgtcttcggtgattcgccatgtctcaccatgtaaatgaaagttttcatagtatcctccatgaagagctgatgaatttttattacatgatattcgtgactaactaccaagtcaccttttgctagggcggttttctcttatttcttattgcataaatttttcttgaaggtgacgttgcgtcatttgctatactgactgagaacgacatactggagcaatcaattggatgtgagcaatggatggacaaagagaactgtctgacgacaggacagcttgccaaacgtacagggataacggtcaggacattgcgatattacgatcaaattgggcttctgagtccaggaggtcaccgcactggatccataagactgtacaacatgaaagatatggaaagattacagcgaattcagatgttgaagtatctagggttatcgcttcaaaaaataatggacattttagatgcagaatcgccatccaacggagagatcagacattcgttgcaagcacaactcgatgttttacaaaagaaaattgcccatacggagcacgtagtgcatgcaatacgagatgctatggaaatgtcggcctatggctccgattggaaccatttggcggatgttatccaaaccgtacagagtgagcaaaattggggggagcaatatcggacggcgaaccgcctgcaaacgcggatacatctttacgacaagtacagtacgaatccccaaggctggcaccgttggatctttgaacaactggaggtgcaaccgggagcccatattctcgagttgggctgcggcgacggaaccttttggataagaaacgccgaacgaattccaagcagctggcgtatcacgcttaccgatatgtcaagcgggatggtggaagaagtacgttgccgcttgggaagcaacaattcgcagtttaagtttttatctgttgacgcgcaacagatccccttccatgaagagcaattcgatatggttatcgctaacaacatgctgtaccacgtgccggacatccctagagcaatccgcgagatgcaccgtatcttaaagcaaggaggtatagtatgcacctctacaatgagcactcaacacttacaagaggtcgaacacttggcggtttcgttcgatcctgagcttcatgtgttggatcatgctattaaacggttccacctggataacggaggggacttgctgtcttcttgcttttccgatcttcggttgcttcgatacgaggactgtctgttggtcgacgaagcggaacccctgatcgaatatataatttcgactccgatgaacgcaagagagcgacttgtcggagcggctattgacaagtttcgagaccacatcaatcggcttttgcagcagaacggaactctcgaaatgactaaagagaacggaatctttctagggaggaaatgagatgaaggcacaacagtatcacccaagagtacggattgtaaaagaggagcttctatcggataactggtacatcttaaataaggtcacattcgagtttgaaaaaaataatggacaatgggagacacaatcccgtgaagtgtacgatcgtggcaacggcgtaacgatcctgctctataatcagcacaaacaaactgttgtactgaccagacagttccgaatgcctacttatcggaacggtaatgaaactggaatgcttatcgaaacctgtgcaggattactcgataaagaaacaccggaagaaggtattcttcgggagacggaggaggagacgggataccgtatcgaccgggtgcagaaagttggcgaggcctatatgtcaccgggctccgttaccgaaatcctgcacttctatatagccgagtatagtgaagatatgacaacgggtggcggtggtggccttgaggaggaacaggaaaacattgaagtgatagaacttccgtttgctcaagcgctagacatggtcgaaagcggcgagattcgtgacgccaagacgataatgctgcttcaatacgctcagatccagggcctcttgaaagtgaaatcgaaaccacttcatatccttatcgcaggcccttatcgatctggaacgaatgatgatcatgtattaatcgagaagaacgtcaactacatgaatgaaattgctcttcaagtttacgaggctggtcacatgccggtgctgggagagtggtatgctttgccccttatcacgacagccggttccactgctctgggagatgagacctttaacaaaatctttcacccgtcttccattcgcctgcttgattactgtaacgccgtgcttcgggttggaggaccctctcagggtgccgatgaaatggtaagggtggcgaaagagaaaggattgttgatttacgaacggcttgacgagcttccgttggtgtgatatatcctccttgaccagaccaaagacaacttgctttgggcctcctcgacagatcacccgaagaatctctcaatcaactgagacactaagggaattgcgcaaatgtttaacatcactcatcggtggacgcccaaacatgcgtccatattcccggctgaactgcgaagggctctcatagccaacgcgaaagcctgcattggcggcttccactccctccgagagcaacaagcggcgtgcagtctgcaatcgaatggccttctgatactgcagaggacttatagccgttacctttttaaaatgcttgtgtaaggaagaagggctcatgtttacttccttcgccaattcttcaatcacaagaggcttagagtaatcgcgggttatcagatggatcgcttgggagatgctatgtgcatagctaccaactacggcaaattgcctgattaaagccccctgctcaccttgtaatacacgataaaggatctcgtgcgtgataagcggcgcaagaaactgaatatccgcaggcgtatccgaaagtctgacaagccgaagcagcgcatcaagcagcagagggtcaaattggctcactagtatgccgcgtccagtctttacggtacattgaggaggactcttcttgataatgtccagaatgacgtctgggctaatggataattgaagacttagataaggaagctccgacgaggcttgagttattttaccaattacgggaagttgaactgatgtgaccatgtaggttgttggatcgtacacatagttttctccagccagcattgctgtctttgagccttgtgcaaccacgtacagggagggcatatggaccgtatgattcagctcggacacatggcttgcacgtctgaaataaagtcctggcacagacgagacaaacgtaccatccgaagacgcatgttgatcaattagatgaatcagttcctgtagattcgtagaaatatcagaggggggaggagacgaaatcattcatgcttcaccttcctttccgttgaacgctaatattgatgtgctaattatatgcgcgccgaataggattaggcaagaattggacttgatcggtctacctgtctcaatcgaattctacttaaaatttacttgcaaggccaacagagggcctaaggcaaatagatcaaaggaagaaggattgggctatgcatttggaaggaagaatagagaacaaagtcgtcgtgattacaggtgcaagcagcggaattggagaagcaacagcactgttacttgccgagcgtggagcaaaagtcgtgcttggagcacgcggagcggagcgccttgaagcgctggcgacacgcatttccaatagaggtggcgaagctgtttatgcacgcactgacgtgagacggcgcgaggatctgtgcaatctcgttaatttggcttgcgaacggtatgggaagctggatgttctcgtcagcaacgctggcgttatgcccatttcccctctcgaagatctgtgtgtcgaggactgggaggacatgattgatgtcaacattaaaggcgttttgtacggtatagccgcagcgttgcctatctttcgcaagcagggttctggacatttcgtgaacatcgcttctgtagcaggacataagactgtgccgaaccagtcggtctactccggtacgaagttcgccgtgcgcgcgatctcagaaggattgcgccaggaggctggcgacaagctgcgcgtgaccatcatttcgcctggtattgtgcagacgaatttcacggagggtatgaccaatccagcattaagagatcaactcgctgccatccgggataaactagccatgacacctgacgcggtagcccgtgcaattggattcgcaattgaacaaccggccgatattgatgtgaacgaaatcgtaatccgtccaaccgcacaaatgtaatataaatagataggggcaccttctcttgtctaacagaatgacagctaaataaaaactctgcaactaaagatacaaaaagacatggactctcattgctaagagtctatgtctaattttagttagtatattatttatctttttgactataatccttgatctttcttataaccaaatgtccaagtcaacccgaatgatactgcgaatgatactacattcaccaagatatataacggtaattgctcattaagataaagtagtgtccccggaattcctgttaatgccatacctgttgcacgtaaatggaaaatagaggctagaaaaccaccaactccaccaccaatcatagacatcacaaaaggttttactaagcgtaaagtaactccaaaaacagctggctcggtaattcccaatgctgcggaaagagcagaaggaaaagcaatttgcttcatttttggcgaaactgctttaattgcaacagctaaaactgctcctgcctgagcaatattcccgcaagtcccaataggatttagatagttccagccatcttttcctaacatgctgatttcaagaaagttcaggatatggtgaacaccgaagatacctaataactgtccgaaacttccataaattaagccgccaatccccaatggtagattcaataggaactcaactgcatataaaacaccgatttctacttcatggaagattggtccaacaataaatagcgctaaaattaatcctgataataaagttaaaaagggagtaagaattaagtctaaagaatctggaattttctttctcaagaagatttcaatttttgaacctagaatacctgctacgaacgcaggaagaacagaaccttgataaccgacaactttaataaatccaaaaaacgtaagtggctctgctgcttgttgaccaacctcataagcgttaggaagtactggactaacaagcatcaatcctagaacaattcctagaataggtgttccaccaaaaattctaaatgtagaccaggctactagcgctggtaagaatgcaaaggcagtatcagtcaaaatttgagtaaacattaaaagctgttgtggaatatcattaggagtcaggccaacaagtcccaataacgcttcttgagtgaataaacctcgtaatcccatgaataaccccgtcgcaactaatactggaataattggaacaaatacatccccaaaaactcgaatcgctttttggaaagtaaccttttgagattcatttgaagcctcagttgccttcttacccgagccattaagcattggagcaaattcatcgtaaactttgttaaccaatccagtccctaaaataacttgatattgcccggaattaaaaaagctacctttgactttatcaattgcctctactcctttcatatcaattttatctttatcgttaataataattcggagtctagttgcacaatgtgtcactgattgaatattttcatttccaccgactaattctaaaattttttcggcgatttctttgttactcattcgttttcctcctcataagagtaaaaattaatcatacccttctcattcaaactcttatattcaatattacgattctgctcatcgcaaaaatatctcattgaaaaaacatactgtccatcattaatgaaaatttctaaagtagagctgtcacaaaaaatgtgcaacttcgttaggtcctttacttgaagaatttttgtttccaatttctcagtaacccaattaattcgtccaatctcaagttttccacaacgatatataattggatttgtgttggaattcaaagacactgaaaaatcttttatagcttcatcaaaatcaataatgagttcaaaggctttactattgttagaaataatgccgtattcatttttgtattcttgctctctcttcctcaaattctcgtattctttcaaggggacttgataaaggtgattatcgatccacttcagttctctcggcatggataaacaatgaaggtagccatctttcactgtaggacaatttctttcttgattctcgtccattctagacatccagccaacgataattcttcgacctttatcatctaaaaaagattgcggcgcataaaaatcaaatccttcatccatcatttttatctcagtagactgattaaatttatttgttttataatccatttttcctgctaaatatccagcatagcttgaaattggccgatcactttgtctgtcagaagttcgcttttgtggacaaaccattagtatttcgattccatcggttaaggtaaagtagtccgggcattcacacatctgatccaatatagtatccgtgtaaaaaataccttgatattcccatgttaataaatcatttgattgaaacagcgtgattgctcccacattttcttttgtttgagctccgacaatcatccaccatttattatcttttttccaaactttaggatcgcgatgatgttcagaaaaacctttaggggtttcaatggcgctttcctgtttgatgaatgttcgtccatcgttagatacagcaattttttgataactttttctaactccatttagtttagtattccctgtatagaagagatacattttcccatcgttctcaatcgcgcttcctgagtaaacaccatctttatcatcatatctatcaggtaaaatcgctgatcgaatatttgtccaatgaactaaatccttagataaaaacaatccccattctttgtaatcatggctcgtatcaaaacgattccattgatgaaaaaaataatattttcctttaaactgaatcaaaccgtttggatcattaagtaatcctttatccggctcaatatggaaataattcttatgccgattttccaacttgaaatagtcctcctcttcaaattttcattaatgcgctttcattacctttgttaatgagatattatcatttcaacctacatttataatatagaaatatttaagagaaatatggaactttctaatatctacattttctttgaagcgttcctatgtataataagggcatgaataataacttaagagaatatacggatagattcactgattttacaaaaaaaagtatttcagactttattctttataacagtggcattgaatattgtgaaccgggttacagttatggtccaaaacgacgagactaccactttattcattttgtaaaggagggcaagggaatactggaaattgaagatcaaaagattgaagtccatgaaaatcaactttttattgtaccagcgaatgttgtttctacttataccgctgacccaaataagccgtggaaatattcttggattggttttatgggcattcagtctggaaactttgttcaaacattacttcagtctgatgaagaaaaatttgtaatgaattgccaagatgcttccttttatgaaagtagaatcgaagatattatcgaactgaataaaaatgatttagcctctttttttaaaattaacggcattatgtatgatatcgcaggaaatttattgaatgaatgcccggttcaaacaactgtgaatagcagtacctccatttcttttcaagcgatgcgttatatggatcttcattatcacgatgacatccaaatttcagatattgcctattctgttggcattcatccaaattatttgtctcttatgtttaaaaatgaggtgggaatcccccccaaaaaatatctttctaatttaaaaataaacaaagcaaaagaactacttgctgaaagcgacgatccaattaaccttattgctagctcagttggtttttctgatgcattatcattttctaaattttttagaaaagaacttgggatatcaccttcccagtatagaaaggagcataaatgatcaatgaatcctttaattcatttttttgaagagaaaaaagtatttcatctcacaaataattatgtcagttatattatagaaattgtagaagatacctatttgctacatcggtattggggacaaaagattactagttacaattttagcaatcgaccaaaattaaaaaagagaacatttgctgcaactccagatattaatatacctgaactatctcttgaatttttacctcaagaggtttctttacctcatcaaggtgattttagaaattcttccataaagattcgaaatgaagatggacaaggaattacaagatttgtctatgttgggtacgaaattcttgatgaagcgttaacgcttcaagatctgccctctgcaagaagcaatgaagctttttgtcagaccttaattgtccatttgtacgataaagtcgcgaatattgctctagatttgttttatacgatttttgaggattcaccgattatcgttcgttctactaaagtaattaacgaaggctctagtacaataaaagttgaaaaacttctaagtgcttctctcgatatacgttacgagaatcaagtatgtacctcattttatggcactcatcaaaaagagttccaaatgaatcgaagtgatattaaacatggattatttaaaattggtagtgctagaggtgcaagtgggcctcaatatcctcccttcatcgctttatcaaaagaggccacagagtttcaaggagaagtccatgcaatgaccttactttacagtggcaatcacgaagagattttagaacgtgatcaatataataacttaagattgcaaattgggttaaatgaagagggcttctcatggactttaaaatcaggggagaacattcagagtccacaagctctgctagtatacagcaatcaagggttcaatagtaattctcaagcattccatacttttttcagtaatcacttgattaatccatcatggaaaaaaagaaagagacccatcgtaatcaacagctgggaaatgacttatttcgatgtttctgatgctttgctaaaaaaattgattgattctgctagtcttttgggttttgaaacagtggtgttggatgatggctggtttggtaaacgcaatagtagtaaaacttctttaggagattggaaggttgacgaaaaaaaattccccaatggaattaaatctttggtggattatgctaaagagaaagacattggttttgggatttggtttgaacccgagatgatatcacccgatacaaacctaatcaaacaacatcccgaatgggtaatgaagagtaaaagctatgaacccattttgggcagaagtcaatacttcttagacttaaccaataaagaagttcaaaacttcgttatcaagacattgtcagatgcaattacaaatttcggagtgaactatatcaagtgggatatgaatcgacatatgactgatcctttctccccgactgaaacagaaaacaactcacaagaattttctcatagatatatgctgggcttttatcatattattagcacactcactttaagccatccagaagtactctttgaaaattgttctagcggtggaggtagattagatcctggtatgttgttctattttcctcaaacatggatcagtgataataccgatgctctggacagacaacaaatccaatatggagcttcttacatgtttccaatctcttcaataactggtcacgtttccgatgttccaaatcatcaaactggtcgcataactgaatttgagacaagagcagctttggcttcttcaaccaatatgggctatgaaatggatgtcatctccatgtctgaagaagagaagaagaaggtagcgaatcatatatcgacttacaaaagagaaagaaagcttgtttttgaaggggaattctatcgattgagttctcctaatgaatcaaatatttgtagttggatgtttgtcgatgaagaaaaaattaatgccattatctatgtatttcggaacacctatcaagtatttgatttatcattacttgttcgaattccttatttagatcaagaagccaactatctcgaagttattacaaatgctacttatagtggatcagagttatataattgcggaatctctcttgaaaatcctaaaggtgattttattgttcataagttaattttaaaaaaagtgtaaatgatctaataccctagctccccattcaaagaattaaaatcttaaaaaaagcagaagaccgttaaatttcacggtcttctgctttttcgattaagtttcttgcaagagtttttgaatataattttaattcttctattattgataagtgaactcacttcaaaaaatagtaaactaaatgaccgccatgcaaaaattaacgatgaagcggttctttttcgcccagacccagcacctccgttgtggaatcgtaaatttcttggtaaagctctgggttttccgctagtgacaccccataagaaggaatcatctctttgatttttggttcccactcttccatatgttgtgggaagcatttttccaatacttccagcataacgtgaacagcagtagaagcacccggagaagcgccgagcagtgcagctaccgaaccatcagcggcactaaccacttccgtaccaaattgaagtgttccttttccgccctccgtatctttgatcacctgcacacgttggcctgctaccacgatcccccagtcctcgattttggcgttcggaataaactcgcgtaattcttccagacgcttttcattcgataacatcacttgctggatcagatatttggtcaatgccatctcttttgcgcctgcggccaacatcgtaatgagattattaggttttacagaaccgatcaaatcgaaatttgagcccgttttcaagaacttcggtgagaagccggcaaacggtccaaatagcagtgctttttggttaccgatatatcttgtatccagatgcggaacagacatgggaggagcaccaaccttagctttaccatatacttttgcatgatgctgggcgacaaccttaggattgttacataccataaatagtccacttaccgggaatcccccgatatatttggactcaggaataccggttctttgtagcaaaggtagacttccacccccaccaccgataaagacaaatttggcattatggtgttcgattttaccgttatccagattacggaccttgaccttccacgagccgtcgctcgcacgtttaatatcctttacactatgtttgtaattgatctcgacgtttttactttttaaatgctcaaacaacatgcgtgttaaagcaccgaagttgacatctgttccagagtcgattttggttgccgcgatgggttcattcaatgtacggccttccataatcagcggaatccattccttcagcttttcagggtcgtcggaaaattccatgccttgaaacagagaaatagttgaaagcgctttaaacctttttttcaaaaaagatacatttttctctcctgttaccaagctcatatgaggtattggtttgataaagtcctgtggattacgaatcaaattgctgtttacaagaaaagaccaaaactgtcttgaaagctgaaactgctcattaatgtctacagctttacgaatatctatagatccgtcagccttctcggatgtatagttcagttcgcacagtgcagcatggcctgtacctgcattattccattcgttagagctttcttctcccgcgtttgcgagtttctcaaacactttgatttcccattctggtgctaactctttcagcaatgatcccagagtcgcgctcatgactccggcaccaattaagataacgtctgtatttttctgaatgctattcataaaaaccttccttatctcttatatttgcaaaaaagagcaggccctcctgcttaggtgatacaagaagcaaggctccactcaggaacatatcttttctgtctctattataactaaaatataatcttttaaaaattatattgtctattatctgataattataaatcatttctgctaaaaagtgagaattttctttgcagaaataataagaatggatctcaacacgctgtattttttgggcttcacttactagcagtaataacagacaccaaaaaaagcgtttagaagcaaatgatgtagagtaacaaatttccaatgattgaatcaacaatccatgtatatgaataactcggtaaaatatgtctttacgggatagaccctaataaatacttcattatgatattcgaaacggtctgttgttgattcccccaatcataatcggagttatccataataaacgattgaaaagggagttgctcaataatttgtaattctagctctcgtcgatgttcaaggaactgaatatatccctcatatccgtaaagccccttgttctttccataatcttgctccgtatggtaccaaatcgcgaaatctaaccattcttgagatctcattgttttaactcgctcaatcgtctcatgtacattcggttgcttcaaatagaacaaaattggttttaactcctgaatttgctccgcaatctgtaatacatgctgaataaaacgatcttctccagcgttatgtcgggcaagtaatgcacaccctgggttctgtaaaaaacagcattcgagtattatcaacttttctttttctcgctgatctttaacaaaagacttccaacgttgaatcatcaactcgcagtgcttttctacgggtactccatcgtaaatttcataacgccggatttcctcatacaaactagaagggattccatttggagctgattgctgcgcaagtgcatatgcgattaaagagtcgttgccattcacagatacaaatggagcaatgtaatgaaacacctcagaatagatagatcggagccgatcaagttcttcgttcggcatacatgcaaccgattcataatcagcgggatgtcgtaagttcccttctaaaaatagttccgattctatttgatgtgtgtttaacatgtcatgtatgtgtctagataatgtggatttgccagagccaggtataccttcaacgataaccagtttcgttttcgcagctggtaaattggccatagtatcacatccttatgaattaaatgattaccttaaggagaaaccaattatcccgttataatgccagatagcttaggaaccttcccatatctatacattcttagaaaaccaataaaaagcactgggtcctgaggactgacccaatgcttttttagatgactatcttctagttacttaataattacgtagtccaggttaaccagttttgcataagtaacaatttggtctgtggttagattcaaggaaaccacggtatggtgaccaccgccgttctcaatccatgctttaaccccatcttggaagtttggcttcacattccacagtacacgggccactggaagatttggagcaggaaccgtcggttcaaatgcagtaacctcattgatcaacagtttataatgcgtgccaaagtcagccatggaaacaactacaccgtctcctgccttgccgtcaaacaccagacgagctggatcttcacgatcgccgatacctaacggagaaacgatgattttaggcttgttgcttgccaacgttgggtcaacttcaagcatatgggattgaaggatcgattcctgaccagccgctaattcataggtgtagtcttccataaagccagtggattggttatggctcatgactttaagcagacgatcgagcgctgcagtcttccaatctccttcaccggcgaagccgtatccttgtgccatcaaacgttgaacggcaagaccaggaagttgtttcataccatagaggtcttcgaagttcgtagtgaaggcagtatagccgccatgatccaggaaccgtttaagggcaatttcatagcttgcttgcactcttacactggcttcccaagcttccttgctataagtaccataatcaaattcatagagttcggagtattccgcaaacaaagcatcaatctcttcttctttcacagcattgacgtactgaacaaggtcgccaattccgaagtagtcaacggtccatccaaattgaatttgagcttcgaccttatcgccttccgtaacgccaacgttacgcatgttgtcgccaaaacgggcaactttgatattgaagctttcgttataagcaaccgctacatccatccactctgcgatttgcttttgcacttctgcgcgttcccagtaacctacgaccactttattctgtttcttcaggcgagcattgataaatccatattcacggtcaccatgagctgcctgattgaggttcatgaagtccatatcaatcgtagcccaaggaatgctttcattatactgtgtagccaaatgaagtaacggcttttgcagcaatttagtaccgcgaatccacatttttgcaggcgagaaggtatgcatccaagtgatgacaccagcaacctcgtcacgatagttgacttctttcatgagattggtgattttgtctgcactaaccgccagatcctgcaatacaagcgggtaaggcagaacgccactcttatttaaggcatcggtcatttcttgtgcgtgtgctttaacttctgctaatgcttcttctccatacagatgttgtgaacctacgacaaaccagaactgttttgtacctactgttgacatcattcatcctcttttcttcattttttagtttatattacttttgcccgtagtacgcgtctttcccatgtttgcgtaaatagtgtttatctagaatgcgctgcggcaattcttcagcaaaatgattcaattctcgtgcgaataaattcattttcgaaacttcttccaacacgacgctattcatgactgccgattttgcatctttgccccaagtgaagggagcatgacccttaagcagaacacccggcactgctaaaatatccagcccgcgctgctcaaaggtttcgatgatgacacgtccggtttccgcttcgtaaccacgatcaatctcctcttgtgtcaagaaacgggcacaaggaacagaaccatagaaggtgtctgcatgagtagtccccattacaggtacatccaagcctgcttgagcccaaatggtcgcccaagtcgaatgcgtgtgtacaataccgccgatctctgcataatgcttataaagtacggcgtgagtcggtgtatctgatgaaggtctcatctctccttcaacaacattgccatcaaaatcaacaaccaccatatcgctaggtttcatcgtgtcataactaacaccactaggtttgataacgaataagcggctctcacgatcaacagcgcttacgttaccccaggtgtatttcacgagtccatgtttaggcaaatccagattggcttgatatacttcttctttcagttgctctaacacgtcaattcctccagttttccactagattatctacagcagcctgttcaatcgccagaccttgtgtgtagcgttccatgaatgcttcaaatcccttaacgtcggaactgtcgggagaaatttcttgcccctcagcatctctaaatactttttggtcgaggaagtcttccagactttcttgttgatccttgttcatcatgtaagaagccagaatagcaataccccacgccccgccttctccagctgttgacatcactgataccgggacattcatggcagccgcaacaattttttgtccgacgataggggttttaaataaaccaccgtgagccagaatgctgtcaattgcgacattttctttctttgtcaaaatatccattccgattttcaaagcagcaaacgcagtgaaaagatgagtccgcatgaaattggccaaattgaaacggctttcaggagagcggacaaacaatggccggcctttctctattccggtgatattctcccctgacaaatagccatagctgagtaaaccgccgccatctggatctgcttccaaagccttgttcagcagcacactgaacaattgattcggatccgccttttgccccattgcctcagagaattcacggaacaatcccagccaagcattgatatcacttgaacagttgttggcatgaaccattccgaccggattaccattcggtgtagtcaccagatcaatttccggatataccgctgaaaggtccttctctaatacaagcatggcaaaaaccgaggttcccacagagacgttgcccgtccgttttctcacactattcgtagcgaccatccctgttcccgcatcaccttctggaggacaaagcggaatacctggttgtaaatcttcagatttatctaagattttagctcccgcggcggttagtacacctgcctgctcgcctgaaatataaactttagggagaattccttctagcttccaatcgtaacctttggctgcaatgagttcatcgaactgcttaaccatcgattcgttataatcatgtgtagtctcatcaattgggaatatgcccgaagcatccccgacgccaatagccttatttccagtcagcagccagtgaatatatccagctaacgtcgtcataaaatcaatctgagggacatgttgctcttcgttcaatatagcttgatacaggtgagcaatactccatcgctcagggatgttgaattggaatttatcagttaacacttttgcggcagcaccggttgtcgcattccgccaagtccggaacggaacaagcatctcacccttgctgtcaaaagccatatagccgtgcatcattgcagagaatcctatagaaccaacggtacgaagggtaatcccatattttcgttcaacctcttgcttcatttcactataagcctcttgcagacccgtaataatactctctaagttgtacgtccaataaccgtccaccaagagattttcccactcatagcttccagatgcgatggtttcaaaatgatgatcaatcagcactgccttgatacgtgtggatccaaattcgataccaagtgaggtttctcccttagtaatcgcttgtttaatgtcttgatccatgctcacgttactcctctctctgaacaactgttataatcgcaataattgaaagaaggcgctttctttaatttacaaccttagtatattttttgttcgtacatttgtcaacacgaatacatagttatacctacaaatattctcatggaccgagtatctctcttttttcccctttagggcatgtatgcaaactataaacccattgcaaatgagcagtaagtagtatgatgagaagatacgaaatacgataagactgatgggattgaatagaagatctgttgtacgcggaacgaaaaacacgagaaggaagatcccaaaaggtcactgtttgaagtttatgcgatgcgatgggtggtacgaactggtgaatcgtagcgcgatttaccgccgattgtgacaagcacataattaccgtaatagctccgctagtggcaaacaaaaactttcgaacacggtataacatgcctatggaagctcgcttgaccttagaattatgaattaactttaatttatttttttattcttggcagaagtgttgacggaattagtgccagtgcatagaagccaatcgaccagataaacgcatgaaatgtaggttgagcaagatgaaatctgactcaatcttttttcgtcttttaggtttattaggcttggcctttagtatttatacatgttaggctatcgattataataagctcataattatgctaagatatgtacatacaaatattatgggtaggtaaattagtattaggacaaccaggaaagaaggaataaagtgaaaccaaagtatcaggtcatccttgaggatataaagagcaacattctatcaggagcatacagcgtaggagaacaaattccaacggaatcggctttgcaggatatgtataaagttagccgccagacggtacgtaaggcaattttagaactatccaacgagggttttttaagaagtgaaaaaggatcgggcacttatgtcagcaaccaatttcgatcaaaaaacggcgggaattccagtaataaaaccatcggagtcatcacaacctacatttccgattacatcttcccttctattattcgcgggattgaagccagattgaatgaagataattattcattgctattagctagtacaaataatgatgtcgcacaggaaaagaaagccttggagatgatgttgtcctttggtgtggatggcttgatcattgagcctacgaagagcaatctatataatcctaatatctcctactatctgacgttcaaggagcaggatgttccgtttatcatgattaatgcttattatgaagagttggaagttcccttcttttgcctcgatgacgtacaatccagctatctggcaacaaaagaattgattgctaacggacacacacacattggtatcattgccaaaatggacgatttacaaggaaagcatcgaatgaagggctatatcaaggcgctgggagaagccaaattacggttttacccagagcaagtgctctcattctatacagagacgaagcaggacctgtccaccaacttaaaaaaattcctaaccgaacaaagagacgggttatccgcaattgtctgctataacgacgaggtaggattagaagttgtacatgtatgcagacaacttggtatatctgttcctgaagacttatccattattggtcaagacaattcctatatttccaagaatgcaaacatcaaacttacgacattaacacacccacaggaacaaatgggacgtgatgccgccgattgggttattaagaaactgcaaggaaagaaggacctacgcaaccacacctattatcaacctgtgttaattgaaggagaaacggtaaagaagaaactgaagtgaaggggtccaacattcattgtaaacaatcaaatggacacacccaaaacgatattaccattgaacactaggcacctagtgcctaattgtcatatgacacactttgaagtgactggtatggatcggtgacgaaatgtaacttgttggtatgacaagtcctttgccatacttggttttgccggacgctatgaggcaaaaatacatttcaaggagaaatcattcatgaaaaaaatgattcacaccaatctcgcggttctactgttatctgctacgataactaccgcctgtatggcacccaacggcgcgtcagttgccgcacccgttaacgcaccagttgcatctgtaaaggctagcttggaggggccgcgaaatgccaaggaactagaagcttttgcagatggtgtttttgcggacaagatgaagaagtttaatacagttggttctaattttgtggtcgtcacgggtgggaaagtgatgctaagcaaaggttacggttatgccgacagggaaaaaagaattcctgttgataaaaataccgttttccaaatcggctctgttacaaagtcattcactgcattggcagctatgcagttggtcgataaggggaaaatggatttaaaacacgatatccaagagtatttaggaggaataaaggttccgaataaaacaggaaaaaaactgacgatgtttgatctacttacatattcaagtggatttgatgaaccagatattctcatggaaatgcatccagaatacgcggacaaatattttccaatgaagaagtacattgcatcaaatatgccaactgttgtcaggcctccaggagaagcgtacacttatgacaattttggtttcatgctagccggatatgcagtagcaaacgtaacgggcatgtcatattcccgatatatggaaaagaatattttcaaaccgttaggcatgaattcgacgaatgtgcggtttaccccccaattgttaagcagaatggctgctcactatggaccaacaggtgaattgatacccttggacgggtttaaaccaacggaaaaacctgaaggcggtatggtttcaacagcagatgacatggcgaagtacctcatgatgcacctgaacaaaggaaagtacaaaggtaaagaagtggtgagtccaaagagcatagagcaaatgcacacataccaattattccctgacaaggagttcccggttacaacaattggattcgaaggctacttcaaagagaagatgaataatcagcatgtgattctaaaaggaggaaatgttacagggcattcttccttgattgttattctgcctgagaagaatacagcgatgtacatgtcctacaataacgactccatgatgagtcttgacgtgtatgaggaatttatgaatcattattatccgagaaaatcagaagttccaaagtccacctacgcggcaataagtgagcagcaggctcaagactacgtgggattataccaaaacacgcgtatcgctgccttaaggacgaaggtttcgtattcggacgggaaattaataatggagacaggaacatcagggaaacatacactaaaaatgatccattctttattatttgaagatgaatcaggtaataaattgacgtttaataaaaatgaagcaggccatattgcatatttgtattacatgcagctcccagacctcgttgcttatgcgcaaaaaataaacattgattcaccattttctgatgtgcctgcggatagtaaatataatccatatattaacaatcttaatgctttgaacgtcatgagcggaaagtcagccaacctcttcgatccgaaaggaacgatgactcagggagaattctcagaagtgctgctgcgcgcccacgggtggtataaacaacccttcatgattgaaccgaataagaagcagatgatggccggactacgtaattatcagcctaattctcctatcactagacaaatggcggcggtaatgatccagaacctgaaacaggttgagcctggaactaaggttaaattgagtggcgaaacggatgcttgggcagttaaagcagtcacagctcttgtttcccaaggtatcatggacccggataccaagatcaattcagacggctccatagatttccgctccaaacagcttttgaagcgtcaagaagccagtgccttattagatcaagcatttaattactatacgttgccaatcagtcactaattcaaaaggttaaccggaaaaagtaagataatgatactttatataaggtttcctgaacccccgatcaaactgggggttttcttgtataataagaaacaagcggctgctgatactgccgcttatttttagttttctccatatccaacggaaatccgcatcgagccgtaaggtttaatccagaagccctgcctcccgggctttttgcaccgcttcctcccggttgcgaacccccagcttcagatagaccgatgacgcatagtttctaaccgtaccatcagataaatacaatttggaggcaatggttttatatcgcagtcctttcgacacgaactgtaaaatttcaagctcccgtggagttaagtcataggtcgcggccacttgggttgtcgacggatcttccccgctcttggcggcttccagctgtgcaaacaatttgtgcgacatctcctgatcgatcagcgtgcctccgcgatagaccatgcgtattgtttcggcgagctctactggcttcatcgacttcaataagtatccgtcggctccgcttcgcagcgcttccagagcctgtccagtatcttcgaacgtggtgagaatcaagatgcggatgtggggccacgtttgttttatggtacgggatgcggagattccgtccaggttcggcatgtccaaatccatgagcaccagctgaggctgaacctgcctgcacagttcgatggcttgctcgccatcttctgctacccctacgacttgcaaatcttgctgctcctccagaagagtccgcagactttcacggataaaaggctggtcatcgacgaccaacagacggatgacttcatccttaagctccgtttgtcgtggcagggtgcaggtaacgagggtgccttcacccggttgggtatagacgccaacatgaccttgcaaattcattactcgctctttcatggcgttcaagccgaaaccatcccgtccatgttccatcccgcggccgttatccttaatttcgagcctcgtctgctgaggctcaaattgcaccaaaaccgtaatctccgtcgagtgtccatgacgcacggcattcgtcaatgattcttgcaagcagcgatacagcgctatctttgcttgcttcgttacagggtattcctctccgaaggcctggaaacgaaccgacaccttagcatgctcctgaaactcctctgccagcttccgcaaagactgaagcagtgggagttcttcatgcggcgattcgatttgatgtacatagcctctcacttcatccatattcttccgggccaggttcaatagagaatcgagccgtttcgttcctgtatccgtctctagctcagggcgcaaggtttccaatcccataatgagggaagtgtaggcatgaccaacagtatcatgaagctctttggagagccgattccgttcttcggccagcgtgatgcgctcgatttgggacaagtactgctccagcaccgcattttgctcgcgtataatttcgctttgacgatgattgaccatcaataaatggaaggaaaatccgaatgcataagccgtcccgaattgaatggtcataacccaaaaatcagtctgctctacaagcagcttaattatagtgggtaggagcaataccgataaaggacctgaccaaagatatgttctttgtttgctgttagcggcaatcaaaaatggatacaacaggaatgtgaggtaggcttccggaaaaaacgaagctaaatacaagcacagcccgcccgggatcacaatctcggtaagcaggtagtatctataattgagctgcaagcacagccagggaacggaaaaagcaataagctgccaaaacacaagaacccaaagcggcagcgtgaaatgagcttgccgctctatgatagtgagcaggagagaagtactgcaaatcaggcggatcataagcatgaaccagtcgtaccagaaccactgctttaccatatcgaacaaaaccatcaacccctaagaactatcagtatgacattacgtaactattatagagcagaacatcatccaacaatacttttaaatccagaccgggacgttccggttaacggttcacactcttgatcataagacgggtgtagccgcctagcatacgcgtcaagctgttcgcaagcctatagctcaccatagtgaatacgactcctaaggtcgaaaccagtatggatttcatcacagtatctacaagtaaacccataaaataataattaaataacggaaagaggagcggggtcgcaatcattgcgagtggagttatataaagcaaggctgcactaatgaggcttaaaatccccaccggaagcttcagcatcagccagccgatagcaatccagttgcgccgatttagcagctccttccttgcttgaagccagatagaggcatcggtgtttattggtttaacgtaaagctcggtggtaatatccgtatagatcttggtctgtatgcgttcaaattgcaggaaggcgtatgtagttcgcaaaatgcgagtaatcagaggaacacccacgacggtaaacgaaagactcaagcctaatgtaagagcgaccagataaaagcaaaagtaaaacaatccggtagcgaaagtaagcagtaggaaatagccattttgaataaagctgacgacggttcttgtcatcaaagagcccacatcctttacaagtagtagtcgtatcctacggctcttgatgtcaaatctaccagtgccataatgtcatatgacacaaggcgaaagcggtctgcaaatctaatgaagaaaaacaactcaaaaacaactgattcttcgccattttttaaatatcgcatagtaatggtaatcgtctttgcagagccaagcggcttttgatccaatccctctgcgatgcatgagaagacacaaagcatggtttccggtaaggagagctgatttctgcctaaaagttttatttttgagaatcaagaataaacatagatgcatcttgtcccatgaatattttacttccattaaaaaaagttttggactgaatatctctatatcctattttagtcataatgtcagtcagctcttcttgattaaatccgttatgaactatatctgaaactactttttcatttttattaaaatctacgattagtaaatgtcctccttcatttagaacatcaaatagccttgataaaacgaattcaacatcatgaatatggagtagaacctgagccataaaaatatagtctgcatgtaaatccgttagaccttccttttcaaaatcaaaacataatgtatttgcattctgaatatgaagatcagtaattttttgctttatttgattaatcatgttttgtgaagtatccagaaaaagcatagaattaaaatcatttaacaagctcattccgacaagacccgttccacacccaaaatcaatagcattcttactattagcgtcaactacatattcacgaatggcatcagatgatacctttgcaatttgaattctttcagaagtgtcatatatattagctatcatttcaaacttatccgtatttcccatgattacctctccaatccgattaataaaatcatgaatacaacaatatagaatgatattctatcgaagcattagcatttagtccacattcttattagtaagctcttagtcttggttcgtttctatacaattttgcttcaacattttcgcccttatttgtgatacggttcaccatcctacctgtagcggcaagtttaaagaccaccccactaaaaggatggcctttaggatcgctaatctattctaattgcctcgatataaagctcgattctcacttcatttccgacaataaccccacctttttccagaggcgagttgaatgtcaaaccaaattcattgcgttcgatactggctgttgaatgaaatcctacacgttcccggccgcgagggtccttgttaagtccttcaaaaatggtatgaaaagtgatgggtttggttactccatgcagagttagattgcccgtaagttcatattgcctttcgccagcaaggacgcagctggtgctttgaaacgtaatggttggatacttggctgcatgaaggaagtcgtcgctcttcaggtgttcatctcgttgcgattggcgagttgtgatactatttgcatctatagaagcctgaacacccatggttgttaaatcgttggggtcaaaactcaagatcgcttggaaatgctcgaatactcctttaattctactaatcattaaatgcgtcaccgaaaactcgacggaactgtggtccggatcaacttcccaattgatattgctcataaataaattccacctctatgataagattttgagaaaggtcgccccatctccaaacactgcgctattcgcatactcctaatgtacaaaaaagctactgacaacgggatgtcagtagctttttttcatttttttggtttcctcgtaaatccgatttcggaatgttcaggctccgccacgtcaaattaaatcgaaggtgagctggataatccatgtacaccttcttcaccattcgtctttgtcgaaataatcatctggcaaatgcagttctcgcaaacaaccgataaatttttctctgaaattcggattgcttttgtattccggccatacctccttatagtaaggcagcaacttctcatgtggaataatgccccagtataaaatcgagttattcagaacctccgggccgccccccatcaacatctgttcaatgatctcccagcttcccagcttgttttcgcaactgcgcgcggcatagatggcagtggtttgcattttcgggtcagcatggcacaagaaaggcgcaaagttctggagagtaattgcaccataatcctccaagatataccctgcataacgcaacgtttccgggtcgtgaatcctgtcaagcctttgcaagatcactggaataaactccgttaaatccacagttttactggaagcgtgcagaatctgtaaagcttgcagaaagtcctcatgcccatccgattgcaacagctccagaagatatgttctacccgtgtcaaaagaggtttggcagatgagccaaatggctgtggttcgattttgggggctttgctccgcaatatttttcaaaaaatcaagggttggctgagagactttcttaaatttaaacattccatcaagcgctttggcttggatttcttcgtttggagcgctctgataaatctggatcagcgcattctcatcacctggcattcgactaccaaaccacccgatatcataatccagaataatttcatccagccagcgctcgtaccagtccagaaagctgtcttcatagacaaagaaaaaaggatgatcgggatggaaatcggaggtgtacacaattctccccctgtatttcccttcaagtacgagatacatgtcgtattcgcagccttgggtgcctatgcacaacatgccgcccagcaccttattacaggtggcgtcgtattcctcatcgggaatgtcctcgtccttggtcaggggctcaatcagatggttccattcctctttggtcatcccgggatgcagaacggattttgcaaggagcgcctggcgctcggtgtaggaagttgcctttccaatcggataaattccataatagggtccggcgcctccgttgccgattttcgttaaaaacagcgcgtaaggctcaggaagggtaacctgattgtgggcttgccagtccgccagctcttttgctgtaagcttctctttaaccctatattgatgtgaggatgctccaaacactgagaaatccgcgtctttgcgcatagcttgactcagtttgttttttattcgatccagttgcgtctctttcttcctaaaccacatattgaaccctcctgttgaccatagccaggtttcctttgtttgcttatccagcaattttattattttttctatgggtcgtacctctttaaaatgatatgtatctttaagtaatctttcattgtagcttctcttaaggtcaccactgaaccaccttagagtaccacagaaaaaaatccatatgaatggaatccatatgggggccaacacgaatttgttaggagacggacacttggcaaatttgatgacgaagaccgtgatcatttttattcttgttagaaaatgacggtgtgagctagccccctttgaccactcaaaggggacttaaagtccacagggatacgattattcattatccggcgtggccggactggccgggggcattaagcctttaaccgcgccgagaaacgggcgaatggacttgatcataccgtagcccatcttcacgaccgggacaaatttctggatcatgccgaatagccgcaagccgccgccgagcataccgccaagccctcctgcgcccgcagtggagccgccaaggccgcctaacagcgagcccatcatcggcagaaatgccgacaccttggcgtccggcttgcgggagcgcgaacggccagacggcttgcgcgcgccgcttttccggttgccgagacggacgcccggggcatgcgtaccagctctgcgtttgatagatcgggagccttgcttcccggaagaagtgcgtggggggactccagcgctggcaagtaccaacccgccgtaattaacatcggtgatgtagccgacataagtctctccgctgtgcagggtgacacagaccggacggccctgaaacttcttagcccgtgcacgcatctctttcgattgtgccatggaagttcacctcgctcactgattataattcagtttacgccaggggcgggctgtctgcttgtgcgaatgggacatacgcacgccaaaaatcgcttgatgatctcaccgccgttcaagtcctcccaagaataacaccgctaaccacagccccacactaaatcaagagaattgccaaaaacctgctactggatgttgtatctcagtcgtctccattttggcgaaaatatatagtgacccaaaaccaaaaggataattgtaatcctcttgaagcaacgtttcgggataaccatcttcatctacctgaaataaaaaagagaatgactcctctttcagcttcgtaaaataatagtcttcattttgaataagtctcgggtttccgcctactttgatcaagaaaggctgatccatcgatttttcgtcatggcttagtttcccgtctgaaattgcatgctttataagacctgggttagtaaatatatctttggcgctttcagttgaaatgggatgctcaatcaccttgaccgagcaattaggataaatgttgttttccaaatactcctcatagtcttcagggatgaaaaccgaaatcatgctctccggtttaaagggatggacgagactcaagtaaaaaacatatttttggttaccttcgtggatgggatctgattgatcatcaaagaagtcgggtgcattcccaccgatccagcctgcactatgttcgttcgatagggccgatcccgcataataaaaaatacaatctgttctctcaagtaaatattcgcttgattttcattaggcattttacaactctccctcaagaaacgcgaatgcccttttgaactattttgcattcactacaacatttttaccgccacttgaggtatggggttttgctctcctacctggagtttcatccccattagagcaagctcattcaaggttctaattcaaggtgcatcttggcttccgcctcatcccatggcaccgagtaacccgcccccttagcgcaaaagatggaggaggatgtatacagtgggtctgcccctttgcggtagcccatccgctctatgacttcctccgtattatggcagcgatcgtagccgctgaacacgcagcggatactgcctcgtccatgcgtaaaggatgcaaattcggcactgtagttcatgaaagtcgacacgggcaccctgcccgtgaccaccgcttgcgttccggttgtttgcggcggattaaaaatacccgaagcacgctgaatatcggacagcaccctgcccatttcatcgatagcgaccttgattttgaaatcgtaatagggctccagcagcacgttgtccgccttctccagtccctgccgtagtgctcgaaaggcagcttcacgaaaatcgccgccatgggtatgttctttatgcgcgcggcccctcagcagcgtaatgttcacgtcggtgaccggcatgccggtcagcagtccgtgatgctcccgttcatagagatgattccgaatcagattctgatagctgacattcagatcatcggcatgacatctgctatcaaacatgatgccgttgccccttgctcccggttcaatcagcagatgcacctccgcataatgcctgagcggttcgaagtggccgtaccctttcacagccgattgaatcgtttccttatacaagatttccggttgtccaaaagagatagcaaagccaaaccgctctttaacaagctgctccagcacttccagttgaatcaatcccatgacgcggatagaaatctcctgcaatttctcatcccaaacgacgttcagagacggctcttccgcctccagcatgcgaaaagcaccgagcaccttctgtacatgtatcgaattgtcgaatactaccttcgattgtagcgtcggttccgactcgtaagctaacttgtccgatatcggccccaggccttgtccagccccggcggcggacaagccggcaaccgcaaacaaatcgccagcttccacttgctccaccggctgcgatttaaggccgttaaacaagaagagccgcgtaactttttcgtcatattgaaccccgccgctctcgtaactaagctgttctctcaccttcagccgaccacccagcgccttaatgaacgtgagtctcgctccgcctgcatcgtgccgaattttataaacccgcccctggaacgaggcattctcgtcataagtggttgtcgtcagcagatgcagctgatctaaaaattcaatgacgcctgtatcctgaagcgcagagccgtaagcacaggggaagagaagacccgccgctatcatcctctgcaaagcctccagccagaagccgcaatcctctctcccctccaggaatgcttccagcaaagcttcatcccgctccgccatggcctcccgcagcggctcgccaactatgccgtcagcgaagctctgtgtaatgcagcaaacttcccccgtcaactgctgacagatatccgcctcggttctgcctgcatccgcgccgatccgatccgtcttgttgataaagaagaacgtcggaatccgatgcttgcgcagcagctgccagaccgtctccgtatggccctggacaccttcaactgcgcttacaatcaggatggcataatcaatgacctgaatcgcccgctccatctccggggagaaatcgacgtgtccgggcgtgtctattaaataatagctgtctcctttatattctattaccgcctgatctgcgaacaccgtaataccccttgcccgctcgatgtcgtggctgtccagaaacgcatcctgatgatccacccgcccccgcgaccggatactgttcgtatggtacagcagctgttccgcaaaagttgtcttacctgcatccacatgggcgaacaggccaatcgttagtcgcttcatagaatcccactttcaacgcttcttgttaatactgctcattttattaaagcatagaaatcgggagagtgggtaggagttggttttgagagaggatctttttttatagacagaagataaaggaaaaacctcccttcgaatctacaccattttaatctgcaagtttcgccctgcttatgatacagtcaccgtgctatctacaacggcaagttttagctatcccttgtggtgatgctttttagacagaagccatataaaatctaacggttgtgatgatcgcattgaatggagatacgcatcaacacttccgaataattcaccattccccctagaggtgagacggtacgcacgcatttcatcaacgagagcagaaaaggagccatccgtagtcagatagctccttttcttattctcagcactaactattcttgtacaattcgaaacctgctgatcatttcgctcacttgttggcttgattgtttcaattgttcagctgcactatgcagatgggaatacgcttgactctgatcgttagaagccgaacttatctcttctgtggcagaagctgcgtctcgagctacatctgatatcttgataatggatgagatgacctgttccctactaacattcatctgccctatatccccatccatctcttgaatcgagctgatgatttcctttagcatatccataatcgattcaaataccgttcccgactcctgaacaatgagagattgttcggagataaccacctctgtctgattcatgacctgcaacgtttgagaaacttctgccttgaggcgtgcaatagttgcgttaattctctctgttgattcataagtcatggtcgacagcttgcgaatctctgtagcgacgactgcaaatccttttccggaatcgccggcacgcgccgcttctatgctcgcatttaatgcgaggagcttcgtttgctcggatacttcattaatcgtctgtacgattgtggaaatcgtaagcatctgttctgccaggccttcaatatgttgcacgaccagttggtttgcttctgtcgtttggagattgtgatcctgtaatttctttactttatccatgccgcctcttaaaacgatttccgcctccgaagacaagctggtcatttttttgttccttacatttaccttttcaatcgtgtccgatagcgccatcgtttcacggctcgttgcctctgtcaaggatgcttgctcggaagcaccaactgcaatttcattaatgcctgacgtcatttcctcgccggttgccgttgtttgttccgcaataaaggtaagttcatgagcggaagtatttacatggccaatcgattggcttactgtcgaaatgagttctttcatacgagataccattatattaaaatcagcggttaattgcccaagctcatcctgggagaaggtacgtatatcgacggccagattgccctccgcaatctctcggacacgtccacgcaaataacggatcggatgatggatggatcggatgatcaaataaccaagcaacgatgaagcgatcaagcctgccaatgttaagaggatactgaccaatcgcaggaagctgtattgtttttgtgtgctgtccaacatgatttgattatcatcgtagtacagatcgcctatgtgatccaaagcgtcctccatctgatcaaacttttcgctgccctcctgataagaaagaagattcgccctttcacggacagttgaatcctttgacgataatccatcaatcaccttcttggagaccaaatcatacgctgcaaccgttgcttcgtagtcttgaatcaacttttcctcattatcaaaaattgttcccattgacttatacttattaagctttttctttgccgactccttttgtttcccgtaatcctccagttgtttcgaaaattgttccgatcctggttcataactgtacagcgatcgctctgccaacagcatctgatataggtcgatatctgctgtacgaatgagatcaatgacttccgccctaatactgaggctctcctcaagcgaggattgtacccgcttcaaattgtaaatcccaacgcctccgatcacaaggctggtgattacagtaacgacgatcgttagaattaccttgttcctgatcgtcatcatgaacttcattcctctcattatgcctcactcccatctagtccatctcgaggtaacatgaaacaatattcgacatcgttcgtcaaacacctttctatacatcagagttatggataaatcgtgaaattgttagaaacccagagtcacgcacatgggattacacttccaaacccaatcctccctaattgtagacacgaaacttcatagtacgaaaatcatgttgatcaacaatctttagttcgggaatgttaggtgtgaccagaatgccaccgtaatggaggtgaacccctaaaccggatcaaaagaagcctaaaaaaattgcgtcctccaggggagaacgcaatataaaccagcttgacaccgtctttcaatatcgtcatttacgctttcgggcgatcactgccaaccggccgttttcggtcgagtactcacacgtagacagtacaataagcttgtcgccataacggggggttatacccgtttcgtaaagagcaagttttttgatgttctgaacatacgaatcgaactcggcgggcgtacttaccttctcaatctggtagtatttaaatacatcgtccgatttgcgataaacttgtgatagaataacggcaacaatctcatactcttcctgttcgtaaagcgtactaaactggaacgtagcatgctccttatagaagctttcttgcttatacttcatcaaatctttgaacatccagccgtttttcatatgatgtccgtgaatcagcaaaacgtccggaccgttgatccggctgtgctcgtctaaaaaggggaggccgagtttgcttttctttttatcgaaatcatgatcgagatagtactgatcatcttgtggattctgcataaccgggtactcaattcgggtgccattaatcttcagccaaccgacgatgtccgggtttctctcgtaaagctctcgaaattcgggaagcatgaccggctcattcgctttcgtaatcaaaggggaggcgaacgcctcccctcctcctttgtccgattctttctcccaaacctttgttaactcttcgattttcacttgatcggcataaccccacagggaaattctcgctatattggcgagagagaataccaacacaaggagagaaacggcgataagaacttttttaattttactcattttcttaccgcctttccggttactgaatatgctttttcttcttgccgctgagtaaacagaatccaatcgtaatcaaggacatcagcgccaaaaccatatagaagattggcgatggactgctatcccctgttttcggagcatcgtccagctcgtaatcgtcattggcgacttcattgtcgacgctaccgccgcttgcgttgttgcctttgttgcctttgttgatttcgttgttcacgttgcctgctccgttattaacgttgcctgctccgttgtcgacgttgcttgctccgttgtcgacgttgcttgctccgttgtcgacgttgcttgctccgttgtcgacgttgcttgctccgttgtcgacgttgcttgctccgttattgacgttgcttgctccgttattgacgttactagcttcgttgttgacgttgctagccccgttgttgacgttgctagttccgttgttaacgttgcctgctccgttgttgacgttgtcggctccgtcgtcgctgttatcggttccgctattgccactgccggacccagttccgccgccaccgccgccattgccgccggaacttaccggcttcaactgtacatcgtagcgtacgatatcgcttccgactgagatcgttgggctcgtatgcgtatcatacccggctttcgttacaaccagatagtaatccgtgtccggaaacaccatgtacgcatatgcgccgtttgcgtcactgttctgacttgggctggcgttatcgttcggcgcaaagcccggaatcattggcagcgtcactttcgtgcctggctcgatgcctttcgccttgttcctcggcgtatcggcataatacagcgtcacttcagcgccttcgatcgtcgcgccggtcgtttcgtccgtaatgataccgtacgggtcaacgagctcctgagaaatattcagttccccgttcgccttcacgtctagatccgccttgatgagcgtcaattctttgcctggcgcaacttcgtaacgtacttccattttgtagttctctgcggataagccatccgcagagaatgcgccgttcggttgcaagccgaatgctctcggaacaccgttctcatttacaacgtattggccgcttgcatcccgcaaataaatgcgcatcttgccggcgagctcgctacccagcagcgaagtctgcccttcaggctgcgtcagaagcacaatgcctaccgctgtaatgtccgccggaacggtctcgtccgtcacactgctgtccacatttgctttttgcgtgaactcgacaggcacatccttcccgcctacttgataccactttgttaatgtgatcgtatagtcggtatccgcctcggcaatgaccgaatactcgcccttctcattcgtctgaatcgtctgcttctcacctgtcttcagattggtcaccgtgatgggcgcattcggaatgacttctcctgtgttgttgtcacgcagcacgccttccagatacggacgggtattgacaaagtgtgcttcgaccgctgttttctccggaatggttcctgtgcgaacgagactttcaggattcgtcacatagccttccttcgtataatcatcttgggtcaccgtatactggagatacgttggaagtccttgcacaacgaacgtctggccgtctgtaagctcgaaagtctctccgctcttgatcttgcccgtgctgccgtccgacttctcataggcgtaggactcgttcgctccctcgcctgtgaaggtgaccgtgtacttgaacagcttcttcttgtcgtcgtctttgcctttaaccgtattgctgattagcaggccgcccttcaagactcgcacgttcgtgaacggggcaacttcatcattacccttcatgactccggtatagtaccgttcctcaggagtagtcacgtattcatcggttgtgtagtctttctgggtaactgtgtatttcagattcttaggcagacccaaaatatccagtgtctctccatccttgagccggaaggtcccgccggacttgatcgtgcccgtgctgccgtccgacttctcgtaagagtagcttccatccttacctgcatcctcaaagctgacggtgtactcgaactccttcgtcttctcgccgtctttgcccataaccgtattgctgatggtcagcttgctgacgatccgttcattgatgaagtccgccttgtgatcgcctttatccgcaattgtgccggaccgttctctcgtctccggctcagtcgtgtaaccgtcaacggtcgtataatcgccctcagttacggtatagaccagatttgcaggcaatgccggcagcgtcacagtttgtccgtgcttgagggtaatcttgtcaccgtttttgatcttgccatacgtattatcgggcttcttataggtgtactctccatccttgccatcgcccttgaaggtcacggtgtactcgaactctttgtccgggtcactgccgttgccttctaccttattggtgatggtcagcttgccttgggccggtgtaggaacgatcagcggattgttcgattccaccttctgtccgtcaacaaggacaggcttgccgggcgcatcgatgatacgtacccggtataacgtagtcgtaggcaagtaagtgaggggatcaatatatgtctgtttgagcaaataatcccctggcacctgaataatgaaattcgtcttgccgtccgtgcccgtcgctttttccgccattacattattttctttatccctggccggcgtgccgtcaggattgagcaactggaactttacatccttcagcggtgttgtaccgtcgggaccgaccttcttaaggaagagcaggccgttttcattggcacttcccgctacatcgttcgcgtccagcataatactgctctgcgctccgatcggcggaagggtatcatcgcccataagcttgatggaattcccggccgttcccggctgcataccctgggattcggtctggtaaacgatctgatagaacttgttcgggtcgacaaaatcaaacctaagcgtcgatcccccggttgccgggtctgtgcctgcagtgactttcacctcactattcggatccgcaagattcagcggtcctccgttacgctctaaagtgccgtccggcttcaacttgccgggatagacagcgatgtcggaaggttcgagggatagaccgcccgccgcattttggcgcagcttcagccccttggcaagggtatccagcaaataaacgccttgcttcatctcaaacggaggcgtgtaattcaccgtccattcctgtacaccagaaacaggcttttgcaccgtcttgctcagagactgcacaggcacaatgattctgtgagcttcggtagcactatagggcttgtctccccatttcatggagaacacagcctgattctccccagcattattgttacctagctggtaattggcaagagcggcattggttggacgcgccttcaccagaatgacgtaggggctctccagcttagaaaaggtgaaggttccttcattgccatccttggtaaagctcaccacatgctgaggcgtacccggcgcaatgactgaaatggcctgtgcatatctaccacttccgcctttaccatcggttctatagcctgtactacctttataaagcctataagcctcgcccggagcataatctacaaactcccagccctccggcaatacatccaccagcttgatgtcgctggctacgcgagtgccgccatccttggccatctcttccgtattgaagcccggcatgttcaccgccagccggaaggtggccgttctatccttgcgatcatagcctgccaggatgtaattgtcaggacgggagttgtccatataccagttcggatcgttggccacgggcgttcttttccatacgctgtcgctccattggcctgaatagtttcggttccaatcggctgcgaccccctctaaacctgccgtgttcgcatacagcatctccttgttcagcatccgcacaaggttcgaggtgttggcctcggcgcgactcacataatcgtcaccgtcgaagagcagcccccggttgctccatgtgtttgcggcgttatcctggcggaacaggttatccgggttggtagtgacagactcaaaggaaacgctcctcggtacatctcctttgtacccggtcactttgataaggtccgccacccgctcgccgttcgccgtcaaggggatcacttcaccgttcagcccattactcacagtcagcgtattctcgcggtatttttgccaaagctgcttggtgtcgatctggctcttgattgcatccagagctgtcgacgttaccataggattggcgtccaaattattcagtacatcgagagaaccgccgtgaaccagcaaatcatagacgactggagcatcgagatcgtactgtaacgtcaagtttatcgtccacttggtgcctgcgacgttgtgcagcgcggtggttgtggtcgcacttttcgtgaaggcatgtgcgccaattctaacctgcgcagtgtccacaacggcagcaggagcggcccagccagttgcatcgttgttctggatggcagttccttcatccttcacatccaattcccagtttgcgcgcgctttgtagtcgaagattgacttgctgctgtctgtcaccttcgtcacaactgtcatatagaggggaccgtccagattcccgccgatggcggttccgatctcatactcccctgcggcgttgcgggtaattggggtatccgtaccgctgtccccattcttataggttgcagaaacaaactccgtcccttcgggcaggatgtctgtaatcttaacgttctgcaagccggttctggacagtacgccgttattgttaatcctcttgttgacctcaaccgtccatgtgatgagcgtatcgtttccactcttgcccggcttgccgctcgccgcaatccagttggggcgtatagcaatccgatgggtatttgatgaagccttcacatcggtagcgtcacccaaaagctttgcggtattatcaatgcggttccatccatactgatcagcaaaattgccgttcttttcgtagtaataactattcttaggaatccacgttttgaaggtaatagtcgccgtgcttttgacgttatctacagtggatgcgtttgggaacttgtagaaaagtgtgcgatcagcagcataatcaggatctgccgcatttccatccacagtgaaggacccaggcacatatacaccgacgttcgcaagctcatcagagaaagtcaacccatccagccgcatggggatggtcttatcgtccatatcggtggcagttactaccgctcgccacgtaatggtaccctcttgaaaagaagggctgttaatcccactgtcatagccgccgttgcttaaagagtttacagtaatagtatactcgggcaccaaatcggagtttttaaacttatagccatctccgaaaatggtcgtatccccaccaccgccaggggtctgatctgccgctctagcagcagcggaaaagccgattttgacgtcgcgtctactgccgtcatatactcctgcgccatcaaacgtaattttgatagaatcggcaaaaaactggacggtagcaattttcagtccgccctgattgattggcataggacctgtaggcgccaaattcacaccagggaagtaggtcgccttatccaggacggcataatctccctgctgaatcacactttcgggcggagcattgagatcgtcgcccttggtcggcacagcgatactatccagctcaagggtaaagttctcccggccgttaatctcgccccctgccggaaccacagcttcagggttaccctgcttcactgtgagcttgaacgtcggattggcgttcgccagcaccgccgttttgtccgtcagatttgccgtcaacgccgcgaaagtgagcagcggagcgtacaccgcctcagttgccgacgacggttggtctggcgcgccgtacaccgcctcagataccgaaggtgattcagccgcattctgcgagccggattcgtcatccgcatatgcagcagcagggaataccactgtctgcaaaacaagcaaaactgccaggcagaaagatagcatagttttacctaaactgcttttttgtttcaatacgaaaatctcctccatttctaaaaatttttgggagcggccagtaactttttccctcatcttaggtcatcttcgccgcttacaacagaaagttaccaatttcgccatatttatatggcgtgtccgaccattataatatagagacctatacaaattctaaacactttccagactttagacccgagtttggcataagtctaaagaactaaacacagtaagctagacatggattcctcccttcttcatttctcatattacctccctctgatgctggatctaccagtactatgagatttttaatagactgggtagggtagggtagggtagggcttgttcatttttatatatcggatttttattaattaaaatttaatgttttcaagttcaaggctccttacattttgtttctataatggatgatctggcttggatgggtttgaagacacaccctagttagggaattatggggtaaaagtagctgtaaaattgttgatgcacgttggcaatctaaatgaatatcacacatatgtcaaaaggactcctaaaggcaatacttctggccttagagtccttattcgaaaaatctgtaaataaagcataacttaatttttgcaccatctacaggcatcccaaaatatgaatacatatatcatatacaaactatgtaatcttcctccaagttggttccacctaactgcctcctgaaaacaacatcctccccaccttacgtggctccccaaaaagtaattgaaatcagcttcgaagcattacttcaattttggagggctcgagaacgatgccacctattagaaacgtttggcaacttctgtagcatgagcaattgcttatagctgaagctttctttaatgatgtcgttccttcaatgagcaaacagaaacggactagcgttacgctagtccgtttcattctgcaccgagttttctgcgctcgcaacttgctggtaggccaatataacttcaaacttggtagtggcatgcaccatattagggatagcaaacataaggatatcggaaagtaaaataacttttcgattaatgtcgaaagcaagtattgtaaaaaatgagcctgaaatagcaacaattaaagtgaatattgttcataaatagtgcctctattggtttgtgttatactaagcatgactacctttttaagataaaagctacataaaaaaatgggttactgtttgtttaaaattacattatcaagaaactgaactgcgtcactattaaatttccaggaaaccccaaacttatcaaccagcattccaaagcacgaagaccaaggcgtatttgataacggcatcacaacatggccgccaacagacaaatgtttaaagtattcttccaatgtttgtttatcatcattaactagactaataagtacgttattccccttcactagttcccctgttaccgccatcatggaaggcaaaatatccgacatcatgatttttccgcctgcaaactcgactgaggattccatgatcatatttaattcattctccgataatggatagttaggatcttgcgggaaatccttaaatttaacttttttaacttctttcgcatttaaaaccttcgaataaaaatcaatcgcttgttctgcaactccatcaaagtttaaatatacaatagctgacataaagtaaaacctccttcgtgttatacatgcagtataatgaataagaggtgacagatgtatgtcaccatttatagatatagtacaaaaaagaaggagaacctatggaaaaggtcgagaggttaatatccatcatcatgattttgctaaaaaaagacgtcgttacaacaaaagaattcgcacaattatttaacgtttccaaaagaacgattcttcgggatatggaaactctgagtttatcgaacatcccgatctattctattcatggaattcatggcggctatggcattatggatgaatacaaggttgataaacgtcttttaagcaactccgacttggagaatatattgactgcgctcggcggattgggacaaattctaattagtgaagaagttgaagtgactattaaaaaaatagaagccatggttagcccattgtctccaaaaggttcaatccaactgtcattttatgattgggagggtcggtctgagattcttcaaaccttgaagatatgccaagaatcgatatcaaagagaaagttggtttcatttgattatatagataaaaatggcaccacgacgaatagaactgtcgagccataccagcttcattttagcgaaatgagttggtatttgaagggattctgtttacatcgtcagagatatagaacatttaaattatccaggatcgatcatcttcttatggatgaaatcacatttaaccctagagttgattcattgggacaagaacatgtagcaagttataaaccggaatcagtcgctattaaggcattaatttcgcctagcataaaagatcaatttatagaaaggtacggccgaaagagtattgaagactatagttctgattatttcttagctaccatccatgttcctcaaaacagtattggatttcaatttttagcaagcttcggtacaaacctagaaatcgtagagcccaaagcatatgttgaagaatttcgaaattatttaaataaaatggtggggatatataatgaaaaccccaatcaattttgataaataaagtgagagagtggtagatttttttatactaattctttaatttgggtagcctcgtgagggaaaatcactcccctctccctttaatgttctcgtcaatctacatcctgccgagttgggtctccttccacttctctttcaaagctttcaaatcttctacgaagaactaagtagattgagccgtcttcttactgcaagcgggtgataggtgaagtagatgggtataccctgtaactcataccagctgcttctgaaagagctgcagctgtagatgagggagacatgccgaattggagtgtttctcggataccacatagagacggatttccttcaccccagatgacacgattccgctgcttggatagttcgcaaaattcacaatgctccataccattaggcgcttgttcttcaggtaagattattacatagggatgatccattcccttgtcgtgcagctccttaccttcacacacaatgaatctattatgcccacccaaaacaaaaacttgccgtcacttatgattcggttctgggtatcatctcgaaggcgaaaagaaaagcccaccaacttggagaacttcgcctaaccatcattcccgacctcattattgttatagtcgtcaataattgacatcgttttatttgccacttcactaccgagcgaggcatacaatttcttatcgccgatcacataaaattcttctttagctcgcgtcgctgcaacattcatcatattgggatcagagacagcccatcttgctgccccactgctatcggagtccgctccaagaacaaagtagacgactttggcttctttcccttgaaaagtatgaactgtaccaatattcgttgtcttcccgttttctcgttttgtgaatttaatttcatctaaaacctgggcaagcttataagccacatttctaaatggggtgatcacatagatttcatccgctaaatccggatcttcctgcaaacgtttatcaatcattcttttcaaaaagtcagcttgttccttaacaaatttgtcatttgctttaccggttgaatcataccattgtgatttcccttgtgcctcatctgctgatttaccttgtaccatcaacccctcatacgaaatttcatttgaaatcgtaaacatcggatagttcgagcgtctgtgtacccaaaggggtatgccaatccattcatcctcatttttttggaaaccatactgacttgtggcatccacaatggtttgagtagacgcatcagcagaaacaaatttctcatcgacttcatagtgtcttccaattagggttaaaacatttgaacctagcgtcattacgggttttatttgtgatggatccccaacgaccataacctttttacttctaaaaatggcaccaacactagcctgtggcagtgcttggcccgcctcgtctataaacagattacctattgaatcttcattaagatttttaaacattcgaccaaaactagcaaaagtagtgctgacaacggggatcgtgaaattcaaccaattccatgattctgaaattagctgctgtccattctcttttcccaagtattcagattgcctattccaaatatttctcgcggcttttaaattccttctgttttcatacagaaattgctttctaacttttaaagctgaaataaatagctctgattgtaatttacggaatttcactgtaaaccatggattagacttttgcagctcatcatacgattgtgaaaaatctggttccttaatgccgctttgatacttgagtttttctaacaatacaatttctcgttccacttttttaaaaccattttgttgtttgatcatccatcgatcgaagttagctcttgtgtcctgagtttgtttttgaacatactcacttttcgcaacattttcccttaacctattttcgagtcgcctacggtcatttaaccatttcgttttttgtttagatagatcatttaaatgattattcgcattattcagatctttgaagtactgctcaacttttgccttattaaatattttctgaagccacaaaaaacttggcttttgagaagtaactacgtcataattccttttagcttgagcttgtagatcaattaggttttctatctcaacagaaggatttgaccaatcctcttggagattttcaatttcttgtcccagtctttctagttcacgtctcgcctcttcttcctgtgagattaaatctgttcgtttctttttttcttcttgttcaaatgcaaacatttgctctttatgcttagtttttaattttcgaagagcatacattttctcgctatagtcttgcattttatctctttcgatttttaattcagcatacagacaggagaattcttgatatacactttcacctgtattcgctggatcatgatactctaaatctttttcgattgcttcaatggttaaaagtaacttgttcatgtttgttgacgcaccgccctctaacgagaacacaccccaattttcctcatgtaaaaactcacttttaatctcgcgattctgtccaaaaccctcaccggttaatttagaattggaaacctctttaaaataatctgcttcatctagtagcttttgaaaatcgcccgcaatcgtttctttctttggtaactccttaacaatattttggaccgccccattgtttgaacttgcaacaacaatgtttttatctgaaatggagtgtggtaaaacaccaagcttaaaatctttccaataaaccagactccctttaatccttttatcagaaagctgcacaatttccgctgtctgttgtacgactaaatcagcaaaaatatcttttaacagtgttgttttccctgttcctggcgggccattgacactacgaatatcatttttatcatttaaagctagattcaccgcaacctgctgcataaatgaaagctcgaaaccgggattacttgggaaccgcccgagcggatagaacttaggttgtaaaatagttgtctcgaaaattcgggggttaaaatgaacggactctttattgccatccagattgtgcctatgtcccgaaaagccattaaaatatcgatccaaatttttattagtgattgtctttgctttgttcagatcttcaataaagaacgaatgtagatttacatctccgttatccaggtttttcacaaatgcatagcggaaattttctgcggaaatatgatatttatgaaaaagctcagagatggtggtatgaaaaccttcttcaaatttgctgttcaaatcttctctaaatacgttttcaactttcaaaaaatctttcggtaattcaccatgttggcggatataaccactcattgtataaaacaatttgtctgctagaaaattcaattcgttatcaaaatagatagagaaggtgaatttgtcagatttactaacttcctcgtaggttttagcaatcttgtatttctccctcaatagttcaacaacttcttgaaaatcgaaaatatcgaaatataatgctaagcccgatttcttaaagaacttatctgatacatcttgttgttttttttgcttcattaaaaagtctgaaaaaaactgattccaatcctcttccattgtatgtatgagctttagcgatttgtcttttttattaatagaaccttcggataactgctcgatcgtaatccaagcatttaaaatatcttgccgtttattcatgagtctccccccattatcatctgtaattactattataaagctctcaccctgtcatctaaagacaaaaagaaaagctccccaacttagagagcttaccaatgtaccattcaattatataagatttcactgcttttaacagtgtattgtattccattcttattccagctctgtctttgagttaatcttaatgacattgtgcatgtgcaggtttactaaatgcttgtcatttcctgttgttattatttttcagaacgcccaacgaacacaagcgacgctatacgtatcccggcaaccggccatatcgaacgtatagcaggctgcgttatattttattgggataattcgctgaccaatcttcttcttcactcactccaaaaagccccgcatccgcaggacttgtctcattttatcttattcatacccctatgcggtgatggtcagaccatcaggtaccccgcattcttttcgcattctcgcgcattcagcgcacttggtcggcggccccaatccgagaattcgtaagcgtacatcctcttttctgttcaagcttactgcaacagtttacgcaataggagtaccattgggtatttcaatatccggcttcaatagaatgacatctcctttttctggaacgcctcccaaaactaatacctccgatttgaatcccgcaatacgccgaggaggaaaattaacgatcgctataatttgcttccctacaatttcctcaaccttgtaacgcttagttatttgtgcacttgaggatttcatcccgatctccggtccaaaatcaatcttaagctttatcgcagggatctttgcttcttcaaaaaactccgcttccttaatcgttccgacacgaatatctagtgctgcaaaatcatcgatcgttgccaacgttttgcctcctccactaaagtctttaaccgctcacgaaaatatctctcacgctttccggcagaacttaatgagttccgctcggtgttgcgttttactgcgctgggcggaacggctgcaggagtcgaatcccttcctcaatggatccctccatcagttctaagagctggggcaccagttcctgcatccggggtgcgctcaggtgccgatcgagggcatcccggttttcccagcgctcgtagatgatgaatgtgccaggctggccttctacctcgtgagcctcgtagtcaatgttgcccaggtcgttgcgcgacggggtgacagcagcagtcatgaatgccttcatctcggcttctctccctgccttagctctcgcctcccagagtacagtaacgtaagggttctttgtatcgttcatactaattcctcctaatttataaatacttcgtattttttgctttaccgttttctcaaatgggggaattccccgtttatgcttgaaattccagtgtatcaatggcttagtttcatgctgttataatcgtccaaaagaacgattaaagttttggcccgcaagaacatcttgacgaaccacatctaaacgccgtgtttggtattcaaccaaagcttttgttatcgaattcggatactgtttaatggagtccataatggcaaccgtatcatcaagtgagtcattaaagcctgcgccagtcattggtgacatggtatgagctgcatcgccgatcatggctattcttccttttgacaatatattagggatatattcattaacaggtgccccgattaaactgcggtccttaatcgcgatttgcaaaattgcatcatcttctttattccaatttgcttggctggtttgtgatagttcttctagtagcgaatccggaatatcttcaccgtataaggaatgctgggcaatcccgccctttaatacacctaattcagacagcaaatgattatgcgaatgatcaaaccagcaaaaaccaatccatctctggccaggattggttcccccttctatacctggcatcacagcagttgtcaatgtaccggcagcactatcgttgaaataagcgctcgaaagttgccgttttttccagtctttccttggcagcagttcttcgtccaccttccctacccacaccagatagccagcataatctgcaaatggtttgtcagggtttaaatagcggcggacaatactgcgatatccatctgcgccaatcaaaaagtcacctttaaacgtctgctccttatcactggtagcccaagcagatgattcattttgcccaacactaacaattcgtgtattgtgctgaagggtaataccaggttctttagcaaccgcattgcgcaaacgctcttgaatggctgaccaagcttcaacattgttgtttccattggatgccaagtgtcttaattttcgttcaatttcactattactataaggctttgtgtgtaaacgaataaaagcaccatttcttaatgatgaatctgcacgttcaagaatggtaactgtataaccagaacgagataacgcaagccccatcattagaccacctaaagatccacctacaataatggcatgttcaaacttaatttgtggcatatttcattcccccattttagctttctgtccaagaggattcgtgaaactgcccgttactgcagcttcatctggctgcggagcatccggtcgaggagtttgtctgggagaatgcggaccagtcgggtcagcagtgccgaatcgcgaccgaccgtatagcgggtgcgtggctttctttcgtggattgcgcgtgaaatcactgctgccactttctcagggcgtataccgtccgttgcccacgtttcagcctgagccttcacggcgtcaaaaagacgatcatggcgtcggtgctggtccggcgtcatcaacttggccagccgctccgctgtcgtaatcccgtgctccgacaggccagtgctgacgccacccggagtgatcatgattaccttgaggccaaacgaggacatctccctgcggagactgtcattgatcgcttccatcgcatacttcgcagccgagtaaattccgaatccgggcatggagaccttgccgccaacggagccgatattgaccacgcgtccaccgctgttcagcaaggccggggtaagcgcctgaataaccgcgacctgtccgatcacgctgacttcgatctggcggcgaaattcatcgagcggaaccatctcaagaggtgcattaacggcgatgccggcattgttgaccacagcccgcaaagggcgaccaagcggatcttgctccacccgttcggccagcgcctttagtgtgtcgatattggtaacatcgacgatcatcggctcgatatttttgcgtctgattttgtcggcgtcttcctgacgacgaacccccgccaaaacgtgaaatccttcagcggcgagctgctccgcggtagccctaccgatgccgctggacgtacctgtcacgacgaccagttcttgagttttgaatgacatcgtaatcctcctaagtttgataagatatgaatcactgtatagcactgctataccagcattatagcaccgctatacaaagttgtatatagcggtgctatatattttctaaaatgttgccctgcggtctgaacatcgttttagcgggtgttgcgtaatgctctcggcttaccacatttcacttatcacacaacacaaatccaaaagaactaatgctcgcatcctcaaaacataaaaagatcgccatcctctggaggtccaggtaggataggcgatctttcttatgcgtcttctaaattggggctttgcctggagtctccaggctctgtcattgaatccctcattttgaatcggcgtccggcctttggatcaaaatgatctgcatcacgctttcccgaatgagatcaacgacgtcgggttggggtgggggtaccttacgaatctgggccgtcacatagagccaagaggccgtattggcggaagtccagaccagatctgccgcagcctgggctgacacagccagtttgccttcggaggcgactccctgaatattttgcactagtgcttggtacgaatgatctgccgcctcgatatgggcgccctcgagtaaccgccccatcatcgccgcataaatccgaggacgggctgccgcgaagcggacatagtcatcccatccttgacgaagagccatctctggaatggtggactccactgcggcaatcttgctttcaaataactgtttgaatgcttccactatagctgcacttagaagtccatcggcatttccaaaatggtggtagagtgtaggagccgtaacctgcgcgatcgcagttacggctcgcgtcgaaaatttggctccaccctcctcttcgagtaccttaagagcagctgccaatattttatcatatgtgttcatacgcccattatagcagtgctatattcgtatgtccatgatgaagcttgtacgcctgtgacattatccctgtagccaaaaaggtactgagcatttttctttcagattaacttcctcattgtacagaagagatggagctactgttgtggatattttaggtttggcagagccaaaacctagtagtgaaatcgcaacaatatagttcgccctacttatgatacggttcaccgcgctatccataacggcaagttatttaaaaaagacacctgagtttggtattgtcccttctagtagacaagaga

SEQ ID NO: 2626 - DNA, 2852 bp, Unknown
  Kingdom: Bacteria, Phylum: Firmicutes, Class: Bacilli, Order: Bacillales, Family: Paenibacillaceae, Genus: Paenibacillus
ttaggataagccctcgaccgattagtattggtcagctccatgcattactgcacttccacccccaacctatctacctcgtcgtcttcaaggggtcttacatactgggaaatctcatcttgaggggggcttcacgcttagatgctttcagcgcttatcccttccgtacatagctacccagcggtgctcctggcggaacaactggtacaccagcggtacgtccatcccggtcctctcgtactaaggacagctcctctcaaatttcctacgcccacgacagatagggaccgaactgtctcacgacgttctgaacccagctcgcgtaccgctttaatgggcgaacagcccaacccttgggacctacttcagccccaggatgcgatgagccgacatcgaggtgccaaacctccccgtcgatgtggactcttgggggagataagcctgttatccccagggtagcttttatccgttgagcgatggcccttccatgcggtaccaccggatcactaagcccgactttcgtccctgctcgacttgtaggtctcgcagtcaagctcccttctgcctttgcactcttcgaatgatttccaaccattctgagggaaccttggggcgcctccgttactctttaggaggcgaccgccccagtcaaactgcccacctgacactgtcctcgcaccgggtcacggtaccaagttagaacctagatacgatcagggtggtatcccaaggatgcctcccttcaagctggcgctcaaagttctacggctcccacctatcctgtacagatcgtacccaaattcaatatcaagctgcagtaaagctccatggggtctttccgtcttgtcgcgggtaacctgcatcttcacaggtattaaaatttcaccggatctctcgttgagacagcgcccaagtcgttacgccattcgtgcgggtcagaatttacctgacaaggaatttcgctaccttaggaccgttatagttacggccgccgtttactggggcttcggttcatagcttcgcccgaaggcttaccactccccttaaccttccagcaccgggcaggcgtcagcccgtatacttcgccttgcggcttcgcacagacctgtgtttttgctaaacagtcgcttgggccttttcactgcggccccctcgggctattcaccctaccgaggcaccccttctcccgaagttacggggtcattttgccgagttccttaacgagagttcttccgcgcgccttagaattctcttctcgcctacctgtgtcggtttgcggtacgggcaccttctcctggctagaggcttttcttggcagtctgagatcatgaccttcgctactacaattttcgctccccatcacagcccagccttaacgatgtgcggatttgcctacacatcagcctcactgcttagacggacatccatccgtccgcgtcactaccctactgcgtcaccccatcgctcataacggattacggtggtacaggaatttcgacctgttgtccttcgactacgcctatcggcctcgccttaggtcccgacttaccctgagcggacgaaccttcctcaggaacccttaggctttcggcggatctgattctcacagatcttttcgttactcataccggcattctcacttgaatgcagtccagcgctccttacggtacaccttcaacccgcattcaacgctcccctacccctgatgcaagcatcaagccatagcttcggtggtgtgtttagccccgttacattttcggcgcagagtcactcgaccagtgagctattacgcactctttcaatggtggctgcttctaagccaacatcctggttgtctgtgcaactccacatcctttcccacttaacacacacttggggaccttagctgatggtctgggctgtttccctttcgacaatggatcttagcactcactgtctgactcccggaactaaatctatggcattcggagtttgactgagcttggtaacccttgcgggccccgcacccaatcagtgctctacctccacgattcttctttccgaggctagccctaaagctatttcggggagaaccagctatctccgggttcgattggaatttctccgctacccccacctcatccccgcatttttcaacatgcgtgggttcgggcctccagtgcgtgttaccgcaccttcaccctggacaggggtagatcacccggtttcgggtctacgtccacgtactcattcgccctattcagactcgctttcgctgcggcttcagctcttcaccttaaccttgcacgggaacgtaactcgccggttcattctacaaaaggcacgccatcacccatagatcgggctctgacttcttgtaagcacacggtttcaggatctatttcactccccttccggggtgcttttcacctttccctcacggtactgcttcactatcggtcgccagggagtatttagccttggcagatggtcctgccggattcatacggggtttcacgtgccccgcactactcgggatccgtctcggagagaacaagttttgaactacagggcttttaccttctctggcgggcctttccagacctcttcatctaaccggttcctttgtaactccatgtgagacgtcccacaaccccaaggagcaagctccttggtttgggctaatccgcgttcgctcgccgctactgacggaatcactattgttttctcttcctcagggtacttagatgtttcagttcccctggtctgcctctattctgcctatgtattcagcagaaagtgactgtcgatgaagacagccgggtttccccattcggacatccccggatcaaagcttgcttacagctccccgaggc

SEQ ID NO: 2627 - DNA, 38709 bp, Unknown
  Kingdom: Bacteria, Phylum: Firmicutes, Class: Bacilli, Order: Bacillales, Family: Paenibacillaceae, Genus: Paenibacillus
tgatgaaaaaagggatttttatcagtataatttagtagaaattactgggttgaatgtagtaggagcatatgaccggaatttataatacgatcaaattttccttttacagaaatgaggggtagtcttgaccacaactttgtccgtgaaggtaaagaaagatggaagcattgaattgctggatttatttgatgcactttcactagaactgataagcagggtccccggccttttgaaagcaaatccattatttgacgacaagagaaaggatgcattattgatcaaggaaataaacgaactaatttataacaagaaactagacgaacaattctcgctggcaaaaaacagttccttggaatttaaaatgatgcttgctgatgtaattgaaaagttgattcgttatgagaacagatgaaatctttcttttagaaggagtgtgttaatgtctaatataatttggcaattacccgttaagcagcaacattactgatcatgagtggattcaccctaaagcaaaatatcatgcctttaaagacaatcaatcagtatgcaaaaggttttatcaaaagacaatttttttgaagtgagcattaaaaaatctgaattaatacaagaaaagcaattagcgtgtaagaggtgtttaaaagttttaaatttagcttgattgataattaaagttaacctttaagggggtatataatagttgaataaattagtagatggagtgttttccattagttcggcaatgattcaaaaatccaacaggcaaaaaaagataaatcgcgaattacaaggaatttgttttaaaattggttgcccttcgctctcacaattaacctacacagaacttaaaaaaataaaatatgagtataataaggggcaatactttgcagaaacagctatcttggaattatttgatgaatttagattaataaaaatttttcagggttggagcaattttgagattccagcaagaaaaaaggaaatccttagagatgtgatttatgctcatatagaaggcaaattcacactctctgtccccgctttggctccacaattggaatggttagtggcttatgctaacgagataaattttaaattaagtgcgggagacctacataaaattataaaaaaagatgtcgtaaaccaagatagtactattgacaaagacgctctagactattatttgaaaaaagtgttgagtgggtttacccataacaattttaaccatgaagaaatgagtaggcatgcaatcttgcatggagcgagtgttgactatgctacagaatggatatccttaagatatatacttctatttgatttgcttttgaatatttataagaagagcaaaagagttactgtagatttagcaagcatgataaaaggttgattttactacgagaaggaggtgataatttgagtttatatgaaagtctgtcggaactttaccatcaattaggttggaagtacgaggaactacatatcgcagtagaagatgataataaaaaagaaatattgcgacttaatgatcaaattaattcattaatgcaacaaagcgaagaattatatattgaaaaactacatacaaaattaccgtaagaatgtagattggatatgaagaagaaatttaatcgctagatataaatactttgataaaagttcaattttaccaaaatacatagaggaggaaaataaatggtgtacgaagtaactaagggagctggatacaagcattataaaggaaataactacacaattgtcagtatggctactcatactaaaacaatggatggtttagtgatctaaaggataaaaataataacatttgggctagactagattgatgaagaggaggaggtcaatgagaatattaactaattatgaagatttaattggtaaaacaatttcttttgttcatgcagcgcaatttgccgaagcaattaccattgcaacaactgataatgaggtgatcgttatgaacagagaaattgatgaagatgaaggagaaggtaatattagaatcttttcagagtttagagcacttgaatacataaaaaaagaagataatagatatgtacgtaatagtcttgctaaacatgctggatttgacattgatgaatacaataaattgaagagagaagagtcattgaagagacaagatgagtggaacttagagcgggaaaagagagaaagagaagagtttaatcgcttgagtagaaaatacaatgtgtatggatacaagtattataaggaaggtcaatggtgtcctcttaatggaaatgagaaagtctatgaaacccacgagatggtcaaaatattaaaaataaaccagttggcttatgttgttaaccatgttgggtacaaagcgcacatatcatttaactcgaaaaatgaactggtttggatgttgcccgaattagactatgaatcggaattttatattgatcctagcgacaacgaacttaataatgaattgctttggataattgagtaaaatcttcattttaaacgatatacataacttaccgcagaaatagtatatacccatttgatatactgttaaatgggtgatgaatatgtttgtatctccaatgcttttagaatacgcagaggacaataaaccatttaataatgataagtatataacagagttaaaactagatggaataagattaatcgttagcaatatagatcgacctagattgtatactcgacacaataatgaaattactgcaaacttcccagaattgattgattcgttaaccattcctactggcagcataattgattgtgaactgatcgtatctgacatagatggtaagcccaatttttcggcagtaatggagaggtttaaatcaaataaaagtaagcataaagttactgcttgtgcgtttgatatcattaaatataaaaataaggatataactaagctgcctttgcttgaacgtaaggagttgcttgatgaatcattcaatgaaaataatttctattcaaagtccaagtatcttgttggcaaaggtgtagaatattttgatttggtgaaacaacaagggctagaaggaaccgttcaaaaactaagtagctctaaatatgaaataggtaaaagatcttcagcatggagaaaagtaattgcttatgaaattgacgaattctttattgttggttatagaaaagaagacttcggatggctattgtctgatggagaacgtgtattaggtgtaatggaacttggagtaggtagagcagagagacaagcaggatttaaggtctttcaacaactcaaaactaaagagacgaatgacatggtgtaccttcagcctcttataaaatgtattgtcaaacatagaggatttacgaagaataatatgttaagactgcccgtgttcgataaatttgtgatttaaaggaggtgataaatctgccaagattattgaagtgtccggtatgtggacaatatggaacaaaggaagatatggttagggaaacagataagcggcattatcataaggaatactgtcatgagaaatggaagagagaaagagtttttaaacaaaaagaacaagaggaattagactcgctgacggacactatagttatgacacataaactacaaagcagacaatctattcccaaatctttttatccgttcattcaagatctgagaaatgattccgtgttgtttggtaagttagataggaagtataagcaaggagtaacgtataaagttattgaagatacatatgattactgtactgaaaaaatagaatgggccagaggaaataaagaattcaaaactataatggctgagctgaaatattgttttgcaatagtaaaaaacaatattgagaactccattagagcgaatagacaaactaagcgaaatcaagttgagtctgaggcattaaataagcacgtagaatcaatgagtaatgtccgtgagaggattaaccagatccaaattaacaaagtagcatcaaatgatgagtctgaccagattgacgttacaacactgtttgactgaggagggcgataacatttctgacgtaacatctacaatcgaagacatttcaactgaaacgttagtggtgggaagcttttatttaaatcctgatttacttttagattatagcgaagtaattaaatctaaatatgattttaatcagccatcggctaggtttatgtacgattcattacttgatttatatagtcaacatgcaggaacagaaataaatgaagtaaaaataaacatatatatgaattcgaatgatgaacgaaaaaagaagtatgattatctgaagggctactcatacatagatagaattacaagaatagttgatttagatgatttccccggctattatgcgaagcttaaaaagttttctctgcttagggaatttgaacgaaaaggtttcccagttcaaaaattaatggatagaaaagattttgacaagattgggactgaagacattataaagggaatggagtaccaaataaataccatcggtacagtgattggtggagtcgaggatagtgttattttgggccataacatgcctgaaaagattgaagagtggaagctgactccagatgtgggcataccgataccatttgaaataatcaatacactgctgcgtggtcttagaggaaagaaatttaatctttttggaatgcatagtggatgtggtaagagccgtactacaagtaaaattgcttgttatttaggtattaagttgaaaattcctgtattggtactagttaacgagcaagatgaaaatgaatggttaggtatgcagatcagcagcgtcctaaacaatcctgaatttggattcgatattcaaatgaaacgaagaggtatcgacggaatcgatgaaacgaagattgtaactggaacgttgactgaagacgaagaagatatcgttaaggaagcagctcgatacataaaagagaacagtaaaatctattttttagaattaaataagtacgacgaaaatacactcaagcgacaaatcaaaaggcacaagctaagaaattgtcagttaattatatatgacacaatgaaagcaccagatcatgattggatgactttcgtaagaactgccgatatgctcaaagaggtagcaagcacagaggacatcccagtatggtctacattccaattgacagatgatagtttgtttaatgatatgttgacaagccaagccattgctaacggtaaacatattaagcacgtagccgatgcgctaatgatggctaaaccaatacctagagatcaatacgataagtttgttatatacaatcctaacgacccgtttgttggagagtctacagctcaattagatatacatacaaactattatatggttgttattgataaaaaccgtggaggtaaagacaaggatattttatgttttgaagttgataaaggtaaaaatatatggattgagagaggatatcttgttccatctgaaaacgagaaagaattaaagcaactcaagaaagaaagcaaaaagcttaaaacagaaaaacaagttaaggatttgaaaaaggcacttaacaaagaagaatgacttgagaggtgatataaaattgatgctcaaactttaaaagaaaacataataagagacaataaagttgcagatattttaacatctctcggttgtcatattaatgataggatgtctagttatggggaaataagatcaacaagaccgggaggagacaatccttccagtcttcaggttttcactgatactttgcttgtaaattgctacacaaacccccttccaaaactgggtagtggacatccagatatcataacacttgttcaacattataaagacatctctttttcaaaggctatgtattatatttgtgaagtttgcggttatagttactatgctgagtacaagcatataaaaaaagaaatagatccatgccttcagtttctagatttaatagaaccaaagaccgaaatctatgatgaagtaccactaagaaaagtagatgaatctattctgaattcgtacatatctttccctaataaattatttcttgatgaaggaataagttgcaatacgcagagattgttcgaagtcgggtattctcttagggataattgtataaccataccgattagagatgaactgggagcgctagttggagtcaaaggaagaactacacttgattataaaacattaaaaacatctaaatattggttccctataccaaccccaaagagccaaatcctttatggcttagataagacatacgatcacataaaaaaggctggcagagtaattgtgtgggaagctgagaagagcgttcagaaggcatggagctatggtattaagcatactgtgagtgttggtggacacgaattaagcaaaacgcaggtgttgaagcttgaacgtttaggggtagatgtgatattggccttcgataacaacataagtgccagcgatctaaaagaggaagcaagtaaatttattatacgagataatgtttattgtatattggcacatagaaatagagatgtactggcagaaaaggatgcaccaattgataaaggattagaatttttcatgaaattgatgaatgaagagaaatacaagataccagtctgagtaaaatatagtttttatgatcaataggagggaactgtttgaatctagagcagatgaagcaagaatatgagaaggctaaagttgatttaactgttgttgagtcgaaaactgccaaagtcgggataaagaatgaaatgtatagcctgaaggacaagattgatagagaagaatatagaaatacatataagttaaatgttgaggttataaatggtgtcgagtttgctattccagaatgcttttcgtggtatagaaaggactatgttgtggagctgaaggataattgcttgtatttgtttggaatgtcagagaccgatgacgatggcagcttcaccagatatggttacgtctggattccgcagaataaggataaatttgttaaactatctatcagagtgttaggtggagatcgcttcggtgaaagatatttcttagaagcagattattacaaacatcccacagataaatattcatatttaaataaagtaatctacaccaatagcaaaaattacaaaccatattacatatacgtattgaataagtttggttttaaacaaaaagaagacaactacaaaaccaatcttcttgaatggaatgaaattaaaaaggaggtataatgcctcctccttatatattaaacaaaaaaatagcagttgacaccaatccaatatacaaatataattaaattatgaaacagagaggtgtggttccatgcacgaagagcaacctgcaaatctaattcctactgagaatatagatgaagcaactcatgtttttattgcagacaagaaattcaacatcaagaccacggtgggaaagttttataaattatatagatgggaggcaaacgcaagttcatgcggtgtagctgaagcatatattattgatgatgaagggaaagattcaacggggttcatgtattattgcaaagctaagttttatatacaaaaataattaataatacatataagaggttgaccgtagattgatcatagccaacaacctctcaaactcgtaaaacaagcatgtaaaagttggattttatttaaaaatgaggagtgaccataaatgaacaaaactgctaaattcggaacttacgctgcccaccagccaggctatgatcgattcaaagagttcggaaaacttgatgattatgcatatcagtcactggttcacatgcagaacgcctctcatcagctttcttgggcattgactgtcttagatcatgccaatattcccgtggaactgcttgaaggggtacggttagctgtagtcaaaacatctggtacatttggggacttgcaagaaaagttgcgagcttataaaaaataatgctaagggagagacattaaaaatgaaaacctgcgattacattagctgcaacaaagaagcaacattttcaggatacatctttggacatatcagaggaatcgacgacaaagatggttttcatgaagtagtagcttgcgagaaacatgctaaacgtgaagatttttttgtacagcactcgactgaaaatatagtaagttcattgggtctaaatactaaggaggaattgcaatgaagcaatatgagccacaaaaatggaacgtacatcaagtcgaagttgatttactcgatgaggatggatttagcggtaaaattgttctcgaagttgggggcaatattcgcggaagagatgtgattgattcggtaattcaaatgattgaggatggagatttttacccgattaagcacgaactgaatgaaagatatattgccgcgatttcagacgagggatatccagaagaatacgttttatacaataaaaatggagatgatcttctgtacgatgcaaatgacatttctgattatgtagttggagtaaatatcgtttcatatagaggtgaaaaataatagtttgtaaaatttgaattttaccaagacaaatatacaaaaaggagatcgcaaatatggagcaatacctaattgatgaatatggtgtaattgaagacgaaatatatttaaccaaagaaaatgatatcgtagagcactttaaagatatcggtagagattacttagattgtggacaagggtattacgaggatgaggcgtcacttatttgtaaagtagcagacaaattttatagtgtcaatattcatgcagatatagcaagtgacaaacaagatgttggagatagactttattggattgatgagatttcaagcgttacatacgaagaaattaataaaccttcaccgaaagaaaagacattggtaaattactcactgatgttgaccgaagatcaaaagcgcagcctagagcattttattagtgaatataaaattaaacaagtcaagtaattaaacaaaaggagagattgtagatgcaaaatgttggtaacggaagtaccacaaagacaatccttgaatttctaaaagcagaagggcctgcaacattatattctaacgtagtggcatttagatatgttagggagttggcttttaaacacagtataggaattgataaactcgttaataaaaattttaagtcagtagatgctgatattcctttggttgcatggagatataactaagatcataaaagaagagttttacaaagaaagggaggaatacgatgaaaaccaatgcagaattaataagtgattggattacagaacagaagaatctcggcaaaacagatgaggaacttaacaacaaagccttctatgaaggttcagatatttacatcattaaaaagagtggcaagaagggcatgtttgatcttaaatgcacttttggtggagctgtatcactggatgacctgcgaactgcgaagtagttccaagtaatcagaaaggaatattatgaaaaatagaatgattaaaaatttgcttttattgtttacttacattttgggatatgaaatcttcagcaatttagtttctaatgactggatgttttttgctggctcaataacggcaattatcgtattgctatccaagaaatttgggatattcagagaagcaaatcactataaaaatatacttttacatagttaaaggagaataatctatatgcctaaagttgcattagtgaaacacaatggaagttcagttctttacgaattctacactgatttagttttaaagaagggtgatctggtagtttgtgatacccaaagaggatatgaaacagccaaagtggtgagctgtaaggagcgcgcagagtgtagtgcaacgaattggattgtttccaaggtggacacgaagagtcacttagaacgagtagagaaagaaaaacggattagctatctaaaacaacaaattgatatgaaaagaaatggatttacagatgaatatattaatgagttgatttctttgaaagataaagcgatgtattctctgattaaagagcttgatgagctaacaaacaaaaatgacaccaagaacgaaattgaactaaaagattcattttattttaaaaatcagaatggatttgaatattatgctactaaattaggagataagtattctattgtacacgttgatactttaagtacctatgaaattaatgtaaagacagtaagagaatatatctctaaaggggaatggagaataattaagtattataaaatgggtatcttttgaggagagtgggagtaaaaacaagattttattatgaaatataaaacaagggagaataaaaaatgaaaattaaaacaaaggactattcatatttaaaggatacatacgttgaaatccaaagaagtgattatgatttcaatattggtttgcaagcatttgtaaaagaagtggatggtgataatttgtatgtggaagtagagaacggtgagactttctggactgatgtagattcagtatatcatgaacctgatacacgaaaacatcctatcagaacggacatgggattttataaacgctttttatatcttcaacaagagattcagggtctgtccactaagtttcgagatactaatgcagaaatgtcaccttgggaaattgaaggatggttgaaatacgcaaaaacaattaaagattcattcgaatcgcttattgatgaagcagaggaacggatggaaaaacaataaaatgatgagtaaaactactattttataaggagtaaaagtatgcaagtgcaacaattactagatagatgcaatacccaaattaatatgttgggcaaagatgcacaagttggtcttgttatgccgggtaaatggggtaagaaggatacaaagcgtctcattccgggtgggccgataggaagaattacagccgaatttgatggtgagatttatggctataaaggtagtgcagtgcatgtctttttctttgccagtgaagtaaagaaagcatgtgaaaaggctttggagagcaacaacaatggctaataagaattccagatttcttattcaagatacagtcacaggaaaatatcttttgcatgtggactcgggtttagatcatccttatgaagatgttaacgctactgaaaaagcaacagtttggagttcattggaacatgttgcttaagtgttgtggtggtacgtggatatgtacagagattatcagattgttaacttggatacgaatgaagtatttataaaggacaagcaacgaggaatcccacatgtaatgtccgtatcaaaataaggaggtgattagaatagaaactttagatgtaatgctgaatgggtatgggattgtcacaaaaaacagcgagggtaattggcgtgagtttaactgtattatgttggagttacaggccgcatggaagaattttagtgaggtagagaagaaagaaatgttggaatacttaggaataaactaacctgaactggagtgattgatatggtgaatatcaaaatcgtaaataaacagacaggaagagagaataggtatctcacttatagttttatgaaagcaattaacaataacattaaaattacactacctgaaaaattcaaaataagtattcaataaattggagaaaggaatgattcaaccatagcttggaagcaaaagcaacctaaaatcccatttgaaccttatgacaatacatatagtaaactcgccaagattaatggaattgaagatatagatcaatttctaaatccactctctaatgttgttcacagtccgtatttgttaaagaacattgatgcactggtgtcgagggttattaaggcaatcaaaaacaatgaaaagattattatttatgctgatgtggattatgatggaattacttcggcagttattctatacaaatggctaattaacttcactgacaatgttttcattaaacatgtagagagatcagtcggtcacggttcggagtatatagttgataaagttgaagatgatacagatttatacatagcagtagacagtagtagtaatgatgtagaaccgttgaagatgttggtggataagggtattgattgtctagttatcgaccaccatacagtcgatatttacaatccctattgcatcttggttaatccgcaacaaccagaatgcaagtatccaaataaaaatgcttcaggtggactgctagtgttcaaggtgtgtcaagtgttggatgactatatggacacatcatttaccttagaactaagtgatttaccgggatttgctttaatggcagatatgatgtccatgatggaaatggaaaataggtattatgctatgttgtcacttaaagggttgcgtcatgaaggattgaagcttctgttcgaatctatgaattctgacttgaagactctaacttcaacagattttctttatggtgcaagtcctgccgttactgctgcaacaagagctgataatatgaaattagctatagactttttaatgagcgatactatttcttcagacacaaaaaaatatgtaaaagaattaattaagttgaacgaaaacaggaaaatagttcaatctgaagcgctagaagccatgaaaactgggttgtgtgaaagcgataaagtaataattgtttttgatcccactctaggcagagggataaatggattagtggcacaagaaatttcaaaaaaatatagtagaccagcaatcgtgcttggatttggagatgacaaagatacatattcaggtagctttagaggactggatgacttttcaatgttagagttgctgagtagatgtgagaatactacatatgcagcaggacatgacagtgctggtggtgtaggagtgttagtgacccatcttgaattactgcgtcaggaactaaattctaaattaagagatttcgtaccagacaacacaatgtattatgatttagagtttagtgcgaacgatatagatgaaagattcatcaaccatctaacagagttctatcgctactcaggaaacaactttaagccgggatcatttctaattaaagatttattcatttcagacaagaaactaatgggtaaagcgaaaaatacagttaagatagattgcggaaagctgcaattaatgaagttcaaaacaggcgaagaatattatgagaaagtacccgtgttcactgagatcgaagcattgggttcattaaatgtgaatgtttggactcagtatagaccaaagaagaagataattaagacttgtcagttattcattgaagattataaagaagtaaatcaaacaaaataataatacatataagaacggagaaaatatacctatgaaattttacggaatcgcagtaaacacacaaaacaaaaacatggtaatcaacaatctaccaactgactatcttggagcagtaaaagaggcaaaacgaatcgcgactaaagaaggattaaagtttcaatttgttaagcctgccatgaacggacaaaaagaaggggctacactcacgaaatttgcagcgcaacgcaagaatcgtaagtctgtaaaacggtgattttatgagagtcaagataagcgaacatgcgcgagtaagatgtgagcaaagtaatattggagtgggtcgccttattaaagaggtggcttcactcccaaatgttcaaggcaagattagatggatgactagatacggagtaattgttctggaacgggtaaatgatactttaattttaattaaaacgtttatagctaagtttaagtataaaggcaagcaatatcataagggatgtagaacgttctaatacatgaatgaaagagtgatagatttgaagactgtacttaaacataaaatcactggtgaatatggaacgctagaatattctatgtttggtggaagtgttcattggtatgatgaaaaaggaattcttagcaaggattggctagtcgattggagactatttttaagcattgggatattgctgaactgccagaagggtacgaaattggtgagtatgggggtgtaaggaaatccgatgaacgaagtaattcatagagtttataaaattagacacaaggagacagggttattttctaaaggtgggactcatattcatggaatctggacaaaagaaggtaaatcttggtcaaatatcggacatttgaagaatcatcttaatcaatttgtgggctacagcaatccttacactgatgccgaaatagttgaagttgttatcaactatgatatgtgcgctaagatggacgtttctgagattatgactcagattatagaaaataaacaaaaagtaaaacaagaagccgctgaaagattaaaacaatgtaaggaacagttagagagaaaacaactggcagagctacaaaaaaagtatgaagaaaagtaaaatacaagtttgattaagaagggtgaatgatgtgattttcgatacagtagattgtccatattgtggatgtgaaaatgacatgtcagatgctttaagtgatggactttcgagtgacaacaagttggattgggaatgtcaagagtgcgaagaggaattcgaagtaaccgtagagtttgaaccaagctacagcgcagagaaaattatttaccataattgtgatgtgtgcagtgtaaaaacaagagacataaatgaagagggaagagtttttcctttccctaaagccctaacaggaaagaaactttgttatggatgctggtctaggttttgcttcgaagaaatggaagagaatataaaatagtggttttataagaataaggagtggagaatatgattgtcagtgaaccagtaaaagtaaaagttgagattgaggatttatcaacgggctgttcttacatatacaaaggtaattccataaaagattgtgtagattactttatttcgttgtttatagggaaaagaccttataaggtaatacatgttagcgcacgatgaatttagataattgcatttaatatagatattggaggccaataaatgaaaaagattgaacgacagcaagaagattttaaacatcttctcaagttaattgaggagaatcctgaacttgaaatcatggcaatggttgattctggaattgtctctgatgatggacgacatatgtggtgggttggaggttgggggtctgcatcagtagaagaagtttggagtaacgatgaaagaatgtatattctctctgaggacgaagaaggacttattgatgaagtatgcgacaacatttgcgatgaaccaaactatgttcttctcacagatgatgaattagaacaggcagcaaaggaaattattgcaggttatggttggaagaaagtaatcgcagtcaaaattaataccccgtaaaataatgcttttactaaaaaaggagagtgaaaatgtttgatgagtactaatctagtccgacaactcagtataaagcaattaaagaaacttactgaagacataaaacaagaaatagaaacgcgtaaaaagaatcaagctcttgagcaatgtggatggtataagcatactgctcttcggtcggcagatgttgataatttcgtaagagtagaggatctatatgaaataggattcttaaggtggttttctcaacacaagttacaacataaaattgatttagataaatataaatacatatttagaattacagatgataatttaattgatgatgacttagatgtttatgcttttagtagttatgctcacgggtggcttttcccagcatttgaagaatgtccaacagtacaaatctcggaagaaggaagaagttatttattaaaagagttttcggagtttagattttgaatattgataaactgggcaatgcgatcaactaggagtgttggcttatgctgagatggaaaatacaacgataatggtgattgcacatgactaacaagtgaataaatctcaatttgagtaagtttagtcaatatacataatggaggatgttaatttgaagaagattttttctatcgtattctttttattggggattatgtcggcagtatatgtagggttctatattatgtttgtcggaggaatagtaggactaattgatgcagtaagagccacaactgttgattcatatatcattactattaatatcgttaaaattctctttgctgggtttattggatatagcattttttatatatttgcgtttatatcgacgtttgttcttggtagaaagttaagaagaagatcaagcaagtaaaagatatatttgataaagaaaggaatgtgagagatgcctattaatataggagatagatttaaattgaaatcaacaggacagcgacttgaggtatccgagatagtcacaatgtacaagctgtctccattaggagcaacagcacttagtacgtccgcaatgactgaggaaaaattgattgaaatttacgacccttatatcgaagaggagacaaactgaatggctgaaagaatctatggctacaaccataacaaagattacactggatttgtttgcgaactaacttggacacttgaaaagacaatgactaaattggaggaactgggcgttatccccccagacggttggattccacatccagaaggattttctgtaaaagaagatcatcaagatgatatgttgattcaattctgtaatattgatactggcgaggatatcgagggagaagcattctggattaaatttgaggatgcggtctcatattgggcctaggagggaaatttatgaagtggactgaaacgacacaccaagaagtatgggaaggtgaatggaaagatatttgcacaaatgaagatggaaccgtcaacctagaccaaattcaacgagaactctttgattatgcttttatacttgatcaagtaccaaaagtttacgaagaagttgctggattaagcaagcccaatgcatacgcaaactctgtaatttatcattttgaacgtaaaagaaaagatacttttgagatgtggttgaaggattttatcgacaattgtgaagatacatataaattacataaagaaagcgacaacggacaagacaatgaatttgcagaaggaattaagtgggttctagatgaactaaaagaagattttggtattgagtaagcttgtaaatgtgagattttatcatggagggagagtgttgatatggtggattggataaaagaagaagtagttgaatttcaagaaactcattctcctatgttgattgtgggagcatacgataatgggacttatgagttagtgcttgaaggcggagaggatgatagtgcgtcagtaagaatgaccaaagaagagttccaaagagtaatagaagcttttaagaaagttatctaaatcaaaggcgtattttacatagacaaaggagcagagaaatgaatctgtataaaatcatgttttaacatttttcaccgaaagatagtcaaaagggtattcttacttatcttgttgcaatttcagacagtgaagtgtacgaatggataaaatcagaaccatcgtcagaaaattgggggagtatattcaatagctacaaatacaaagaagaagacaatgaagtattcgatatttatgacaatgacttaagcattgtagatcaagagagtttcagagatagaacgattagattacatggagatatgtacgatgaagaggtagagctaagtgatttgtattatggagcaacactgtatggatgggaagccgtaaaagaaaatataaattccaatgatataaaaacaatgagagacttaggagtcaacgttgaaatggggagtctgattgaatcataaggagtatgctccaaaagcaaaattgggggacaaagtgtggatctgtgactatagattcaacgatatagataatcagccaatccgtcactttacccctaggaaagtcgttgttttgagtaatgatgaattgcccaaaaataaacgtgtttactattctgattttcactttagaccagtcaatgaaaaagggaaagtgctatcgcaaataattgctccatacgacaacactggatatagagcctatacaggtgtatcgctaaatattttccacacggaggaagaatgtaaaaaacattatctaaatcagtgtatggaaaacctgaagcggtttgaacaagccaaaattaacaaggtcgaatattatgataagaagattgacgagataaataaggagatgatggctttgctgtaattaaagccacatattataaaaaagagacctctaaggtctcagaatatttagacagagccttttagctcgtcacgtaaaagtttctctatgttattgtatatggttgttactctctctaaataagactcaaaattttcgttagctctatccatcatcgcattattaggatctgtatttcttaatctataataatatcgtttggctccaattgcatcatatgaaattttatataagctatcaattaactcagcaagttcctcagagatatgaatactaatagattttttagactctttaagacgatttgcttcgcttatgcattcttcttgattttcgtggtttgaattgtaaagattgaaaaatactcttgcttgttcccacatccgtattgatgcttgatatttatcctttgaatacatatcgaacatttgcttacttttatcagcctgtagttctagctctttcatgtaaacattcttctccttttctagttcggatttatacttctcagtatccttaagcaattcagttttgaatgatgctaacctttggtcaaaatgtcccttcagataggccttgccaattaactttattgctccaaaacatgtggctgcaataactgggactgatacaattagagttccccagtcaattgataaattcatataacatctccctttctgttgtcattatatgatatcggacaattttgtaaattaattaatagaaaaaggagtaatgaaaatgcaggaaaaagatgctttgattaataagaaaaaagaattacaacagaagatagttgaaattgatgaaaaattaactgcaattgaaaatttaaaaaaaccttatgttgccaatgtctgtgcttatagcggacattattcaatgcaattcgaaacagaagaaaaagcaagaaagaaacttgatgaatactttaacaaacaatattttaaaaatggactgaactatggggtgtatctatataagtattgcgaagatgggaagtctagtttgatggatgttaagccaaaaggacaaccagacttctttccactagaatttattagcaagtaaaagtcaaattttataaaaaatagggagaatttaaatgctaaaatgtgttgattatcaaacaggtagacatattggagaagtagaagactgggtagccgaggcgaatgaaaatgaatatgagttgatatataacgattatacgtacaacctgaaatatgttgtcaacaatgtagccttctttgttaaacagcagtttaattctacaatagagaacaacttttcttatcacgcaccaaaagatggtcagaccgaaaaatacgatttgattcgcagcaaagcaagggaaatggcatatctactcgatgaactggttcccaatggacgtgaaaagtctctagcattaacaaatctagaacagtcaattttctgggctaatgctggtgttgcacgtaattaaagataaaatgcacatttgattaaggagtgaaaaaatgaccaaatttgaaattccgacatactatggagtcactatttctttttatgaaaaaggtggcaaatattatatgcaatatagtgaatggtcttcagagagaacagagataagtaaaaagttttacgatgctgcgatagaagaattcaatgttgaaaaagaatggaaataagtattacagtgatcgttaaaaatatccaatcaatcagaagacgttaaaatgtaccttttaaatagaacaagaataggagatgtttactataaaatacggtcaacaagtatggggtagtgtagcaatcgataaaaaaatatcaatcacttcaagtaccaatacgtttggatttgatgttgatggtagatctcactcaattacaattcctaatggcacatatagtacaaaccgcgaaagacatgagtcagagttaattcaggcgattatcacagcatcctcaaatcaaaacattcctgtagaatttaaattgggagggatgcattacgatgagaggtataatgttctaattatagaacacacagataaagaaaaagcgcatgtgttagataattttactggtaccgcaaacgatatactttttggaagtattaagtttgacttgaagcctagagactaagtaatgtgggggcatatagtaaagtagaaataaataaaaccaataagtaaaaataaataaattattgacattattaattaaatgaatataatgaaatatataaaagaaaagaggtgattaagatgaatcagattgttagtacattgagcttgtctgcgaatacttctctgctttattctgattatacatgccatcgaaggtgggataataaaaatgagtaaagtaactaacaagttgctggagaatgtcgcaaagctacgagaatcattagatagactaagcaagagtaatgagaaattaaccaatgctcgtatcggcttagaaaaagctcaaagagataagatcgatatgattaatgaacgaatggggaatatcaatatcaagaagtggattgaaaaaaatggacgtaagtgatgaattggctgaaatactcgttaattgttttatgtgtgatgtagacacagagcaagaaaagaagctacatgaagataattatataaagaagaagcttaaacagtttttgagcaaaaaggactttgacaagtatgatcaactaaaggaacagatttggaaagacgcttggagagaatttgataaagtggcatcaaacaaaaatacataaaagaggacaacttaatatgaataatgaattgaaaaggtttatcgttgaagatatgctgcctcgtgaggtcgaagctttgactattgctgctgattcattatatctaaagagagataaagatagggagtatttagataactggtggctcgttgttagagcattgctaggagaaagagtagaggaatttagaaactgtcggattgtaaatgaattatataattatttaaatcatagacaggaaaatgaggaggtaaggaaacgtgaattatggtattagagatatcattgagctgcatgtgtttgatgagactgggaattttgtttcaactatcagttccttaaaaaaggggagcataagtgtagcaaatagaacgatcagagttaaagatgctctgttgaatggcgacatgctcaagtttctaaataaatcggaagacacgaagtcagattatgataagttctttagtaaaactcaaaattgcgaaactatagtttttaatcgtagggttgtcaattgtaaacttatagctgaaggtttttatagaaaacaagaaaatcaagaagatattctagtacaatatgaaatgccaaagtgcagtattgtaagtgcttataacttcaaccattcttatattggagatgcagatgactttgattatgtatttgaaataaaagagtttaatgaaggaggcgatttattcaagcttcatattgagaagtaatacatagcattttagataaaacagttcttttacacagaaacagatggggatgatacatacgcaagttactaaaagagatggttcaattgttgcgttcaatcaacaaaagatagttgaagctatattcaaagcaatgaaaagaacaaagaaaggtatcgataagcaattagcagccaatgccaccaaagaagttgttgaaatgcttaacaatgtatctaatgtagatattgaagttatccaagatgcagttgtagatgttcttatgcaaagcgagagaaaagatgtagccaaagagtacataggttatcgagaagtacggaatctgaaacgaagagaaagaagcagtctcgataaaaaagtatctggattgctcgatatgtccaatgaggaagtattaaaagaaaactcaaacaaagatggacagacaattcccacgcaacgagatcttttagcaggtattattgcaaaggattatgctcaggcttatatgattccaaaacgagttgttgaggctcacaatagaggagatttacattttcacgatcaagattattcgccctatttccctatgacaaactgtatgctaattgatttaaagggaatgttggagaatggatttaagcttggtaatgctcaaatagaaactccaaagtctattacaacagcagcagccgttactgcacaaattattgcacaagtagctagtcatatttacggcggtaacacgattaatgaaattgataagatcttggctccatatgtgagagcatcatttattaaacattttagagtgggcatgaaatggttcgaaggcaatccaaacgatcatatacttgaaagccaagtgtatccagaaagttcaattctcaagaccagatttacaaaagaatataactatgcaattcaattgacagaaaaagaaacgctagacgcgttccaatcccttgagtatgagatcaatactttggtatctgcaaacggacaaacgcctttctcaacatttggatttggtagaggaacaagttgggaagaaagacagattcagatcgccattcttaaaaatcgaattagaggattaggcaaagaaggcagtactcctatatttccaaaattgatttttgcactagaagggggagttaacctaaagcccaaagatcctaattacgacattaaacaattggcaatcaaatgtagtacgttgagaatgtatcctgatatcctttcagtcccaaaggttaaagaagtaacaggttcatttaagttcccaatgtcatgccgcagctttttaagtaaatacatagaaaacaatgaagagttacacgatggacgatttaatatgggggtagtaactcttaacttgccacggattgcaattcgtgcaaacaagagcgaaacagcattttatagtttgttggatcatgaattagaaatttgtaaagaagcgttaatgtttagaatcaatcgcctaaaaggagtcaaagcaaaagttgcaccgatcctctatatggagggagcggcaggagtcagattaaagcccgaagacacaattgaccaactattggaaaatgacagagcaagtatttcacttggatacataggtctacatgaaaccatattggcgttatttgagaaacacatttttgatgactcttttatgcatcaaaaaggattgaatattgtaaaatatcttagcgacaaagcaaacaaatggaaaaatgaaactgactatgggtttagtttatattctacgccagcagaatcgctatgttatcgtttttgtgaactagataagaataagtacggtctaattaaaggtgttactgacaaaggatactataccaattcgtttcatttagaagtcaaaaaaaaggtaacgccattcgaaaaaatcgagtttgaaaaagattaccctcaatatgcaagtggtggattcatttcatactgtgaatttgattcattagtgaaaaatccagaagcattagaagctgtatgggattttgcttatgagagagtaccgtactttggaacaaatactccagtagacaagtgttatgaatgttggtatgaaggagagtttagggcaacaaatcaaggcttcaagtgtccaaattgcaataataatgatcctaaaacaagttcagtcataagacgctgctgtggctatctttcggagccttcacaaagaccatttaacaaaggaaagcaaaaagaggttgtatcgagagtgaaacataactaatgtacatagcagactataagagattcgatgttataaatggtacaggactgagacattcgttatttgtatctggttgcacacatcattgtaaagggtgcttcaatgcttcagcatggaattctcaatacggaattgaatatacggatgaactagagaataagataatcaatgatctgaagattgattatgtgcaaatagctggcttatctgtattgggcggtgaaccatttcagaatattgatgggctgctgtctcttctgaaacgagtaaagaatcagtgtaaagataagacagtttggatatggtcgggttatacgtttgaagaaatactaaaagatagctcaaagaaagatatgttatcactctgtgatgttttaattgatggcaaatttgaattagataaaaaggacttaactctaaaatggcgtggttccagtaaccaaagagttatcgatgtacaaaagagcctagaactacagatgtctatactatttgaggatcgataatactgggtgggcggtagggtataaggaggttgaaatgcgagcaatcgaatgttaattgtatatgactcacttacaggcaacgtagaacgatttgtaaagaaactaggaatgagaaatattaagatcaatgatggattactcgttgatgaacctttcgttttaattacgtatacaactggatttggagaagtacccaaaagagttgcagagtttgctaaaaataatgagtattatatgaagggcgttatatctagtggtaaccgtaactggggacttaagtttggcaaagcggcagaaattatatcacatgaatattgtattcctttgattcacaaatttgaactctcaggcaaccaaatggacattgaaattataaacgaaaggattaaaaatatttgaaatacttagaattgaacaacctaattatgaagaaaaaagacggattctttgaccttgaaaaagattctgaagctatcaaagagtttgaaaaagaagtcattaaaaatatggtgcatttcaataataacgaagaacgaatgaagcatctaattgaggaagactattacatagatttttatgagctttatagtaaagaagaagtgagtaaattacatgaaattgcttatagttacaagtttaaatttgcctcatatatggctattcaaaagttttataacgattatgcattgaaaacaaacgataaaaacgattatcttgaggatatcgagcaacacaattgtgtggtcgcaatgtatttggcacaaggacagtatgaagtggcagtgaacattctaaaaggattaatggaacaacgaattcaacccagcactcctacgtatttgaatgctggacgcagcagaagaggagaaatggtgtcttgtttcttgcttgagatggatgattctttaaactccattaactatgtacttaatacttgtatgcagctctctaagattggtggaggtgtggcagtaaacctttctaagttgcgtggacgaggcgaaccaattaaaggcgtagaaggtgcagctaaaggaataagtcctgttttgaagcttatggaagatgctttctcatatgctgatcaaatgggacaacgaaaaggctcaggagctggatactataatatttttggatgggatgttcaagaattcttagacagtaaaaagataaatgcagatgaaaagtcccgacttaagacactctctatcggtctcatagtacctcaaaaattctatgaacttgccgaacaagataaacctctatatgtatttgcaccatattcagtatacaaagcttatggaattcacctcgacgacatgaatatggatgagatgtatgaggagttaatgaagaatgaggtagttaaaaagaagcgcctagatgcaagagatatgatcactaagattgctgtgtcacagcttgaatctggctatccatacattgttaatagagataatgctaacaacgcacatgctttaaagggaattggaaatataaagatgtcaaatctatgcactgaaatttttcagctacaagaaacttcagaaattaatgattatggacaagacgacattatccgtaaggacattagctgcaatttggcttcgctaaacattgtgaacgtgatggagtctaaaaatatcaaggaatctgtattcaccggaatttatgcaatcgactctgtgtcaagattgaccaacatcggtaatgctcccggtgttaaattagcaaatgatgaattgcattcaattggactgggagcaatgaacctgcatggttttttagcgaaaaaccgtattgcctatgaaagcaatgaagctattgaattcgttagagcattttttgctgccatgaatttttactctcttgaagcaagtatggaactttctaagaagtatggctcatttaaagggtttgaactttccgaatacgcaaacggaaattactttgtaatgtacgaaaaagaagatttcaatccagttagcgataagatcaaaaagttatttgaaggcattaatctcccaaccaaaaaagactggactaaattgaaaatgcaagttgctgagtttggtttggctaatgcatacagactcacaattgctccaacgcaatccatcagttacgtacaaaattcaacttcaagtgttatgccaatcgttgagccaattgaaacaagaacctacgctaattcaacaacatattatcctatgccgtttttggcacgagacaacttcttcttttataagtctgcttacaatatggatatgtttaaaatgattgatttaatttcagaaattcagagacatatcgatcaaggcgtatcaacaatattgtatgtaaatagtgatgtgtccactaaagaattgggaagatactatgtatatgctaatagaaaaggtctcaaatctttgtattatacacgtactaaaaaattatctgtagaagaatgtacaagttgtgctatttaaacgaacaggagagtaactagatgacattaaaagctgtaaattggaacagagaagacgatggatttactcaaacattttggaagcaaaacattgaacagttttggaccgatgatgaaattccgctttctgatgataaaatgagttgggttgatttaatgccaaccgaacaagatgtgtacaaaagggtattggggggattaacactacttgatactcttcagggaggggtagggatgcctcaaattttagagcgagttgaaggacttcaacgaaaagcagtatttggctttatgggaatgatggagcaaattcatgcaaagtcatacagtagcatctttactaccctagctaccacggaagagattgatgaaatttttgaatgggtggaacagaacaaacatcttcaaaaaaaggctaaaacaatacagcaatattacattaatattagaaccaaaagagatttttacatggctatggctgcttctgttcttttagaaagctatttgttttatagcggattcttttaccctctgtatttagctggacaaggcaagttaacagcaagtggagagattattgatcttattttaagggacgaagctatacacggtttatatacaggtttaattgctcaagaagtgtacgaatccatgaataaacgtgaaaaggatagagtaagggaagaagtactagatctcgttgtagagctgtataaaaacgaagcagaatataccgacgaactgtataccgtcattggccttgaagaagaagttaagaagtatgtacgttataatgcaaatcgtgccttacagaatctaggcttcgataaccactttcccgtagaagatattaatccaattgttcagaatggaattagcacaaacaccaagcaacatgacttcttttcgaaaaaagggaatggctatgtcagaacaactaatattgaaagaatgacagacgaagatttcaaatttgattttaataagtagaactaaaaaagtgatataagggagccaatatacatatgacaactataaataacaagcaagtaaaacaaccattttataatatcggtgacaaagtttacatcaaaccactaaaggtgaagggtattgttaaggggcatctggatgggttgactgtagtcacatactttatcaaagataaaagacgtacgaataagtttgaagaaacattattgcgttcctttaaatataagggtggattcttagctaccgagaaacttaaaagtattgttcctgaaggcgtaaaaatgcagttttcatctattgaactaaaacgagaaacacttaaaaaacaaatcaaagtaaaatactttgctgatatcgaacctctgcaaaagatttctaagggtgattggattgatcttcgttctgctattgatgttgaaatgaaggcaggagaatacaaacttatccctcttggtgtggggatgaagctacctgaaggttatgaggccaacccagtacctcgaagcagcacatttaagaattttggaatcattcaagcaaatcattttggagttattgataactcgtattcaggtaacaaagaccagtggcattttccagctattgctcttcgggatactgtaatcaaaaagaatgatcgaatttgtcaatttagaattcaagaagtaatgcctgaaatcgaacttatcactgttgatgagcttgatgatatttcaagaggtggttttggcagcacaggagtgcaataattagaataactgggcggtggtaactccactgcctttaataatgaccaaaaggagaatttaaatatgaacaaaatcgatgtactagataaaggttatgtacgattagtagatgtaatgggttcggatcttacagtggctaatgctgctcgtgtatcatatgcaaaagagtcaaaagaactaactgaaaaggatattaagttaattaaatttctagcgggagaagatcatacaagcccttttagacatgcatttctccagtttgaagtatatgcacctcttatggtagctcgacaatggtggaaatatatcgttggctctgaccatacaatggatgcttggaatgaatctagtcgccgctacatcactgaagagccaaactttcatgtcccagcatttaatgagtggcgttctaaacctgtaaactcaaagcaaggcagcggagatattgttaaatttgagcttggtgaagaagctacatatcgacttattaaaactattgaagatgcagaaagtaattatgagtgggctattgaaaaagggatctgtgcagaacaagcaagactgtttctcccggcgtatggtatgtatgtgcgttggtattggtctacatcactccaaggagtttgccatttcctaaaccagagacttgaacatgatgctcaaaaagaaatccaagaatacgcaaaagcagttatcgaattggctaaagaaagatttcccgttagcatcgatgaattaaacaaataaaaataatgaaatacctatatacaaaaataattaaatatgatactatgagtacaggttaaacaaagcctgtactttttttattaggaggttgatagtttgaaagagttggcaggggaaggaagtgaagagtacgcttttcttcataacaaacattgcacctacgatcatattgggattaatgatgaggtatggtcgtcgaatattcaaagaagatttttctcaaataaattcaaaattaaatagagaatcgatcttcaattcattttgttttgccattatgggcttctcgattctatcaaaattatcttcattagtgatagcacagcaaccagtaataccgcatattcaaacaccgattatgtatgtgtatgccatagcatttagtcctgtttttgaagaattaatttgtagaaagtatatattcacgaaactacataaacgctacaacttttggctgtcagcaattttaagttccatcatatttgcaattccacacttcaacgcagttaattttatagcatacgtgtttattggaattgtatggagttggtattataaaaagacaaataacatcctagtaccaatattcagccatttattatttaattactttgttattttatttatgtcactgaaagggtgaaacaaatgaacttatcaaaagaagcagaaacattattgagcatatgttgggtagacaatgaacctagatctacaactttccttgttggtgaaaaaatgatttttaatggaatcgagtttaaaccaaccgaagaaacatatgatgaattacttgaatatcaacaacattcaattcgaccatacaaagtcgagaagtttggcaagttcgttaatttaacgggaaggaaggtgaagtaaatttgattcaaaacattatacataaaatattctggagtaaagcatttgaggaagtcagggaaggacataggaaaatgtgctatgagttaggcattaaagatggtcaggatgaatttgataaaaataataaattctataaagagtttgctgaagcttataacaatgaaacaatcatattaaattaaataatacataggagaacagttgaatgaaagtgagcaacagagttattgagcagtataaagtgtgttgtccaattagttacttaaagtgtgattcagtcaccgatgttgaatacaaaattaaaagggcggttgcattaggaagaaagtacgctgaacatgaagacagaaaatatattcagtactatcaccttcagtttacggtacaaaacggcaaagtcattgatttgactagagattataataaatacatagaagttagcgagagagtaaaaaatgcatatgatcgactcgaaggaaagttgctagtataactcttcgtaaaagccgtcttttatcaaaatacatattacagataacaactagataacaacaatgaggattgtagtaaattaacatcaagtgtccttattgcagttatattgttacagcacgaaacatatttcaaaggagagaaaacgaccttaacagtggcaatcttttgtgagagtgatggatgtctagtaaagccaagtactgttgatatgaaaccatcacttactcttggggatgtaaaagcgtggcggtaatgggggattctatattgaatgatcaaaatcaaacgtacaaagggatactgcttaagctcattaagcgaagttatgtaggaatgttggcaatgagatttacacttaatgatacaaatcagaatgtttggattccaaaaaaacatctctacgatgatggtacattgataccaaatgataatgtagattatgtttttagaaaagcccaaagacagttgcatttggctggctacagtgacccaattcaagggataaaacgagatacaaatgtaaaaaggccaataccattttaagataaaaatctaattttatacgaataataaaaaaggagagataatcattgattatcaatggctttagggtaggtattattacatgtccagactaattgatgcagacaaactgcttaaatggcttgaagagtcgccagaagctgctgggttttggggtgagggtggcgcagatattgatgaacatgatgcgtttgataatcttattaatgcaatcaactccggggcttttcagcccgactagttcaatgtgggaggtataaaaatgaatgaaattctaacaatcataaaaaagctcaaaaaaggtaaaaaagttatgtttaaagatatcagtaaaaagaatttagtatgtgcgctattaaatgaatataagattattacatatgtagatggatcttttgtgcagattgcctatcagcacacggatgaattcgagaaggagaatacagagcaatgagttacttagatgttactatgcatggattgtccaatatgctctacaacatctcgcaaaacccaagtaaagaaaattgtaatgtcatgttggacagcattaagcgaacccttgctgactataatgaagcgggtggaattatcaatattaaagactttagggagaaggagtaaccgaataatgttcaaaaaagaagaagtggagttttatttgaagttacatgatgatgtaacagataagatttacgaaatcattcatttacatagtgcaattgataataaatattacgaagtcaatgaaatacaatataaaaataatgtcatcatagtggatgttgaatattataaatatggagatcttgagtatgatagcatacatattgatccgcgaatgctgtacgacgatgagttgtttaatgaactcgtgattgagtctgagcaagttgagaacaagcgatcaaatcaaattaaaactaaagagcagcagagaataaaagaagaattagaaaaggcgcgtcagttaattgctaagtatgaacaacaataagataaaagtctagtttgatcaaaaaataaaaaaaccagaaaatatctggctcaaggagatataaatgaagctagtaactattgataaaaatatgatatccaattataaaaaatatagtaacgaaacacacaaaaaatcaagaattcagcatgctaaaaagaataagaaatacattactgtactttaccataaacttcttgatggtagtcggacaaaagcgttgttaaaacgttcagttggtgttgtgatgacagttctaaaattttctcgatttctgaatagtttaaaaggtttactttttttagcttatgtagtgcttcagttaatttatcctcataatctgtttgagatcttaccagtaaatctgcttcagttacctttttcttgaaatcatacaccatcttcaagcacctctatttagtagatttgattctatatgactaaactttggtgactattgaaccattaccataatactacgacataattttacatgtgacaattcggaacatcagttctgtcaagagatattgacatggtgcgaacaatgcttgacatcttatttacagcaaagagatcaaaaaatatttttataaattacctgttttacagagaaaggagatcaaatcatgaactttcatcgtgaatattatgagatattcacttctccaagccaagataaatatgaatatgcatatacaaaatggcttgaatattactattacacagagatatatgatcgaagggtttgttctggatttaatgagaaaactcagtgtgcgataccattaaacactattgaatacatagatattaaccgcaatgcgaaacgtcttatgaatgacattgttcgagaactaagggacaaagaagtagataaagaaactcggagagcttgctaaaaatgaggccgcaagacattcacatgacaaagttgaagagatactaagacaagtcaatggattacgtgaacctaaataaattgaaatcaaataactataaagaggagaatgagaaaatgacacttgaaaacagcatcaaagacacaatcaccaaaaagcttgaggatggcactgtagagaagttgattgaacaacaactagagaaaggggtagttaatgcattagagaatttatttagatcctatggagatgtcactaaaattattgaagagaaagtgaaatcggtaatggttccctatcttgagtctcatgactattcacaatacataactaaattggacacagtgctggtagatgtactccaaaactcagcacttgagaataaacaacttcttagtaatttcaaaaatctaatgattacggacgacaaagtaaagcatttgaatgtgtcagatctttataaacattggaaggattacgtagctaagaatattgatacgaataaattagaagttgattatgatgatggtgttagttatgaatatgcaaacttaatatttgaatgtgagaaagatgaagggatgaaccagtcaatcagattgcatcgttggaaggacagtaaagataaaggatgggacattgagcatcatgaagtaaaggatttaaagtctcttagacacttaaacgattttgaactcttactaatgaagttgaatcaaaactacacttccttgattatcgatgttgagtttgattcagattgtgttgaggttgaagcaaaaccagaaccaacatttagttaatacatattcctgatgaaacacttgttttatagaaaggagggaattcttattcttaaattgttctgtgatcaccaatgggaaacaaacgaccgaaaacatgaagaaatgattacttacggaattgtaaaaaaatctggaatgaaacggcatatgatttgcactaagtgtggcaaatataaatctgtatggatatacattgactatattaggaaggggtaatacatatcagaacattagcagttagtgatccgcatggatgtaatgacgaatttaattcattattgaaaaaagtaaagtacaatccttctcatgacaaactcattctacttggagattatgttgatcgaggacaaaagagtagacagatggttgaacaagtaatgcagcttcataatgaatggggtgtaattgctcttaagggaaatcatgacgatatgtttgtagttgccataaacaatgatagtgaggaattagatgcccaatggcttaataatggtggatttcaaactgtagaaagttattgtggaattagtttttttgaagaaggattcgagtgggaacaatacataaaagcaaaagagttcattagaaagcattatcagtatcacgttgatttcttagagtcactgcccttatatcatgaaacagaaagtcacatatttgttcacgctggagttaatccattttatgaagactggcgaaatcagcctgagagcgacttcatttggattagagatatattctttaacaataagactggctcagagaaaaagattgtttttggtcatacaccttgcatccatttgcatgatactgaggacatttggtttgatcctaagggtgataagattggaattgatggagcctgtgcatatggattacaaatgaacctgcttgaaatcaccgaagaaggaacatacatagaacattgtgtacgtagaggcgaaatatatgattaacaagactttaaattataaaagagatcctagcttgaacaatgaagagatgattaaagaggcaaaactaacaaacaataaagatatcagggataagattataaataataatattccttttgttaaaagcctagctgaccgctggtttaaacgtggagtcccagaagagtttgatgatctagtgggtatgggaatggtagcactaatgaaggcttataatacatatgacacgaacaagaatattaaatttacttcatatcttggaaaagtagtatggaaagaatttatggcacattccagatataaaagcatgaaatgccgtagcaagtactccagtattagcttcaacgaaacacttcataaatcaaaaggcgcagacgaagaaaagctacttgctgaagttattccaaatgacagtcacctagattatctaacagttgaggatgaaatgttcaatacacatttagttgaacaaatggatacattgttggcaaagaaggagagaatcgttgctgataagtacttttttgaagggaaaagcatatcggaaattggagttgaacttggtgtgtcgcgtcaggcagcgcatcaggcttttcagagaacgattaagaggctaacaccaatatatacataaaagtaaaactcatattttatgaggaaagagggtttagatgagtattcaaaaagaaattcattattttgatcatggtaacaagaaatataaaatcatccataagaataaaacaacatattgggaaagagctggagctattgttgagtttaacgtaaatataaaaatgaaagttttttggatattctacagaacagtatttaataaggattacctttttccaaatttatctgacaatagggtcgaacttgccaaatctgagtatttttacggaggacgtacagatgaaaataacgctcaaattacaaactgatagtcacaacacatactcaacagaaaaaatcgatttcgaatcttaccgtgactctttagaagtaacaatcaaactaggagacagagaggtcactgttgataaacaagaactattaaagtcaattgaaatactatgtaagtaaaagatacatttgatgaggagatggaacatgtggcttttgacattgagaatttcaagaatgaaacacagttgagaaacgattttatagatgagcttaaattgtgtgctttcacagatgaagatggctatcctaatgttttacgttgatagagtttggagtaccatcgataaattggatgagaaaatgaaagatagagtattgttttggtttgtaatagaacatctaacattggttaacagataaaaggcgactttgatcaagaaagggtgtaggtaaagtgttagacaggaaacataacgaagattggtatgagatcgaagattggtatgagaagagcaaatctatgcctatgccgaagaaagccttcttattaacttttaatttaatcaatggtaattcaattagagtaaaaacgtttgataaggatgtttttgagataataactcatcagttgagtagttcttctaaatatcatttcccaaaaacagatatcaatgaagaattaataatttatattgatcacgtattgtgggcagacatagcggagattgaagctaactaaagtaagtggagaactaataggggtgagtaagcatagaactaaataggtacatggagatcatgaataacaagaaagattctaaacaaataacaaatgagcaatacgcaaaatacataagcaagttatggcaatggcaaataaacagttccacagaatattatcaagcggaggatgatcatttttaatgatcgataatacacatgaaattcttaaaccaagatgatatttttgagattttgaagaaatccctaaaaaaacattatttcatatttaagagtgaacctgtaatagaaattgatgtagatgttatggcgagtaattacaattttattatcagaaaattaaattttagtggaaagattgtttcatttaaattcaaaggagaaatattcaaaagaaaactaactttaacagaaattaagggaatgttggaatcagagcttggtgggaaagtagatgtggcagcatacataaatgagatcgatcaaattgaagaaaatatgaacagctacaatatgaatacagttttagtggctactgttatcaaagaagaacctgagttaaataaagaatgtattatgactttaatcgatatggctaccgacatgaatgacaaagagtggtttgtggagctaacaaatagatataatcaattgcgataaaacatgaatttgattaggaaaggagtattgaatgaaggtcgatatcagaaagccgctgattgaagcaggatcaattgttgaaatagaaggaaattattacatcgtaaatgaattgccgagctgtgtttattacgaaacaaggcctcattggaggttttatctacataatttaaatgggacaggattttataattatccagtaacaatagaagtactgtctcaaactatacacaatgaaggttggaaggtctatagcagtaaacattttaaactcattattgaagatactgattgatgagtcttagcacagtaactgcgtttcataaaatctgaaaaaaggagatgtatattatgacttttaaaaatggacagtggatgtttaacgatgtatcggacggagtttgggggatcggtgagtattttgatttaaaagcgcaagcaattaaggcagcaaaggaatactattcaccagaagaacaaaaagaattctatgttggtcaactttgcgaaattagtaatagtattacggttgattctgagggagttttggatgatatttcgtcatctatttacgatgaagttggtgaagcagcagaagactacctgaattatgtgaatcgggaagaaagagaaattttagatgaaagacttactcaagttgttcgcgagtggatgaaagaatttggatacgagccttcgttttttaggatcgaaaacacagaaaaaataagatggatatagatttgtccgaaacattaaaataaggcagtcaaaaactcaatgtttataatggttttgagatagcgatttctgcgtaaaatcctgattttatttgaatatatcaatcctaaaataaaaaaataattaaatatatacaataataaaaagccgtgatataattatcttatagaatgtattacattgtatgacactgttggtaactttcatactttgatactcattgtatttggaggtaatatcatggctttaactgtagtgaaaaatttaagtgtgattgatctcggatttagctataccaaaggaaagacaggcaatacattgtatcttcagccatctatttctggggatgttcaaccgatgttcgaagaaaacatcaaaccaaatgattttttctataacgatgaattatttgtaggaaatgttgctctgaggcatagtgagatcaaatacttcacactaaaaaataataagagtgaagcaatgacttcagatgctttactgaaaaccggattaggatatctaaataaaagcaatccatttaacatggtaactggactacctgtattattctattttaatcaaaagagtgatatggaaaagatgttagatagaataaatacagaggatacctatagccttaagaaaggtcggggaaattattcagaaattaaacttcatataaataaatataaacttgttccgcaaggatatggaatagcaatgtattat
